(12) United States Patent
Paldi et al.

(10) Patent No.: US 8,822,426 B2
(45) Date of Patent: Sep. 2, 2014

(54) **PREVENTION AND TREATMENT OF *NOSEMA* DISEASE IN BEES**

(75) Inventors: Nitzan Paldi, Moshav Bar Giora (IL); Eitan Glick, Nes Ziona (IL)

(73) Assignee: Beeologics Inc., St. Louis, MO (US)

( * ) Notice: Subject to any disclaimer, the term of this patent is extended or adjusted under 35 U.S.C. 154(b) by 0 days.

(21) Appl. No.: 13/318,636

(22) PCT Filed: May 5, 2010

(86) PCT No.: PCT/IB2010/051980
§ 371 (c)(1),
(2), (4) Date: Nov. 3, 2011

(87) PCT Pub. No.: WO2010/128465
PCT Pub. Date: Nov. 11, 2010

(65) Prior Publication Data
US 2012/0053231 A1    Mar. 1, 2012

Related U.S. Application Data

(60) Provisional application No. 61/213,086, filed on May 5, 2009.

(51) Int. Cl.
*C12N 15/11* (2006.01)
*C07H 21/02* (2006.01)
*A01K 51/00* (2006.01)

(52) U.S. Cl.
USPC .............................. 514/44 A; 536/24.5; 449/2

(58) Field of Classification Search
None
See application file for complete search history.

(56) References Cited

U.S. PATENT DOCUMENTS

| | | | |
|---|---|---|---|
| 4,732,250 | A | 3/1988 | Maucher et al. |
| 5,898,031 | A | 4/1999 | Crooke |
| 6,107,094 | A | 8/2000 | Crooke |
| 6,506,559 | B1 | 1/2003 | Fire et al. |
| 7,056,704 | B2 | 6/2006 | Tuschl et al. |
| 7,078,196 | B2 | 7/2006 | Tuschl et al. |
| 8,097,712 | B2 | 1/2012 | Paldi et al. |
| 2002/0086356 | A1 | 7/2002 | Tuschl et al. |
| 2003/0044443 | A1 | 3/2003 | Erickson, Jr. et al. |
| 2003/0092651 | A1 | 5/2003 | Norris et al. |
| 2003/0180945 | A1 | 9/2003 | Wang et al. |
| 2004/0259247 | A1 | 12/2004 | Tuschl et al. |
| 2005/0080032 | A1 | 4/2005 | Gross et al. |
| 2005/0095199 | A1 | 5/2005 | Whyard et al. |
| 2007/0011448 | A1 | 1/2007 | Chhabra et al. |
| 2007/0219151 | A1 | 9/2007 | Satishchandran et al. |
| 2008/0194512 | A1 | 8/2008 | John et al. |
| 2008/0261303 | A1 | 10/2008 | Kreutzer et al. |
| 2009/0118214 | A1* | 5/2009 | Paldi et al. ................. 514/44 |
| 2012/0108497 | A1 | 5/2012 | Paldi et al. |
| 2012/0258646 | A1 | 10/2012 | Sela et al. |
| 2013/0289097 | A1 | 10/2013 | Paldi et al. |

FOREIGN PATENT DOCUMENTS

| | | |
|---|---|---|
| CN | 1505504 | 6/2004 |
| CN | 101139607 | 3/2008 |
| EP | 1416049 | 5/2004 |
| WO | WO 97/47193 | 12/1997 |
| WO | WO 99/32619 | 7/1999 |
| WO | WO 00/04176 | 1/2000 |
| WO | WO 01/34815 | 5/2001 |
| WO | WO 2009/060429 | 5/2009 |
| WO | WO 2010/128465 | 11/2010 |
| WO | WO 2011/045796 | 4/2011 |
| WO | WO 2013/153553 | 10/2013 |

OTHER PUBLICATIONS

Paldi et al (Applied and Environmental Microbiology, Sep. 2010, p. 5960-5964 vol. 76, No. 17).*
Yadav et al. "Host-Generated Double Stranded RNA Induces RNAi in Plant-Parasitic Nematodes and Protects the Host From Infection", Molecular & Biochemical Parasitology, 148: 219-222, 2006.
Official Action Dated May 30, 2012 From the US Patent and Trademark Office Re. U.S. Appl. No. 13/332,430.
Standifer "Honey Bee Nutrition and Supplemental Feeding", Beekeeping in the United States Agriculture Handbook, 335: 39-45, Oct. 1980.
International Preliminary Report on Patentability Dated Nov. 17, 2011 From the International Bureau of WIPO Re. Application No. PCT/IB2010/051980.
Official Action Dated Oct. 15, 2012 From the US Patent and Trademark Office Re. U.S. Appl. No. 13/332,430.
Communication Pursuant to Article 94(3) EPC Dated Feb. 17, 2011 From the European Patent Office Re. Application No. 08847971.2.
Communication Relating to the Results of the Partial International Search Dated May 13, 2009 From the International Searching Authority Re.: Application No. PCT/IL2008/001440.
International Preliminary Report on Patentability Dated Feb. 1, 2010 From the International Preliminary Examining Authority Re.: Application No. PCT/IL2008/001440.
International Search Report and the Written Opinion Dated Jul. 19, 2010 From the International Searching Authority Re.: Application No. PCT/IB2010/051980.
International Search Report and the Written Opinion Dated Feb. 24, 2011 From the International Searching Authority Re. Application No. PCT/IL2010/000844.
International Search Report and the Written Opinion Dated Nov. 30, 2010 From the International Searching Authority Re. Application No. PCT/IB2010/053776.
International Search Report Dated Aug. 13, 2009 From the International Searching Authority Re.: Application No. PCT/IL2008/001440.
Notice of Allowance Dated Sep. 9, 2011 From the US Patent and Trademark Office Re. U.S. Appl. No. 12/222,949.
Official Action Dated Mar. 18, 2011 From the US Patent and Trademark Office Re. U.S. Appl. No. 12/222,949.

(Continued)

*Primary Examiner* — Richard Schnizer

(57) ABSTRACT

Compositions and methods for reducing susceptibility and enhancing tolerance to *Nosema* disease (Nosemosis) using RNA interference technology, and more particularly, prevention and treatment of *Nosema* infections in honeybees by feeding of *Nosema*-specific dsRNA.

12 Claims, 11 Drawing Sheets
(11 of 11 Drawing Sheet(s) Filed in Color)

(56) References Cited

OTHER PUBLICATIONS

Official Action Dated Sep. 23, 2010 From the US Patent and Trademark Office Re. U.S. Appl. No. 12/222,949.
Official Action Dated Jun. 28, 2010 From the US Patent and Trademark Office Re. U.S. Appl. No. 12/222,949.
Reponse Dated Jul. 18, 2011 to Official Action of Mar. 18, 2011 From the US Patent and Trademark Office Re. U.S. Appl. No. 12/222,949.
Response Dated Jun. 15, 2011 to Communication Pursuant to Article 94(3) EPC of Feb. 17, 2011 From the European Patent Office Re. Application No. 08847971.2.
Response Dated Jan. 20, 2011 to Official Action of Sep. 23, 2010 From the US Patent and Trademark Office Re. U.S. Appl. No. 12/222,949.
Response Dated Jul. 27, 2010 to Official Action of Jun. 28, 2010 From the US Patent and Trademark Office Re. U.S. Appl. No. 12/222,949.
Written Opinion Dated Aug. 13, 2009 From the International Searching Authority Re.: Application No. PCT/IL2008/001440.
Akiyoshi et al. "Genomic Survey of the Non-Cultivatable Opportunistic Human Pathogen, *Entcrocytozoon Bicncusi*", PLoS Pathogens, 5(1): e1000261: 1-10, Jan. 2009.
Amdam et al. "The Hive Bee to Forager Transition in Honeybee Colonies: The Double Repressor Hypothesis", Journal of Theoretical Biology, 223: 451-464, 2003.
Aronstein et al. "SID-I Is Implicated in Systemic Gene Silencing in the Honey Bee", Journal of Agricultural Research and Bee World, XP009115329, 45(1): 20-24, Jan. 2006.
Burri et al. "Microsporidian Mitosomes Retain Elements of the General Mitochondrial Targeting System", Proc. Natl. Acad. Sci. USA, 103(43): 15916-15920, Oct. 24, 2006.
Campbell et al. "Gene-Knockdown in the Honey Bee Mite *Varroa Destructor* by a Non-Invasive Approach: Studies on a Glutathione S-Transferase", Parasites & Vectors, XP002621493, 3(73): 1-10, Aug. 16, 2010. Abstract.
Carthew "Gene Silencing by Double-Stranded RNA", Current Opinion in Cell Biology, XP002263320, 13: 244-248, 2001.
Chen et al. "High Throughput Genome-Wide Survey of Small RNAs From the Parasitic Protists *Giardia Intestinalis* and *Trichomonas Vaginalis*", Genome, Biology and Evolution, p. 165-175, Jul. 6, 2009.
Chen et al. "*Nosema Ceranae* Is a Long-Present and Wide-Spread Microsporidian Infection of the European Honey Bee (*Apis Mellifera*) in the United States", Journal of Invertebrate Pathology, XP022438643, 97(2): 186-188, Jan. 29, 2008.
Cornman et al. "Genomic Analyses of the Microsporidian *Nosema Ceranae*, An Emergent Pathogen of Honey Bees", PLoS Pathogens, 5(6): e1000466: 1-14, Jun. 2009.
Cox-Foster et al. "A Metagenomic Survey of Microbes in Honey Bee Colony Collapse Disorder", Science, XP002533680, 318(5848): 283-287, Oct. 2007. Database EMBL [Online], Retrieved From EBI, Database Accession No. EU122366, Nov. 15, 2007.
Cox-Foster et al. "Saving the Honeybee. The Mysterious Ailment Called Colony Collapse Disorder Has Wiped Out Large Numbers of the Bees That Pollinate a Third of Our Crops", Scientific American, p. 40-47, Apr. 2009.
Franco Nunes et al. "A Non-Invasive Method for Silencing Gene Transcription in Honeybees Maintained Under Natural Conditions", Insect Biochemistry and Molecular Biology, XP002523702, 39(2): 157-160, Feb. 2009.
Gill et al. "Stripped-Down DNA Repair in a High Reduced Parasite", BMC Molecular Biology, 8(24): 1-14, Mar. 20, 2007.
Henderson et al. "U.S. National Bee Colony Loss Survey, www.beesurvey.com, Preliminary Findings With Respect to Colony Collapse Disorder (CCD)", Bee Alert Technology, Inc., Mar. 26, 2007.
Katinka et al. "Genome Sequence and Gene Compaction of the Eukaryote Parasite *Encephalitozoon Cuniculi*", Nature, 414(6862): 450-453, Nov. 22, 2001. Abstract.
Liu et al. "Effect of a Fluvalinate-Resistance-Associated Sodium Chennel Mutation From *Varroa* Mites on Cockroach Sodium Channel Sensitivity to Fluvalinate, a Pyrethroid Insecticide", Insect Biochemistry and Molecular Biology, XP025014535, 36(11): 885-889, Nov. 1, 2006. Abstract.
Malhotra et al. "Double-Stranded RNA-Mediated Gene Silencing of Cysteine Proteases (Falcipain-1 and -2) of *Plasmodium Falciparum*", Molecular Mcirobiology, 45(5): 1245-1254, 2002.
Malone et al. "Effects of Transgene Products on Honey Bees (*Apis Mellifera*) and Bumblebees (*Bombus* Sp.)", Apidologie, XP009141014, 32(4): 287-304, Jul. 2001. p. 288, 1-h Col., § 3 - p. 289, 1-h Col., § 2.
Maori et al. "IAPV, A Bee-Affecting Virus Associated With Colony Collapse Disorder Can Be Silenced by DsRNA Ingestion", Insect Molecular Biology, XP002523701, 18(1): 55-60, Feb. 2009. Abstract.
Maori et al. "Isolation and Characterization of Israeli Acute Paralysis Virus, A Dicistrovirus Affecting Honeybees in Israel: Evidence for Diversity Due to Intra-and Inter-Species Recombination", Journal of General Virology, XP002533679, 88(Part 12): 3428-3438, Dec. 2007. Database EMBL [Online], Retrieved From EBI, Database Accession No. EF219380, Nov. 21, 2007.
Maori et al. "Reciprocal Sequence Exchange Between Non-Retro Viruses and Hosts Leading to the Appearance of New Host Phenotypes", Virology, XP022065066, 362(2): 342-349, 2007.
Mayack et al. "Energetic Stress in the Honeybee *Apis Mellifera* From *Nosema Ceranae* Infection", Journal of Invertebrate Pathology, 100(3): 185-188, Mar. 2009.
Nakayashiki et al. "Evolution and Diversification of RNA Silencing Protiens in Fungi", Journal of Moleular Evolution, 63(1): 127-135, Jul. 2006.
Nunes et al. "A Non-Invasive Method for Silencing Gene Transcription in Honeybees Maintained Under Natural Conditions", Insect Biochemistry and Molecular Biology, XP002523702, 39(2): 157-160, Feb. 1, 2009.
Palacios et al. "Genetic analysis of Israel Acute Paralysis Virus: Distinct Clusters Are Circulating in the United States", Journal of Virology, XP002533681, 82(13): 6209-6217, Jul. 2008. Database EMBL [Online], Retrieved From EBI, Database Accession No. EU436456, Jun. 19, 2008.
Peyretaillade et al. "Microsporidian *Encephalitozoon Cuniculi*, A Unicellular Eukaryote With an Unusual Chromosomal Dispersion of Ribosomal Genes and a LSU rRNA Reduced to the Universal Core", Nucleic Acids Research, 26(15): 3513-3520, 1998.
Price et al. "RNAi-Mediated Crop Protection Against Insects", Trends in Biotechnology, XP022757296, 26(7): 393-400, Jul. 2008.
Robalino et al. "Double-Stranded RNA and Antiviral Immunity in Marine Shrimp: Inducible Host Mechanisms and Evidence for the Evolution of Viral Counter-Responses", Developmental & Comparative Immunology, 31: 539-547, 2007.
Siomi et al. "On the Road to Reading the RNA-Interference Code", Nature, 457(7228): 396-404, Jan. 22, 2009. Abstract.
Slamovits et al. "Genome Compaction and Stability in Microsporidian Intracellular Parasites", Current Biology, 14(10): 891-896, May 25, 2004.
Taylor et al. "Validation of Spermidine Synthase as a Drug Target in African Trypanosomes", Biochemical Journal, 409(2): 563-569, Jan. 15, 2008.
Tsaousis et al. "A Novel Route for ATP Acquisition by the Remnant Mitochondria of *Encephalitozoon Cuniculi*", Nature, 453(7194): May 22, 2008. Abstract.
Ullu et al. "RNA Interference in Protozoan Parasites", Cellular Microbiology, 6(6): 509-519, 2004.
VanEngelsdorp "Colony Collapse Disorder: A Descriptive Study", PLoS ONE, 4(8): e6481: 1-17, 2009.
Wang et al. "Molecular Characterization of an Arachnid Sodium Channel Gene From the *Varroa* Mite (*Varroa Destructor*)", Insect Biochemistry and Molecular Biology, XP002621492, 33(7): 733-739, Jul. 2003. Abstract.
Wang el al. "Tracking Anonymous Peer-to-Peer VoIP Calls on the Internet", ACM, CCS'05, Alexandria, VA, USA, Nov. 7-11, 2005, 11 P., 2005.
Williams "Unique Physiology of Host-Parasite Interactions in Microsporidia Infections", Cellular Microbiology, XP002589428, 11(11): 1551-1560, Nov. 2009.

(56) References Cited

OTHER PUBLICATIONS

Williams et al. "Genome Sequence Surveys of Brachiola Algerae and Edhazardia Aedis Reveal Micriosporidia With Low Gene Densities", BMC Genomics, 9(200): 1-9, Apr. 29, 2008.
International Preliminary Report on Patentability Dated Mar. 1, 2010 From the International Bureau of WIPO Re. Application No. PCT/IB2010/053776.
Office Action Dated Mar. 19, 2012 From the Israel Patent Office Re. Application No. 205594 and Its Translation Into English.
Baum et al. "Control of Coleopteran Insect Pests Through RNA Interference", Nature Biotechnology, 25(11): 1322-1326, Nov. 2007, Advance Online Publication, Nov. 4, 2007.
De La Fuente et al. "RNA Interference for the Study and Genetic Manipulation of Ticks", Trends in Parasitology, 23(9): 427-433, Sep. 2007. Abstract.
Di Prisco et al. "*Varroa Destructor* Is an Effective Vector of Israeli Acute Paralysis Virus in the Honeybee, *Apis Mellifera*", Journal of General Virology, 92: 151-155, 2011.
Fairbairn et al. "Host-Delivered RNAi: An Effective Strategy to Silence Genes in Plant Parasitic Nematodes", Planta, 226(6): 1525-1533, Nov. 2007. Abstract.
Hunter et al. "Large-Scale Field Application of RNAi Technology Reducing Israeli Acute Paralysis Virus Disease in Honey Bees (*Apis Mellifera*, Hymenoptera: Apidae)", PLoS Pathogens, 6(12): e1001160-1 - e1001160-10, Dec. 2010.
Liu et al. "Prevention of Chinese Sacbrood Virus Infection in *Apis Cerana* Using RNA Interference", Current Microbiology, 61(5): 422-428, Nov. 2010. Abstract.
Maggi et al. "Resistance Phenomena to Amitraz From Population of the Ectoparasitic Mite *Varroa Destructor* of Argentina", Parasitology Research, 107(5): 1189-1192, Oct. 2010. Abstract.
Maori et al. "Israel Acute Paralysis Virus of Bees, Complete Genome", GenBank EMBL, EBI Dbfetch, XP002533679, Accession No. EF219380, Nov. 21, 2007.
Mutti et al. "IRS and TOR Nutrient-Signaling Pathways Act Via Juvenile Hormone to Influence Honey Bee Caste Fate", Journal of Experimental Biology, 214(Pt.23): 3977-3984, Dec. 1, 2011. Abstract.
Paldi et al. "Effective Gene Silencing in a Microsporidian Parasite Associated With Honeybee (*Apis Mellifera*) Colony Declines", Applied and Environmental Microbiology, 76(17): 5960-5964, Sep. 2010.
Patel et al. "The Making of a Queen: TOR Pathway Is a Key Player in Diphenic Caste Development", PLoS ONE, 2(6): e509-1 - e509-7, Jun. 2007.
Steeves et al. "Transgenic Soybeans Expressing SiRNAs Specific to a Major Sperm Protein Gene Suppress *Heterodera Glycines* Reproduction", Functional Plant Biology, 33(11): 991-999, Nov. 1, 2006. Abstract.
International Preliminary Report on Patentability Dated Apr. 26, 2012 From the International Bureau of WIPO Re. Application No. PCT/IL2010/000844.
Nakayashiki et al. "Evolution and Diversification of RNA Silencing Proteins in Fungi", Journal of Molecular Evolution, 63(1): 127-135, Jul. 2006.
Communication Pursuant to Article 94(3) EPC Dated Jun. 29, 2012 From the European Patent Office Re. Application No. 08847971.2.
Notice of Allowance Dated Apr. 11, 2013 From the US Patent and Trademark Office Re. U.S. Appl. No. 13/332,430.
Advisory Action Before the Filing of an Appeal Brief Dated Feb. 22, 2013 From the US Patent and Trademark Office Re. U.S. Appl. No. 13/332,430.
Communication Pursuant to Article 94(3) EPC Dated Jul. 12, 2013 From the European Patent Office Re. Application No. 08847971.2.
Applicant-Initiated Interview Summary Dated Mar. 5, 2013 From the US Patent and Trademark Office Re. U.S. Appl. No. 13/332,430.

Communication Pursuant to Article 94(3) EPC Dated Oct. 8, 2013 From the European Patent Office Re. Application No. 10719620.6.
Examination Report Dated Oct. 13, 2013 From the Instituto Mexicano de la Propiedad Industrial Re. Application No. Mx/a/2012/004378 and Its Summary in English.
International Search Report and the Written Opinion Dated Oct. 28, 2013 From the International Searching Authority Re. Application No. PCT/IL2013/050321.
Patent Examination Report Dated Oct. 23, 2013 From the Australian Government, IP Australia Re. Application No. 2008325989.
Communication Pursuant to Article 94(3) EPC Dated Feb. 17, 2014 From the European Patent Office Re. Application No. 08847971.2.
Translation of Office Action Dated Jul. 2, 2013 From the State Intellectual Property Office of the People's Republic of China Re. Application No. 201080056585.9.
Dietemann et al. "*Varroa Destructor*: Research Avenues Towards Sustainable Control", Journal of Apicultural Research, XP055069108, 51(1): 125-132, Feb. 2012.
Garbian et al. "Bidirectional Transfer of RNAi Between Honey Bee and *Varroa Destructor*: *Varroa* Gene Silencing Reduces *Varroa* Population", PLOS Pathogens, XP055069058, 8(12): e1003035-1 - e1003035-9, Dec. 20, 2012.
Zhou et al. "The Effects of Brood Comb Cell Size on the Reproductive Behavior of the Ectoparasitic Mite *Varroa Destructor* on Honey Bees", Chinese Jurnal of Entomology, 43(1): 89-93, Dec. 31, 2006.
European Search Report and the European Search Opinion Dated Feb. 3, 2014 From the European Patent Office Re. Application No. 13156180.4.
European Search Report and the European Search Opinion Dated Feb. 3, 2014 From the European Patent Office Re. Application No. 13156180.5.
European Search Report and the European Search Opinion Dated Feb. 6, 2014 From the European Patent Office Re. Application No. 13156183.9.
Cox-Foster et al. "A Metagenomic Survey of Microbes in Honey Bee Colony Collapse Disorder", Science, 318(5848): 283-287, Oct. 2007.
Nielsen et al. "Sacbrood Virus Isolate T73/05A Polyprotein Gene, Partial CDs", Database EMBL [Online], XP002719130, Retrieved From IBIS, Database Accession No. EF570887, May 12, 2007.
Palacios et al. "Genetic Analysis of Israel Acute Paralysis Virus: Distinct Clusters Arc Circulating in the United States", Journal of Virology, 82(13): 6209-6217, Jul. 2008.
Whitfield et al. "BB170006B20C05.5 Bee Brain Normalized/Subtracted Library, BB17 *Apis Mellifera* cDNA Clone BB170006B20C05 5', mRNA Sequence", Database EMBL [Online], XP002719131, Retrieved IBIS, Database Accession No. BI503250, Aug. 30, 2001.
Office Action Dated Jan. 19, 2014 From the Israel Patent Office Re. Application No. 205594 and Its Translation Into English.
Chawla-Sarkar et al. "Downregulation of Bc1-2, FLIP or IAPs (XIAP and Survivin) by SiRNAs Sensitizes Resistant Melanoma Cells to APO2L/TRAIL-Induced Apoptosis", Cell Death and Differentiation, 11: 915-923, Apr. 30, 2004.
Communication Relating to the Results of the Partial International Search Dated Jul. 24, 2013 From the International Searching Authority Re. Application No. PCT/2013/050321.
Office Action Dated May 12, 2014 From the State Intellectual Property Office of the People's Republic of China Re. Application No. 201080056585.9 and Its Translation Into English.
Examination Report Dated May 12, 2014 From the Instituto Mexicano de la Propiedad Industrial Re. Application No. MX/a/2012/004378 and Its Translation Into English.
Amdam et al. "Altered Physiology in Worker Honey Bees (Hymenoptera: Apidae) Infested With the Mite *Varroa destructor* (Acari: Varroidae): A Factor in Colony Loss During Overwintering?", Journal of Economic Entomology, 97(3): 741-747, 2004.

\* cited by examiner

FIG. 1

```
Nosema EEQ82057.1  (1) -MIERG-IMEKIKN--LLTEDEVEAEANSG-RGILSIFRIAKVERRMFWLMTLMF
Nosema EEQ82872.1  (1) -------------------------------MTKTKKFPKVKILLSLTF
Nosema EEQ82913.1  (1) MSVDNSKVLQNNENSALPTEDEILYEASNG-SGIYSLIRVAKVERKMFWIMAAMF
Nosema EEQ83030.1  (1) -MSVINET----PENNLPTEDEIDQLANSR-TGLLSYFKVAKVEMPKFFILGIMF
     Enc. SEQ1     (1) -MNEVENNNHSFPREDIPTEDEILEEANSR-QGILRYFRVARAEYTKFALLGLMF
     Enc. SEQ2     (1) -MSEIGSSVPVNENRPLLTEDEVEAQANSSTVWPLSRIRVARCEWKLWGSLAFIF
     Enc. SEQ3     (1) -MSTFQLSASSKDSYLFRTEEELEEFVYGK-TGFFKHIRVARNEWPRVLYLSLLF
     Enc. SEQ4     (1) -MSENREIDATDRRDKTFDKEKLRPHVYSS---VAGGMRSTSGDTKAVLLFSLLF
                   56                                                    110
Nosema EEQ82057.1  (51) SLISFIYSVGRVLKDAAVLSRQMPLSINCLKSFVILPVTLMCVGLIQKSTLSYSF
Nosema EEQ82872.1  (19) LMACVINTLLEFYREIVIMTKQIPSSLYYIKLFFSLPIICLMMSYVQKALNVYSI
Nosema EEQ82913.1  (55) FIISFIYSVARVLKDAAVIGKQLPASIFFLKFVILLPFSFISVGIIQKALDKYPF
Nosema EEQ83030.1  (50) GLINFVYSFERILKDLFVMVRQDQNSIMFMKIFYVLPISFASVILIQWLMQNKPV
     Enc. SEQ1     (54) GIFGFIYSFMRILKDMFVMVRQEPITILFFKIFYILPVSMALVFLIQYMLGTKTV
     Enc. SEQ2     (55) GLASAYIYSFSRVMKDSFVLSRQLPIAISFLKTCFVLPISVIVTGIVQKLLVTRTI
     Enc. SEQ3     (54) GVITMVHTMGNLREMVLMGRQDPMSMFFIKSFLPPCSLLFIWAIQLGLSLFTP
     Enc. SEQ4     (52) ALLSYIDAFLYVLGDMVMMNTQMFSSILFKSVLVLPMTFFFIVIVQKGLRYLSQ
                   111                                                   165
Nosema EEQ82057.1 (106) TKIFDGALLIFAFLYILGLVLLPYSHLFQLDSYIFRDLFSDGKCVVRGYDALLS
Nosema EEQ82872.1  (74) LSIVNFILFGFIGIFFLKISLLIPFEYKIQKGSQWALDIFCDGKMSVRSLMGLSP
Nosema EEQ82913.1 (110) TKIFDVTLIVFAVAAFTILGSLLPFSDYIQIQPFWAKDIFADGKAVARSTDFLES
Nosema EEQ83030.1 (105) SSIFNLFLIFTAFFFGLGAIFL-IEEKVTPSSFLFRDIFADNKGALKGLNFIKY
     Enc. SEQ1    (109) SRIFSIFCGGFASLFFLCGAVFL-IEEQVSPSKFLFRDMFIDGKMSSRSLNVFKS
     Enc. SEQ2    (110) SKVFDYTLIAFSFLYLLIGMVLLPFAEKIQPGLYIFSRDIFADDKMAYKGFEFLFA
     Enc. SEQ3    (109) SKMFDITLILFSGCYILFGLVVWPLKGYIQKDFYWSRDIFGDGKMESLRIHFLYP
     Enc. SEQ4    (107) PRMLEVILISSVFFLLFGFVIWPYCKRLQPDFWSRDIFSDGKMKTRHLDEFFP
                   166                                                   220
Nosema EEQ82057.1 (161) EALVFNEWTSSLVYIVSEMFGNLVLESYFFLTFANSLTTPGQSARFIPLFYVFSNI
Nosema EEQ82872.1 (129) FLYMYSEWISTLCYILSFLWSTLVVGFALYALANHACTEDEMKEIVPNFSTITAI
Nosema EEQ82913.1 (165) IALVFNEWTSSAIYVLSEMFGSLILSYLFMTFANGLSTPGQSARFVPLFYVGSNL
Nosema EEQ83030.1 (159) FLITANEPVSTCIFIIAEMWGSLLMAYLYMSFLNESCTIRQFTRFLPPFYIIANL
     Enc. SEQ1    (163) MFLTLNEPLATIVFISAEMWGSLVLSYLFSFLNESCTIRQFSRFIPPLIIITNV
     Enc. SEQ2    (165) IFLIFNEWTTSFVYVCAELFIGSLVVQFMFFLAFANEALTIRQSTRMMPLFYVISNI
     Enc. SEQ3    (164) VFLVFNEWTSSFLFLCSEMWGALVVSYFFNIFANEVSTRRQSQRYTSVYNISNAI
     Enc. SEQ4    (162) IFLVFSEWASTMLEYLVAFLWGSLIISFMFFSRAIHQCTEAQVKKFLPTISLISAV
                   221                                                   275
Nosema EEQ82057.1 (216) SLFLSSQVTELFITRYRSKLTFSEAEFLYNG--FFYFSGVLVIVIFLIKKYLERNV
Nosema EEQ82872.1 (184) SMIISVAFIYIKDELANILPAGLHDKIDGSSLFFLILSFVTTLIYFLKSYIPLKT
Nosema EEQ82913.1 (220) ALLLSGMINYFVSVSKSKMSYVAAERFFNG--FFCLSGILCAVIYLLKKYLENNV
Nosema EEQ83030.1 (214) ALLVFGLASSSFRELRKGFSYEQNQLLYSS--VHAMGGICLILMYMKYYFENKI
     Enc. SEQ1    (218) SLFFSATVAGAFFKLREKLAFQQNQVLLSG--IFFQGFLVVLVIFLKIYLERVT
     Enc. SEQ2    (220) LLLLSSESTSFYSKKVREWDYKKTCLITNS--FFAVFGAMIAYTYLVKKYAENTI
     Enc. SEQ3    (219) SFLSAVLTLVFNKWRDGVAFETKFELGFRI--LILVLGSTVIGILALKKYMEREI
     Enc. SEQ4    (217) VFLSSGLLTKSLNSRRDALFPYHEKERLFSQ--VFIVTSALTVMSAITSFFTDRAL
                   276                                                   330
Nosema EEQ82057.1 (269) TNKPLFVVKS--VKKKGPKVKVGFAEGLKEMMASKLLENISLTVMFYGISTNLIE
Nosema EEQ82872.1 (239) KEIKETNKE----------EDKTTSSFDLLQSKFLRNMCAAALIYAINAGFID
Nosema EEQ82913.1 (273) TSKPMFVRKT--FTKKKSKVKVGFVDGLIEMSKSKLLENMSLVVLFYAVSTNHE
Nosema EEQ83030.1 (267) MSVPIFIPSN--TIKKKQKVSVGFSEGISIMMKSKLLMSLCIIVFFYNITFNLIE
     Enc. SEQ1    (271) MKRPLFIVSSG-SRRKKAKANVSFSEGLEIMSQSKLLEAMSLIIVLFENISYNMVE
     Enc. SEQ2    (273) LKKQLFIRTEGVAKKKGRKSSAGFSESMKELMAQSKFLVAMVMNALFYYAGTNLIE
```

```
Enc.SEQ3  (272) LPAPVFLREVEKTSTERR-KLKLDEARQTLSRSKLIAISLNVLLYGVTSTLVE
Enc.SEQ4  (270) AKDDPRHKGK----KEHKVRKIGFAGSLKMMQKSRFLRAMTESVVAASVCSNIFE
                331                            385
Nosema EEQ82057.1 (322) STFKSGLVKGAEELNENTKSYSMGYNSFEQKIASITVIILLLSPFPKLIQTKGWI
Nosema EEQ82872.1 (283) MSLKNSLSTGSRINNMPPKDYSQKYLVTTSETISAVSLFYNFVIRGNRIASR-IF
Nosema EEQ82913.1 (326) SAYKSALAVGANETGEAKSTYASIYTSIEQSGVAVIVMILLLTPFPRLIKTKGWI
Nosema EEQ83030.1 (320) SVYKAGIKAASKSLGLEVGEYSGKFNTIDQILVAVIVIILNLSAFSTLVLES-GWI
Enc.SEQ1  (325) STFKVGVKVAAEYFNEEKGKYSGKENRIDQYMTSVVVICLNLSPFSSYVFTRGFL
Enc.SEQ2  (328) SSWKNGISVAADANNMEKRAYSASIVSGEQRVVGALVAHLLTPFSTLVQTHGWI
Enc.SEQ3  (326) ATEKSGLAAGARYTNNSKETFANFYNGLEQHIAISLLVVINTPYSALVKKGGWK
Enc.SEQ4  (321) AIYRGGFVLGAVQSSTSKSSYMNRLNAMAQHTSFLLVMFFKPATHLIERRGWF
                386                            440
Nosema EEQ82057.1 (377) FVAIACPLITLFAVVSNCGLAFYNYPATNNDTNFFLNSLCATPGKSFIKLFNVLG
Nosema EEQ82872.1 (337) YLSIASPIAAIFFTALISGLSFYNLRTAP---------------SVLRINLFNWCA
Nosema EEQ82913.1 (381) TIAILCPHTFFSAFGTFVLAYLNFPITNKEDNIFDIYRLPST-DSIIKLFNIVG
Nosema EEQ83030.1 (375) TMGLLTPLFLLGSIIVMGASIYNSAIF--GLAFSWISVFFKKMSYIYTLFSYSG
Enc.SEQ1  (380) LVGLITPIVTLMAIVLFLGSALYNTSMF--ESGLGIVNGLFPGGKPLFVLLNYFG
Enc.SEQ2  (383) TMAIVPPLVTLVSSLVIFGSAFFNYSNYPEGKTSVILSSLVKGYKPNFYLFCNIG
Enc.SEQ3  (381) YLASLPIVIAMFSLFSVFLIAFYNVGADF-SGGNVLFGSLFKNRMPTFILFNTLG
Enc.SEQ4  (376) PVAITAPIVAIITLVLFFPMVFFNNITLG------DLASGEEYVGSFVLLNYTG
                441                            495
Nosema EEQ82057.1 (432) CVAVALMKVACKYGSFDISKEAISMQIDSSLRARYKGIFDGVFGKLGKSLGSLFVW
Nosema EEQ82872.1 (378) TIGFAFSKITKYVLFDLAKEMLSMRVPVKYRYKFKSFYDGVCIKIGKSIISLYGT
Nosema EEQ82913.1 (435) VICVSLMKISKYAAFDITKEALSMQIDGSIRAKYKGIFDGVFGKLGKSFGSVYGF
Nosema EEQ83030.1 (428) MFFLAFIKVLKYSAFDICKEKMGMRIDPAHRARFKSVYDGIFNKLGKSIGSLYGL
Enc.SEQ1  (433) VIFMSLLKITKYSAFDICKEKLGMRINPTYRARFKAVYDGIFGKLGKSIGSIYGL
Enc.SEQ2  (438) IYCVSGMKIAACYAFYDISKEAISLQIDPLYRPELKAVYDGLCGKLGKSIGSLYAM
Enc.SEQ3  (434) LVTNASMKIGKYLGADVSKEAISMQIDPLYRAKYKAVYDGLCGKLGKSLGSIICT
Enc.SEQ4  (425) MFLTTIIRISKYCFFDVAKEAASIRVSPVHRHSFRGIHDGLGINIGKTIGSVYCT
                496                            550
Nosema EEQ82057.1 (487) IMGYAFQTRDFRKLAPLCISVIVFFVIIWIYSVTIYLNKKYKESVVSNLPIDVDLF
Nosema EEQ82872.1 (433) FLT-FILFPDIRQVSYVSFIFLIFANFLWIRSVCYLSKKYNESIEQNSEIDVDFN
Nosema EEQ82913.1 (490) TTTILLGTRDVRRGAPISLCVLILFCLIWFYSVFYLNRKYKESVENNAPIDIDLF
Nosema EEQ83030.1 (483) AILVALDTDNVRKGSPITLTIALLIYIWIRABYLAGAYNVSIKNNTSVDIDLL
Enc.SEQ1  (488) LMFEALDTEDLRKATPITAGIFIFIVMWVKAHYLSRSYESAVQHNRDVDIDMT
Enc.SEQ2  (493) FWSLVMGYNDVRAAAPITLGMWLISPIWIYSVIYLNRKYNQSIQTSSPIDLDLF
Enc.SEQ3  (489) VMTGLWDITDIRRVSSVSGILIVTIAMWYFLKYLSRQFQAAVEANTYELDEF
Enc.SEQ4  (480) LVTVWFDVRDVRNVVSVSTVFVGVFCVIWIRSILHINKKYKESIERNDFINVELA
```

FIG. 1 CONTINUED

PREVENTION AND TREATMENT OF *NOSEMA* DISEASE IN BEES

RELATED APPLICATIONS

This application is a National Phase of PCT Patent Application No. PCT/IB2010/051980 having International filing date of May 5, 2010, which claims the benefit of priority of U.S. Provisional Patent Application No. 61/213,086 filed on May 5, 2009. The contents of the above applications are all incorporated herein by reference.

FIELD OF THE INVENTION

The invention relates to compositions and methods for reducing susceptibility to *Nosema* spp infection in bees and more particularly, to the use of composition for reduction of *Nosema* mitosomial gene expression for prevention and treatment of *Nosema* spp in honeybees.

BACKGROUND

The importance of honeybees and other pollinating insects to the global world economy far surpasses their contribution in terms of honey production. The United States Department of Agriculture (USDA) estimates that every third bite we consume in our diet is dependent on a honeybee to pollinate that food. The total contribution of pollination in terms of added value to fruit crops exceeds $15 billion per annum, with indirect potential consequence of $75 billion dollars.

Microsporidia are basal fungi and obligate intracellular parasites of other eukaryotes characterized by extreme genomic and cellular reduction. Two described species of microsporidia, *Nosema apis* and *Nosema ceranae*, cause a widespread and destructive disease in adult honey bee. Nosema disease is widespread across the world, and it has been observed that nosema pathogenesis, together with increased viral load, are the best predictors of weak and collapsing colonies. In Europe, disappearing colony syndrome has been directly attributed to *Nosema ceranae*, and the risk of colony depopulation is six times higher in colonies infected with *N. ceranae* than in uninfected ones. Recently, it was shown that natural *Nosema ceranae* infection can cause the sudden collapse of bee colonies.

Transmission of *Nosema* in honey bee colonies is mainly via the fecal-oral route in which pathogens are spread from diseased hosts to uninfected hosts via ingestion of nucleated *Nosema* spores from fecal material from infected bees. The spores geminate within the midgut and release polar tubes that transfer their sporoplasm into midgut epithelial cells. Inside the cell, the sporoplasm grows to form a multinuclear plasmodium, or "meront", replicating to generate more spores, usually numbering in the millions per infected bee.

Current Anti-*Nosema* Protocol: Fumagillin

Fumagillin is an antibiotic derived from the fungus *Aspergillus fumigates*. It is an anti-angiogenic agent that covalently and selectively binds and inhibits the methionine aminopeptidase, MetAP-2 and has been used for many years to treat microsporidiosis caused by *Nosema* in honeybees. It is used extensively in the United States where beekeepers drench their hives in sucrose solution containing Fumagillin. However, Fumagillin does not kill *Nosema* spores, and has rapidly deteriorating potency after application, resulting in only partial and temporary anti-*Nosema* effect, since new bees emerge constantly in a colony, and re-application is required several times a year. Indeed, differences between treated and untreated colonies disappear several months after treatment, with several different etiologies.

a) *Nosema*-infected colonies naturally recover during the summer
b) fumagillin loses its efficacy or
c) fumagillin becomes depleted from colony honey stores In humans, Fumagillin was used more than 40 years ago for the treatment of intestinal amebiasis, and it is effective when used topically. However, a recent study showed that Fumigillin caused serious toxic side effects (neutropenia and thrombocytopenia) in patients that were treated for microsporidiosis due to *Enterocytozoon bieneusi*.

Of further concern is the possibility that *Nosema*, multiplying in the millions in each bee gut, will eventually develop resistance to Fumagillin, as has been the experience with other antibiotics that are copiously applied. Thus, possible resistance of *Nosema* to Fumagillin makes many beekeepers around the world understandably concerned about it's widespread use for prevention of *Nosema* infection. Due to these and other concerns, Fumagillin's use for treating *Nosema* in honeybees has already been prohibited in Europe.

*Nosema* and Microsporidian Genetics

Several Microsporidian genomes, including the human *Encephalitozoon cuniculi* (*E. cunuculi*), have been published to date. The sequence analysis of *E. cuniculi* revealed a very small and compacted genome of 2.9-megabase, comprising of nearly 2000 genes. Due to its extreme reduction, *E. cuniculi* genome lacks most of the introns and intergenic spacers usually found in eukaryotic genomes. The majority of the genes are also shorter than their corresponding homologues. In addition, in-depth analysis of the predicted genes showed absence of genes of some biosynthetic and metabolic pathways, while other such pathways included a relatively limited number of genes. Recent studies using the sequencing information have revealed some details of microsporidian evolution and metabolism such as homologues of bacterial ADP/ATP transporter suspected important in *E. cunuculi* energy metabolism.

Being an obligate parasite, *E. cuniculi*, and microsporidia in general, relies on its host to provide it with the energetic and metabolic needs. The compensation pathways, and their function, are poorly understood.

For many years, microsporidia were thought be lacking the mitochondria, and accordingly proposed to have evolved before the appearance of the eukaryotic mitochondria. *Nosema* lack electron transport chain and Kreb's cycle, however, recently a highly reduced organelle, extremely reduced both in size and biochemical complexity, called the mitosome was identified, a probable relic from a primitive mitochondrion. To date, only 20 mitosomal proteins were identified, in contrast to the yeast mitochondrion, which contains about 1000 proteins.

Recently, a draft sequence of the *Nosema ceranae* genome was published, enabling further analysis of protein homologies and revealing a significant homology to, while distinct diversity from the *E. cunuculi* genome, and only few genes orthologous with that of *S. cerevisae*.

Intracellular symbiotic organisms use mitochondrial carrier family proteins (MCF) in order to acquire various substrates, including ATP, from the host cell, in order to provide the energy for the protein transport and other necessary mitosomal activities. However, as the microsporidian genomes have apparently lost all of the genes for the MCF proteins, it is not known how the parasite's mitosome acquires the necessary ATP for its function. Several bacterial intracellular parasites, such as *Rickettsia*, possess a nucleotide transporter which is used for ATP import from their eukaryotic host cell.

Homologues of these genes were identified in the *E. cuniculi* genome, however, the use of such bacterial-like nucleotide transporters to acquire ATP from a eukaryotic cell is unknown in a eukaryotic parasite. There are no homologues of these proteins in either vertebrate or invertebrate species sequenced to date.

Gene Silencing in Invertebrates

The process of post-transcriptional gene silencing is most likely a cellular defense mechanism used to prevent the expression of foreign genes, thought to be shared across kingdoms. The presence of long dsRNAs in cells stimulates the activity of a ribonuclease III enzyme referred to as Dicer, which is involved in the processing of the dsRNA into short pieces known as short interfering RNAs (siRNAs). These are typically about 21 to about 23 nucleotides in length and comprise about 19 base pair duplexes. The RNAi response also features an endonuclease complex, commonly referred to as an RNA-induced silencing complex (RISC), which mediates cleavage of single-stranded RNA having sequence complementarity to the antisense strand of the siRNA duplex. In some organisms, an amplification stage may follow the initiation stage of gene silencing, involving an RNA dependent RNA Polymerase (RdRP), which may subsequently lead to degradation of RNAs outside the initial dsRNA region of homology. It has been shown in some species that RNAi mediated interference spreads from the initial site of dsRNA delivery, producing interference phenotypes throughout the injected animal. In some invertebrates, including honeybees, a systemic interference defective (SID) gene encoding a transmembrane protein important to the systemic RNAi pathway has been identified. Apparently, these SID1-like proteins channel dsRNAs between cells, enabling a mechanism of systemic spread of the silencing signal. However, an invertebrate RdRP homologue has not yet been described. Recently, gene silencing by feeding viral dsRNA has been demonstrated effective in combating IAPV infection in honeybees (PCT IL2008/001440).

Microsporidia have been classified as Fungi, which have shown an evolutionarily diverse repertoire of silencing proteins. Some of these are distinct from vertebrate silencing homologues. In *Trypanosoma brucei* a DICER-like homologue was identified. RISC homologues have also been described, and RNAi-related transcripts have been identified in simple, parasitic eukaryotes such as Giardia and Trichomonas. However, the function of such enzymes and their products is unclear. Further, although DICER and RISC enzymes have been detected in some species of Trypanosomes, other Trypanosomes have been identified as RNAi-negative, consistent with the observation that many eukaryotic parasites are genetically heterogeneous where RNAi pathways are concerned (Ullu et al, 2004).

RNAi gene silencing in intracellular eukaryotic parasites has been demonstrated either for host proteins suspected of critical roles in the parasites life cycle (as in *T. cruzi*), or in free-living forms, such as the extra-cellular forms of *Plasmodium* and *T. brucei* that can be cultured in-vitro. As opposed to the numerous studies with viral parasites, to date, no endogenous gene silencing in intracellular forms of eukaryotic parasites has been demonstrated. In addition to the requirement of traversing at least one parasite membrane of undefined permeability and composition, additional obstacles to effective RNAi methodology for intracellular forms of eukaryotic parasites include the heterogeneity of RNAi pathways in lower, parasitic eukaryotes, poor understanding of the function of such pathways, and the limited knowledge of parasite metabolism, and therefore difficulty in selecting effective targets for silencing the parasite genes.

There is thus a need and it would be highly desirable to have methods for effective, gene silencing in *Nosema*, in order to prevent and treat *Nosema* infection in honeybees.

SUMMARY OF THE INVENTION

According to an aspect of some embodiments of the present invention there is provided an isolated nucleic acid agent comprising a nucleic acid sequence downregulating expression of a gene product of a *Nosema* parasite.

According to another aspect of some embodiments of the present invention there is provided a nucleic acid construct comprising an isolated nucleic acid agent comprising a nucleic acid sequence downregulating expression of a gene product of a *Nosema* parasite.

According to yet another aspect of some embodiments of the present invention there is provided a bee-ingestible composition comprising an isolated nucleic acid agent comprising a nucleic acid sequence downregulating expression of a gene product of a *Nosema* parasite.

According to some embodiments of the invention the bee-ingestible composition is in solid form.

According to some embodiments of the invention the bee-ingestible composition is in liquid form.

According to some embodiments of the invention the bee-ingestible composition comprises protein.

According to some embodiments of the invention the protein is in the form of pollen and/or soy patties.

According to some embodiments of the invention the liquid is a sucrose solution or a corn syrup solution.

According to some embodiments of the invention the liquid further comprises a carbohydrate or sugar supplement.

According to still another aspect of some embodiments of the present invention there is provided a method for reducing the susceptibility of a bee to a *Nosema* infection comprising feeding the bee an effective amount of an isolated nucleic acid agent comprising a nucleic acid sequence downregulating expression of a gene product of a *Nosema* parasite, thereby reducing the susceptibility of the bee to the *Nosema* infection.

According to an aspect of some embodiments of the present invention there is provided a method for reducing the susceptibility of a bee to a *Nosema* infection comprising feeding the bee an effective amount of the nucleic acid agent comprising nucleic acid sequences downregulating the expression of at least one *Nosema* ATP/ADP transporter protein or homologue thereof and least one *Nosema* mitosomal protein, thereby reducing the susceptibility of said bee to the *Nosema* infection.

According to another aspect of some embodiments of the present invention there is provided a method of reducing the susceptibility of honeybees to *Nosema* infection, the method comprising feeding to the honeybee hive an effective amount of double stranded ribonucleic nucleic acid (dsRNA), said double stranded RNA comprising at least one sequence complementary to at least 21 nucleotides of a *Nosema*-specific mRNA and capable of inducing degradation of the *Nosema*-specific mRNA.

According to some embodiments of the invention the gene product is an mRNA encoding a *Nosema* polypeptide.

According to some embodiments of the invention the agent is selected from the group consisting of a dsRNA, an antisense RNA and a ribozyme.

According to some embodiments of the invention the dsRNA is selected from the group consisting of siRNA, shRNA and miRNA.

According to some embodiments of the invention the nucleic acid sequence is greater than 15 base pairs in length.

According to some embodiments of the invention the nucleic acid sequence is 19 to 25 base pairs in length.

According to some embodiments of the invention the nucleic acid sequence is greater than 30 base pairs in length.

According to some embodiments of the invention the *Nosema* parasite is *N. ceranae* or *N. apis*.

According to some embodiments of the invention the *Nosema* parasite is *N. ceranae* and the gene product is an mRNA encoding a *Nosema* mitosomal protein.

According to some embodiments of the invention the *Nosema* mitosomal protein is selected from the group consisting of TOM70, TIM22, TOM40, Imp2, mitochondrial Hsp70, ATM1-ABC transporter proteins, Frataxin, Ferredoxin, ERV1, ferredoxin, NADPH oxido-reductase [FNR], pyruvate dehydrogenase α subunit, pyruvate dehydrogenase β subunit, mitochondrial glycerol-3-phosphate dehydrogenase (mtG3PDH), manganese-containing superoxide dismutase (MnSOD), DNAJ (Hsp70 interacting), Iron Sulfur cluster ISU1, Cystein desulfurase Nsf1, NAR1 and Rfl1.

According to some embodiments of the invention the nucleic acid sequence is complementary to a sequence as set forth in any of SEQ ID NOs: 55-252698.

According to some embodiments of the invention the *Nosema* parasite is *N. ceranae* and the gene product is an mRNA encoding a *Nosema* ATP/ADP transporter protein or homologue thereof.

According to some embodiments of the invention the ATP/ADP transporter protein or homologue thereof is selected from the group consisting of proteins encoded by SEQ ID NOs: 44, 45, 46 and 47.

According to some embodiments of the invention the isolated nucleic acid agent comprises at least two nucleic acid sequences downregulating expression of a gene product of a *Nosema* parasite. The at least two nucleic acid sequences can be contiguous or non-contiguous with respect to one another.

According to some embodiments of the invention nucleic acid sequences downregulate the expression of at least two *Nosema* mitosomal proteins. According to some embodiments of the invention the nucleic acid sequences downregulate the expression of at least one *Nosema* ATP/ADP transporter protein or homologue thereof and least one *Nosema* mitosomal protein.

According to some embodiments of the invention the nucleic acid sequences comprise at least one nucleic acid sequence complementary to the sequence as set forth in SEQ ID NO: 59 and at least one nucleic acid sequence complementary to a sequence as set forth in SEQ ID NOs: 57 and 58.

According to some embodiments of the invention the nucleic acid sequences comprise a plurality of sequences having at least one nucleic acid sequence complementary to a sequence as set forth in each of SEQ ID NO: 59, 55, 56, 57 and 58.

According to some embodiments of the invention the bee is a honeybee, a forager, or a hive bee.

According to some embodiments of the invention the *Nosema* infection is a *Nosema ceranae* or a *Nosema apis* infection.

According to some embodiments of the invention the infection is a *Nosema ceranae* infection and feeding the effective amount of the nucleic acid agent reduces mortality from the infection.

According to some embodiments of the invention the nucleic acid agent comprises a nucleic acid sequence selected complementary to any of the sequences as set forth in the group consisting of SEQ ID NOs: 55-252698.

According to some embodiments of the invention the nucleic acid agent comprises a plurality of nucleic acid sequences complementary to any of the sequences as set forth in each of the group consisting of SEQ ID NOs: 57, 58 and 59.

According to some embodiments of the invention the feeding comprises providing a liquid bee-ingestible composition.

According to some embodiments of the invention the feeding comprises providing a solid bee-ingestible composition.

Unless otherwise defined, all technical and/or scientific terms used herein have the same meaning as commonly understood by one of ordinary skill in the art to which the invention pertains. Although methods and materials similar or equivalent to those described herein can be used in the practice or testing of embodiments of the invention, exemplary methods and/or materials are described below. In case of conflict, the patent specification, including definitions, will control. In addition, the materials, methods, and examples are illustrative only and are not intended to be necessarily limiting.

BRIEF DESCRIPTION OF THE DRAWINGS

The patent or application file contains at least one drawing executed in color. Copies of this patent or patent application publication with color drawing(s) will be provided by the Office upon request and payment of the necessary fee.

Some embodiments of the invention are herein described, by way of example only, with reference to the accompanying drawings and images. With specific reference now to the drawings and images in detail, it is stressed that the particulars shown are by way of example and for purposes of illustrative discussion of embodiments of the invention. In this regard, the description taken with the drawings and images makes apparent to those skilled in the art how embodiments of the invention may be practiced.

In the drawings:

Figure 2:
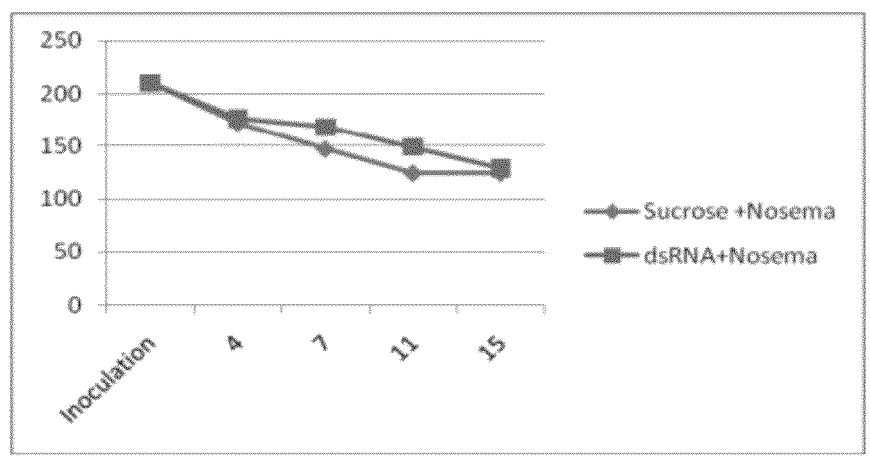
Figure 3:
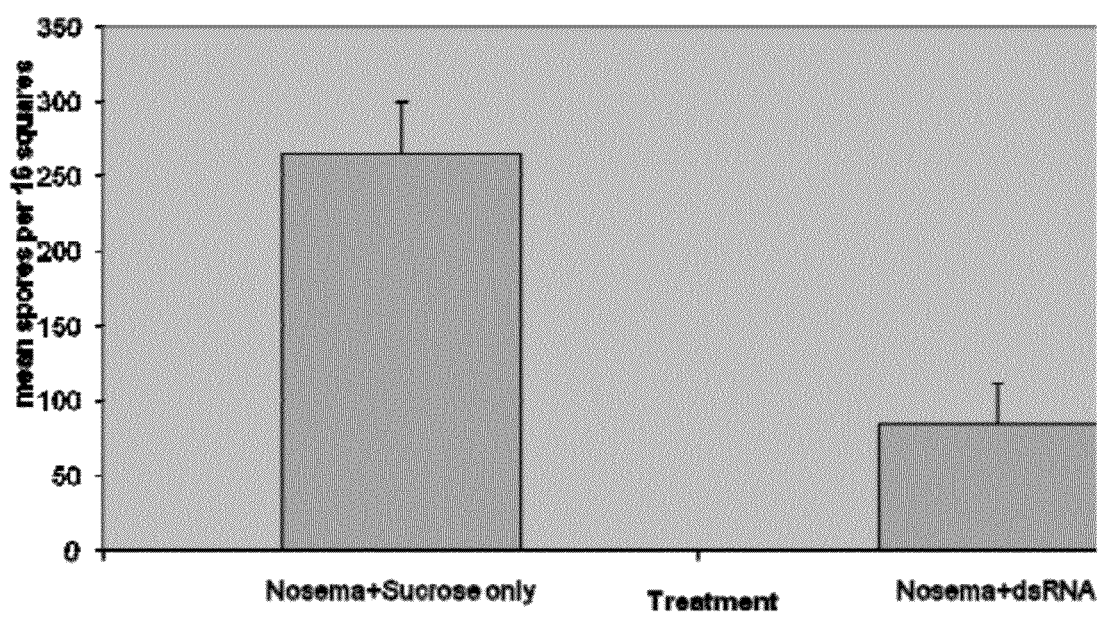
Figure 4:
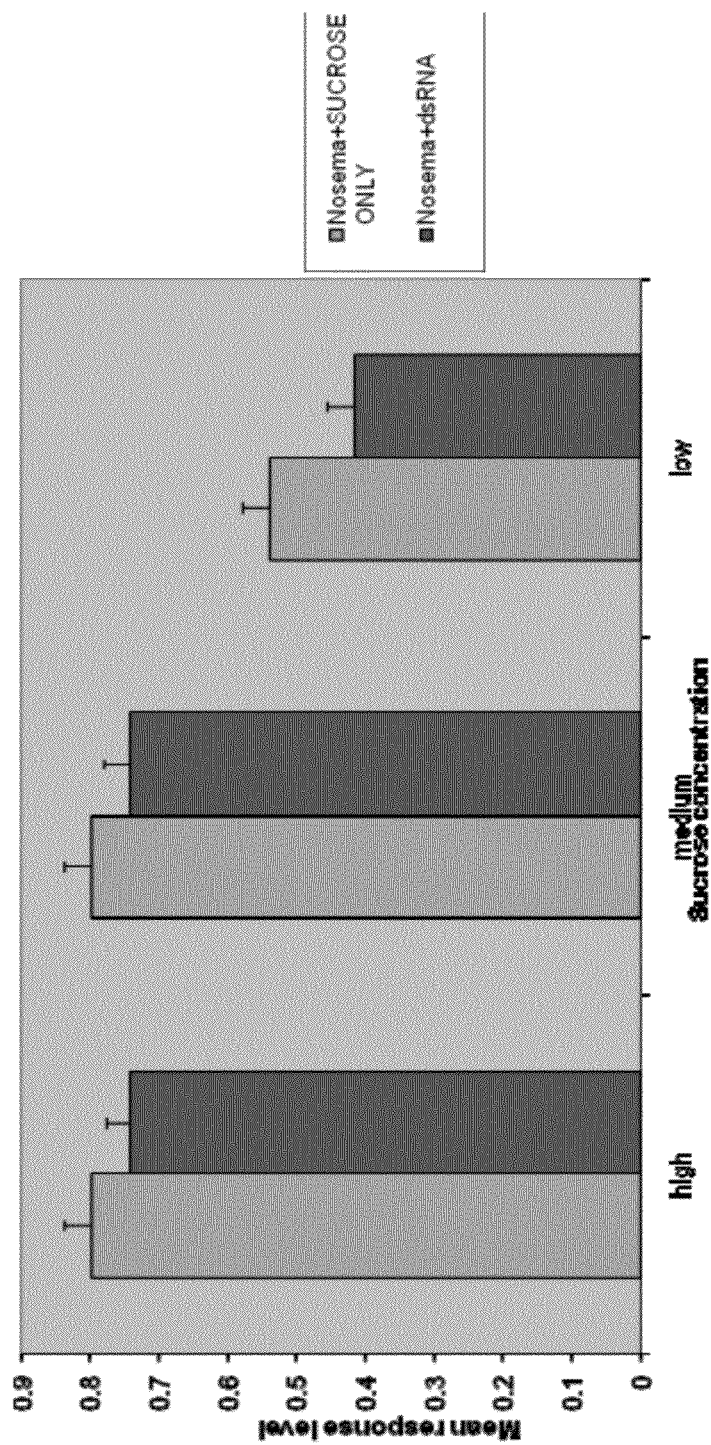
Figure 5:
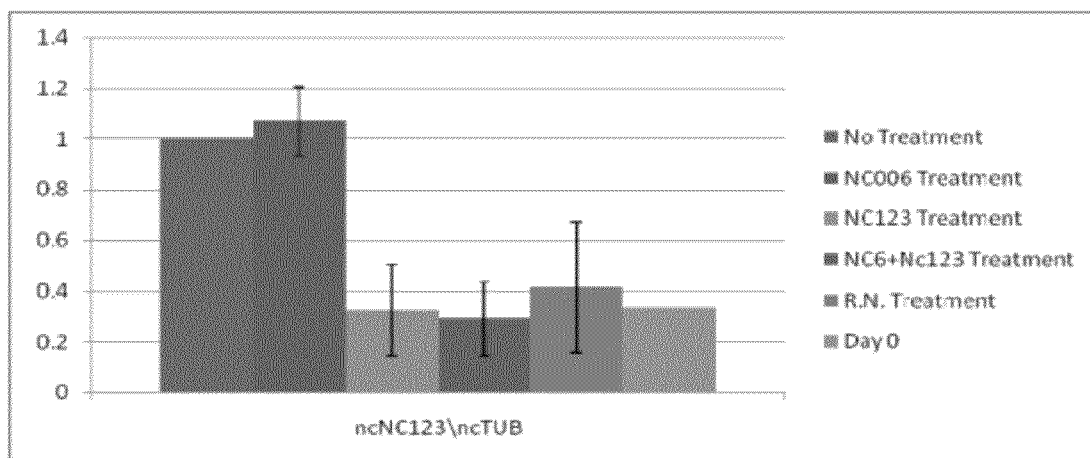
Figure 6:
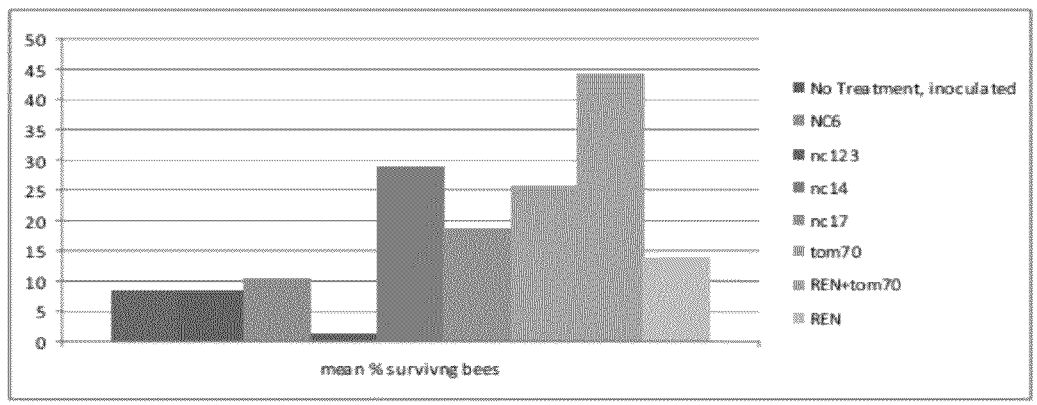
Figure 7:
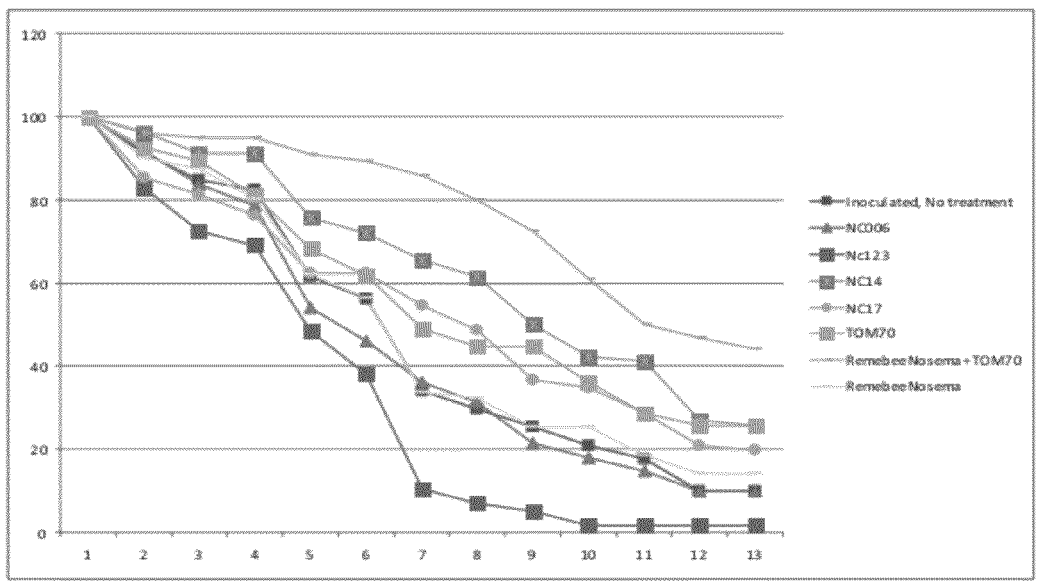
Figure 8:
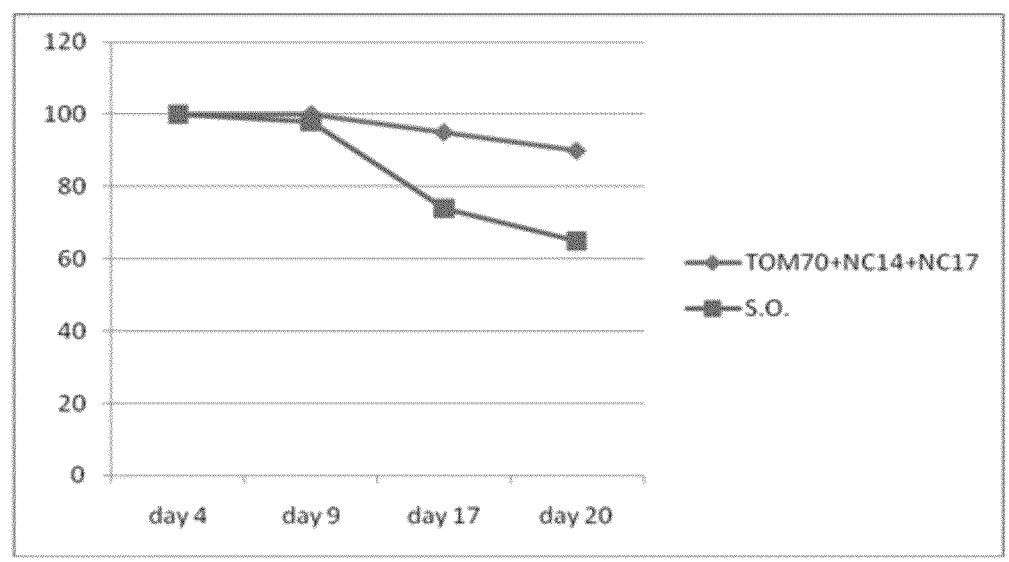
Figure 9:
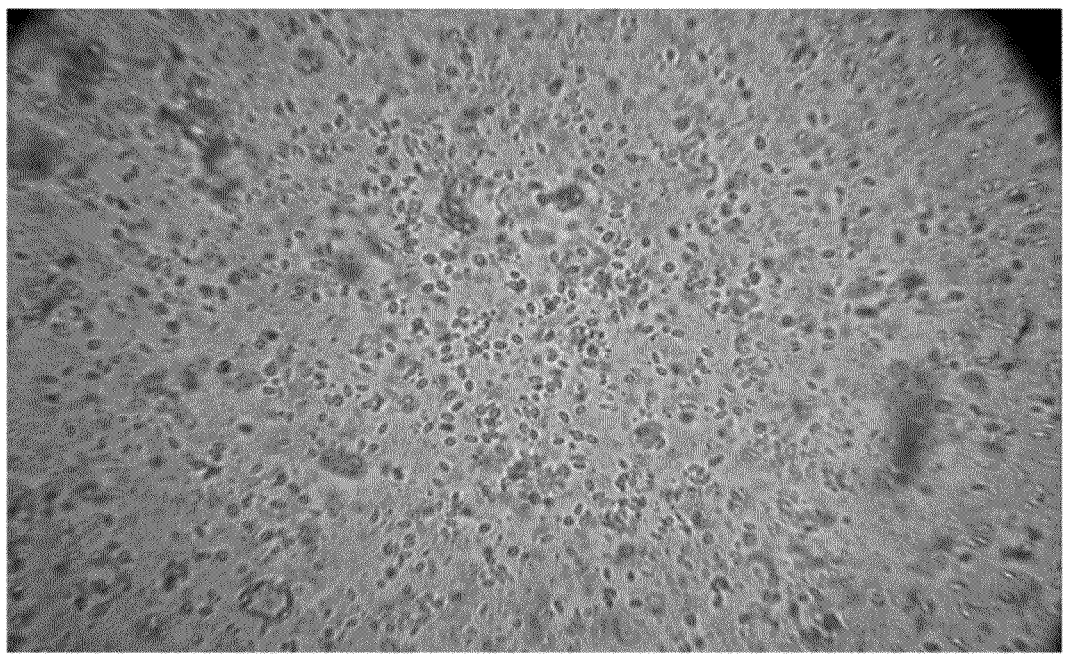
Figure 10:
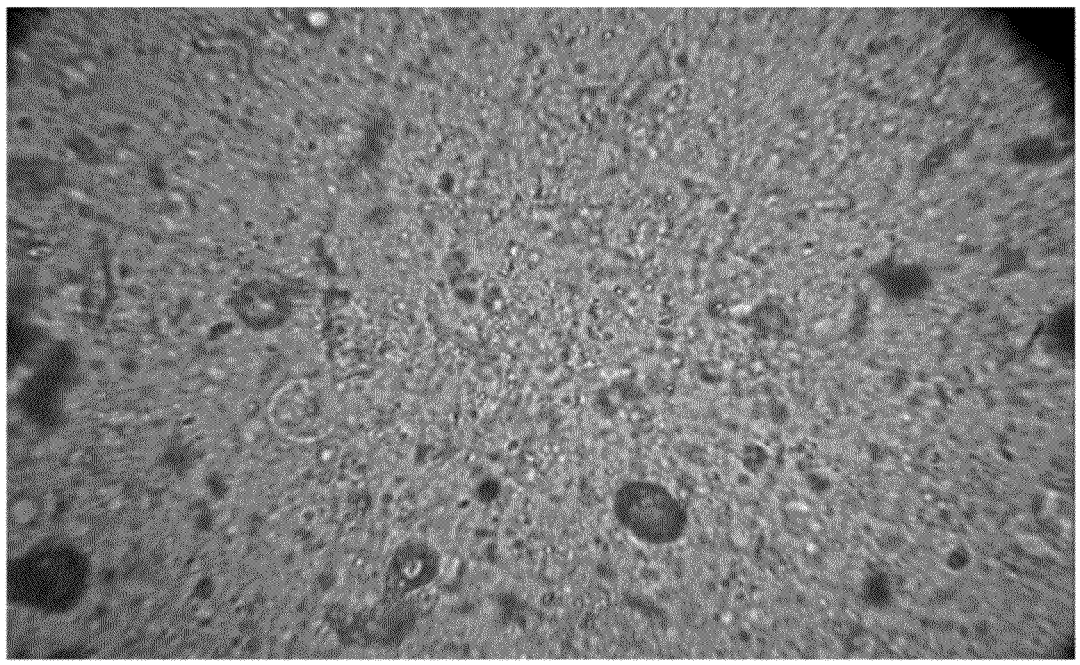
Figure 11:
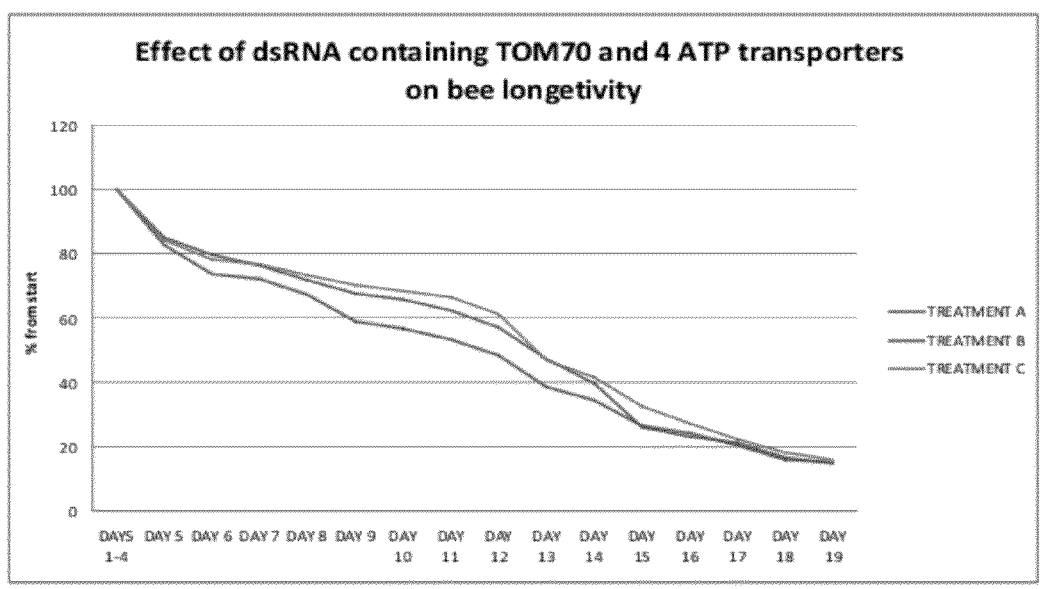

FIG. 1 is an alignment of *E. cuniculi* ATP transport protein sequences (Enc SEQ 1 is SEQ ID NO: 23; Enc SEQ 1 is SEQ ID NO: 24; Enc SEQ 1 is SEQ ID NO: 25; Enc SEQ 1 is SEQ ID NO: 26), and the homologues found in *N. ceranae*. EEQ82075.1 is SEQ ID NO: 27; EEQ83030.1 is SEQ ID NO: 44; EEQ82913.1 is SEQ ID NO: 46 and EEQ82872.1 is SEQ ID NO: 47;

FIG. 2 is a graph showing enhanced survival of bees fed dsRNA of *N. ceranae* ATP/ADP transport protein homologues. The Y-axis represents the number of surviving bees counted per minihive, at each time point and the X-axis represents the number of days from inoculation with *N. ceranae*. N=6 minihives per treatment;

FIG. 3 is a histogram showing reduced *Nosema* spore levels in bees found dead following feeding of hives and boxes with dsRNA of *N. ceranae* ATP/ADP transport protein homologues. Dead bees succumbing to *Nosema* infection in box and minihive experiments were collected from day 7 to day 15 post infection, and spores prepared for counting in a haemacytometer as described herein. Uninfected bees (no *Nosema* spores detected) were excluded from the samples. Y-axis is mean spore count per 16 squares. N=75 samples. Note that feeding the dsRNA of *N. ceranae* ATP/ADP transport protein homologues resulted in greater than three-fold lower spore count in the dead, infected bees, compared with untreated controls;

FIG. 4 is a histogram showing reduced hunger in bees fed with dsRNA of *N. ceranae* ATP/ADP transport protein homologues. Hunger, expressed as the tendency of positive response in the Proboscis Extension Reflex (PER) assay, was consistently greater among untreated, infected control bees (*Nosema*+Sucrose only) than bees fed with dsRNA of *N. ceranae* ATP/ADP transport protein homologues (*Nosema*+ dsRNA). N=1000 total responses. Note that the increased threshold for PER response among bees fed with dsRNA of *N. ceranae* ATP/ADP transport protein homologues is most clearly evident at low (<1%) sucrose concentrations, indicating reduced metabolic stress in the treated bees;

FIG. 5 is a histogram illustrating the specific silencing of *Nosema* gene expression by dsRNA of *N. ceranae* ATP/ADP transport protein homologues. Levels of gene expression of *Nosema* ATP/ADP transporter protein homologue NC123 in bees fed *Nosema* specific dsRNA was assayed by real-time PCR, normalized in relation to *Nosema* tubulin gene expression, and expressed in relation to NC123 expression in *Nosema*-infected bees fed sucrose only (no treatment), which was given a value of 1. Column titles from left to right: No treatment, NC006 Treatment (fed dsRNA of NC006 protein), NC123 Treatment (fed dsRNA of NC123 protein), NC6+Nc 123 Treatment (fed combined dsRNA of NC006 and dsRNA of Nc 123 protein), R.N. Treatment (fed combined dsRNA of NC006 protein, dsRNA of Nc123 protein, dsRNA of Nc014 protein and dsRNA of Nc017 protein) and Day 0 (uninfected). Note the significant reduction of transcript number, only among bees fed the dsRNA in which the NC123-specific homologous dsRNA was present;

FIG. 6 is a histogram illustrating enhanced survival in bees fed dsRNA of *N. ceranae* mitosomal and non-mitosomal proteins. Mean % of the bees in a minihive surviving at day 14 following *Nosema* infection is indicated for bees fed *Nosema* specific dsRNA of *N. ceranae* mitosomal and non-mitosomal energy-related protein homologues. Column titles, starting from second from the left: No treatment, infected, NC6 (fed dsRNA of *Nosema* NC006 protein), NC123 Treatment (fed dsRNA of *Nosema* NC 123 protein), NC14 (fed dsRNA of *Nosema* Nc014 protein), NC17 (fed dsRNA of *Nosema* Nc017 protein), TOM70 (fed dsRNA of *Nosema* Nc014 protein), REN+TOM70 (fed combined dsRNA of *Nosema* NC006 protein, dsRNA of Nc123 protein, dsRNA of Nc014 protein, dsRNA of Nc017 protein and dsRNA of TOM70 protein) and REN (fed combined dsRNA of NC006 protein, dsRNA of Nc123 protein, dsRNA of Nc014 protein and dsRNA of Nc017 protein). Note the significant enhancement of survival with feeding of some, but not all of the *Nosema*-specific dsRNA (e.g. nc014, nc017 and TOM70), and the synergic effect of feeding combined nc006, nc123, nc014, nc017 and TOM70 dsRNA;

FIG. 7 is a graph showing the enhanced survival in bees fed dsRNA of *N. ceranae* mitosomal and non-mitosomal proteins, as percent surviving bees following infection, expressed over the entire duration of the experiment. Legend: No treatment, infected (■), NC6 (fed dsRNA of *Nosema* NC006 protein) (▲), NC123 Treatment (fed dsRNA of *Nosema* NC123 protein) (■), NC14 (fed dsRNA of *Nosema* Nc014 protein) (□x), NC17 (fed dsRNA of *Nosema* Nc017 protein) (●), TOM70 (fed dsRNA of *Nosema* Nc014 protein) (▒) REN+TOM70 (fed combined dsRNA of *Nosema* NC006 protein, dsRNA of Nc123 protein, dsRNA of Nc014 protein, dsRNA of Nc017 protein and dsRNA of TOM70 protein) (▼) and REN (fed combined dsRNA of NC006 protein, dsRNA of Nc123 protein, dsRNA of Nc014 protein and dsRNA of Nc017 protein) (▬). Note the consistently superior survival rate among the bees fed combined nc006, nc123, nc014, nc017 and TOM70 dsRNA (▼);

FIG. 8 is a graph illustrating enhanced survival of bees fed dsRNA of a combination of *N. ceranae* mitosomal and non-mitosomal proteins, as percent surviving bees, following infection, expressed over the entire duration of the experiment. Significantly reduced mortality was observed in minihives of bees fed combined dsRNA of *Nosema ceranae* Nc014 protein, Nc017 protein and TOM70 protein (TOM70+ NC14+NC17, ♦), compared to untreated bees (S.O., ■);

FIG. 9 is a photomicrograph illustrating the high *Nosema* spore count characteristic of surviving bees fed combined dsRNA of *Nosema ceranae* Nc014 protein, Nc017 protein and TOM70 protein, 21 days after infection;

FIG. 10 is a photomicrograph illustrating the absence of *Nosema* spores in the surviving, untreated control bees fed sucrose only, 21 days after infection;

FIG. 11 is a graph illustrating the enhanced survival of bees fed dsRNA of *N. ceranae* mitosomal and non-mitosomal proteins, as percent surviving bees following infection, expressed over the entire duration of the experiment. Legend: No treatment, un-infected (Treatment A), No treatment, infected (Treatment B) and feeding combined dsRNA of *Nosema* NC006 protein, dsRNA of Nc123 protein, dsRNA of Nc014 protein, dsRNA of Nc017 protein and dsRNA of TOM70 protein (Treatment C). Note the consistently superior survival rate among the bees fed combined nc006, nc123, nc014, nc017 and TOM70 dsRNA (Treatment C).

DESCRIPTION OF EMBODIMENTS OF THE INVENTION

The present invention, in some embodiments thereof, relates to methods and compositions for reducing the susceptibility of bees to *Nosema* infection and/or reducing the severity of *Nosema* infections by feeding *Nosema*-specific dsRNA.

Before explaining at least one embodiment of the invention in detail, it is to be understood that the invention is not necessarily limited in its application to the details set forth in the following description or exemplified by the Examples. The invention is capable of other embodiments or of being practiced or carried out in various ways.

While reducing the present invention to practice, the inventors have shown that ingestion by a bee of compositions containing one or more dsRNA molecules, wherein at least one segment of the dsRNA molecule corresponds to a substantially identical segment of *Nosema* mitosomal protein RNA and/or one or more non-mitosomal ATP/ADP transporter homologues, will result in reduced incidence and severity of a *Nosema* infection, and greatly enhanced survival of the bees and the colony overall. These results indicate that a polynucleotide molecule, either DNA or RNA, derived from a *Nosema* mitosomal protein and/or at least one additional non-mitosomal ATP/ADP transporter protein homologue sequence can be used to design a nucleic acid agent or nucleic acid construct according to the methods of the present invention to produce one or more RNA sequences that can form into a dsRNA molecule available for ingestion by bees when provided by feeding. While reducing to practice, it was shown that bee colonies exposed to *Nosema* mitosomal protein-specific dsRNA in their feed endured *Nosema* infection with greater survival (see FIGS. 2, 6-8 and 11) and lower incidence of fatally infected bees than untreated colonies (see FIGS. 3 and 8-10), and that *Nosema* mitosomal protein-specific dsRNA provided together with non-mitosomal ATP/ADP transporter protein homologue dsRNA was synergic in its protective effect.

Thus, according to one embodiment of the present invention there is provided a method for reducing the susceptibility of a bee to a *Nosema* infection comprising feeding the bee an effective amount of an isolated nucleic acid agent comprising a nucleic acid sequence downregulating expression of a *Nosema* gene product, or a nucleic acid construct comprising the nucleic acid sequence, thereby reducing the susceptibility of the bee to the *Nosema* infection.

As used herein, the term "bee" is defined as any of several winged, hairy-bodied, usually stinging insects of the superfamily Apoidea in the order Hymenoptera, including both solitary and social species and characterized by sucking and chewing mouthparts for gathering nectar and pollen. Exemplary bee species include, but are not limited to *Apis, Bombus, Trigona, Osmia* and the like. In one embodiment, bees include, but are not limited to bumblebees (*Bombus terrestris*) and honeybees (*Apis mellifera*).

As used herein, the term "colony" is defined as a population of dozens to typically several tens of thousand honeybees that cooperate in nest building, food collection, and brood rearing. A colony normally has a single queen, the remainder of the bees being either "workers" (females) or "drones" (males). The social structure of the colony is maintained by the queen and workers and depends on an effective system of communication. Division of labor within the worker caste primarily depends on the age of the bee but varies with the needs of the colony. Reproduction and colony strength depend on the queen, the quantity of food stores, and the size of the worker force. Honeybees can also be subdivided into the categories of "hive bees", usually for the first part of a workers lifetime, during which the "hive bee" performs tasks within the hive, and "forager bee", during the latter part of the bee's lifetime, during which the "forager" locates and collects pollen and nectar from outside the hive, and brings the nectar or pollen into the hive for consumption and storage.

As used herein, the term "tolerance" is defined as the ability of a bee or bee colony to resist and/or endure infestation by and/or proliferation of a *Nosema* pathogen, including, but not limited to, degree of infection, severity of symptoms, infectivity to other individuals (contagion), and the like. Tolerance can be assessed, for example, by monitoring bee longevity/life-span, infectivity, presence of symptoms, such as, but not limited to, hunger, vitality, flight range, etc, presence of pathogenic organisms, or time course of a disease in a population following a challenge with the *Nosema* pathogen.

As used herein, the term "susceptibility" is defined as the ability of a bee or bee colony to become infested or infected by and/or support proliferation of a *Nosema* pathogen, including, but not limited to, degree of infection, severity of symptoms, infectivity to other individuals (contagion), and the like. Susceptibility can be assessed, for example, by monitoring infectivity, presence of symptoms, such as, but not limited to, hunger, vitality, flight range, etc, presence of pathogenic organisms, mortality or time course of a disease in an individual bee or bee population following a challenge with the *Nosema* pathogen.

As used herein, the term "*Nosema*" is defined as any organism of a genus (the type of the family Nosematidae) of microsporidian protozoans that includes various parasites, particularly those causing disease in bees or bee colonies. *Nosema* infecting bee include but are not limited to *N. ceranae* and *N. apis*. Infection of bees or bee colonies with a *Nosema* parasite is commonly known as Nosemosis. It will be appreciated that the gene silencing mechanisms described herein can be effective for combating microsporidean species infecting hosts other than bees, with examples including but not limited to, the silk moth, and humans. However, due to the heterogeneity of RNAi and metabolic pathways in microsporidia, and in view of the critical role of the individual parasite's endogenous RNAi pathways for effective gene silencing, identification of effective candidate target genes may be required in each case.

As used herein, the term "mitosome" is defined as a double membrane-bound mitochondria-like organelle of Microsporidia highly reduced from the perspective of both physical size and biochemical complexity. Mitosomal proteins include, but are not limited to protein and metabolite import proteins (TOM70, T1M22, TOM40, Imp2, mitochondrial Hsp70, and ATM1-ABC transporter proteins), proteins involved in ISC assembly and export (frataxin, ferredoxin, ISCU, ISCS, ERV1, and ferredoxin NADPH oxido-reductase [FNR]), pyruvate dehydrogenase subunits, PDHα and -β, mitochondrial glycerol-3-phosphate dehydrogenase (mtG3PDH) and manganese-containing superoxide dismutase (MnSOD).

As used herein, the term "ATP/ADP transporter protein" refers to a protein which function is transfer of ATP and/or ADP through membranes. Microsporidian ATP/ADP transporter proteins homologous to ATP/ADP transporter proteins from other species have been identified in *E. cuniculi* and *N. ceranae* (see above, and FIG. 1). As used herein, "putative" ATP/ADP transporter proteins, "ATP/ADP transporter protein orthologues" or "ATP/ADP transporter protein homologues" refer to proteins, or putative encoded polypeptides from polynucleotide sequences, having significant amino acid identity or similarity to known ATP/ADP transporter proteins of othr species, and/or possessing consensus sequences common to known ATP/ADP transporter proteins. Examples of *Nosema* ATP/ADP transporter proteins, or ATP/ADP transporter protein homologues, are nc123 (SEQ ID NO:19), nc006(SEQ ID NO:22), nc014(SEQ ID NO:21) and nc017 (SEQ ID NO:20).

As used herein, the terms "bee disease" or "bee colony disease" are defined as undesirable changes in the behavior, physiology, morphology, reproductive fitness, economic value, viability, honey production, pollination capability, resistance to infection and/or infestation of a bee, a population of bees and/or a bee colony, directly or indirectly resulting from contact with a *Nosema* parasite or a *Nosema*-infected bee or other organism.

A draft of the genome of *N. ceranae* has been provided in Cornman et al. 2009 Plos Pathogen.

While reducing the present invention to practice, the inventors have shown that providing *Nosema* mitosomal-specific dsRNA, alone or in combination with dsRNA specific to additional non-mitosomal *Nosema* ATP/ADP transporter protein homologues in the feed of bees exposed to *Nosema* dramatically reduced the incidence and levels of *Nosema* sequences detected in the bees (see FIG. 5). Thus, in some embodiments of the present invention, the methods and compositions are useful for down-regulating expression of a *Nosema* mitosomal or non-mitosomal polypeptides in a bee.

As used herein, the term "downregulating expression" is defined as causing, directly or indirectly, reduction in the transcription of a desired gene, reduction in the amount, stability or translatability of transcription products (e.g. RNA) of said gene, reduction in translation of the polypeptide(s) encoded by the desired gene and/or reduction in the amount, stability, or alteration of biochemical function of the polypeptides encoded by the desired gene, so as to reduce the amount or function of the gene products. As used herein, "downregulating expression" also relates to reduction in amount, stability or translatability of *Nosema* mitosomal or non-mitosomal RNA molecules in cells of a bee. Downregulating expression of a *Nosema* gene RNA can be monitored, for example, by direct detection of gene transcripts (for example, by PCR), by detection of polypeptide(s) encoded by the gene or bee *Nosema* RNA (for example, by Western blot or immunoprecipitation), by detection of biological activity of polypeptides encode by the gene (for example, catalytic activity, ligand binding, and the like), or by monitoring changes in a cell or organism resulting from reduction in expression of a desired *Nosema* gene or *Nosema* RNA (for example, reduced proliferation of a *Nosema* parasite, reduced virulence of a *Nosema* parasite, etc). It will be appreciated that changes in the course, severity, duration, etc. of a *Nosema* infection can be monitored in some instances via observation of the host, and/or host colony as well as direct observation of the parasite. This direct observation can be useful in instances where nosema virulence in relation to honeybee genotype is high. As used herein, the downregulation can be transient, for example, for the duration of the presence of a downregulating agent, or permanent, resulting in reduction of *Nosema* gene expression or RNA for the lifetime of the organism and/or its future generations. Downregulation of *Nosema* mitosomal or non-mitosomal polypeptides can be effected on the genomic and/or the transcript level using a variety of molecules which interfere with transcription and/or translation (e.g., RNA silencing agents, Ribozyme, DNAzyme and antisense). Treatment and prevention of viral infections with dsRNA has been disclosed by WO/2003/004649 to Tenllado et al and PCT patent application IL2008/001440 to Paldi et al. Use of dsRNA in insects is disclosed in US Patent Application 2007 0250947, US Patent Application 2006 0272049, PCT Applications WO 2007/080127 and WO 2007/080126, US patent application 20030150017, PCT patent application WO 02/14472, US Patent Application 20030154508, PCT patent application WO 2004/005485, PCT application WO 99/32619 and U.S. Pat. No. 6,326,193.

Following is a list of agents capable of downregulating expression level and/or activity of *Nosema* mitosomal polypeptides.

Downregulation of *Nosema* mitosomal and non-mitosomal polypeptides can be achieved by RNA silencing. As used herein, the phrase "RNA silencing" refers to a group of regulatory mechanisms [e.g. RNA interference (RNAi), transcriptional gene silencing (TGS), post-transcriptional gene silencing (PTGS), quelling, co-suppression, and translational repression] mediated by RNA molecules which result in the inhibition or "silencing" of the expression of a corresponding protein-coding gene or *Nosema* mitosomal RNA sequence. RNA silencing has been observed in many types of organisms, including plants, animals, and fungi.

As used herein, the term "RNA silencing agent" refers to an RNA which is capable of inhibiting or "silencing" the expression of a target gene. In certain embodiments, the RNA silencing agent is capable of preventing complete processing (e.g, the full translation and/or expression) of an mRNA molecule through a post-transcriptional silencing mechanism. RNA silencing agents include noncoding RNA molecules, for example RNA duplexes comprising paired strands, as well as precursor RNAs from which such small non-coding RNAs can be generated. Exemplary RNA silencing agents include dsRNAs such as siRNAs, miRNAs and shRNAs. In one embodiment, the RNA silencing agent is capable of inducing RNA interference. In another embodiment, the RNA silencing agent is capable of mediating translational repression.

RNA interference commonly refers to the process of sequence-specific post-transcriptional gene silencing in animals mediated by short interfering RNAs (siRNAs). The corresponding process in plants is commonly referred to as post-transcriptional gene silencing or RNA silencing and is also referred to as quelling in fungi. The process of post-transcriptional gene silencing is thought to be an evolutionarily-conserved cellular defense mechanism used to prevent the expression of foreign genes and is commonly shared by diverse flora and phyla. Such protection from foreign gene expression may have evolved in response to the production of double-stranded RNAs (dsRNAs) derived from viral infection or from the random integration of transposon elements into a host genome via a cellular response that specifically destroys homologous single-stranded RNA or viral genomic RNA.

The presence of long dsRNAs in cells stimulates the activity of a ribonuclease III enzyme referred to as dicer. Dicer is involved in the processing of the dsRNA into short pieces of dsRNA known as short interfering RNAs (siRNAs). Short interfering RNAs derived from dicer activity are typically about 21 to about 23 nucleotides in length and comprise about 19 base pair duplexes. The RNAi response also features an endonuclease complex, commonly referred to as an RNA-induced silencing complex (RISC), which mediates cleavage of single-stranded RNA having sequence complementary to the antisense strand of the siRNA duplex. Cleavage of the target RNA takes place in the middle of the region complementary to the antisense strand of the siRNA duplex.

Accordingly, the present invention contemplates use of dsRNA to down-regulate protein expression from mRNA.

According to one embodiment, the dsRNA is greater than 30 bp. The use of long dsRNAs can provide numerous advantages in that the cell can select the optimal silencing sequence alleviating the need to test numerous siRNAs; long dsRNAs will allow for silencing libraries to have less complexity than would be necessary for siRNAs.

In one embodiment of the present invention, the dsRNA is greater than 30 base-pairs, and is selected from the group complementary to a sequence as set forth in SEQ ID NOs: 55-59. In another embodiment of the present invention, the dsRNA is greater than 30 base pairs and comprises at least two sequences complementary to a sequence selected from group as set forth in SEQ ID NOs: 55-59. In yet another embodiment, the dsRNA comprises the sequence complementary to the sequence as set forth in SEQ ID NO: 59 and to a sequence as set forth in at least one of SEQ ID NOs: 57 and 58. In one embodiment of the present invention, the dsRNA comprises at least two sequences downregulating expression of a target *Nosema* gene, wherein the at least two sequences can be contiguous, or non-contiguous with respect to one another.

Another method of downregulating *Nosema* mitosomal and/or non-mitosomal proteins is by introduction of small inhibitory RNAs (siRNAs).

The term "siRNA" refers to small inhibitory RNA duplexes (generally between 18-30 basepairs, between 19 and 25 basepairs) that induce the RNA interference (RNAi) pathway. Typically, siRNAs are chemically synthesized as 21mers with a central 19 bp duplex region and symmetric 2-base 3'-overhangs on the termini, although it has been recently described that chemically synthesized RNA duplexes of 25-30 base length can have as much as a 100-fold increase in potency compared with 21mers at the same location. The observed increased potency obtained using longer RNAs in triggering RNAi is theorized to result from providing Dicer with a substrate (27mer) instead of a product (21mer) and that this improves the rate or efficiency of entry of the siRNA duplex into RISC.

It has been found that position of the 3'-overhang influences potency of an siRNA and asymmetric duplexes having a 3'-overhang on the antisense strand are generally more potent than those with the 3'-overhang on the sense strand (Rose et al., 2005). This can be attributed to asymmetrical strand loading into RISC, as the opposite efficacy patterns are observed when targeting the antisense transcript.

The strands of a double-stranded interfering RNA (e.g., an siRNA) may be connected to form a hairpin or stem-loop structure (e.g., an shRNA). Thus, as mentioned the RNA silencing agent of the present invention may also be a short hairpin RNA (shRNA).

The term "shRNA", as used herein, refers to an RNA agent having a stem-loop structure, comprising a first and second region of complementary sequence, the degree of complementarity and orientation of the regions being sufficient such that base pairing occurs between the regions, the first and second regions being joined by a loop region, the loop resulting from a lack of base pairing between nucleotides (or nucleotide analogs) within the loop region. The number of nucleotides in the loop is a number between and including 3 to 23, or 5 to 15, or 7 to 13, or 4 to 9, or 9 to 11. Some of the nucleotides in the loop can be involved in base-pair interactions with other nucleotides in the loop. Examples of oligonucleotide sequences that can be used to form the loop include 5'-UUCAAGAGA-3' (Brummelkamp, T. R. et al. (2002) Science 296: 550) and 5'-UUUGUGUAG-3' (Castanotto, D. et al. (2002) RNA 8:1454). It will be recognized by one of skill in the art that the resulting single chain oligonucleotide forms a stem-loop or hairpin structure comprising a double-stranded region capable of interacting with the RNAi machinery.

According to another embodiment the RNA silencing agent may be a miRNA. miRNAs are small RNAs made from genes encoding primary transcripts of various sizes. They have been identified in both animals and plants. The primary transcript (termed the "pri-miRNA") is processed through various nucleolytic steps to a shorter precursor miRNA, or "pre-miRNA." The pre-miRNA is present in a folded form so that the final (mature) miRNA is present in a duplex, the two strands being referred to as the miRNA (the strand that will eventually basepair with the target) The pre-miRNA is a substrate for a form of dicer that removes the miRNA duplex from the precursor, after which, similarly to siRNAs, the duplex can be taken into the RISC complex. It has been demonstrated that miRNAs can be transgenically expressed and be effective through expression of a precursor form, rather than the entire primary form (Parizotto et al. (2004) Genes & Development 18:2237-2242 and Guo et al. (2005) Plant Cell 17:1376-1386).

Unlike, siRNAs, miRNAs bind to transcript sequences with only partial complementarity (Zeng et al., 2002, Molec. Cell 9:1327-1333) and repress translation without affecting steady-state RNA levels (Lee et al., 1993, Cell 75:843-854; Wightman et al., 1993, Cell 75:855-862). Both miRNAs and siRNAs are processed by Dicer and associate with components of the RNA-induced silencing complex (Hutvagner et al., 2001, Science 293:834-838; Grishok et al., 2001, Cell 106: 23-34; Ketting et al., 2001, Genes Dev. 15:2654-2659; Williams et al., 2002, Proc. Natl. Acad. Sci. USA 99:6889-6894; Hammond et al., 2001, Science 293:1146-1150; Mourlatos et al., 2002, Genes Dev. 16:720-728). A report (Hutvagner et al., 2002, Sciencexpress 297:2056-2060) hypothesizes that gene regulation through the miRNA pathway versus the siRNA pathway is determined solely by the degree of complementarity to the target transcript. It is speculated that siRNAs with only partial identity to the mRNA target will function in translational repression, similar to an miRNA, rather than triggering RNA degradation.

According to one embodiment of the present invention, the nucleic acid agent is capable of causing cleavage and/or degradation of a Nosema mitosomal and/or non-mitosomal target polynucleotide sequence. As used herein, the phrases "target" or "target polynucleotide sequence" refer to any sequence present in a Nosema cell, whether naturally occurring sequence or a heterologous sequence present due to an intracellular or extracellular pathogenic infection or a disease (e.g. Nosemosis), which *Nosema* mitosomal or non-mitosomal polynucleotide sequence has a function that is desired to be reduced or inhibited. The *Nosema* target sequence may be a coding sequence, that is, it is translated to express a protein or a functional fragment thereof. Alternatively, the target sequence may be non-coding, but may have a regulatory function, or it may be without any known function. As described herein, one target polynucleotide sequence is a *Nosema* mitosomal polynucleotide sequence necessary for proteins involved in energy transfer, such as that of *Nosema* mitosomal ATP transporter homologues or metabolite import proteins, combinations of the same, alone or in combination with polynucleotide sequences targeting *Nosema* non-mitosomal proteins such as non-mitosomal ATP/ADP transporter homologues. The term "gene" is intended to include any target sequence intended to be "silenced", whether or not transcribed and/or translated, including regulatory sequences, such as promoters, enhancers and other non-coding sequences.

In one embodiment of the present invention, synthesis of RNA silencing agents suitable for use with the present invention can be effected as follows. First, the *Nosema* polypeptide mRNA or other target sequence is scanned downstream of the AUG start codon for AA dinucleotide sequences. Occurrence of each AA and the 3' adjacent 19 nucleotides is recorded as potential siRNA target sites. Preferably, siRNA target sites are selected from the open reading frame, as untranslated regions (UTRs) are richer in regulatory protein binding sites. UTR-binding proteins and/or translation initiation complexes may interfere with binding of the siRNA endonuclease complex [Tuschl ChemBiochem. 2:239-245]. It will be appreciated though, that siRNAs directed at untranslated regions may also be effective, as demonstrated for GAPDH wherein siRNA directed at the 5' UTR mediated about 90% decrease in cellular GAPDH mRNA and completely abolished protein level (see Ambion technical library 91/912 at the Ambion website).

Second, potential target sites are compared to an appropriate genomic database (e.g., human, mouse, rat, insect, etc.) using any sequence alignment software, such as the BLAST software available from the NCBI server of the NIH. Putative target sites which exhibit significant homology to other coding sequences are filtered out. For example, host (e.g. bee) target sites can be filtered out in this manner. Qualifying target sequences are selected as template for siRNA synthesis.

Preferred sequences are those including low G/C content as these have proven to be more effective in mediating gene silencing as compared to those with G/C content higher than 55%. Several target sites are preferably selected along the length of the target gene or sequence for evaluation. For better evaluation of the selected siRNAs, a negative control is preferably used in conjunction. Negative control siRNA preferably include the same nucleotide composition as the siRNAs but lack significant homology to the genome. Thus, a scrambled nucleotide sequence of the siRNA is preferably used, provided it does not display any significant homology to host gene sequences, or non-relevant *Nosema* target sequences.

For example, a suitable *Nosema* siRNA can be an *Nosema* specific siRNA corresponding to *Nosema ceranae* sequences SEQ ID NOs: 27, 47 and 46. Additional suitable *Nosema* siRNAs can be designed according to sequences from any *Nosema*, for example, including, but not limited to *Nosema apis, Nosema bombi, Nosema bombycis, Nosema antheraeae, E. cuniculi* and the like. According to one specific embodiment, the *Nosema* mitosomal target sequences are ADP/ATP transporter homologue 123 and/or the mitosomal metabolite transport protein TOM 70, and any or all of the non-mitosomal ADP/ATP transporter homologues, Nc 006, Nc 014 and Nc 017. Primer sequences for producing nucleic acid agents for silencing these genes are detailed in Table 1.

TABLE 1

*Nosema- specific dsRNA sequences for silencing ATP/ADP transporter homologues and TOM70 and the primer sequences used to make them*

```
Primer name
ADP/ATP TRANSPORTER    Sequence
PROTEIN HOMOLOGUE      (SEQ ID NO)

NA7001 T7 Nc006 F     CTAATACGACTCACTATAGGGAGACAGCTAACGAGCCCGTTTC
                      (SEQ ID NO: 1)

NA7002 T7 Nc006 R     CTAATACGACTCACTATAGGGAGACCATAGTAATCCATCCACTAC
                      (SEQ ID NO: 2)

NA7003 T7 Nc123 F     CTAATACGACTCACTATAGGGAGACTGGTCTTTAACGAATGGAC
                      (SEQ ID NO: 3)

NA7004 T7 Nc123 R     CTAATACGACTCACTATAGGGAGAGTGGGCACGCTATGGCAAC
                      (SEQ ID NO: 4)

NA7005 T7 Nc014 F     CTAATACGACTCACTATAGGGAGACTCCTGGACAGTCCGCTAG
                      (SEQ ID NO: 5)

NA7006 T7 Nc014 R     CTAATACGACTCACTATAGGGAGAATCAGTTGACGGTAAACGG
                      (SEQ ID NO: 6)

NA7007 T7 Nc017 F     CTAATACGACTCACTATAGGGAGAGCTTGATGGGCTTATCTCC
                      (SEQ ID NO: 7)

NA7008 T7 Nc017 R     CTAATACGACTCACTATAGGGAGAGCAATGCGATTTCCACGG
                      (SEQ ID NO: 8)

TOM-70 PROTEIN

NT7009 T7 TOM70 F     CTAATACGACTCACTATAGGGAGACTGAATGTTACAAGCAGATGGG
                      (SEQ ID NO: 9)

NT7015 TOM70 R        CTAATACGACTCACTATAGGGAGAACCAGGAGTATCTGGATGAC
                      (SEQ ID NO: 10)
```

*Note:
The *Nosema* specific sequences are in plain font.

Additional suitable *Nosema* siRNAs can be designed according to sequences from any *Nosema* sequence, for example, the sequences detailed herein, including, but not limited to TOM70 (for example, SEQ ID NOs:60-11687), TIM22, TOM40 (for example, SEQ ID NOs: 11688-19103), Imp2, mitochondrial Hsp70 (for example, SEQ ID NOs: 19104-34511), ATM1-ABC transporter proteins (for example, SEQ ID NOs: 34512-80411), Frataxin, Ferredoxin, ERV1 (for example, SEQ ID NOs: 80412-84803), ferredoxin, NADPH oxido-reductase [FNR] (for example, SEQ ID NOs: 84804-94911, 94912-108140), pyruvate dehydrogenase α subunit (for example, SEQ ID NOs: 108141-116852), pyruvate dehydrogenase β subunit (for example, SEQ ID NOs: 116853-125294), mitochondrial glycerol-3-phosphate dehydrogenase (mtG3PDH) (for example, SEQ ID NOs: 125295-140999), manganese-containing superoxide dismutase (Mn-SOD) (for example, SEQ ID NOs: 141000-146687), DNAJ (Hsp70 interacting) (for example, SEQ ID NOs: 146688-157505), Iron Sulfur cluster ISU1, Cystein desulfurase Nsf1 (for example, SEQ ID NOs: 157506-169079), NAR1 (for example, SEQ ID NOs:169080-178790), RLI1 (for example, SEQ ID NOs:178791-195062), NC006 (for example, SEQ ID NOs: 195063-209633, NC123 (for example, SEQ ID NOs: 209634-224609), NC014 (for example, SEQ ID NOs: 224610-239747) and NC017 (for example, SEQ ID NOs: 239748-252698)(see Table 2, below).

TABLE 2

*Nosema* Proteins suitable for targeting with dsRNA

| | Encephalitozoon GenBank (protein) | *Nosema* GenBank (protein) | *Nosema* GenBank (DNA)/ coordinates | SEQ ID NO: |
|---|---|---|---|---|
| TOM70 | | EEQ82075.1 | ACOL01000120/8001-9314 | SEQ ID NO: 27 |
| TIM22 | CAD25556.1 | — | | |
| TOM40 | CAD25408.1 | EEQ82411.1 | ACOL01000061/14217-15062 | SEQ ID NO: 28 |
| Imp2 | | | | |
| mitochondrial Hsp70 | NP_586360 | EEQ81757 | ACOL01000228.1/4051-5784 | SEQ ID NO: 29 |
| ATM1-ABC transporter | CAD26030 | EEQ82581.1 | ACOL01000042/1310-3019 | SEQ ID NO: 30 |

TABLE 2-continued

Nosema Proteins suitable for targeting with dsRNA

| | Encephalitozoon GenBank (protein) | Nosema GenBank (protein) | Nosema GenBank (DNA)/ coordinates | SEQ ID NO: |
|---|---|---|---|---|
| proteins | | EEQ82586.1 | ACOL01000042/8786-10507 | SEQ ID NO: 31 |
| | | EEQ82587.1 | ACOL01000042/10905-12638 | SEQ ID NO: 32 |
| Frataxin | XP_965969 | — | | |
| Ferredoxin | NP_585988.1| | — | | |
| ERV1 | CAD25469 | EEQ82883 | ACOL01000016/5063-5572 | SEQ ID NO: 33 |
| ferredoxin NADPH oxido-reductase [FNR] | CAD27143 | EEQ81930 | ACOL01000159/6191-7324 | SEQ ID NO: 34 |
| | | EEQ83026 | ACOL01000006/2688-4190 | SEQ ID NO: 35 |
| pyruvate dehydrogenase subunits, PDHα and -β | CAD27078 | EEQ82465 | ACOL01000055/12839-13828 | SEQ ID NO: 36 |
| | CAD25304 | EEQ81634 | ACOL01000316/888-1847 | SEQ ID NO: 37 |
| mitochondrial glycerol-3-phosphate dehydrogenase (mtG3PDH) | CAD25806 | EEQ82606 | ACOL01000039/538-2304 | SEQ ID NO: 38 |
| manganese-containing superoxide dismutase (MnSOD) | CAD26018 | EEQ82623 | ACOL01000038/17225-17878 | SEQ ID NO: 39 |
| DNAJ (Hsp70 interacting) | Q8SRK0 | EEQ82425 | ACOL01000059/6412-7635 | SEQ ID NO: 40 |
| Iron Sulfur cluster ISU1 | Q8SSM2 | — | | |
| Cystein desulfurase Nsf1 | Q8SQS2 | EEQ82825 | ACOL01000020/5924-7231 | SEQ ID NO: 41 |
| Critical Fe/S cytosolic proteins | | | | |
| NAR1 | NP_597440.1 | EEQ82578 | ACOL01000043/12613-13713 | SEQ ID NO: 42 |
| RLI1 | | EEQ83099 | ACOL01000003/27828-29657 | SEQ ID NO: 43 |
| ATP/ADP Transporter homologues | | | | |
| Nc006 | | EEQ83030.1 | ACOL01000006/9068-10708 | SEQ ID NO: 44 |
| Nc123 | | EEQ82057.1 | ACOL01000123/4795-6480 | SEQ ID NO: 45 |
| Nc014 | | EEQ82913.1 | ACOL01000014/4714-6417 | SEQ ID NO: 46 |
| Nc017 | | EEQ82872.1 | ACOL01000017/9811-11271 | SEQ ID NO: 47 |

It will be appreciated that the dsRNA sequences target RNA transcripts complementary to DNA sequences of the targeted gene which are expressed in the parasite (transcribed into RNA), and that the actual complementation taking place in the RNAi pathways occurs following reduction of the dsRNA to smaller fragments by the RNAi enzymes.

Multiple Nosema sequences can be designed to include sequences suitable for producing siRNAs effective against more than one Nosema species. Such multiple Nosema dsRNA can be of the long or short variety, and may also be combined with sequences corresponding to diverse classes of pathogens (e.g. viral and/or bacterial and/or fungal sequences, etc). Further, multiple sequences can be designed to include two or more dsRNA sequences of the same Nosema parasite.

It will be appreciated that the RNA silencing agent of the present invention need not be limited to those molecules containing only RNA, but further encompasses chemically-modified nucleotides and non-nucleotides.

In some embodiments, the RNA silencing agent provided herein can be functionally associated with a cell-penetrating peptide. As used herein, a "cell-penetrating peptide" is a peptide that comprises a short (about 12-30 residues) amino acid sequence or functional motif that confers the energy-independent (i.e., non-endocytotic) translocation properties associated with transport of the membrane-permeable complex across the plasma and/or nuclear membranes of a cell. The cell-penetrating peptide used in the membrane-permeable complex of the present invention preferably comprises at least one non-functional cysteine residue, which is either free or derivatized to form a disulfide link with a double-stranded ribonucleic acid that has been modified for such linkage. Representative amino acid motifs conferring such properties are listed in U.S. Pat. No. 6,348,185, the contents of which are expressly incorporated herein by reference. The cell-penetrating peptides of the present invention preferably include, but are not limited to, penetratin, transportan, pIsl, TAT (48-60), pVEC, MTS, and MAP.

Another agent capable of downregulating a *Nosema* polypeptide is a DNAzyme molecule capable of specifically cleaving an mRNA transcript or DNA sequence of the *Nosema* polypeptide. DNAzymes are single-stranded polynucleotides which are capable of cleaving both single and double stranded target sequences (Breaker, R. R. and Joyce, G. Chemistry and Biology 1995; 2:655; Santoro, S. W. & Joyce, G. F. Proc. Natl, Acad. Sci. USA 1997; 943:4262) A general model (the "10-23" model) for the DNAzyme has been proposed. "10-23" DNAzymes have a catalytic domain of 15 deoxyribonucleotides, flanked by two substrate-recognition domains of seven to nine deoxyribonucleotides each. This type of DNAzyme can effectively cleave its substrate RNA at purine:pyrimidine junctions (Santoro, S. W. & Joyce, G. F. Proc. Natl, Acad. Sci. USA 199; for rev of DNAzymes see Khachigian, L M [Curr Opin Mol Ther 4:119-21 (2002)].

Examples of construction and amplification of synthetic, engineered DNAzymes recognizing single and double-stranded target cleavage sites have been disclosed in U.S. Pat. No. 6,326,174 to Joyce et al. Downregulation of *Nosema* polypeptides or cleavage of *Nosema* RNA can also be effected by using an antisense polynucleotide capable of specifically hybridizing with an mRNA transcript encoding the *Nosema* polypeptide or a *Nosema* RNA target sequence.

Design of antisense molecules which can be used to efficiently downregulate a *Nosema* polypeptide must be effected while considering two aspects important to the antisense approach. The first aspect is delivery of the oligonucleotide into the cytoplasm of the appropriate cells, while the second aspect is design of an oligonucleotide which specifically binds the designated mRNA or RNA target sequence within cells in a way which inhibits translation thereof.

A number of delivery strategies which can be used to efficiently deliver oligonucleotides into a wide variety of cell types have been disclosed [see, for example, Luft J Mol Med 76: 75-6 (1998); Kronenwett et al. Blood 91: 852-62 (1998); Rajur et al. Bioconjug Chem 8: 935-40 (1997); Lavigne et al. Biochem Biophys Res Commun 237: 566-71 (1997) and Aoki et al. (1997) Biochem Biophys Res Commun 231: 540-5 (1997)]. Several approaches for designing and predicting efficiency of specific oligonucleotides using an in vitro system were also published (Matveeva et al., Nature Biotechnology 16: 1374-1375 (1998)].

For example, a suitable antisense oligonucleotide targeted against the *Nosema* mRNA would be of the sequences complementary to sequences as set forth in SEQ ID NOs: 27, 46 and 47.

Thus, the current consensus is that recent developments in the field of antisense technology which, as described above, have led to the generation of highly accurate antisense design algorithms and a wide variety of oligonucleotide delivery systems, enable an ordinarily skilled artisan to design and implement antisense approaches suitable for downregulating expression of known sequences without having to resort to undue trial and error experimentation.

Another agent capable of downregulating a *Nosema* polypeptide is a ribozyme molecule capable of specifically cleaving an mRNA transcript encoding a *Nosema* polypeptide. Ribozymes are being increasingly used for the sequence-specific inhibition of gene expression by the cleavage of mRNAs encoding proteins of interest [Welch et al., Curr Opin Biotechnol. 9:486-96 (1998)]. Ribozymes have been identified in insects (Webb et al, Science 2009; 326:953), and used effectively for gene silencing in insects (Lee et al, FASEB J 2001; 15:2390-400).

An additional method of regulating the expression of a *Nosema* polypeptide gene in cells is via triplex forming oligonucleotides (TFOs). Recent studies have shown that TFOs can be designed which can recognize and bind to polypurine/polypyrimidine regions in double-stranded helical DNA in a sequence-specific manner. These recognition rules are outlined by Maher III, L. J., et al., Science, 1989; 245:725-730; Moser, H. E., et al., Science, 1987; 238:645-630; Beal, P. A., et al, Science, 1992; 251:1360-1363; Cooney, M., et al., Science, 1988; 241:456-459; and Hogan, M. E., et al., EP Publication 375408. Detailed description of the design, synthesis and administration of effective TFOs can be found in U.S. Patent Application Nos. 2003 017068 and 2003 0096980 to Froehler et al, and 2002 0128218 and 2002 0123476 to Emanuele et al, and U.S. Pat. No. 5,721,138 to Lawn.

The RNA, dsRNA, siRNA, or miRNA of the present invention may be produced chemically or enzymatically through manual or automated reactions or in vivo in an organism. RNA may also be produced by partial or total organic synthesis. Any modified ribonucleotide can be introduced by in vitro enzymatic or organic synthesis. The RNA may be synthesized by a cellular RNA polymerase or a bacteriophage RNA polymerase (e.g., T3, T7, SP6). If synthesized chemically or by in vitro enzymatic synthesis, the RNA may be purified prior to feeding or formulated in an acceptable carrier and provided as a liquid, solid or semi-solid to the bees. For example, RNA can be purified from a mixture by extraction with a solvent or resin, precipitation, electrophoresis, chromatography, or a combination thereof. Alternatively, the RNA may be used with no, or a minimum of, purification to avoid losses due to sample processing. The RNA may be dried for storage or dissolved in an aqueous solution. The solution may contain buffers or salts to promote annealing, and/or stabilization of the duplex strands.

It will be appreciated that mechanisms other than dsRNA for targeting the *Nosema* ATP/ADP transporter homologues, or other mitosomal and non-mitosomal proteins can effectively block gene expression in the parasite, and therefore potentially reduce *Nosema* levels, severity of symptoms and contagiousness in the host bees. Any molecules capable of traversing the membrane of bee mucosal epithelial cells and able to disrupt *Nosema* mitosomal (such as a mitosomal ATP/ADP homologue or TOM) or non-mitosomal (such as a non-mitosomal ATP/ADP homologue) expression or activity, could potentially enter the *Nosema* parasite in the intracellular stage, and reduce infection levels and severity of symptoms in infected host bees. Examples of such drugs are small molecules, peptides, enzymes that interact with the ATP-ADP transporters such as kinase or phosphatase enzymes.

For transcription from a transgene in vivo or from an expression cassette, a regulatory region (e.g., promoter, enhancer, silencer, leader, intron and polyadenylation) may be used to modulate the transcription of the RNA strand (or strands). Therefore, in one embodiment, there is provided a nucleic acid construct comprising the nucleic acid agent. The nucleic acid construct can have polynucleotide sequences constructed to facilitate transcription of the RNA molecules of the present invention are operably linked to one or more promoter sequences functional in a host cell. The polynucleotide sequences may be placed under the control of an endogenous promoter normally present in the host genome. The polynucleotide sequences of the present invention, under the control of an operably linked promoter sequence, may further be flanked by additional sequences that advantageously affect its transcription and/or the stability of a resulting transcript. Such sequences are generally located upstream of the promoter and/or downstream of the 3' end of the expression construct. The term "operably linked", as used in reference to a regulatory sequence and a structural nucleotide sequence, means that the regulatory sequence causes regulated expression of the linked structural nucleotide sequence. "Regulatory sequences" or "control elements" refer to nucleotide sequences located upstream, within, or downstream of a structural nucleotide sequence, and which influence the timing and level or amount of transcription, RNA processing or stability, or translation of the associated structural nucleotide sequence. Regulatory sequences may include promoters, translation leader sequences, introns, enhancers, stem-loop structures, repressor binding sequences, termination sequences, pausing sequences, polyadenylation recognition sequences, and the like.

The nucleic acid agent can be delivered to the bees in a great variety of ways. As detailed herein, bee feeding is common practice amongst bee-keepers, for providing both nutritional and other, for example, supplemental needs. Bees typically feed on honey and pollen, but have been known to ingest non-natural feeds as well. Bees can be fed various foodstuffs including, but not limited to Wheast (a dairy yeast grown on cottage cheese), soybean flour, yeast (e.g. brewer's yeast, torula yeast) and yeast products products-fed singly or in combination and soybean flour fed as a dry mix or moist cake inside the hive or as a dry mix in open feeders outside the hive. Also useful is sugar, or a sugar syrup. The addition of 10 to 12 percent pollen to a supplement fed to bees improves palatability. The addition of 25 to 30 percent pollen improves the quality and quantity of essential nutrients that are required by bees for vital activity.

Cane or beet sugar, isomerized corn syrup, and type-50 sugar syrup are satisfactory substitutes for honey in the natural diet of honey bees. The last two can be supplied only as a liquid to bees.

Liquid feed can be supplied to bees inside the hive by, for example, any of the following methods: friction-top pail, combs within the brood chamber, division board feeder, boardman feeder, etc. Dry sugar may be fed by placing a pound or two on the inverted inner cover. A supply of water must be available to bees at all times. In one embodiment, pan or trays in which floating supports-such as wood chips, cork, or plastic sponge-are present are envisaged. Detailed descriptions of supplemental feeds for bees can be found in, for example, USDA publication by Standifer, et al 1977, entitled "Supplemental Feeding of Honey Bee Colonies" (USDA, Agriculture Information Bulletin No. 413).

It will be appreciated that the dosing and treatment regimen of *Nosema*-specific nucleic acid agent can be optimized by the individual user according to host sub-species, weather conditions, stage in the life cycle of the host and/or parasite, host environmental conditions, etc. For example, the nucleic acid agent can be provided to the bees constantly, throughout the hives' lifetime, or according to a predetermined schedule of feeding.

All the bees in a hive are potentially susceptible to the *Nosema* infections detailed herein. Thus, according to some embodiments, the bees can be forager bees, hive bees and the like.

Also provided is a method for reducing the susceptibility of a bee to a disease caused by *Nosema*, the method effected by feeding the bee on an effective amount of a nucleic acid or nucleic acid construct comprising a nucleic acid agent downregulating expression of a *Nosema* mitosomal and/or non-mitosomal polypeptide and/or causing cleavage and/or degradation of a *Nosema* mitosomal or non-mitosomal RNA. Methods for reducing the susceptibility of a bee colony or bee-hive to *Nosema* infection or epidemic by feeding oligonucleotides and/or polynucleotides are envisaged. Thus, in some embodiments, the present invention can be used to benefit any numbers of bees, from a few in the hive, to the entire bee population within a hive and its surrounding area. It will be appreciated, that in addition to feeding of oligonucleotides and/or polynucleotides for reduction of the *Nosema* infection and infestation, enforcement of proper sanitation (for example, refraining from reuse of infested hives) can augment the effectiveness of treatment and prevention of infections.

It is expected that during the life of a patent maturing from this application many relevant methods for downregulating *Nosema* proteins will be developed and the scope of the term "downregulating *Nosema* protein" or "downregulating *Nosema* polypeptide" is intended to include all such new technologies a priori.

As used herein the term "about" refers to ±10%.

The terms "comprises", "comprising", "includes", "including", "having" and their conjugates mean "including but not limited to". This term encompasses the terms "consisting of" and "consisting essentially of".

The phrase "consisting essentially of" means that the composition or method may include additional ingredients and/or steps, but only if the additional ingredients and/or steps do not materially alter the basic and novel characteristics of the claimed composition or method.

As used herein, the singular form "a", "an" and "the" include plural references unless the context clearly dictates otherwise. For example, the term "a compound" or "at least one compound" may include a plurality of compounds, including mixtures thereof.

Throughout this application, various embodiments of this invention may be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Whenever a numerical range is indicated herein, it is meant to include any cited numeral (fractional or integral) within the indicated range. The phrases "ranging/ranges between" a first indicate number and a second indicate number and "ranging/ranges from" a first indicate number "to" a second indicate number are used herein interchangeably and are meant to include the first and second indicated numbers and all the fractional and integral numerals therebetween.

As used herein the term "method" refers to manners, means, techniques and procedures for accomplishing a given task including, but not limited to, those manners, means, techniques and procedures either known to, or readily developed from known manners, means, techniques and procedures by practitioners of the chemical, pharmacological, biological, biochemical and medical arts.

As used herein, the term "treating" includes abrogating, substantially inhibiting, slowing or reversing the progression of a condition, substantially ameliorating clinical or aesthetical symptoms of a condition or substantially preventing the appearance of clinical or aesthetical symptoms of a condition.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable subcombination or as suitable in any other described embodiment of the invention. Certain features described in the context of various embodiments are not to be considered essential features of those embodiments, unless the embodiment is inoperative without those elements.

Various embodiments and aspects of the present invention as delineated hereinabove and as claimed in the claims section below find experimental support in the following examples.

EXAMPLES

Reference is now made to the following examples, which together with the above descriptions illustrate some embodiments of the invention in a non limiting fashion.

Materials and Methods

Plastic Box Protocol

Experimental Regimen

Bees were introduced into boxes (30-35 bees to each box) at study day 0, and placed in a room kept at a constant temperature of 25° C., 70% relative humidity and 12 hour light/dark cycle.

Nurse bees were collected from the entrance of a honeybee colony that was previously checked and no *N. ceranae* detected in the older forager bees. The bees were placed for several minutes in the cold to reduce activity. Subsequently, 30-35 bees were transferred into each box. The bees were observed during the first 2 days to determine stability in the boxes (i.e. no visible changes in the population). At study day 3 daily feeding of the treatment groups was initiated. The indicated amounts of all treatment components were added to the 66% sugar solution. All boxes were then monitored for bees' survival for up to an additional 21 days.

The boxes were then allocated randomly and equally to each treatment group.

Bees in the boxes were fed a sucrose syrup via a capillary tube sealed at its top end, thus avoiding drippage and enabling supply of feed upon demand. One feeding capillary tube was placed in each box.

Acclimation and Inclusion Criteria

The feeding capillaries were filled with 1.5 milliliters of 66% sucrose solution (w/v) and placed into the boxes (one in each box). The bees were then left for a 2 day acclimation period. During the acclimation period—any dead bees from the initial collection process were replaced with newly captured bees. At the end of the 2 days, only boxes in which the honeybees consumed the sucrose solution were included in the trial.

Treatment Groups

Untreated infected (control): Fed 66% w/v sucrose solution then infected with U.S. *Nosema Ceranae* (>100,000 per bee), on study day 5. The bees were subsequently fed 50 microliter per bee 66% sucrose solution for another 12-14 days.

Treatment group (all four ATP/ADP transporter dsRNA sequences): Fed regular 66% w/v sucrose solution then infected with U.S. *Nosema Ceranae* (>100,000 per bee), either 10 days or 3 days after acclimation. The bees were subsequently fed 50 microliter per bee 66% sucrose solution for another 12-14 days, containing 20 ug/ml of each of 4 *Nosema* ATP/ADP transporter sequence dsRNA (complementary to sequences as set forth in SEQ ID NOs. 55-58)

Evaluation Methods

Visual Inspection—Survival Rate at the End of the Experiment

Following administration of treatment solutions to bees' boxes at study day 3, each day the bees in each box are visually inspected and the number of dead bees counted in each box.

Hunger Levels—Proboscis Extension Response

Bees infected with *Nosema* show increased hunger level that is typified by increased responsiveness to sugar. Specifically, bees infected with *Nosema* show a lower threshold level of responsiveness to sugar in a Proboscis Extension Reflex assay.

At the end of the feeding regimen in the boxes or minihives, bees were placed for 5 minutes in a freezer, captured individually and individually placed in a glass vial and chilled on ice until immobile. Then they were strapped within a 4.5 cm long plastic drinking straw with a small strip of tape on the thorax. Testing begins 45 minutes after the last bee is strapped to allow the bees to get acclimated and 24 bees are tested at a time. The antennae of a strapped bee was touched with a droplet of sucrose and proboscis extension response [response is full extension of the proboscis—a Proboscis Extension Response (PER)]—is recorded. Each bee is assayed for PER with a concentration series of 0.1%, 0.3%, 1%, 3%, 10%, and 30% sucrose solution by weight. In between every two successive concentrations, the antennae are touched with water to control for possible sensitization from repeated stimulation.

*Nosema* Spore Counts

Each day, all the dead bees were removed from each box, pooled according to treatment and total nosema spore counts were performed with 100 microliter water per crushed bee. *Nosema* counts were performed essentially as described previously by Cantwell et al: Briefly, bee abdomens were ground with a glass pestle, vigorously mixed with 1.5-2.0 ml water, and sampled (10 µl) into a hemacytometer for counting. Total number of *Nosema* under the microscope were counted for 16 small squares (or one large square). The average *Nosema* spore count per bee was calculated as follows: (total number of spores counted) (4,000,000)/number of squares counted=number of spores per bee.

dsRNA Preparation:

*Nosema* sequences corresponding to mitosomal and non-mitosomal proteins associated with energy metabolism and ATP/ADP transport (SEQ ID NOs: 27, 44, 45, 46 and 47) were cloned into a plasmid between two opposing T7 promoters. Following propagation of plasmid DNA, the viral fragments, including the T7 promoters, were excised, gel-purified, and served as templates for T7-directed in-vitro transcription.

Real Time PCR

Preparation of Samples:

Only live bees were collected, to a 15 ml collection tube. The tubes were frozen immediately in liquid nitrogen and transferred to −70 c. Standard curves were generated for each reaction, specific curves for each gene. The standard curves were based on known concentration of plasmids suspensions, cloned with the fragments amplified by each tested gene specific primers. The standard curves allow the calculation of the relative arbitrary number of mRNA copies from each tested gene.

The relative expression levels for each gene were calculated as the number of arbitrary copies of the tested gene in each sample divided by the arbitrary mRNA arbitrary copy number of a *Nosema ceranae* housekeeping gene (e.g. tubulin or actin). Mean and standard error values were calculated for each sample and sets of repeats, according to the experimental design.

Values of each treatment were featured as the relative expression from the control treatment at study day 0, and are given the 100% expression level. Mean and standard error values were calculated for each sample and sets of repeats, according to the experiment design, and standard statistics analysis. The desired fragments were reverse transcribed and amplified from RNA isolates of *Nosema*-infected bees. The pLUG plasmids were generated using the pLUG(R)-Multi TA cloning vector kit from iNTRON Biotechnology (Gyeonggi-do, Korea), according to the manufacturer's protocol. The RT amplified fragments were ligated into the plasmids and the ligated plasmids transformed into Top10 *E. coli* competent cells, using heat shock transformation. The Top10 competent cells were incubated on LB agar plates containing 200 ug/ml Ampicillin and blue/white selection reagent. Colonies that grew and were positive were tested for presence of the insert using PCR amplification with the forward primer from the desired insert and the reverse primer from the pLUG plasmid. Positive colonies were grown in LB medium supplemented with 200 ug\ml ampicillin. The pLUG plasmids were purified from the top10 *E. Coli* cells, using the IBI High speed plasmid mini kit (IBI Scientific, IOWA, USA), according to the manufacturer's protocol.

Real-time PCR Protocol

1. RNA extraction from at least 3 stomachs of bees using peqGOLD Trifast, (Peqlab, Delaware, USA)
2. 8 ul of the RNA sample was removed and diluted to a total volume of 10 ul, for DNAse I treatment, 30 min in 37° C. (remainder stored at −70° C. for future use).
3. 2 ul of the DNAse-treated RNA was diluted to 1:5 and used as template for the RT PCR reaction.
4. AB HIGH CAPACITY cDNA RT KIT 200RXN+2× RNAse INHIBITOR (Applied Biosystems, California, USA, cat: 4374966) was used.
   The cDNA was diluted 1:5 to a final volume of 100 ml using Nuclease Free ddH2O and stored until use at −20° C.
5. During the qPCR reaction AB POWER SYBR GREEN PCR MIX 5 ML (Applied Biosystems, California, USA cat: 4367659) was used according to the following protocol:

| Component | Final Conc. | x1 Volume (μl) |
|---|---|---|
| Power SYBR Green PCR Master Mix (2X) | 1x | 7.5 |
| Forward Primer (10 uM) | 500 nm | 0.5 |
| Reverse Primer (10 uM) | 500 nm | 0.5 |
| Template | 1-100 ng | 2 |
| Water | | 4.5 |
| Total | | 15 |

Primers

| NAME | Target | Orientation | Sequence (SEQ ID NO) |
|---|---|---|---|
| B90111 | Honeybee Actin | Forward | AGGAATGGAAGCTTGCGGTA (SEQ ID NO: 11) |
| B90121 | Honeybee Actin | Reverse | AATTTTCATGGTGGATGGTGC (SEQ ID NO: 12) |
| Ntub7025 | *Nosema C.* Tubulin | Forward | AGAACCAGGAACGATGGAGA (SEQ ID NO: 13) |
| Ntub7026 | *Nosema C.* Tubulin | Reverse | TCCTTGCAAACAATCTGCAC (SEQ ID NO: 14) |
| NA70011 | Nc006 F | Forward | CACCTGAAAACAACTTACCTAC (SEQ ID NO: 15) |
| NA70021 | Nc006 R | Reverse | GTATCTTGCCTTACCATCAC (SEQ ID NO: 16) |
| NA70031a | Nc123 F | Forward | GGaAAAGAtGAGAATATGGAAGAAG (SEQ ID NO: 17) |
| NA70041b | Nc123 R | Reverse | CCAGTTACCCTTGTTTGTGTAGG (SEQ ID NO: 18) |

All reactions were carried out according to a thermal protocol consisting of 5 min at 95° C., then 40 cycles of the four-step protocol consisting of 94° C. 20 seconds, 60° C. 30 seconds, 72° C. 1 minute and 78° C. 20 seconds. Fluorescence was monitored repeatedly during the 78° C. step, in order to reduce fluorescence from primer artifacts.

Mini-Hive Experiments

Bees were introduced into minihives (~300 bees to each hive) at study day 0.

Nurse bees were collected from within a honeybee colony that was previously checked and found to have no *N. ceranae*. The bees were transferred into every mini-hive containing a queen in a cage, approximately 300 bees in each mini-hive, 5 grams protein patty, and 5 grams candy.

The bees were observed during the first 2 days to determine stability in the minihives (i.e. no drastic changes in the population). At study day 3 daily feeding of sucrose syrup were initiated according to the treatment groups.

1. Untreated infected: The bees were fed 15 ml per hive (50 µl per bee) per day 66% sucrose solution.
2. Treatment group Bees were fed with 15 ml per hive (50 µl per bee) per day 66% sucrose solution supplemented with Nosema mitosomal and/or non-mitosomal dsRNA.

All mini-hives were monitored until egg laying by the queen is initiated. Only hives that accepted the new queen, take in the syrup treatments and have the queen initiate egg laying are included in the trial.

The mini-hive boxes are placed in a room kept at a constant temperature of 30° C., and in constant darkness. The sucrose syrup with or without treatment is fed via a petri dish placed at the bottom of the mini-hive.

Following administration of treatment solutions to bees minihives at study day 3, each day the bees in each box were visually inspected to ensure the stability of the system. In all mini-hives, the queens layed eggs as required for inclusion criteria. At day 10, when the bees were infected with Nosema ceranae (approximately 100,000 spores per bee), once daily photographs were taken to record bee survival on both sides of each comb. The number of bees in each mini-hive was calculated by counting the bees on the screen from both sides of the single comb in the mini-hive.

Differential Effect of ATP/ADP Transporter dsRNA Sequences on Gene Real-time PCR Transcript Levels Nurse bees were collected from a hive found to be without N. ceranae. Set up as described above.

Five treatment groups were defined, three hives of 30 bees per group-total 90 bees per group. Total of 15 minihives were included. Allocation to treatment groups was assigned arbitrarily on day 0. Daily feeding of 50 micoliters per bee 66% w/v sucrose solution with 1 microgram per bee each dsRNA of ATP/ADP transporters. Infection with Nosema was initiated on day 3. The five treatment groups were:

1. Control, Untreated, infected
2. Infected+NC006 dsRNA (complementary to SEQ ID NO: 55) only
3. Infected+NC123 dsRNA (complementary to SEQ ID NO: 56) only
4. Infected+NC006 dsRNA+NC123 dsRNA (complementary to SEQ ID NO: 55 and complementary to SEQ ID NO: 56)
5. Infected+dsRNA of each of all four ATP/ADP N.C. transporters (complementary to each of SEQ ID NOs: 55-58)

The plastic boxes were placed in a room kept at a constant temperature of 25° C., 70% RH and 12 hour light/dark cycle. Feeding was as described for the Bee Box protocol above.

Live bees were collected at day 0 and at day 13 after infection. From each box, bees were pooled into groups of 3 bees (3×3 pools per hive, total 9 samples from each treatment), and RNA was extracted separately for each group, as described above.

Example 1

Nosema ceranae Genome Homologues to ATP/ADP Transporter Proteins Found in Encephalitozoon cuniculi The N. ceranae genome has been published. FIG. 1 shows a sequence alignment between the mitosomal and non-mitosomal ATP transporter proteins found in Encephalitozoon cuniculi and four homologues identified in N. ceranae.

Example 2 dsRNA Targeting Nosema Mitosomal and Non-mitosomal ATP/ADP Transporter Homologues Reduces Nosema Spore Counts and Mortality Following Infection Since Nosema rarely reduces nurse bee lifespan in box experiments due to the feeding of the bees ad-libitum (not shown), indicators for reduced lifespan are best achieved in a hive setting. In our box experiments, no difference was observed in forager lifespan within the time span of the experiment. When bee lifespan was evaluated in the more natural mini-hive setting (FIG. 2), it was clearly evident that bees in untreated hives succumb earlier to Nosema infection in relation to bees from hives fed with dsRNA targeting 4 Nosema mitosomal and non-mitosomal ATP/ADP transporter homologues (NC123, NC006, NC014 and NC017).

In order to determine the effectiveness of feeding dsRNA in prevention of Nosema, parasite levels in dead bees from Nosema infected samples were determined. In all box and mini-hive experiments from 7 days post infection to 15 days post infection (bees in which no parasites were detected under the microscope were excluded), counting parasite levels clearly showed that the bees fed with dsRNA from the 4 Nosema ceranae ATP/ADP transporter homologues have an over three-fold lower count compared with untreated controls (FIG. 3) (N=75 samples $p<0.0001$).

Example 3 dsRNA Targeting Nosema Mitosomal and Non-mitosomal ATP/ADP Transporter Homologues Reduces Hunger (Proboscis Extension Response) in Bees Infected with Nosema ceranae In order to determine whether feeding N. ceranae mitosomal and non-mitosomal ATP/ADP-specific dsRNA reduces energetic stress in bees following N. ceranae infection, Proboscis Extension Reflex (PER), an indicator of hunger, was tested in treated and control bees.

Metabolic stress following N. ceranae infection in bees manifests in increased responsiveness to very low concentrations of sucrose, with the PER at low (<1%) sucrose being measurably increased in the infected bees. FIG. 4 shows that feeding N. ceranae mitosomal and non-mitosomal ATP/ADP-specific dsRNA increases the responsiveness threshold of the treated bees, compared to that of untreated bees. Although at higher (10-30%) sucrose concentration and at medium concentration of sucrose (1-3%) the discernible difference was not statistically significant, at the lower concentrations (0.1-0.3%), the difference in response was significant ($p<0.03$ N responses=330), indicating reduced metabolic stress (e.g. hunger) in the bees fed with the N. ceranae mitosomal and non-mitosomal ATP/ADP transporter orthologue-specific dsRNA. While not wishing to be limited to a single hypothesis, one explanation would be that silencing the N. ceranae mitosomal and non-mitosomal ATP/ADP transport homologues has a direct effect on energy drain caused by the N. ceranae infection (total responses=1000).

Further, when Nosema counts were performed on the treated and control bees participating in the bioassay (PER), no significant difference in the levels of parasite infestation in bees from the different groups was discernible (results not shown). While not wishing to be limited to a single hypothesis, one explanation of this would be that treatment of the bees with the *Nosema*-specific dsRNA not only acts to eliminate the parasite infestation, but weakens the virulence and/or metabolic load of the parasite infection, enhancing survival among even infected bees. This is further borne out by the observation that in the minihive experiments, untreated controls the bee population was found to decline by more than a third following infection with *Nosema*, and none of the live bees had apparent *Nosema*. Without being limited to one explanation, this could be due to a more rapid mortality of infected bees.

Example 4 dsRNA Targeting *Nosema* Mitosomal and Non-mitosomal ATP/ADP Transporter Homologues Effectively Reduces Transcript Levels of the Targeted ATP/ADP Transporter Homologues In order to determine whether feeding bees dsRNA of *Nosema* mitosomal and non-mitosomal ATP/ADP transporter homologues results in a specific effect on expression of the targeted genes, and not in a generalized alteration of *Nosema* metabolism and/or gene expression, transcript levels of specific targeted genes in infected bees were evaluated by Real-Time PCR, and standardized against housekeeping gene expression (*Nosema* tubulin).

FIG. 5 illustrates the effect of feeding bees dsRNA of *Nosema* mitosomal and non-mitosomal ATP/ADP transporter homologues on the transcript levels of specific *Nosema* mitosomal proteins (Nc123, SEQ ID NO: 19). Feeding dsRNA of *Nosema* mitosomal ATP/ADP transporter homologue Nc006 ("NC006 Teatment") did not reduce the expression of *Nosema* mitosomal and non-mitosomal ATP/ADP transporter homologue Nc123. Feeding bees dsRNA of *Nosema* mitosomal ATP/ADP transporter homologue Nc123 (complementary to the sequence as set forth in SEQ ID NO: 56) alone ("NC123 Treatment"), or in combination with one ("NC6+NC123 Treatment") or more ("R.N. Treatment") other *Nosema* mitosomal and non-mitosomal ATP/ADP transporter homologues (Nc006, complementary to the sequence as set forth in SEQ ID NO: 55, Nc014, complementary to the sequence as set forth in SEQ ID NO: 57 and Nc017, complementary to the sequence as set forth in SEQ ID NO: 58) consistently resulted in specific silencing of 60-70% of *Nosema* mitosomal ATP/ADP transporter homologue Nc123 gene expression. Thus, silencing of *Nosema* genes by feeding bees with dsRNA of *Nosema* mitosomal and non-mitosomal proteins results in effective and transcript-specific silencing of the target *Nosema* gene expression.

Example 5

Synergic Enhancement of Survival Following *Nosema* Infection by Feeding dsRNA Targeting *Nosema* Mitosomal and Non-mitosomal Proteins In order to determine the effect of silencing individual *Nosema* mitosomal and non-mitosomal energy-related homologues with dsRNA on bee resistance to *Nosema* infection, survival of bees in minihives following feeding with a variety of dsRNAs of *Nosema* mitosomal and non-mitosomal energy-related homologues was monitored.

FIG. 6 shows that feeding dsRNAs of some, but not all of the *Nosema* mitosomal and non-mitosomal energy-related homologues tested resulted in significantly enhanced survival of the treated bees following infection with *Nosema* [see, for example, "nc14" (complementary to the sequence as set forth in SEQ ID NO: 57) and "tom70" (complementary to the sequence as set forth in SEQ ID NO: 59) compared to "nc17" (complementary to the sequence as set forth in SEQ ID NO: 58) or "nc123" (complementary to the sequence as set forth in SEQ ID NO: 56)]. Feeding bees combined dsRNA of more than one *Nosema* mitosomal and non-mitosomal energy-related orthologue was also not always equally effective-dsRNA of combined *Nosema* mitosomal and non-mitosomal ATP/ADP transporter homologues and the mitosomal TOM-70 orthologue ("REN+tom70") was significantly more effective in enhancing survival than the *Nosema* mitosomal and non-mitosomal ATP/ADP transporter homologues alone ("REN"). FIG. 7 shows that the enhanced survival of bees fed with dsRNA of combined *Nosema* mitosomal and non-mitosomal ATP/ADP transporter homologues and the mitosomal TOM-70 orthologue ("REN+tom70") was significant for the entire duration of the study.

Feeding bees a combination of dsRNA of *Nosema* non-mitosomal ATP/ADP transporter homologues nc014 and nc017, and the mitosomal TOM-70 orthologue was effective in enhancing survival in minihive experiments (FIG. 8). Whereas the bee population fed sucrose only ("S.O.") declined more than a third by day 20 following infection, survival of bees fed the combined dsRNA for *Nosema* ATP/ADP transporter homologues nc014 and nc017 with dsRNA for *Nosema* TOM-70 ("TOM 70+NC14+NC17") remained high throughout the duration of the study.

Spore counts from live bees treated with combined dsRNA for *Nosema* ATP/ADP transporter homologues nc014 and nc017 with dsRNA for *Nosema* TOM-70 ("TOM 70+NC14+NC17") (FIG. 9) and live control bees ("S.O.") (FIG. 10) taken at completion of the minihive study (day 20) indicate near absence of *Nosema* infection in the live control bees, while high levels of *Nosema* infection were detected in the live bees fed dsRNA. While not wanting to be limited to a single hypothesis, this may be explained by the phenomenon of high susceptibility to mortality from *Nosema* infection in the untreated bees, leaving only uninfected bees alive in the hives, while in the bees fed the *Nosema* dsRNA, enhanced resistance to the effects of the parasite infection resulted in reduced mortality and greater survival among infected bees.

Resistance of the bees to *Nosema* infection was also tested by feeding dsRNAs of *Nosema* mitosomal and non-mitosomal energy-related homologues prior to infection with the parasite, and monitoring survival of the bees in box protocol (continuous feeding) following infection. FIG. 11 illustrates the superior survival, over more than 2 weeks, of bees fed dsRNA of combined *Nosema* mitosomal and non-mitosomal ATP/ADP transporter homologues (nc123, nc006, nc014 and nc017) and the mitosomal TOM-70 orthologue (REN+TOM 70, "Treatment C"), compared to infected ("Treatment B") bees, and even to uninfected bees ("Treatment A") bees fed sucrose only.

Thus, the results brought herein clearly indicate that gene silencing by feeding bees dsRNA of some, but not all *Nosema* mitosomal and non-mitosomal proteins associated with energy metabolism such as ATP/ADP transporter and TOM-70 homologues, can effectively reduce *Nosema* infection and virulence, enhancing overall survival, and specifically enhancing survival of *Nosema*-infected bees.

Although the invention has been described in conjunction with specific embodiments thereof, it is evident that many alternatives, modifications and variations will be apparent to those skilled in the art. Accordingly, it is intended to embrace all such alternatives, modifications and variations that fall within the spirit and broad scope of the appended claims.

All publications, patents and patent applications mentioned in this specification are herein incorporated in their entirety by reference into the specification, to the same extent as if each individual publication, patent or patent application was specifically and individually indicated to be incorporated herein by reference. In addition, citation or identification of any reference in this application shall not be construed as an admission that such reference is available as prior art to the present invention. To the extent that section headings are used, they should not be construed as necessarily limiting.

Cited References

Akiyoshi et al., 2009 *PloS Patholog;* 5:1000261
Burri et al. 2006 *PNAS;* 103:15916-20
Chen et al 2009 *Genome Biol Evol.* 2009:165-75
Cornman, R. S. et al, 2009, *PLoS Pathogens* 5(6)
Gill and Fast, 2007 *BMC Mol. Biol;* 8:24
Katinka et al., 2001 *Nature;* 414:450-53
Malhota et al 2002 *Mol Microbiol.* 45:1245-54
Maori et al. 2009 *Insect Mol Biol* 18:5-60
Mayack and Daug 2009 *J. Invertebr Pathol.* 100(3):185-8
Nakayashiki, et al. 2006 *Mol Evol* 63:127-135
Peyretaillade et al, 1998, *NAR;* 26:3513-20
Price and Gatehouse 2008. *Trends in Biotechnology* 26:393-400
Siomi H and Siomi M 2009. *Nature* 457:396-404
Slamovits et al. 2004 *Curr Biol;* 14:891-96.
Taylor et al 2008 *Biochem J.* 409:563-69
Tsaousis et al. *Nature* 453, 553-556;
Ulla et al. 2004 *Cellular Microb.* 6:509-19
vanEngelsdorp et al. *PLoS Aug* 2009
Williams et al., 2008 *BMC Genomics;* 9:200;

SEQUENCE LISTING (252698 sequences)

SEQ ID NO: 1 - DNA, 43 bp, Artificial sequence
  Single strand DNA oligonucleotide
ctaatacgactcactatagggagacagctaacgagcccgtttc

SEQ ID NO: 2 - DNA, 45 bp, Artificial sequence
  Single strand DNA oligonucleotide
ctaatacgactcactatagggagaccatagtaatccatccactac

SEQ ID NO: 3 - DNA, 44 bp, Artificial sequence
  Single strand DNA oligonucleotide
ctaatacgactcactatagggagactggtctttaacgaatggac

SEQ ID NO: 4 - DNA, 43 bp, Artificial sequence
  Single strand DNA oligonucleotide
ctaatacgactcactatagggagagtgggcacgctatggcaac

SEQ ID NO: 5 - DNA, 43 bp, Artificial sequence
  Single strand DNA oligonucleotide
ctaatacgactcactatagggagactcctggacagtccgctag

SEQ ID NO: 6 - DNA, 43 bp, Artificial sequence
  Single strand DNA oligonucleotide
ctaatacgactcactatagggagaatcagttgacggtaaacgg

SEQ ID NO: 7 - DNA, 43 bp, Artificial sequence
  Single strand DNA oligonucleotide
ctaatacgactcactatagggagagcttgatgggcttatctcc

SEQ ID NO: 8 - DNA, 42 bp, Artificial sequence
  Single strand DNA oligonucleotide
ctaatacgactcactatagggagagcaatgcgatttccacgg

SEQ ID NO: 9 - DNA, 46 bp, Artificial sequence
  Single strand DNA oligonucleotide
ctaatacgactcactatagggagactgaatgttacaagcagatggg

SEQ ID NO: 10 - DNA, 44 bp, Artificial sequence
  Single strand DNA oligonucleotide
ctaatacgactcactatagggagaaccaggagtatctggatgac

SEQ ID NO: 11 - DNA, 20 bp, Artificial sequence
  Single strand DNA oligonucleotide
aggaatggaagcttgcggta

SEQ ID NO: 12 - DNA, 21 bp, Artificial sequence
  Single strand DNA oligonucleotide
aattttcatggtggatggtgc

SEQ ID NO: 13 - DNA, 20 bp, Artificial sequence
  Single strand DNA oligonucleotide
agaaccaggaacgatggaga

SEQ ID NO: 14 - DNA, 20 bp, Artificial sequence
  Single strand DNA oligonucleotide
tccttgcaaacaatctgcac

SEQ ID NO: 15 - DNA, 22 bp, Artificial sequence
  Single strand DNA oligonucleotide
cacctgaaaacaacttacctac

SEQ ID NO: 16 - DNA, 20 bp, Artificial sequence
  Single strand DNA oligonucleotide
gtatcttgccttaccatcac

SEQ ID NO: 17 - DNA, 25 bp, Artificial sequence
  Single strand DNA oligonucleotide
ggaaaagatgagaatatggaagaag

SEQ ID NO: 18 - DNA, 23 bp, Artificial sequence
  Single strand DNA oligonucleotide
ccagttacccttgtttgtgtagg

SEQ ID NO: 19 - protein, 561 aa, Nosema ceranae
MIERGIMEKIKNLLTEDEVEAEANSGRGILSIFRIAKVERRMFWLMTLMFSLISFIYSVGRVLKDAAVLSRQMPLSINCLKSFVILPVTLVCVGLIQKSTLSYSFTKIFDGALLIFAFLYIILGLVLLPYSHLFQLDSYFFRDLFSDGKCVVRGYDALLSLALVFNEWTSSLVYIVSEMFGNLVLSYFFLTFANSLTTPGQSARFIPLFYVFSNISLFLSSQVTELFTRYRSKLTFSEAEFLYNGFFVFSGVLVIVIFLIKKYLERNVTNKPLFVVKSVKKKGPKVKVGFAEGLKEMMASKLLLNISLTVMFYGISTNLIESTFKSGLVKGAEELNENTKSYSMGYNSFEQKIASITVIILLLSPFPKLIQTKGWIFVAIACPLITLFAVVSVCGLAFYNYPATNNDTNFFLNSLCATPGKSFIKLENVLGCVAVALMKVAKYGSFDISKEAISMQIDSSLRARYKGIFDGVFGKLGKSLGSLFVWIMGYAFQTRDFRKLAPLCISVIVFFVIIWIYSVIYLNKKYKESVVSNLPIDVDLFASKLLDNKKEEEIDVSVLVN

SEQ ID NO: 20 - protein, 486 aa, Nosema ceranae
MTKTKKFPKVKILLSLTFLMACVINTLLEFYREIVIMTKQIPSSLYYIKLFFSLPIICLMMSYVQKALNVYSILSIVNFIIFGFIGIFFLIGSLLIPFEYKIQKGSQWALDIFCDGKMSVRSLMGLSPFLYMYSEWISTLCYILSELWSTLVVGFALYALANHACTEDEMKEIVPNFSTITAISMIISVAFIYIKDELANILPAGLHDKIDGSSLFFLILSFVTTLIYFLKSYIPLKTKEIKETINKEEDKTTSSFDLLQSKFLRNMCAAALIYAINAGFIDMSLKNSLSTGSRINNMPPKDYSQKYLVTTSLTISAVSLFYNFVIRGNRIASRIFYLSIASPIAAIFFTALISGLSFYNLRTAPSVLRINLENWCATIGFAFSKITKYVLFDLAKEMLSMRVPVKYRYKFKSFYDGVCIKIGKSIISLYGTFLTFIEIPDIRQVSYVSFIFLIFANFLWIRSVCYLSKKYNESIEQNSEIDVDFN

SEQ ID NO: 21 - protein, 567 aa, Nosema ceranae
MSVDNSKVLQNNENSALPTEDEIEYEASNGSGIYSLIRVAKVERKMFWIMAAMFFIISFIYSVARVLKDAAVIGKQLPASIFFLKFVIILPFSFISVGIIQKALDKYPFTKIFDVTLIVFAVAFTILGSLLLPFSDYIQIQPFWAKDIFADGKAVARSTDFLFSIALVFNEWTSSAIYVLSEMFGSLILSYLFMTFANGLSTPGQSARFVPLFYVGSNLALLLSGMINYFYSVSKSKMSYVAAERFFNGFFCLSGILCAVIYLLKKYLENNVTSKPMFVRKTFTKKKSKVKVGFVDGLIEMSKSKLLLNMSLVVLFYAVSTNIIESAYKSALAVGANETGEAKSTYASIYTSIEQSGVAVIVMILLLTPFPRLIKTKGWITIAILCPIITFFSAFGTFVLAYLNFPITNKEDNIFDIYRLPSTDSIIKLENIVGVICVSLMKISKYAAFDITKEALSMQIDGSIRAKYKGIFDGVFGKLGKSFGSVYGFTITTLLGTRDVRRGAPISLCVLILFCLIWFYSVFYLNRKYKESVENNAPIDIDLFTSSKVKAPSSEPTVATKSVTTEE

SEQ ID NO: 22 - protein, 546 aa, Nosema ceranae
MSVINETPENNLPTEDEIDQLANSRTGLLSYFKVAKVEMPKFFILGIMFGLINFVYSFLRILKDLFVMVRQDQNSIMFMKIFYVLPISFASVILIQWLMQNKPVSSIFNLFLIIFTAFFFGLGAIFLFEEKVTPSSFLFRDIFADNKGALKGLNFIKYFLITANEPVSTCIFIIAEMWGSLLMAYLYMSFLNESCTIRQFTRFLPPFYIIANLALLVSGLASSSFRELRKGFSYEQNQLLYSSVFIAMGGICLILMYMKYYFENKIMSVPIFIPSNTIKKKQKVSVGFSEGISIMMKSKLLMSLCIIVFFYNITFNLIESVYKAGIKAASKSLGLEVGEYSGKFNTIDQILVAVTVITLNLSAFSTLVESSGWITMGLLTPLFLLLGSIIVMGASIYNSAIEGLAFSWISVFFKKMSYIYTIENYSGMFFLAFIKVLKYSAFDICKEKMGMRIDPAHRARFKSVYDGIFNKLGKSIGSLYGLAILVALDTDNVRKGSPITLTIAIILIYIWIRAIIYLAGAYNVSIKNNTSVDIDLIKDDKKENAE

SEQ ID NO: 23 - protein, 597 aa, Encephalitozoon cuniculi
MNEVENNNHSFPREDIPTEDEIEEEANSRQGILRYFRVARAEYTKFALLGLMFGIIGFIYSFMRILKDMFVMVRQEPTTILFIKIFYILPVSMALVFLIQYMLGTKTVSRIFSIFCGGFASLFFLCGAVFLIEEQVSPSKFLFRDMFIDGKMSSRSLNVFKSMFLTLNEPLATIVFISAEMWGSLVLSYLFLSFLNESCTIRQFSRFIPPLIIITNVSLFLSATVAGAFFKLREKLAFQQNQVLLSGIFIFQGFLVVLVIFLKIYLERVTMKRPLFIVSSGSRRKKAKANVSFSEGLEIMSQSKLLLAMSLIVLFFNISYNMVESTFKVGVKVAAEYFNEEKGKYSGKFNRIDQYMTSVVVICLNLSPFSSYVETRGFLLVGLITPIVTLMAIVLFLGSALYNTSMEESGLGIVNGLFPGGKPLYVLENYFGVIFMSLLKITKYSAFDICKEKLGMRINPTYRARFKSVYDGIFGKLGKSIGSIYGLLMFEALDTEDLRKATPITAGIIFIFIVMWVKAIIYLSRSYESAVQHNRDVDIDMTLMFEALDTEDLRKATPITAGIIFIFIVMWVKAIIYLSRSYESAVQHNRDVDIDMT

SEQ ID NO: 24 - protein, 600 aa, Encephalitozoon cuniculi
MSEIGSSVPVNENRPLLTEDEVEAQANSSTVWPLSRIRVARCEWKLWGSLAFIFGASAYIYSFSRVMKDSFVLSRQLPIAISFLKTCFVLPISVIVTGIVQKLLVTRTISKVFDYTLIAFSFLYLLIGMVLLPFAEKIQPGLYFSRDIFADDKMAYKGFEFLFAIFLIFNEWTTSFVYVCAELFGSLVVQFMFLAFANEALTIRQSTRMMPLFYVISNILLLLSSESTSFYSKKVREWDYKKTCLITNSFFAVFGAMIAVTYLVKKYAENTILKKQLFIRTEGVAKKKGRKSSAGFSESMKLMAQSKFLVAMVMNALFYYAGTNLIESSWKNGISVAADANNMEKRAYSASIVSGEQRVVGALVAIILLTPISTLVQTHGWITMAIVPPLVTLVSSLVIFGSAFFNYSNYPEGKTSVILSSLVKGYKPNFYLECNIGIYCVSGMKIAKYAFYDISKEAISLQIDPLYRPRLKAVYDGLCGKLGKSIGSLYAMFWSVMGYNDVRAAAPITLGMWLIISPIWIYSVIYLNRKYNQSIQTSSPIDLDLFFWSVMGYNDVRAAAPITLGMWLIISPIWIYSVIYLNRKYNQSIQTSSPIDLDLF

SEQ ID NO: 25 - protein, 598 aa, Encephalitozoon cuniculi
MSTFQLSASSKDSYLFRTEEELEEEVYGKTGFFKHIRVARNEWPRVLYLSLLFGVITMVHTIMGNLREMVLMGRQDPMSMFFIKSIFLPPCSLLFIWAIQLGLSLFTPSKMFDITLILFSGCYILFGLVVWPLKGYIQKDFYWSRDIFGDGKMESLRIHFLYPVFLVFNEWTSSFLFLCSEMWGALVVSYFFNIFANEVSTRRQSQRYISVYNISNAISIFLSAVLTLVFNKWRDGVAFETKELGFRILILVLGSTVIGILALKKYMEREILPAPVFLIREVEKTSTERRKLKLDEARQTLSRSKLLIAISLNVLLYGVTSTLVEATFKSGIAAGARYTNNSKETFANFYNGLEQIIIAISLLVVINTPYSALVKKGGWKYLASLPIVIAMFSLFSVFLIAFYNVGADSGGNVLFGSLFKNRMPTFILENTLGLVTNASMKIGKYLGADVSKEAISMQIDPLYRAKYKAVYDGLCGKLGKSLGSIICTVMTGLWDITDIRRVSSVSGILIVIIIAMWYFILKYLSRQFQAAVEANTYIELDEFVMTGLWDITDIRRVSSVSGILIVIIIAMWYFILKYLSRQFQAAVEANTYIELDEF

SEQ ID NO: 26 - protein, 589 aa, Encephalitozoon cuniculi
MSENREIDATDRRDKTFDKEKLRPHVYSSVAGGMRSTSGDTKAVLLFSLLFALLSYIDAFLYVLGDMVMMNTQMPSSILFIKSVLVLPMTFFFIVIVQKGLRYLSQPRMLEVILIISSVFFLLFGFVIWPYCKRLQPDFFWSRDIFSDGKMKTRHLDFFFPIFLVFSEWASTMLYLVAELWGSLIISFMFFSRAIHQCTEAQVKKFLPTISLISAVVFLSSGLLTKSLNSRRDALPYHEKERLFSQVFIVTSALTVMSAITSFFTDRALAKDDPRHKGKKEHKVRKIGFAGSLKMMQKSRFLRAMTESVVAASVCSNIFEAIYRGGIVLGAVQSSTSKSSYMNRLNAMAQIITSIFLLVMFFKPATHLIERRGWFPVAITAPIVAIITLVLFFPMVFFNNITEGDLIASGEEYVGSFVLENYTGMFLTTIIRISKYCFFDVAKEAASIRVSPVHRHSFRGIHDGLGINIGKTIGSVYCTMFLTTIIRISKYCFFDVAKEAASIRVSPVHRHSFRGIHDGLGINIGKTIGSVYCTLVTVVFDVRDVRNVVSVSTVFVGVFCVIWIRSILHINKKYKESIERNDFINVELA

SEQ ID NO: 27 - DNA, 1314 bp, Nosema ceranae
atgaaacgaaaaacagaaatatttattgctattacagtagtcactgcagtgacatgttacttatttaaaaaaataataaatagacaaaagtctgattatacatcaataaaacaggaagcagataaatattttatacaagaagattataaaaatgctattctgttgtacactaaatgtaaatatatgaaaagtgatgctgaaattcttactaaaattagtctctgtaattatttcttaaaaaattatcaagaagttataaataattctttatttaagacaaataataaagatctaataaaaataagatctgaatgttacaagcagatgggaaataaaaaaaaatttcttaaggatttagcactttatgaaacatttgctaataataaagaagtccaagatgaaattatgcagactgttaaagaaatttgtgaagaagaagtgaatgagtttattgaacaagaaggtttaaaaattaataaagaagatgtgctaagaggacttgtttcaataaaaaatataaatgagatttatgatgcatttggaggtaaatctaagaagtttaaattttctaatgatgaaaaggaagtgttaaatcttcttaatgccattattttacacctaaaaggaaaaaaagaacaggcaattcttttattagaaaaatctacttataaatacagtatcttgtatagagcatattttcttacattgaagaatgaatatatttcatcttcattgcctttagatgacgagattactacgctttacttgtattctaagatttttaaagataaatctgatacttaccttaaatctgctatagataaatcagtagatctacctattgaacagaaagactttctgtacgtagatcttcttgtattttacatttctaaaaaggatgttgaaaaagttaatgaaacaattaataatttaaaagagactcttacccccactttattggaacttattggagaatattatttaaaaagtggaaatcactctaaaatgttagatctattatctagtcatccagatactcctggtaaattacttttaacggcactttatgcaataagtattgataagaaaaaggatgctatagaaattttatatagaagtatatcagaatattcatcttattttaaatcttatttgtatttaggaaatattttaataaatgatgacttaaatgaatgcaggaaattgtttaatacatcacttcaatattgttgtaattctgatgaggtttttattgttaagcagtcacttattttaatagaagtacatgaatacatcaaagaaaataaaatataa

SEQ ID NO: 28 - DNA, 846 bp, Nosema ceranae
atgaaatctttctacaaaaaaataaaaagttatttattcaaatctgccattaatacatcttttgatacttttaatttagaaaatgtaagcattactagcttaaatacgtacaccggtgttaaaaccgaaatatcaaaaaccgtatcaccacacttccagatttctcatgtctcttctatgggcgcagatttcgacataaaacagacatacgccacgttctgctttaacaatcttttgctacaaacgagcatagaccaagacaaaatatttagaataagaggtacccacatgtttaaaaatctacttactaaattccatacagtaattggtagaagtaaagatatctttacacaaatagaggtagacataaaaaataaatacaataatatgtgtataaaaatgatacagccagctattaaaggtgcttcatgtatatacgtgggtaattatatgcagcagctaggagtaattagtcttggtggggagattattaaagctgatgaatacattggactatcttttgtagggagatatgaagggattggttctatttctactatatcacttcagcagtttaatacactgtctatagattattacaagacattgtcttctatttgtgacgtaggtattaaaatatcaactgatagggaaaaatcagttaattatggattaggagttaaactacacagtaaaaaaggagaaattatcggatgtgtagataacaatcatattttaagcataatttataatgataaattatctgaagggttaacacttaatttgagttgtagatttggtaagaaagtatttgattatggctatgggtttatttatgaattttaa

SEQ ID NO: 29 - DNA, 1734 bp, Nosema ceranae
ttaagaatttttcaatattttttttgcttgttctaagtcataaatttttttagtcaaatatgactttaaaatctcttttgtttcatctgttacttgtttgtactttaaaaattgttgaatttcaattttaaattcggcacaatttttttcaatttcatcttttttcgaattttcttcggcttctcgtatcatttgcgaaatttcaccttcatttaatccacttgaaggcacaatttcgatttcttgcttttttttcgttatcccgtcttgcgcagatactttgtatattccgttagcatcggcttcaaatgtaacatctatctttggaatacctgcaggtgctttaggaatgtttttgagctttatagctcctaaatatttattgtcttttaccatctttctttctccttgatatattctaatatctacttcggattgattatcttcagaggtagaaaaactgtgtgtttccttaaatggaatagtagaatttctatgaattatcttattaaaaatcccgcccaaaagctctatacctaaactcaatggtactacatccaataataggacatcttttatttttccttctaacacgcctgcttgtagagcggcccctttagcaacagcttcatctggattaatatttgtagaaggctcgataccaaaaatcttcttaacaagttttctaacatacggcattcgtgtcattccacccacaagtataacgtgtttaatatcacttttagttatattggcatctctaatagctttaagacaggggtttattgttttgtctattaacttttttgtaattttttcaaattcgtcgcgtgtaattacctcttttaagtgataattctttttactatcgttataaatatacggaatattaatttcagacgaaagattagacgacagttcttttttcattttttccgctgcttctttaattctattataacaagaatcgtgtttaagtaaatcaattcctgttctacttttaaatttttcattaatataatctactaaagtattatccaaatcttctcctcctaaaaaagtatttccgttagtagattttacatgaaaaataccattatctaattctaatatactaatgtcaaaagttcctcctcccagatcataaacagctataataccctgtgcagacttgtcaagcccataagcaagtgctgccgcagtaggctcattaatcactctaagcacttgtaatcccgcaatccttcccgcatctttagtagcttgcctttgcatgtcatcaaaatatgcgggcactgttataacagatcttaatactttagaatttaaaaaattctctgcggcatttttcatttttgacaaaataaatgcaccaatttgtgcaggagaatatttcttattgtcaatttttatccaaatatcgccgttacaatgcttagtagtgtcatatggtaagctttttaaataatcttttaattctacatcatcaaattttcgtcccagcaatctcttagacgcaaaaatcgtattcttgggatgtaataacaagttagacttagcttgctcacctgttaaaattttatctttaaaaattgataccaccgatggtgtagttctaccaccttcttcgttttcaataatttgtgggatattgttatgtataagagacacacaagaattggttgttcctagatcaattcctattattttagagctaatttcttctttagacat

SEQ ID NO: 30 - DNA, 1710 bp, Nosema ceranae
ttataagtttaatgtagaaataatattttcttctatcttatgtaatgatacagttttgtttttaatacttagcactttatcaaataagtggagtaaatctaaattatgtaaaacaataattatcgtcttctctaagttgttggagattagacttttaagaatttcatattcagcttttttgtccaatgcggccgttggctcatctaaaattataataggagaattttttagtgccgaccttaacaaaattactttttgtctttctccaccactaagcttatgtcccttatctccaacatgtgtgttgtattcatcctctaggttgtttatagaatcgtgtacacaaagttttttactgatttttataacttcttctttatcaaatatttcttttccatatgttaaattataataaaccgtttcgttaaacaaaaatgaggtttgtggtgcaaatgatataagtgatctatatgaactattagaaatttcttttatatctcgattatctagataaatatttcccccataattttcaaatctcataatcatctttataagagatgtttttcccgatccattttttccaataatagctactttttcaccttttttaattaaaatatttatgtccgttaaaatttttttggagtaataattaaatgatgcattttctaatcttatatcattattaaattcattaacatctactaaatttggttcttcttttataagctctggtttaaaagatgttcttatatttaagattgcttgtgtatatcgtgagtaaaagaaccctaattgtccaaaacttgaatacaatgttctattaatgccaatataaaatacaacatccctggcacttagttttgctgttaatattccatagtttcctaatgttataactataaaacactgtaaagcaaaaattatcttatttacaaggtataaaaaactaagagatctccagattctgttacattccgattctacttcagaaacatatttttcatatttaagcgattcttcttcttctgttttatatgctagtatagtctcatgattaattaaagaatcatgtaagtgatttgagcatctttgttgtgcgcaattatattcttttcttattcctgtacgccaatgaactattttcgcagttgcaaggatgtaaactaataatgtgattaaaataataaacatatttgtcaaccctaaatttgtataaattgacgaacacgccaatataactgtaaaaaaaatatttatgatattaacaaataaaacttcgatcaattcacttattgctttactttctcggtctattattgtttgtatttcaccgcatcctattttattgtatctactaagttccatatttataaaatttttaaatgaattttttcctgtcagtctgaatacatgttgaacgggtgtaacaaatataaaattgttaagttctgacattgtaattgatacaattgtcaaaactgcaaaatacaaaagactttgactaagatctttattatctgtaatatcactagtcaatttccgggtagcttcaactgttaaaacattaaatgtacaaactgcaaatgtcccaaaaattatgtaaatgacaaatgttcgaataaagggctttgaaataacatattctacaatcaggtctttcataatactaatatcactaccataaatagattttttttctaacat

SEQ ID NO: 31 - DNA, 1722 bp, Nosema ceranae
atgaaggaaaaaaccaattatgaaattttatatgatacatttgtaaaatattgttacaatatttcctatataaggtacgtaatgtttcccatattactgtctacaattatagcttgttatctcgaagttcaggcaagtaacatatcaaaaagaattgcagaagattttgaaaataaaataaatgcaggaaaaagtatatttaaatatattttatttttaacttcatcaatagtattaagacaaattaatgatattgtgtttagcgggccaatacaatttttatataaaattgttggagttgaagcattttatcattacatttcattaaacttagaaaattttaacaaaataggaagtggagagatacaaatgattattgagcggaaaagtagagcatatggtgacatactagaactaactactctctcggccgtaccaacctgtattgtagttattatgtcgtttttctcagtatataaaaatttgggaagagatgcactctacgtaatgttggctacaagtgccttgtatgtgtattttacatttgtattttcaatatggagaaacaatattagaagacaatataataagtcacaggataaattatcgaataaattacaagattttttagctaatcatgaaacaattaaagcctataatatggaagaagaaactattacatattttgatgaaaatcaaaaaccggtagaatattttggggtaaagtctcacagaattttgttctctcttttatatatacaaaaaatgacatttgcgatacaggcaattattattatcacattaggatcttttggatattttccgattaaattatcctctcaacagttagtcttttatatttcgattagtaaaacgttgacaaattcgttgagcgaaatgggaatgctatacacaagatatgtacaaggatttttaaatgcaaagtctggatattacgagtttaaagaggatacacaaactgataaaataagactgatagattttaatgaaaagctagaatttagaaatgtatcttttagttatttaaataagcctattttagtgaatgctaatttcgttattaataaaggggagcgtgttgctattataggaaaaaatggaacaggtaaaagtacaataataaaattgttaatgaaattttataaatatgatggagatatattaattgatgatacagaaatagataatatttcggatagaagttacagaagtttaatatcatatgcaacacaaaacacgttcttattcgataatactgtgacatacaatatattttacgggactaaaaacgtaacagaaaaagaagttttagaattagccaaaaaaataggtgtattagagtctatacaggaatttaaagatgggtttagcacatcggtcggtgaacgcggaagatttttatctggtggtgaaaggcaaaaaattatgctgatgcgtgcattgcttaaaaattcagagatcgttttattagacgagccaacctcagcactagataaaaagagtgaactagaaactatgacatatatttttaatgaatttaagtaccatacttttgtaataattgtacacaatctagaattattggctttgtttgataaaattttatttgtaaatggtaatgaggtaacaatgatagaagacattaacaaaaaacttgaagaaaattcaaagtattttgcagatattttaaacaacgaataa

SEQ ID NO: 32 - DNA, 1734 bp, Nosema ceranae
atgaaaaaaatttcgaatagaaaaattatcaaagaaattatttacaatgatttattaaaaataagaatgttgcgatatgttattgtaccaataatatttttaactatattttacactgttttagagataaaaataagtacattagtaaagaatcttaatcaatctatcgcaaatcgaaaaggtgaacacacagcacttgaaagatttgtgttacagtcactcttagtggctgtattgaccgaacttaatggatttatttttacaggtgtagtgcaatatatttatagaaatacggcaaaatctacattcaaaggcttcatttctctttcacctaaaaattttagtaccataggtggcggagaaattcaaacaataatagatagaaaatcaaaatctgcaagtgaacttattgaagtgtttcttacaagcttgcttccaatatgccttaaacttttatttgcccttattgcagttataaaaaatatgggaggtcttgcgggcttcataatgtttgtttgtgtttcttgctatgcgactgtgactatattgatagcacaatggagatctaatattagaagagaacttaataactctgaaaatagatctagtaataaactacaagatggattaaataatcatgaaacaatcgtctcctttgggactacagatcttgaagtagatgaatatgatcagtttcttaaaattaatgcatctaatagtaacagattatggagagcactgtacattttaaatttatctcagagagcaatttttctcttacaaagtttttttattatttatgcaggaatatcaggaatattatctcaaaatatgtcatctaaccaactcatttatttaatgtccattacatctacggttactattaatttaagtaacttgggttacttatacactagatatacacaagcaataattaatgcaagatctacttatgatacaatgttagatataaaaaaagagaataataagtttaagattacagaatttaaagaaagtattaagtttaataatttgtcatttggttatgaaagtagacaaatttttaataaaataaatctagaaatatacaaaggagaaaaagtagcaattataggtaaaaatggtagtggtaaatcaacattactaaaactactgcttaaatttgatgaagattacaaaggtagcattttaatagatgacattgatattaaaaaaatcaaagacgaattttataggaatttattaggttacataccacagaatacatttttgtttaatgaatctgtaaaatataatattaaatacggatcttttggtatttcagacgaggatatttttgcattgtgtaaagagtttggattatatgacgttttcatgaacctcgaaaatggttttgatacgaatgtaggagaaagaggaaggttattaagtggtggagaaaagcaaaagattttattaatgcgtactatgttaagaaacaaggagataatggcattagatgaacccactgcagcacttgataaggagtctgaaaaaaagattttagagataattttacaacaggaagatcgaacagttttgatgataattcataatctagaacttattaataaatttgataaaataatttacattgatgaaaataatatagaagtctataaaaatgatattgaaggacaaaaaaagttttctacaaatttacaatattttttatcatacaaattaggtaaataa

SEQ ID NO: 33 - DNA, 510 bp, Nosema ceranae
ttattctggttcacaaccacaactccaaacaccttctacctttttacagtccataatgggctttcctaatcttttattaactatgttatgtgctttacatagccactggacaaattcgtcatgtgtggcaacttgtggaggatttaagcttaacagtctttgaaaatgtccacaacattctgcacaggggaaaagagatgataaaaggtaaataaattgaagtgtatcttttttatgttgtactgtaggaaatgcaggataaacagctgccatggtatgtaaaagtgtccatgttgctctccccaatctatctttaacttccttatttgttaatttttgattatgaattagacctaattcacctacttttggtgaaatagattgtaaaacagattttccaagtgagttgtctgcatgtgtatgcgggaaaaaatgctgttttgctaaataaacaatccatacacccaataagataataagtcctcttaatactttctgctctttgttcat

SEQ ID NO: 34 - DNA, 1134 bp, Nosema ceranae
ttatatccaactatcaaaaaatagcctcttttctttcacaatttcagaaaaattttcattaaaaatgctataaatagttttttgcatatcaggtcggccacaaacataaaccaaacatccgtctttaatgtatgtttttatctcatttaaattttgtaataaataatcagtaacataaattttattacaagataaaattttaataatttctgtgtttttatattttgcatctttaataagatcatcttcttgatttctaaatccatatattagtttgatatattgatcgtcttctttatttttcaaaaacgaaaaaaatggagcaatgccagttccagtacaaatacccaacacttttttacaaaaatttaatctaaataatttactcggtctgtgacagatctttaaattattataattttgcatatctatgaaattggaaacatgtccatatctatcgccttttttaataattgctactaaaatttcacatttttcatttacgtggttagtaagtgaataatatcttggcttaattgtttgacaattcataataagatcctctaaacttggtttacattgaaatgtatatataatgtcaagcacattattccagttcttaatgatgcttaaataatcttttactccttctttagaacacagatattcaatatcatgcttatttttagaggttttagaaatatccataagccatgcttttttaggcaatgaagtaaaatcaaaaatatacttgaaaaagtcacgcaaagatccttcgaattgaaaccccgtttttccaacttgctcaatatataataatgtatcaccagacatttctagtaaacttaacatttcattaacaagcaaatcattatttgaacaaagtagaccaatactatcaccaggaacaaaatctaatgtataattaagttgaaccttatatacctttttccatgtacaggaaaggttttcaatatttagtatatttgtatctatcaaatttatattctcgtttgtctttattttataagaacctgtatagttggtctttttaattataagcttattgaaatttctaatatttaaaggaacaaaatctacatttagattatattctaatttattgaatttcat

SEQ ID NO: 35 - DNA, 1503 bp, Nosema ceranae
ttaccaagtttctgcctgaaaatatattttctttttataaatatctaataacattttttcaataatattattaagtctagaatttccacttacaaatattaaccaatcatcaatattttctagcccttttatagtcttataaatatcttgtatgtatttattatcttcccttgaaacagcggggtaaatttcaatgcctttattttcaaactcttctttatataaaaaatctacatctctaaatctaaaaccatataataaaataacttttttaaaaaaatttaaatcagaatagtaattaacaaatgccctgggaagtgtaataccagtaccagtgcacataaacaaaatctttttaccactaaaattaagtctattttgtactatgttaacatgaatagtagaccctttagtaagtaattttaaatactctgaacaaagaccttttcgttcttcttttaaacttgttttaaaagaaacaagagagacggtgacaaagtaacaaaaatcttttttcgttaatgtaaaatatcttggattaattacagggatatacttgtacataaaatttgaggtaagttttatcttaaaatcttttagaacctcaaaaatagtgcgcttcggtagtaaaatgtaatcatagtacagatcgtaatttagataaatttctttacatttctcacgatattcctcagcaatggtatctgtgataagcgaaagttgtagaaaaaaatagatttgaggaatagaattaaaatcacaatattttttaatatatttaaccaaggtattgtcctttatgttattatatcttacaaactcctcgtaattataattttcaggataaaccgctagacaatcaccgatttcaaaattttctatatctatatcaaattttatttctaaaataggataaatgtaattgtaaggtgttaatatcttaatatcatttattgacgcactgtataaatcatttttacaacttgcaaaatttttagcattttgtagtttgtaatgcggtaatatataatatagatcttttatccatgtcttaaattcgcccataaatccttctttgtcttggctatctccattaccctttcttatcagaggtttagctccgtgttttaaaaggcaattatacaactttttagaacaaaaattaaaagatttataagacgaatccccaaggccaaatacagcaaaatttaagtgttgtaaaaaatttgtaggcagattttttttgcgcaaaaatttccaaaatttagtcatgttaaaaggttcagaaccattcccatgagtcgaacatacaaatataatcatatcaatatctaatattttttcgaaatcaaaactgtccatatctaaagtaaaatctgttggaagcaattctttatcaacgttataaatcaaatctttattgtatccgtatagtataacattttgaataagtttagcaatatgtatagaatttcctgtttgggagccatataagattatcat

SEQ ID NO: 36 - DNA, 990 bp, Nosema ceranae
ttattcagaataaacatcttttaaaagttcatcgatatcgggttctttagaaaaaataacttttttaacaccttcttcaaagcaggaaattacctcatcttcgataatttttacttcttcacaagtcgcaaatttttgtaagttattttttgcttctttaaggcaatcattattttttttttcattaatttcctccgtggatctgtaaaaatcgttaacatctaaacaggagtgcccacatgtcctgtacgtatcaatttgcaagatgataggtcctttttctattgcatgttgtctagcaaatgtaaatacatcaatcagttgagttatgtttttatctgtaagacgtatacctggaatattatatccccttttaaaatattcaggatatgtagtggaattactttcaggtgtccacatactataatgattattttcacatacataaaccacaggaagtttccataatgcagccatattgaacgactcccagacctgtccctgatttgcagcaccatccccgaaaaatacaaatgctacattttttacttttttatattgtaaagcaaatcccaatcctgtaccaagcgatacctgcgcacctactataccgtgtcccccataaaattggtcattatacaaatgcatcgatcctccttttcctttgcaattaccaatagcctttcctaataattcccctataatactttctatactgattccacaaataaatgctaatccatggcatctataagatcctatgactttatcatttttatctagtaccttttgtaaactcatataaatgttttcctgtcctattactaaatgacagaagcctcttatatttccttttttatacttagagttagcatattcttcgataagacgtagaattaacatatttctataaacatcttgtacaagttctttgtttaaagtagttttcagtttaactgtatttttatctaccaaataataatctatcat

SEQ ID NO: 37 - DNA, 960 bp, Nosema ceranae
atgatagaaattcgcgatcttataaatcaagcattggatgaggaaatgggaatggatcataatgtatatataataggagaagaagtaggcatctctggtggtcctcacggtcttactaaaaatttgatcaaaaaatacggcgatcaaagagtgaaggatacccctatttcggaaatgggatttacaggtctcgctgtgggttcaagctatttagggttaagacccgtagtagattttatgacttggaattttgctttgcaatcaattgaccatattattaattcttgtgcgaaaaccttgtatatgtcaggaggaagaatacaatgtccaattgtttttaggggaccaaatggattcaataatgggtacgctgcacagcacacacaagattttgcaccaatatatggttctattccaggccttaaggtggtttgtccttatacgggtaaagaccataaaggacttttaaaaagcgctattagagacaataacccggttatatttcttgagaatgaaatattatataaagataaataccttgaagtgtctaataattatattcaaccacttgacaaggcagtaattgaaaaaaatggtgttgacgttacagttttaggaatatcaataagtcttaaagaaatttttaaagcagacagtttgttagagaaaaaaaatatcgacattgagataattaatcttgtgtcaataaaaccaattgattatgttactattgaaatatcagtcaaaaaaacacaaaagttagtgatagttgattttgcatatcctactttcaatattgcgagtgaaatagctgcgcacttttacgaaaaatttaaagatataaaaattatgcgtgttcttgcgcaagatattcctacaccgtatgcacttaatcttgaaaaaatgtcttatccgacatgcaatgatattgtaaatgctgttacaaaaataaattcatag

SEQ ID NO: 38 - DNA, 1767 bp, Nosema ceranae
atggtgtataaggttttatttacagtaataggattaatatgtggtatacttacaataattaaacgatacaagtattttaagataaaaaaattggccttaacttacttcgggaaacaagacttgcaatggaaacctaaaagtcggtcagaaattattaacgatttaaaaaatacaaactttgacatattgattattggtggcggttcaacgggaatgggatgtgcaatcgaagcagctacacgaggtataagtgttggcctgatagaagcacatgattttggttcgggcacgagttcaaaatctacaaaactttttcatggcggtgtacgctaccttgaaaaagctgttaatgatttagatagatctcagtttgacttggtatctgaagcattaagtgaacgaaaaattgttatgaatatgtgtccttttctagtaaggtcgatggaaatattatttccggtttataaaaggcttttaattccttactactatattggccttaaattttatgattggatttctgggcaacggtcccttgggcgaagtaaatttttgtcgcggcaacaaactattacaaaatttcctaatgtgagaaaaatcgaccttgtaggatccgtttcgtatcgtgatggccaattttatgatgctaaatacaatgttctattgggtgtcacagctacctactatggagctgttgtattaaatcatgcaaaattcttgtcagtaacaaaagatggcgataaaattaatggaattaaatgtcaagattcaataaataatgaaaaatttttaattaggtgtaaagttttaataaatacttctggcccttttgctgacgaggttcgaaatacatcaattgaaaactgtcaaccaatactccaacatagttatggtacacatattgtagttcctgcgatattttcgcctaaaaatatgggctttgttgatccaagcacgagtgatggaagaatcgcattttttatgaattttaaaggtaaaacattgattggaggaacagatgttaagtgtaaagttgaagatttaataaaaccgactgaagaagatctaaactttcttattcacgaggccaattattttacagatcacaatttaaaattaacaaaaaaagatgttttgtctgtttggacaggtattagaccgttagtcaaggatttatcgaaaagttcaacagaaaagatatgtagaaaacatactataagaatagataaagacaatatggtaactgtaacaggtggtaagtggacaatttttcgacttatgggagaacagacaataaatcaaattataaaagtttttaatataaagtctaataaaccaagtataacacaatatcttcctgttttgggatcacagggatatactaaagctacagaatttgatttggcacttactttaaatattccagaagatatagctaagcatttagctacaacttatggtaccaaagcttacaatttctctgaatactttaatgggtcatacaccagacttacagatggttatccttatacaaaagaagaaatagtatattgtatcgaacatgaattggcttatcgcatcagtgatatattatttaataggatgatgataggatacattgacgtcagaagagcatttgatttaattggtatagtagctgaagtaatgaaagactattacggatgggatcagcaaagatataatgaagaaacaaaattatgcatggaaatgatggaaacttgtggttatagtttattaaaaaattaa

SEQ ID NO: 39 - DNA, 654 bp, Nosema ceranae
ttaatttatgcataattgaccatcatcagtaataaacacattacctttcttttctaccacacatttttgatatatttcattaactacatcccaatcaattacattccaccattcattaatgtattcttttctcctatttttatactgtaaataatacgcatgttcccatacatcaagacatagtaaaggaatacattcaccatcctccatcataggattgtcttgattaacactggtcttaatacacaatttatctttatatatcaaccacacccatcctgatccaaataattttacagcttcagtattaaaattctccttaaatttatttattgatccaaagtcttttattatagcactttccaactgggaagaaatctttttattttctggtgacattaccaaccagaaaagactatggttgtaatgaccaccaccataatctcttaattgtttatcaacaagtgcatttcctttattattaaaaagtaatgaatttaatgatttaccacacaaattgttatctaatattattttattaagagtgtctacatacgcttgatggtgcttagagtggtgggtctccattatatcttcacttatataaggctctagagatttataactatatttcagatttggaagagtgaacat

SEQ ID NO: 40 - DNA, 1224 bp, Nosema ceranae
atggcacaagacccccaaggactttatgaagtattaggacttaaagctggtgcaagcattgatgaagttaaaaaagcatttacaaaaaaacaaagggaatgtcatcccgatggtgcattttttaaagctgctcttagaaaatgtaaaacagatgaagaaagagcaaaagttgaaaaagaatttaaagaaaaatcacaaaaatgtaatcaagctaaagcagttttatttgatgagaaaaaaaagcaagagtatgatatgggaatgactggcgattttggattttctgcaggtggtggagactttttcgatattttttcaagttttactggtggaggaagaagaaatcgagtacaaaaagttcaagatacagaatacgagtttaatatttcgttgaaggaagcttatatgggaaagcgagctagttttaatgtaaaagtgcaaagagaatgttctgcgtgtaacggtaaaggaggagacagtgttgaaacatgtgaaccatgtaaaggtaaaggtaaggtagaacatcataggagactaggtcctttaatttctgtacaagaagcaccttgtaataattgtaattctactggatttgttgttaaaggaaagctttgtcaaagttgtaaaggtaaacaatacgttgagactaaagaacatattgaagtggaagtagagccaggagtacagaacggtagaaaatatacattttctggcaaaggaaatcataaaaaaaattgtgtaccgggtgatgtgattcttattgtaaacattacaaatgatccaagatttagaaaaagtggatataatttaattagtaaggttgatattccattgtatgttgctttggcaggcggacagattatatttgaacatatcactggtaagaaatttgaaattactttatatccatttaaagatttaaagaaatgtattattttaaaaggcgaaggttttaaaataaaaaatagttattcgggtggtgatcttattctcgaacctaatataattatagataagaatattgataaagatttattagcacgcgccttgaattatgttcctgtaagaaaagattttacaggaactgctgttccaaaatatgcagaatttggtgttatgcctaaagaacaggaagaacaaaacgaaagagaaagattcgaaggtgcagaagagttttttggaggaaatggtagagatttttttagcaagtttggatttttctaa

SEQ ID NO: 41 - DNA, 1308 bp, Nosema ceranae
atgttatttttttatagccccatttttatgactaaaagtttaacgaattctaaaactttaaatttaatgtcaagtgtacaatcaccagttataaatacaaaaaaaatatatcttgatgcacaagcgaccaagcctttagacccgcgtgtgcttgatgcaatgcttccatactatacatccatttttggaaatccacattctcgcacgcatacgtttggatggaatgcagaaaaaggcgtagaaatggctcgaaagcaagtagcagatttactgaatgccaatgaaaaagaaattatttttactagcggtgctactgagagtaacaaccttgcactaaagggtgtctttgcatttttaaaaaaagacaataggcctgttcatatcattaccacacaaattgaacataaatgtgtattggacacatgtagaagattagaagaagaaggagctacagtgacttatttgcctgtagataaaaatggaatagtagatccgcaattaataaaaaacagtattactaaagataccgctttggtgtctgttatggctgttaacaacgaaatgggagcaatacaaccgcttaaagaaataggaagaatatgtaaagaaaataatattttatttcacactgatgcagcacaagcagttggtaatatagatattgatgtcaatgatatgaatattgatttactaagtttatcaagtcataaaatttatggtccaaaaggtgttggtgccttatacgtcagaagaaggcctagggtgagaatgttaccactttttaatggtggtggacaagaaagaggattaagaagtgggacaacttctccacctttagttgttggattaggcaaagctgctgagatatgctctcaggagatgcgtaaggactatgaatatatacaaaaattatcggataaactaaaaaatcgcatcaaaacgaatgtagaaaatgttgttattaacggcgatgattctaagacttttcctggctgtctcaatatttcttttccatatgtagaaggtgaagggcttatgatgaatattaaggatattgctgttagtagtggaagtgcttgcacttcatcatctttagaaccctcttatgttttgcgagctttaggcaaaaatgatgatcttgcgcattcttctataagatttggaataaataagtttacaactgaagaagaaatcaataaagtatctagtgatacaattaaagctgttaataagttaagagatatgtctcctttatatgaaatggtcaaagaagggatagatttagataaaattaattggtctgcttaa

SEQ ID NO: 42 - DNA, 1101 bp, Nosema ceranae
atgaatactgaaaataaaccatgtatttcaccatttacctttaaactagaagattgcctggcatgttcggcttgtattgctgatttttctgttccaaaaattcctacttacacagaactgaaagatgtccctttaacatttttattatcaccacattcgaaaatgaatatgtatgcacactataacaatcatataatgtcctttagtgattttgaatatcacttaatttcatttataaaactaaaatttaatgtaataaaagtatatgatacatcttatgtcaaaaatattctgtatgatagtgtttatgaggaaagcacgagagacaaaataataataagtgactgtcctgggactgtttcatatattgaaaggcaagcacaccatttaattgaatatttatctgttacttctacacaacaacaagccataaagctacttgctcaggggcgaagtataagtgtcatacagtgctatgataaatttttagagaatagcgatgatgttttaactacctatgatttttataaaatgattttggatctaggatttttacagcataattttattaaaggaacctgtgagaaatgggagaagtgtactattggatatcattatggatatttagaacacatattaaataagaagaacaattatttaacaaaaaatgatagtataaaaatatttaacagtaaaaatgaggaggtaaggttaaatggaaaaagaaaattaaatattaacacagttacattaaataaaattaatatacctgagatagattataaatataaaaatggagtgtttacatatacacagatcaaaaataataagaaaaaaaaatatttaagaatattgggtctagaaccttttcttaattttattaaggaaagtaaacataaagaattagaatatgatgtatgcgaaatatacatttgtaatcagggatgcattaatggaccaggacaattgtatacagataatttatatgtaaataattcagaatacatagatattgatcttggtattgattgtaaacagttacaaaaaaggacatatagaaaaatagaaacaaagaaagttaattttaaaatagaatggtaa

SEQ ID NO: 43 - DNA, 1830 bp, Nosema ceranae
atggccaagaatgaatctaataaaataacgagactggcaattgttaattatgaactatgtaaaccgaaggaatgtatgtcagaatgtaaaaaggcgtgtcctgttaataaaacaggaaaggagtgtattacaattgatactaaatcacatatctcagaaattctgtgtataggatgttctgcgtgtcaaaagaaatgtccttttaaggcgattacaattgtaaatttacctacaaatctagataaagacatttcacatagatattcggcaaatggttttaaacttcacagattaccaatccctaaatatggtaaggttttagggctagtaggcactaatggtataggaaaaagtactgcacttaaaatattatcgggcaatcttaaaccaaacttaggaaagttcgacgttacgcccgactgggcagcaattctaaataattataaaggatctgaacttcatggattttttactaaaattttagaagggtctattaaagctatttctaagatacagtatatagataaaatgcctaaatttttaaaaggacgctataagtcagaaatcgcctccggaaaaatgttgtttactgttaatgatatattaaaaaaagttgatgaaaaaaataaatttgactattacgtagataaaatggcacttaaaaatgtattaacaagagaattagagcaattaagtggtggtgaacttcaaagattttgtattgcatacacatgtttacaagaaggaaatgtttatatttttgatgaacccactagttttttggatgttaagcagcgactagcagctgctaaggaaataagaaatttgtgtgaagaaaataaatatgttgtagttgtcgaacacgatttagccattttagatttgatgtgtgattttggatgtgttctatacggacaatctggggcatacggtgtaataagcgcaccatacgttattaaatcagcaataaatatatttcttgatggatttttgcctacagaaaacatgaaatttagaaattcagagttaaagtttaatatttcggaaacacttgatagtattatatctaccagagaccagtatcattatcccaatttgataaaaacatatccaaattttacgcttaaagttgaaggcggtaacttttcagattctgaaattgttgtatttcttggtgaaaatggaatgggcaaaactactttagtaggtttgatttcggggttaattaaagatgataacggggaagagttcggtttgttgtcatatagtcttaaaccgcaaaaaatcataccgaaatacaaaggaacagttagagatctttttatgtcaaaaattcgttcttcctttttagacgctaattttgttaatgaagctattaaacctttagatattcatcatttatacgaccaacttgtagaaaacttgagtggtggagaattacaaagaattgcaataataatatgtttaggaaaagatgctaacctttatttattagatgaaccttctgcgtatctagattcagatcagagaatagcgatttcaaaagttataaaaaggtttatttatgggaagaagcgaacagcctttgtggttgaacatgatttaattgtaggtacatatttggctgataaagttgttgtttttgagggaagccctagtgttcatagcactgctcataaaccgatggatttgcatagtggaatgaatatttttttaaagaatcttgatattacttttagaagagactcttccaattttagaccaagagttaataagccgaattccgcaaaagacagaactcagaaagaagagaataaatattttttttga

SEQ ID NO: 44 - DNA, 1641 bp, Nosema ceranae
ttattctgcgttttcttttttgtcgtcttttattaaatctatgtctacacttgtattatttttaattgaaacgttatatgcacccgctaaatagattatagctctaatccaaatataaatcaatattattgcaatcgttaatgtgattggactacccttccttacattatcagtatcaagtgctactaatatggctagtccatataatgaaccaatagattttcctaatttattaaaaataccatcataaacacttttaaaccgtgccctgtgtgcaggatcgattctcatacccattttctctttacaaatatcaaaggctgaatattttaatacttttatgaatgctaaaaagaacattccactgtaattttcgatcgtataaatgtacgacatttttttaaaaaatacagaaatccatgaaaaagcaagtccttcaatggcagaattgtagattgatgctcccataacgattattgaccccaacaacaagaataaaggtgttaagagtcccatagtaatccatccactactttctactaaagtagaaaatgctgacaaattaagtgttattacagtaactgctaccaatatttgatctattgtattaaatttgccggagtattctcctacctctaatcctaaactttttgacgcagctttaattcctgctttatagacagattcaattaaattaaatgttatattgtaaaaaaagactattatacaaagtgacattaataattttgatttcatcattatactaataccttcggagaaacctacactaactttttgtttcttttttatcgtattagaaggtataaatattggtacactcattattttattctcgaaataatatttcatgtacattaatattagacatataccgcccatggcaataaaaaccgaagaatataataactgattttgctcatagctaaatccttttcgcaattctctgaaagaactactggctaatccagatactagtaaagctaaatttgctattatgtaaaaaggtggtaaaaatcttgtaaactgtctgatagtacaactttcatttaaaaaactcatgtataaataagccataagtaaactgccccacatttctgctattataaaaatacaagttgaaacgggctcgttagctgtaattaaaaaatattttataaagttcaatcccttcaatgcacctttgttatcagcgaaaatatctctaaataaaaagctagatggtgttactttctcttcaaacaaaaagattgcccctagtccgaagaaaaatgcagtaaaaattattagaaatagattaaaaatcgatgatacaggtttattttgcataagccactgtattaaaattacagatgcaaaagatataggaagaacataaaaaattttcataaacataattgaattctgatcttgccttaccatcacaaataaatcttttaaaattcttaaaaatgaatacacaaagttaattaatccaaacataataccaagtataaaaaatttaggcatttcaaccttagcaactttaaaataactcagtaatcctgttcttgaatttgctaattgatcaatctcatcttccgtaggtaagttgttttcaggtgtttcatttattacactcat

SEQ ID NO: 45 - DNA, 1686 bp, Nosema ceranae
atgattgagaggggtattatggaaaaaataaaaaatttattaacagaggatgaagtagaagcagaagcaaattctggaaggggcattttatcaatatttagaattgctaaggtagaaagaagaatgttttggcttatgacgcttatgttttcgcttatttcctttatttactcagtaggacgagtgttaaaagatgcagcagttcttagtagacagatgccactatccattaattgtcttaaaagctttgtaattttaccagttactcttgtttgtgtaggattaattcagaagtctacactctcttattcttttacaaaaatatttgatggtgcattgttaatatttgcttttctttatatcattcttggtctagttcttcttccatattctcatcttttccagcttgatagttatttttttagagacctttttagtgatgggaaatgtgttgtaagaggctatgatgctttattatctttggcactggtctttaacgaatggacatcctctctagtttacattgtttcagaaatgtttggtaatttagtattgtcttatttcttcttgacgtttgctaattctttaacaactccaggacaaagtgcaagattcatacctttattttatgttttctcgaatatttctcttttcttatcttctcaagtgacagaactttttacaagatatagatcaaagctcactttctcagaggcggaatttttatataatggcttttttgtattttctggagttctagtaatagttatatttttaattaaaaaatatttggagaggaatgtgactaacaaacctttgtttgttgtaaaatctgttaaaaagaagggaccaaaagttaaagtaggatttgcggagggccttaaagaaatgatggcatcaaagttattacttaacatttcattaactgttatgttctatggtatatcaactaatttaatagaatcaacatttaaaagtggacttgtgaaaggtgcagaagaattaaacgagaatactaaaagttattctatgggatataattcatttgaacaaaagatagcatcaataactgttattatcctgcttttatcaccatttccaaaattaatacaaaccaaaggatggatatttgttgccatagcgtgcccacttattaccctttttgctgtagtttctgtgtgtggtcttgctttttacaattatccggcaacaaataatgacacaaatttttttctaaattcattatgtgctacgcccggtaaatcgtttataaaattagaaaatgttttaggatgtgtagctgtagctcttatgaaagtagcaaaatatggctcttttgatatttccaaagaagccatttcaatgcagattgattcgtcattgcgtgcacgttataaaggaatttttgacggtgtttttggtaagttaggaaaatctcttggatcgttatttgtgtggattatgggatatgcatttcaaacaagagattttagaaaattagctcccttatgtatcagcgtaattgtcttttttgttattatttggatttattcagttatttatttaaataagaaatacaaagaatcagttgttagtaatttacccatcgatgttgatttgtttgcatcaaagttgttagataataaaaaagaagaggaaattgatgtgtcagtgctcgttaattaa

SEQ ID NO: 46 - DNA, 1704 bp, Nosema ceranae
atgtcagtagacaattcgaaagttctacaaaataacgaaaactctgctcttcctacagaagatgaaattgagtatgaggccagcaatggttctggtatatattcacttattagagtagcaaaggttgagagaaagatgttttggatcatggcagctatgttctttattatctcctttatttattcggtggctagagtgcttaaagatgccgctgttattggtaaacaactcccagcgtcaattttctttttgaaatttgttattatccttccgttctcatttatttcagtaggtattattcagaaagctttagataaatatccttttacaaaaatatttgatgtaactttaatagttttcgctgttgcatttactatacttggtagtttattacttccctttagtgattatattcagattcaaccgttttgggccaaagatatttttgctgatggaaaagctgttgccagaagtacagattttttattttctattgcacttgttttcaatgaatggacaagttctgctatctatgttttatctgaaatgtttggtagtttgattctttcatatttatttatgacgtttgctaatggtctttcgactcctggacagtccgctagatttgtccctttattttatgttggatctaatttggctttacttctttcaggaatgataaattacttttatagtgtaagtaaatctaaaatgtcgtatgttgcggccgaaagattttttaatggatttttttgtctgagtggaattctctgtgctgtaatttatcttctaaaaaaatatttagaaaataatgttactagcaaaccaatgtttgttagaaagacttttactaaaaagaagagtaaagtgaaggttggatttgttgatggacttattgagatgagtaaatctaaactactgttgaatatgtcattagtcgtattattttatgctgtttctacgaatattattgagtcagcttataaatctgctttagctgtcggtgctaatgaaactggtgaggcaaaatctacctatgcttcaatttatacatcaattgaacaatctggagttgctgttattgtcatgattttgctacttaccccttttccaaggcttattaaaacaaaaggatggattacaatagccattctatgtcctattattacttttttttctgcttttggtacttttgtattagcttatttaaacttcccaattacaaacaaagaggataatatatttgatatttaccgtttaccgtcaactgattctataatcaaattagaaaatattgttggtgtcatttgtgtatctttaatgaagatttctaaatatgcagcatttgatatcacaaaagaggctttgtctatgcagattgatggttctataagagcgaaatacaaaggtatttttgatggtgtatttggtaagctggggaaatcttttggatcagtttatggatttacaattactacattattaggaacaagagatgttcgtagaggtgctcctatatcgctttgtgttctaatattgttctgccttatatggttttattctgttttctatctcaatagaaaatataaagaatctgtcgagaataatgcaccaattgatattgatttattcactagttcaaaagtcaaggcaccttcttctgaacctactgttgctaccaaaagtgttactacagaagaataa

SEQ ID NO: 47 - DNA, 1461 bp, Nosema ceranae
ttaattaaaatcaacatctatctcagaattttgttcaattgattcattatattttttacttaaataacagacactcctgatccacaaaaaatttgcaaatattaaaaatataaaagacacgtatgatacttgtctaatatctggaatttctataaacgtcaaaaaagttccatataaagagataatagatttaccaattttgatacatacaccatcataaaaacttttaaatttatacctgtatttaacaggcaccctcatagaaagcatttcttttgctaaatcaaataaaacatatttggtaattttagaaaatgcaaatccaatggttgcacaccaattttcaagatttattcttaagaccgatggagctgtgcgcaaattgtaaaaagaaagtcctgaaattagagcggtaaaaaatatagcagcaataggggaggcaatagatagataaaagatccttgatgcaatgcgatttccacggattacaaagttataaaataatgatacagcactaatcgttaaggaagttgttactaaatatttttgagaataatctttcggaggcatattattaattctgcttcccgtagataaagaattttttaaggacatatcaataaatcctgcattaatagcatagattaatgccgctgcacacatatttcttaaaaatttggattgtaaaagatcaaacgaggatgtcgttttgtcttcttctttatttatagtttcctttatttctttagttttaagaggaatataactttttaaaaagtaaattaatgtagttacaaaagacaagatcaaaaaaaacaaactactaccgtcaattttatcatgcaaacctgcaggaagtatatttgctaattcatcttttatataaataaaagctacagaaataatcattgaaatggcggtgattgtggaaaaattaggaacaatttctttcatttcatcttctgtacaagcatgattggctaacgcatataaagcaaaaccaactactagagtactccacaactccgataagatgtaacataaagtacttatccactcactgtacatatataaaaaaggagataagcccatcaagcttctaactgacatcttaccatcacaaaaaatatctagtgcccattgtgatcctttttggattttatattcaaatggaattaaaagagaaccaattagaaaaaaaatgccaataaaaccaaaaataataaaattcacaatactaagaatagagtacacatttaaagccttttggacatatgacatcataagacatataattggcagtgaaaagaaaagctttatgtagtacagtgacgaaggaatttgttttgtcataatcacgatttctctgtaaaattccaataatgtgttaatcacacatgccattaaaaatgtaagtgacaataatatttttacttttgggaatttttttgtcttagtcat

SEQ ID NO: 48 - DNA, 23 bp, Artificial sequence
  Single strand DNA oligonucleotide
ttaccctatgaaacgaaaaacag

SEQ ID NO: 49 - DNA, 27 bp, Artificial sequence
  Single strand DNA oligonucleotide
tttcagcatcacttttcatatatttac

SEQ ID NO: 50 - protein, 437 aa, Nosema ceranae
MKRKTEIFIAITVVTAVTCYLFKKIINRQKSDYTSIKQEADKYFIQEDYKNAILLYTKCKYMKSDAEILTKISLCNYFLKNYQEVINNSLFKTNNKDLIKIRSECYKQMGNKKKFLKDLALYETFANNKEVQDEIMQTVKEICEEEVNEFIEQEGLKINKEDVLRGLVSIKNINEIYDAFGGKSKKFKFSNDEKEVLNLLNAIILHLKGKKEQAILLLEKSTYKYSILYRAYFLTLKNEYISSSLPLDDEITTLYLYSKIFKDKSDTYLKSAIDKSVDLPIEQKDFLYVDLLVFYISKKDVEKVNETINNLKETLTPTLLELIGEYYLKSGNHSKMLDLLSSHPDTPGKLLLTALYAISIDKKKDAIEILYRSISEYSSYFKSYLYLGNILINDDLNECRKLFNTSLQYCCNSDEVFIVKQSLILIEVHEYIKENKI

SEQ ID NO: 51 - DNA, 1032 bp, Artificial sequence
  Sequencing results
  misc_feature (1)..(20): n is a, c, g, or t
  misc_feature (51)..(51): n is a, c, g, or t
  misc_feature (64)..(64): n is a, c, g, or t
  misc_feature (66)..(66): n is a, c, g, or t
  misc_feature (671)..(671): n is a, c, g, or t
  misc_feature (683)..(683): n is a, c, g, or t
  misc_feature (719)..(719): n is a, c, g, or t
  misc_feature (722)..(722): n is a, c, g, or t
  misc_feature (727)..(727): n is a, c, g, or t
  misc_feature (789)..(789): n is a, c, g, or t
  misc_feature (796)..(797): n is a, c, g, or t
  misc_feature (799)..(799): n is a, c, g, or t
  misc_feature (804)..(804): n is a, c, g, or t
  misc_feature (818)..(818): n is a, c, g, or t
  misc_feature (822)..(822): n is a, c, g, or t
  misc_feature (836)..(840): n is a, c, g, or t
  misc_feature (845)..(845): n is a, c, g, or t
  misc_feature (849)..(849): n is a, c, g, or t
  misc_feature (853)..(854): n is a, c, g, or t
  misc_feature (864)..(864): n is a, c, g, or t
  misc_feature (866)..(866): n is a, c, g, or t
  misc_feature (880)..(880): n is a, c, g, or t
  misc_feature (887)..(887): n is a, c, g, or t
  misc_feature (891)..(891): n is a, c, g, or t
  misc_feature (902)..(903): n is a, c, g, or t
  misc_feature (906)..(913): n is a, c, g, or t
  misc_feature (918)..(918): n is a, c, g, or t
  misc_feature (920)..(920): n is a, c, g, or t
  misc_feature (937)..(938): n is a, c, g, or t
  misc_feature (941)..(941): n is a, c, g, or t
  misc_feature (944)..(944): n is a, c, g, or t
  misc_feature (956)..(956): n is a, c, g, or t
  misc_feature (958)..(958): n is a, c, g, or t
  misc_feature (962)..(962): n is a, c, g, or t
  misc_feature (964)..(969): n is a, c, g, or t
  misc_feature (971)..(974): n is a, c, g, or t
  misc_feature (977)..(977): n is a, c, g, or t
  misc_feature (983)..(987): n is a, c, g, or t
  misc_feature (991)..(991): n is a, c, g, or t
  misc_feature (998)..(1003): n is a, c, g, or t
  misc_feature (1005)..(1005): n is a, c, g, or t
  misc_feature (1008)..(1015): n is a, c, g, or t
  misc_feature (1017)..(1017): n is a, c, g, or t
  misc_feature (1019)..(1022): n is a, c, g, or t
  misc_feature (1024)..(1026): n is a, c, g, or t
  misc_feature (1028)..(1032): n is a, c, g, or t
nnnnnnnnnnnnnnnnnnnnctcggcacccggggatcctctagagtcgacncagcaggcatgcncngcttgccacgtctaatacgactcactatagggagactggtctttaacgaatggacatcctctctagtttacattgtttcagaaatgtttggtaatttagtattgtcttatttcttcttgacgtttgctaattctttaacaactccaggacaaagtgcaagattcatacctttattttatgttttctcgaatatttctcttttcttatcttctcaagtgacagaactttttacaagatatagatcaaagctcactttctcagaggcggaatttttatataatggcttttttgtattttctggagttctagtaatagttatatttttaattaaaaaatatttggagaggaatgtgactaacaaacctttgtttgttgtaaaatctgttaaaaagaagggaccaaaagttaaagtaggatttgcggagggccttaaagaaatgatggcatcaaagttattacttaacatttcattaactgttatgttctatggtatatcaactaatttaatagaatcaacatttaaaagtggacttgtgaaaggtgcagaagaattaaacgagaatactaaaagttattctatgggatataattcatttgaacaaaanatagcatcaatnactgttattatcctgcttttatcaccatttccaaanttnatacnaaccaaaggatggatatttgttgccatagcgtgcccactctccctatagtgagtcgtattangctctgnnancttgnatgcctgcaggtcnactntagaggatcccccnnnnnccganctcnattnntaatcatggncntagctgtttcctgngtgaaanttgntatccgctccnnttnnnnnnnnatacnancccggaagcataagtgnnaanccnggggtgcctaangntgancnnnnnnannnntgngttgcnnnnnctgnccgtttnnnnnngnaannnnnnnngncnnnngnnntnnnnn

SEQ ID NO: 52 - DNA, 1019 bp, Artificial sequence
  Sequencing results
  misc_feature (1)..(12): n is a, c, g, or t
  misc_feature (16)..(16): n is a, c, g, or t
  misc_feature (60)..(60): n is a, c, g, or t
  misc_feature (817)..(818): n is a, c, g, or t
  misc_feature (833)..(833): n is a, c, g, or t
  misc_feature (863)..(863): n is a, c, g, or t
  misc_feature (885)..(885): n is a, c, g, or t
  misc_feature (892)..(892): n is a, c, g, or t
  misc_feature (911)..(911): n is a, c, g, or t
  misc_feature (924)..(925): n is a, c, g, or t
  misc_feature (937)..(937): n is a, c, g, or t
  misc_feature (961)..(962): n is a, c, g, or t
  misc_feature (969)..(969): n is a, c, g, or t
  misc_feature (988)..(989): n is a, c, g, or t
  misc_feature (999)..(1001): n is a, c, g, or t
  misc_feature (1008)..(1008): n is a, c, g, or t
  misc_feature (1019)..(1019): n is a, c, g, or t
nnnnnnnnnnnntcgnctcggcacccggggatcctctagagtcgacctgcaggcatgcangcttgccacgtcctaatacgactcactatagggagacagctaacgagcccgtttcaacttgtatttttataatagcagaaatgtggggcagtttacttatggcttatttatacatgagttttttaaatgaaagttgtactatcagacagtttacaagatttttaccacctttttacataatagcaaatttagctttactagtatctggattagccagtagttctttcagaggattgcgaaaaggatttagctatgagcaaaatcagttattatattcttcggtttttattgccatgggcggtatatgtctaatattaatgtacatgaaatattatttcgagaataaaataatgagtgtaccaatatttataccctctaatacgataaaaaagaaacaaaaagttagtgtaggtttctccgaaggtattagtataatgatgaaatcaaaattattaatgtcactttgtataatagtctttttttacaatataacatttaatttaattgaatctgtctataaagcaggaattaaagctgcgtcaaaaagtttaggattagaggtaggagaatactctggtaaatttaatacaataggtcaaatattggtagcagttactgtaataacgcttaatttgtcagcattttctactttagtggaaagtagtggatggattactatggtctccctatagtgagtcgtatgctctggaagcttgcatgcctgcaggtcgactctagaggatccccgggtaccganntcgaattcgtaatcntggtcatagctgtttcctgtgtgaaattgntatccgctcacaattccacacnacatacnagccggaagcataaagtgnaaagcctggggtnnctaatgagtganctaactcacattaattgcgttgcnntcactgnccgctttccagtcgggaannctgtcgtgcnnnctgcatnaatgaatcggn

SEQ ID NO: 53 - DNA, 665 bp, Nosema ceranae
actggtctttaacgaatggacatcctctctagtttacattgtttcagaaatgtttggtaatttagtattgtcttatttcttcttgacgtttgctaattctttaacaactccaggacaaagtgcaagattcatacctttattttatgttttctcgaatatttctcttttcttatcttctcaagtgacagaactttttacaagatatagatcaaagctcactttctcagaggcggaatttttatataatggcttttttgtattttctggagttctagtaatagttatatttttaattaaaaaatatttggagaggaatgtgactaacaaacctttgtttgttgtaaaatctgttaaaaagaagggaccaaaagttaaagtaggatttgcggagggccttaaagaaatgatggcatcaaagttattacttaacatttcattaactgttatgttctatggtatatcaactaatttaatagaatcaacatttaaaagtggacttgtgaaaggtgcagaagaattaaacgagaatactaaaagttattctatgggatataattcatttgaacaaaagatagcatcaataactgttattatcctgcttttatcaccatttccaaaattaatacaaaccaaaggatggatatttgttgccatagcgtgcccac

SEQ ID NO: 54 - DNA, 645 bp, Nosema ceranae
cagctaacgagcccgtttcaacttgtatttttataatagcagaaatgtggggcagtttacttatggcttatttatacatgagttttttaaatgaaagttgtactatcagacagtttacaagatttttaccacctttttacataatagcaaatttagctttactagtatctggattagccagtagttctttcagagaattgcgaaaaggatttagctatgagcaaaatcagttattatattcttcggtttttattgccatgggcggtatatgtctaatattaatgtacatgaaatattatttcgagaataaaataatgagtgtaccaatatttataccttctaatacgataaaaaagaaacaaaaagttagtgtaggtttctccgaaggtattagtataatgatgaaatcaaaattattaatgtcactttgtataatagtctttttttacaatataacatttaatttaattgaatctgtctataaagcaggaattaaagctgcgtcaaaaagtttaggattagaggtaggagaatactccggcaaatttaatacaatagatcaaatattggtagcagttactgtaataacacttaatttgtcagcattttctactttagtagaaagtagtggatggattactatgg

SEQ ID NO: 55 - DNA, 737 bp, Artificial sequence
  Tom70 dsRNA complementary sequence
ctgaatgttacaagcagatgggaaataaaaaaaaatttcttaaggatttagcactttatgaaacatttgctaataataaagaagtccaagatgaaattatgcagactgttaaagaaatttgtgaagaagaagtgaatgagtttattgaacaagaaggtttaaaaattaataaagaagatgtgctaagaggacttgtttcaataaaaaatataaatgagatttatgatgcatttggaggtaaatctaagaagtttaaattttctaatgatgaaaaggaagtgttaaatcttcttaatgccattattttacacctaaaaggaaaaaaagaacaggcaattcttttattagaaaaatctacttataaatacagtatcttgtatagagcatattttcttacattgaagaatgaatatatttcatcttcattgcctttagatgacgagattactacgctttacttgtattctaagatttttaaagataaatctgatacttaccttaaatctgctatagataaatcagtagatctacctattgaacagaaagactttctgtacgtagatcttcttgtattttacatttctaaaaaggatgttgaaaaagttaatgaaacaattaataatttaaaagagactcttacccccactttattggaacttattggagaatattatttaaaaagtggaaatcactctaaaatgttagatctattatctagtcatccagatactcctggt

SEQ ID NO: 56 - DNA, 645 bp, Artificial sequence
  NC006 dsRNA complementary sequence
ccatagtaatccatccactactttctactaaagtagaaaatgctgacaaattaagtgttattacagtaactgctaccaatatttgatctattgtattaaatttgccggagtattctcctacctctaatcctaaactttttgacgcagctttaattcctgctttatagacagattcaattaaattaaatgttatattgtaaaaaaagactattatacaaagtgacattaataattttgatttcatcattatactaataccttcggagaaacctacactaactttttgtttcttttttatcgtattagaaggtataaatattggtacactcattattttattctcgaaataatatttcatgtacattaatattagacatataccgcccatggcaataaaaaccgaagaatataataactgattttgctcatagctaaatccttttcgcaattctctgaaagaactactggctaatccagatactagtaaagctaaatttgctattatgtaaaaaggtggtaaaaatcttgtaaactgtctgatagtacaactttcatttaaaaaactcatgtataaataagccataagtaaactgccccacatttctgctattataaaaatacaagttgaaacgggctcgttagctg

SEQ ID NO: 57 - DNA, 665 bp, Artificial sequence; identical to SEQ ID NO: 53
  NC123 dsRNA complementary sequence

SEQ ID NO: 58 - DNA, 670 bp, Artificial sequence
  NC014 dsRNA complementary sequence
ctcctggacagtccgctagatttgtccctttattttatgttggatctaatttggctttacttctttcaggaatgataaattacttttatagtgtaagtaaatctaaaatgtcgtatgttgcggccgaaagattttttaatggatttttttgtctgagtggaattctctgtgctgtaatttatcttctaaaaaaatatttagaaaataatgttactagcaaaccaatgtttgttagaaagacttttactaaaaagaagagtaaagtgaaggttggatttgttgatggacttattgagatgagtaaatctaaactactgttgaatatgtcattagtcgtattattttatgctgtttctacgaatattattgagtcagcttataaatctgctttagctgtcggtgctaatgaaactggtgaggcaaaatctacctatgcttcaatttatacatcaattgaacaatctggagttgctgttattgtcatgattttgctacttaccccttttccaaggcttattaaaacaaaaggatggattacaatagccattctatgtcctattattacttttttttctgcttttggtacttttgtattagcttatttaaacttcccaattacaaacaaagaggataatatatttgatatttaccgtttaccgtcaactgattc

SEQ ID NO: 59 - DNA, 631 bp, Artificial sequence
  NC017 dsRNA complementary sequence
gcaatgcgatttccacggattacaaagttataaaataatgatacagcactaatcgttaaggaagttgttactaaatatttttgagaataatctttcggaggcatattattaattctgcttcccgtagataaagaattttttaaggacatatcaataaatcctgcattaatagcatagattaatgccgctgcacacatatttcttaaaaatttggattgtaaaagatcaaacgaggatgtcgttttgtcttcttctttatttatagtttcctttatttctttagttttaagaggaatataactttttaaaaagtaaattaatgtagttacaaaagacaagatcaaaaaaaacaaactactaccgtcaattttatcatgcaaacctgcaggaagtatatttgctaattcatcttttatataaataaaagctacagaaataatcattgaaatggcggtgattgtggaaaaattaggaacaatttctttcatttcatcttctgtacaagcatgattggctaacgcatataaagcaaaaccaactactagagtactccacaactccgataagatgtaacataaagtacttatccactcactgtacatatataaaaaaggagataagcccatcaagc

SEQ ID NO: 60 - DNA, 19 bp, Artificial sequence
  SiRNA target sequence
atgaaacgaaaaacagaaa

SEQ ID NO: 61 - DNA, 19 bp, Artificial sequence
  SiRNA target sequence
tgaaacgaaaaacagaaat

SEQ ID NO: 62 - DNA, 19 bp, Artificial sequence
  SiRNA target sequence
gaaacgaaaaacagaaata

SEQ ID NO: 63 - DNA, 19 bp, Artificial sequence
  SiRNA target sequence
aaacgaaaaacagaaatat

SEQ ID NO: 64 - DNA, 19 bp, Artificial sequence
  SiRNA target sequence
aacgaaaaacagaaatatt

SEQ ID NO: 65 - DNA, 19 bp, Artificial sequence
  SiRNA target sequence
acgaaaaacagaaatattt

SEQ ID NO: 66 - DNA, 19 bp, Artificial sequence
  SiRNA target sequence
cgaaaaacagaaatattta

SEQ ID NO: 67 - DNA, 19 bp, Artificial sequence
  SiRNA target sequence
gaaaaacagaaatatttat

SEQ ID NO: 68 - DNA, 19 bp, Artificial sequence
  SiRNA target sequence
aaaaacagaaatatttatt

SEQ ID NO: 69 - DNA, 19 bp, Artificial sequence
  SiRNA target sequence
aaaacagaaatatttattg

SEQ ID NO: 70 - DNA, 19 bp, Artificial sequence
  SiRNA target sequence
aaacagaaatatttattgc

SEQ ID NO: 71 - DNA, 19 bp, Artificial sequence
  SiRNA target sequence
aacagaaatatttattgct

SEQ ID NO: 72 - DNA, 19 bp, Artificial sequence
  SiRNA target sequence
acagaaatatttattgcta

SEQ ID NO: 73 - DNA, 19 bp, Artificial sequence
  SiRNA target sequence
cagaaatatttattgctat

SEQ ID NO: 74 - DNA, 19 bp, Artificial sequence
  SiRNA target sequence
agaaatatttattgctatt

SEQ ID NO: 75 - DNA, 19 bp, Artificial sequence
  SiRNA target sequence
gaaatatttattgctatta

SEQ ID NO: 76 - DNA, 19 bp, Artificial sequence
  SiRNA target sequence
aaatatttattgctattac

SEQ ID NO: 77 - DNA, 19 bp, Artificial sequence
  SiRNA target sequence
aatatttattgctattaca

SEQ ID NO: 78 - DNA, 19 bp, Artificial sequence
  SiRNA target sequence
atatttattgctattacag

SEQ ID NO: 79 - DNA, 19 bp, Artificial sequence
  SiRNA target sequence
tatttattgctattacagt

SEQ ID NO: 80 - DNA, 19 bp, Artificial sequence
  SiRNA target sequence
atttattgctattacagta

SEQ ID NO: 81 - DNA, 19 bp, Artificial sequence
  SiRNA target sequence
tttattgctattacagtag

SEQ ID NO: 82 - DNA, 19 bp, Artificial sequence
  SiRNA target sequence
ttattgctattacagtagt

SEQ ID NO: 83 - DNA, 19 bp, Artificial sequence
  SiRNA target sequence
tattgctattacagtagtc

SEQ ID NO: 84 - DNA, 19 bp, Artificial sequence
  SiRNA target sequence
attgctattacagtagtca

SEQ ID NO: 85 - DNA, 19 bp, Artificial sequence
  SiRNA target sequence
ttgctattacagtagtcac

SEQ ID NO: 86 - DNA, 19 bp, Artificial sequence
  SiRNA target sequence
tgctattacagtagtcact

SEQ ID NO: 87 - DNA, 19 bp, Artificial sequence
  SiRNA target sequence
gctattacagtagtcactg

SEQ ID NO: 88 - DNA, 19 bp, Artificial sequence
  SiRNA target sequence
ctattacagtagtcactgc

SEQ ID NO: 89 - DNA, 19 bp, Artificial sequence
  SiRNA target sequence
tattacagtagtcactgca

SEQ ID NO: 90 - DNA, 19 bp, Artificial sequence
  SiRNA target sequence
attacagtagtcactgcag

SEQ ID NO: 91 - DNA, 19 bp, Artificial sequence
  SiRNA target sequence
ttacagtagtcactgcagt

SEQ ID NO: 92 - DNA, 19 bp, Artificial sequence
  SiRNA target sequence
tacagtagtcactgcagtg

SEQ ID NO: 93 - DNA, 19 bp, Artificial sequence
  SiRNA target sequence
acagtagtcactgcagtga

SEQ ID NO: 94 - DNA, 19 bp, Artificial sequence
  SiRNA target sequence
cagtagtcactgcagtgac

SEQ ID NO: 95 - DNA, 19 bp, Artificial sequence
  SiRNA target sequence
agtagtcactgcagtgaca

SEQ ID NO: 96 - DNA, 19 bp, Artificial sequence
  SiRNA target sequence
gtagtcactgcagtgacat

SEQ ID NO: 97 - DNA, 19 bp, Artificial sequence
  SiRNA target sequence
tagtcactgcagtgacatg

SEQ ID NO: 98 - DNA, 19 bp, Artificial sequence
  SiRNA target sequence
agtcactgcagtgacatgt

SEQ ID NO: 99 - DNA, 19 bp, Artificial sequence
  SiRNA target sequence
gtcactgcagtgacatgtt

SEQ ID NO: 100 - DNA, 19 bp, Artificial sequence
  SiRNA target sequence
tcactgcagtgacatgtta

SEQ ID NO: 101 - DNA, 19 bp, Artificial sequence
  SiRNA target sequence
cactgcagtgacatgttac

SEQ ID NO: 102 - DNA, 19 bp, Artificial sequence
  SiRNA target sequence
actgcagtgacatgttact

SEQ ID NO: 103 - DNA, 19 bp, Artificial sequence
  SiRNA target sequence
ctgcagtgacatgttactt

SEQ ID NO: 104 - DNA, 19 bp, Artificial sequence
  SiRNA target sequence
tgcagtgacatgttactta

SEQ ID NO: 105 - DNA, 19 bp, Artificial sequence
  SiRNA target sequence
gcagtgacatgttacttat

SEQ ID NO: 106 - DNA, 19 bp, Artificial sequence
  SiRNA target sequence
cagtgacatgttacttatt

SEQ ID NO: 107 - DNA, 19 bp, Artificial sequence
  SiRNA target sequence
agtgacatgttacttattt

SEQ ID NO: 108 - DNA, 19 bp, Artificial sequence
  SiRNA target sequence
gtgacatgttacttattta

SEQ ID NO: 109 - DNA, 19 bp, Artificial sequence
  SiRNA target sequence
tgacatgttacttatttaa

SEQ ID NO: 110 - DNA, 19 bp, Artificial sequence
  SiRNA target sequence
gacatgttacttatttaaa

SEQ ID NO: 111 - DNA, 19 bp, Artificial sequence
  SiRNA target sequence
acatgttacttatttaaaa

SEQ ID NO: 112 - DNA, 19 bp, Artificial sequence
  SiRNA target sequence
catgttacttatttaaaaa

SEQ ID NO: 113 - DNA, 19 bp, Artificial sequence
  SiRNA target sequence
atgttacttatttaaaaaa

SEQ ID NO: 114 - DNA, 19 bp, Artificial sequence
  SiRNA target sequence
tgttacttatttaaaaaaa

SEQ ID NO: 115 - DNA, 19 bp, Artificial sequence
  SiRNA target sequence
gttacttatttaaaaaaat

SEQ ID NO: 116 - DNA, 19 bp, Artificial sequence
  SiRNA target sequence
ttacttatttaaaaaaata

SEQ ID NO: 117 - DNA, 19 bp, Artificial sequence
  SiRNA target sequence
tacttatttaaaaaaataa

SEQ ID NO: 118 - DNA, 19 bp, Artificial sequence
  SiRNA target sequence
acttatttaaaaaaataat

SEQ ID NO: 119 - DNA, 19 bp, Artificial sequence
  SiRNA target sequence
cttatttaaaaaaataata

SEQ ID NO: 120 - DNA, 19 bp, Artificial sequence
  SiRNA target sequence
ttatttaaaaaaataataa

SEQ ID NO: 121 - DNA, 19 bp, Artificial sequence
  SiRNA target sequence
tatttaaaaaaataataaa

SEQ ID NO: 122 - DNA, 19 bp, Artificial sequence
  SiRNA target sequence
atttaaaaaaataataaat

SEQ ID NO: 123 - DNA, 19 bp, Artificial sequence
  SiRNA target sequence
tttaaaaaaataataaata

SEQ ID NO: 124 - DNA, 19 bp, Artificial sequence
  SiRNA target sequence
ttaaaaaaataataaatag

SEQ ID NO: 125 - DNA, 19 bp, Artificial sequence
  SiRNA target sequence
taaaaaaataataaataga

SEQ ID NO: 126 - DNA, 19 bp, Artificial sequence
  SiRNA target sequence
aaaaaaataataaatagac

SEQ ID NO: 127 - DNA, 19 bp, Artificial sequence
  SiRNA target sequence
aaaaaataataaatagaca

SEQ ID NO: 128 - DNA, 19 bp, Artificial sequence
  SiRNA target sequence
aaaaataataaatagacaa

SEQ ID NO: 129 - DNA, 19 bp, Artificial sequence
  SiRNA target sequence
aaaataataaatagacaaa

SEQ ID NO: 130 - DNA, 19 bp, Artificial sequence
  SiRNA target sequence
aaataataaatagacaaaa

SEQ ID NO: 131 - DNA, 19 bp, Artificial sequence
  SiRNA target sequence
aataataaatagacaaaag

SEQ ID NO: 132 - DNA, 19 bp, Artificial sequence
  SiRNA target sequence
ataataaatagacaaaagt

SEQ ID NO: 133 - DNA, 19 bp, Artificial sequence
  SiRNA target sequence
taataaatagacaaaagtc

SEQ ID NO: 134 - DNA, 19 bp, Artificial sequence
  SiRNA target sequence
aataaatagacaaaagtct

SEQ ID NO: 135 - DNA, 19 bp, Artificial sequence
  SiRNA target sequence
ataaatagacaaaagtctg

SEQ ID NO: 136 - DNA, 19 bp, Artificial sequence
  SiRNA target sequence
taaatagacaaaagtctga

SEQ ID NO: 137 - DNA, 19 bp, Artificial sequence
  SiRNA target sequence
aaatagacaaaagtctgat

SEQ ID NO: 138 - DNA, 19 bp, Artificial sequence
  SiRNA target sequence
aatagacaaaagtctgatt

SEQ ID NO: 139 - DNA, 19 bp, Artificial sequence
  SiRNA target sequence
atagacaaaagtctgatta

SEQ ID NO: 140 - DNA, 19 bp, Artificial sequence
  SiRNA target sequence
tagacaaaagtctgattat

SEQ ID NO: 141 - DNA, 19 bp, Artificial sequence
  SiRNA target sequence
agacaaaagtctgattata

SEQ ID NO: 142 - DNA, 19 bp, Artificial sequence
  SiRNA target sequence
gacaaaagtctgattatac

SEQ ID NO: 143 - DNA, 19 bp, Artificial sequence
  SiRNA target sequence
acaaaagtctgattataca

SEQ ID NO: 144 - DNA, 19 bp, Artificial sequence
  SiRNA target sequence
caaaagtctgattatacat

SEQ ID NO: 145 - DNA, 19 bp, Artificial sequence
  SiRNA target sequence
aaaagtctgattatacatc

SEQ ID NO: 146 - DNA, 19 bp, Artificial sequence
  SiRNA target sequence
aaagtctgattatacatca

SEQ ID NO: 147 - DNA, 19 bp, Artificial sequence
  SiRNA target sequence
aagtctgattatacatcaa

SEQ ID NO: 148 - DNA, 19 bp, Artificial sequence
  SiRNA target sequence
agtctgattatacatcaat

SEQ ID NO: 149 - DNA, 19 bp, Artificial sequence
  SiRNA target sequence
gtctgattatacatcaata

SEQ ID NO: 150 - DNA, 19 bp, Artificial sequence
  SiRNA target sequence
tctgattatacatcaataa

SEQ ID NO: 151 - DNA, 19 bp, Artificial sequence
  SiRNA target sequence
ctgattatacatcaataaa

SEQ ID NO: 152 - DNA, 19 bp, Artificial sequence
  SiRNA target sequence
tgattatacatcaataaaa

SEQ ID NO: 153 - DNA, 19 bp, Artificial sequence
  SiRNA target sequence
gattatacatcaataaaac

SEQ ID NO: 154 - DNA, 19 bp, Artificial sequence
  SiRNA target sequence
attatacatcaataaaaca

SEQ ID NO: 155 - DNA, 19 bp, Artificial sequence
  SiRNA target sequence
ttatacatcaataaaacag

SEQ ID NO: 156 - DNA, 19 bp, Artificial sequence
  SiRNA target sequence
tatacatcaataaaacagg

SEQ ID NO: 157 - DNA, 19 bp, Artificial sequence
  SiRNA target sequence
atacatcaataaaacagga

SEQ ID NO: 158 - DNA, 19 bp, Artificial sequence
  SiRNA target sequence
tacatcaataaaacaggaa

SEQ ID NO: 159 - DNA, 19 bp, Artificial sequence
  SiRNA target sequence
acatcaataaaacaggaag

SEQ ID NO: 160 - DNA, 19 bp, Artificial sequence
  SiRNA target sequence
catcaataaaacaggaagc

SEQ ID NO: 161 - DNA, 19 bp, Artificial sequence
  SiRNA target sequence
atcaataaaacaggaagca

SEQ ID NO: 162 - DNA, 19 bp, Artificial sequence
  SiRNA target sequence
tcaataaaacaggaagcag

SEQ ID NO: 163 - DNA, 19 bp, Artificial sequence
  SiRNA target sequence
caataaaacaggaagcaga

SEQ ID NO: 164 - DNA, 19 bp, Artificial sequence
  SiRNA target sequence
aataaaacaggaagcagat

SEQ ID NO: 165 - DNA, 19 bp, Artificial sequence
  SiRNA target sequence
ataaaacaggaagcagata

SEQ ID NO: 166 - DNA, 19 bp, Artificial sequence
  SiRNA target sequence
taaaacaggaagcagataa

SEQ ID NO: 167 - DNA, 19 bp, Artificial sequence
  SiRNA target sequence
aaaacaggaagcagataaa

SEQ ID NO: 168 - DNA, 19 bp, Artificial sequence
  SiRNA target sequence
aaacaggaagcagataaat

SEQ ID NO: 169 - DNA, 19 bp, Artificial sequence
  SiRNA target sequence
aacaggaagcagataaata

SEQ ID NO: 170 - DNA, 19 bp, Artificial sequence
  SiRNA target sequence
acaggaagcagataaatat

SEQ ID NO: 171 - DNA, 19 bp, Artificial sequence
  SiRNA target sequence
caggaagcagataaatatt

SEQ ID NO: 172 - DNA, 19 bp, Artificial sequence
  SiRNA target sequence
aggaagcagataaatattt

SEQ ID NO: 173 - DNA, 19 bp, Artificial sequence
  SiRNA target sequence
ggaagcagataaatatttt

SEQ ID NO: 174 - DNA, 19 bp, Artificial sequence
  SiRNA target sequence
gaagcagataaatatttta

SEQ ID NO: 175 - DNA, 19 bp, Artificial sequence
  SiRNA target sequence
aagcagataaatattttat

SEQ ID NO: 176 - DNA, 19 bp, Artificial sequence
  SiRNA target sequence
agcagataaatattttata

SEQ ID NO: 177 - DNA, 19 bp, Artificial sequence
  SiRNA target sequence
gcagataaatattttatac

SEQ ID NO: 178 - DNA, 19 bp, Artificial sequence
  SiRNA target sequence
cagataaatattttataca

SEQ ID NO: 179 - DNA, 19 bp, Artificial sequence
  SiRNA target sequence
agataaatattttatacaa

SEQ ID NO: 180 - DNA, 19 bp, Artificial sequence
  SiRNA target sequence
gataaatattttatacaag

SEQ ID NO: 181 - DNA, 19 bp, Artificial sequence
  SiRNA target sequence
ataaatattttatacaaga

SEQ ID NO: 182 - DNA, 19 bp, Artificial sequence
  SiRNA target sequence
taaatattttatacaagaa

SEQ ID NO: 183 - DNA, 19 bp, Artificial sequence
  SiRNA target sequence
aaatattttatacaagaag

SEQ ID NO: 184 - DNA, 19 bp, Artificial sequence
  SiRNA target sequence
aatattttatacaagaaga

SEQ ID NO: 185 - DNA, 19 bp, Artificial sequence
  SiRNA target sequence
atattttatacaagaagat

SEQ ID NO: 186 - DNA, 19 bp, Artificial sequence
  SiRNA target sequence
tattttatacaagaagatt

SEQ ID NO: 187 - DNA, 19 bp, Artificial sequence
  SiRNA target sequence
attttatacaagaagatta

SEQ ID NO: 188 - DNA, 19 bp, Artificial sequence
  SiRNA target sequence
ttttatacaagaagattat

SEQ ID NO: 189 - DNA, 19 bp, Artificial sequence
  SiRNA target sequence
tttatacaagaagattata

SEQ ID NO: 190 - DNA, 19 bp, Artificial sequence
  SiRNA target sequence
ttatacaagaagattataa

SEQ ID NO: 191 - DNA, 19 bp, Artificial sequence
  SiRNA target sequence
tatacaagaagattataaa

SEQ ID NO: 192 - DNA, 19 bp, Artificial sequence
  SiRNA target sequence
atacaagaagattataaaa

SEQ ID NO: 193 - DNA, 19 bp, Artificial sequence
  SiRNA target sequence
tacaagaagattataaaaa

SEQ ID NO: 194 - DNA, 19 bp, Artificial sequence
  SiRNA target sequence
acaagaagattataaaaat

SEQ ID NO: 195 - DNA, 19 bp, Artificial sequence
  SiRNA target sequence
caagaagattataaaaatg

SEQ ID NO: 196 - DNA, 19 bp, Artificial sequence
  SiRNA target sequence
aagaagattataaaaatgc

SEQ ID NO: 197 - DNA, 19 bp, Artificial sequence
  SiRNA target sequence
agaagattataaaaatgct

SEQ ID NO: 198 - DNA, 19 bp, Artificial sequence
  SiRNA target sequence
gaagattataaaaatgcta

SEQ ID NO: 199 - DNA, 19 bp, Artificial sequence
  SiRNA target sequence
aagattataaaaatgctat

SEQ ID NO: 200 - DNA, 19 bp, Artificial sequence
  SiRNA target sequence
agattataaaaatgctatt

SEQ ID NO: 201 - DNA, 19 bp, Artificial sequence
  SiRNA target sequence
gattataaaaatgctattc

SEQ ID NO: 202 - DNA, 19 bp, Artificial sequence
  SiRNA target sequence
attataaaaatgctattct

SEQ ID NO: 203 - DNA, 19 bp, Artificial sequence
  SiRNA target sequence
ttataaaaatgctattctg

SEQ ID NO: 204 - DNA, 19 bp, Artificial sequence
  SiRNA target sequence
tataaaaatgctattctgt

SEQ ID NO: 205 - DNA, 19 bp, Artificial sequence
  SiRNA target sequence
ataaaaatgctattctgtt

SEQ ID NO: 206 - DNA, 19 bp, Artificial sequence
  SiRNA target sequence
taaaaatgctattctgttg

SEQ ID NO: 207 - DNA, 19 bp, Artificial sequence
  SiRNA target sequence
aaaaatgctattctgttgt

SEQ ID NO: 208 - DNA, 19 bp, Artificial sequence
  SiRNA target sequence
aaaatgctattctgttgta

SEQ ID NO: 209 - DNA, 19 bp, Artificial sequence
  SiRNA target sequence
aaatgctattctgttgtac

SEQ ID NO: 210 - DNA, 19 bp, Artificial sequence
  SiRNA target sequence
aatgctattctgttgtaca

SEQ ID NO: 211 - DNA, 19 bp, Artificial sequence
  SiRNA target sequence
atgctattctgttgtacac

SEQ ID NO: 212 - DNA, 19 bp, Artificial sequence
  SiRNA target sequence
tgctattctgttgtacact

SEQ ID NO: 213 - DNA, 19 bp, Artificial sequence
  SiRNA target sequence
gctattctgttgtacacta

SEQ ID NO: 214 - DNA, 19 bp, Artificial sequence
  SiRNA target sequence
ctattctgttgtacactaa

SEQ ID NO: 215 - DNA, 19 bp, Artificial sequence
  SiRNA target sequence
tattctgttgtacactaaa

SEQ ID NO: 216 - DNA, 19 bp, Artificial sequence
  SiRNA target sequence
attctgttgtacactaaat

SEQ ID NO: 217 - DNA, 19 bp, Artificial sequence
  SiRNA target sequence
ttctgttgtacactaaatg

SEQ ID NO: 218 - DNA, 19 bp, Artificial sequence
  SiRNA target sequence
tctgttgtacactaaatgt

SEQ ID NO: 219 - DNA, 19 bp, Artificial sequence
  SiRNA target sequence
ctgttgtacactaaatgta

SEQ ID NO: 220 - DNA, 19 bp, Artificial sequence
  SiRNA target sequence
tgttgtacactaaatgtaa

SEQ ID NO: 221 - DNA, 19 bp, Artificial sequence
  SiRNA target sequence
gttgtacactaaatgtaaa

SEQ ID NO: 222 - DNA, 19 bp, Artificial sequence
  SiRNA target sequence
ttgtacactaaatgtaaat

SEQ ID NO: 223 - DNA, 19 bp, Artificial sequence
  SiRNA target sequence
tgtacactaaatgtaaata

SEQ ID NO: 224 - DNA, 19 bp, Artificial sequence
  SiRNA target sequence
gtacactaaatgtaaatat

SEQ ID NO: 225 - DNA, 19 bp, Artificial sequence
  SiRNA target sequence
tacactaaatgtaaatata

SEQ ID NO: 226 - DNA, 19 bp, Artificial sequence
  SiRNA target sequence
acactaaatgtaaatatat

SEQ ID NO: 227 - DNA, 19 bp, Artificial sequence
  SiRNA target sequence
cactaaatgtaaatatatg

SEQ ID NO: 228 - DNA, 19 bp, Artificial sequence
  SiRNA target sequence
actaaatgtaaatatatga

SEQ ID NO: 229 - DNA, 19 bp, Artificial sequence
  SiRNA target sequence
ctaaatgtaaatatatgaa

SEQ ID NO: 230 - DNA, 19 bp, Artificial sequence
  SiRNA target sequence
taaatgtaaatatatgaaa

SEQ ID NO: 231 - DNA, 19 bp, Artificial sequence
  SiRNA target sequence
aaatgtaaatatatgaaaa

SEQ ID NO: 232 - DNA, 19 bp, Artificial sequence
  SiRNA target sequence
aatgtaaatatatgaaaag

SEQ ID NO: 233 - DNA, 19 bp, Artificial sequence
  SiRNA target sequence
atgtaaatatatgaaaagt

SEQ ID NO: 234 - DNA, 19 bp, Artificial sequence
  SiRNA target sequence
tgtaaatatatgaaaagtg

SEQ ID NO: 235 - DNA, 19 bp, Artificial sequence
  SiRNA target sequence
gtaaatatatgaaaagtga

SEQ ID NO: 236 - DNA, 19 bp, Artificial sequence
  SiRNA target sequence
taaatatatgaaaagtgat

SEQ ID NO: 237 - DNA, 19 bp, Artificial sequence
  SiRNA target sequence
aaatatatgaaaagtgatg

SEQ ID NO: 238 - DNA, 19 bp, Artificial sequence
  SiRNA target sequence
aatatatgaaaagtgatgc

SEQ ID NO: 239 - DNA, 19 bp, Artificial sequence
  SiRNA target sequence
atatatgaaaagtgatgct

SEQ ID NO: 240 - DNA, 19 bp, Artificial sequence
  SiRNA target sequence
tatatgaaaagtgatgctg

SEQ ID NO: 241 - DNA, 19 bp, Artificial sequence
  SiRNA target sequence
atatgaaaagtgatgctga

SEQ ID NO: 242 - DNA, 19 bp, Artificial sequence
  SiRNA target sequence
tatgaaaagtgatgctgaa

SEQ ID NO: 243 - DNA, 19 bp, Artificial sequence
  SiRNA target sequence
atgaaaagtgatgctgaaa

SEQ ID NO: 244 - DNA, 19 bp, Artificial sequence
  SiRNA target sequence
tgaaaagtgatgctgaaat

SEQ ID NO: 245 - DNA, 19 bp, Artificial sequence
  SiRNA target sequence
gaaaagtgatgctgaaatt

SEQ ID NO: 246 - DNA, 19 bp, Artificial sequence
  SiRNA target sequence
aaaagtgatgctgaaattc

SEQ ID NO: 247 - DNA, 19 bp, Artificial sequence
  SiRNA target sequence
aaagtgatgctgaaattct

SEQ ID NO: 248 - DNA, 19 bp, Artificial sequence
  SiRNA target sequence
aagtgatgctgaaattctt

SEQ ID NO: 249 - DNA, 19 bp, Artificial sequence
  SiRNA target sequence
agtgatgctgaaattctta

SEQ ID NO: 250 - DNA, 19 bp, Artificial sequence
  SiRNA target sequence
gtgatgctgaaattcttac

SEQ ID NO: 251 - DNA, 19 bp, Artificial sequence
  SiRNA target sequence
tgatgctgaaattcttact

SEQ ID NO: 252 - DNA, 19 bp, Artificial sequence
  SiRNA target sequence
gatgctgaaattcttacta

SEQ ID NO: 253 - DNA, 19 bp, Artificial sequence
  SiRNA target sequence
atgctgaaattcttactaa

SEQ ID NO: 254 - DNA, 19 bp, Artificial sequence
  SiRNA target sequence
tgctgaaattcttactaaa

SEQ ID NO: 255 - DNA, 19 bp, Artificial sequence
  SiRNA target sequence
gctgaaattcttactaaaa

SEQ ID NO: 256 - DNA, 19 bp, Artificial sequence
  SiRNA target sequence
ctgaaattcttactaaaat

SEQ ID NO: 257 - DNA, 19 bp, Artificial sequence
  SiRNA target sequence
tgaaattcttactaaaatt

SEQ ID NO: 258 - DNA, 19 bp, Artificial sequence
  SiRNA target sequence
gaaattcttactaaaatta

SEQ ID NO: 259 - DNA, 19 bp, Artificial sequence
  SiRNA target sequence
aaattcttactaaaattag

SEQ ID NO: 260 - DNA, 19 bp, Artificial sequence
  SiRNA target sequence
aattcttactaaaattagt

SEQ ID NO: 261 - DNA, 19 bp, Artificial sequence
  SiRNA target sequence
attcttactaaaattagtc

SEQ ID NO: 262 - DNA, 19 bp, Artificial sequence
  SiRNA target sequence
ttcttactaaaattagtct

SEQ ID NO: 263 - DNA, 19 bp, Artificial sequence
  SiRNA target sequence
tcttactaaaattagtctc

SEQ ID NO: 264 - DNA, 19 bp, Artificial sequence
  SiRNA target sequence
cttactaaaattagtctct

SEQ ID NO: 265 - DNA, 19 bp, Artificial sequence
  SiRNA target sequence
ttactaaaattagtctctg

SEQ ID NO: 266 - DNA, 19 bp, Artificial sequence
  SiRNA target sequence
tactaaaattagtctctgt

SEQ ID NO: 267 - DNA, 19 bp, Artificial sequence
  SiRNA target sequence
actaaaattagtctctgta

SEQ ID NO: 268 - DNA, 19 bp, Artificial sequence
  SiRNA target sequence
ctaaaattagtctctgtaa

SEQ ID NO: 269 - DNA, 19 bp, Artificial sequence
  SiRNA target sequence
taaaattagtctctgtaat

SEQ ID NO: 270 - DNA, 19 bp, Artificial sequence
  SiRNA target sequence
aaaattagtctctgtaatt

SEQ ID NO: 271 - DNA, 19 bp, Artificial sequence
  SiRNA target sequence
aaattagtctctgtaatta

SEQ ID NO: 272 - DNA, 19 bp, Artificial sequence
  SiRNA target sequence
aattagtctctgtaattat

SEQ ID NO: 273 - DNA, 19 bp, Artificial sequence
  SiRNA target sequence
attagtctctgtaattatt

SEQ ID NO: 274 - DNA, 19 bp, Artificial sequence
  SiRNA target sequence
ttagtctctgtaattattt

SEQ ID NO: 275 - DNA, 19 bp, Artificial sequence
  SiRNA target sequence
tagtctctgtaattatttc

SEQ ID NO: 276 - DNA, 19 bp, Artificial sequence
  SiRNA target sequence
agtctctgtaattatttct

SEQ ID NO: 277 - DNA, 19 bp, Artificial sequence
  SiRNA target sequence
gtctctgtaattatttctt

SEQ ID NO: 278 - DNA, 19 bp, Artificial sequence
  SiRNA target sequence
tctctgtaattatttctta

SEQ ID NO: 279 - DNA, 19 bp, Artificial sequence
  SiRNA target sequence
ctctgtaattatttcttaa

SEQ ID NO: 280 - DNA, 19 bp, Artificial sequence
  SiRNA target sequence
tctgtaattatttcttaaa

SEQ ID NO: 281 - DNA, 19 bp, Artificial sequence
  SiRNA target sequence
ctgtaattatttcttaaaa

SEQ ID NO: 282 - DNA, 19 bp, Artificial sequence
  SiRNA target sequence
tgtaattatttcttaaaaa

SEQ ID NO: 283 - DNA, 19 bp, Artificial sequence
  SiRNA target sequence
gtaattatttcttaaaaaa

SEQ ID NO: 284 - DNA, 19 bp, Artificial sequence
  SiRNA target sequence
taattatttcttaaaaaat

SEQ ID NO: 285 - DNA, 19 bp, Artificial sequence
  SiRNA target sequence
aattatttcttaaaaaatt

SEQ ID NO: 286 - DNA, 19 bp, Artificial sequence
  SiRNA target sequence
attatttcttaaaaaatta

SEQ ID NO: 287 - DNA, 19 bp, Artificial sequence
  SiRNA target sequence
ttatttcttaaaaaattat

SEQ ID NO: 288 - DNA, 19 bp, Artificial sequence
  SiRNA target sequence
tatttcttaaaaaattatc

SEQ ID NO: 289 - DNA, 19 bp, Artificial sequence
  SiRNA target sequence
atttcttaaaaaattatca

SEQ ID NO: 290 - DNA, 19 bp, Artificial sequence
  SiRNA target sequence
tttcttaaaaaattatcaa

SEQ ID NO: 291 - DNA, 19 bp, Artificial sequence
  SiRNA target sequence
ttcttaaaaaattatcaag

SEQ ID NO: 292 - DNA, 19 bp, Artificial sequence
  SiRNA target sequence
tcttaaaaaattatcaaga

SEQ ID NO: 293 - DNA, 19 bp, Artificial sequence
  SiRNA target sequence
cttaaaaaattatcaagaa

SEQ ID NO: 294 - DNA, 19 bp, Artificial sequence
  SiRNA target sequence
ttaaaaaattatcaagaag

SEQ ID NO: 295 - DNA, 19 bp, Artificial sequence
  SiRNA target sequence
taaaaaattatcaagaagt

SEQ ID NO: 296 - DNA, 19 bp, Artificial sequence
  SiRNA target sequence
aaaaaattatcaagaagtt

SEQ ID NO: 297 - DNA, 19 bp, Artificial sequence
  SiRNA target sequence
aaaaattatcaagaagtta

SEQ ID NO: 298 - DNA, 19 bp, Artificial sequence
  SiRNA target sequence
aaaattatcaagaagttat

SEQ ID NO: 299 - DNA, 19 bp, Artificial sequence
  SiRNA target sequence
aaattatcaagaagttata

SEQ ID NO: 300 - DNA, 19 bp, Artificial sequence
  SiRNA target sequence
aattatcaagaagttataa

SEQ ID NO: 301 - DNA, 19 bp, Artificial sequence
  SiRNA target sequence
attatcaagaagttataaa

SEQ ID NO: 302 - DNA, 19 bp, Artificial sequence
  SiRNA target sequence
ttatcaagaagttataaat

SEQ ID NO: 303 - DNA, 19 bp, Artificial sequence
  SiRNA target sequence
tatcaagaagttataaata

SEQ ID NO: 304 - DNA, 19 bp, Artificial sequence
  SiRNA target sequence
atcaagaagttataaataa

SEQ ID NO: 305 - DNA, 19 bp, Artificial sequence
  SiRNA target sequence
tcaagaagttataaataat

SEQ ID NO: 306 - DNA, 19 bp, Artificial sequence
  SiRNA target sequence
caagaagttataaataatt

SEQ ID NO: 307 - DNA, 19 bp, Artificial sequence
  SiRNA target sequence
aagaagttataaataattc

SEQ ID NO: 308 - DNA, 19 bp, Artificial sequence
  SiRNA target sequence
agaagttataaataattct

SEQ ID NO: 309 - DNA, 19 bp, Artificial sequence
  SiRNA target sequence
gaagttataaataattctt

SEQ ID NO: 310 - DNA, 19 bp, Artificial sequence
  SiRNA target sequence
aagttataaataattcttt

SEQ ID NO: 311 - DNA, 19 bp, Artificial sequence
  SiRNA target sequence
agttataaataattcttta

SEQ ID NO: 312 - DNA, 19 bp, Artificial sequence
  SiRNA target sequence
gttataaataattctttat

SEQ ID NO: 313 - DNA, 19 bp, Artificial sequence
  SiRNA target sequence
ttataaataattctttatt

SEQ ID NO: 314 - DNA, 19 bp, Artificial sequence
  SiRNA target sequence
tataaataattctttattt

SEQ ID NO: 315 - DNA, 19 bp, Artificial sequence
  SiRNA target sequence
ataaataattctttattta

SEQ ID NO: 316 - DNA, 19 bp, Artificial sequence
  SiRNA target sequence
taaataattctttatttaa

SEQ ID NO: 317 - DNA, 19 bp, Artificial sequence
  SiRNA target sequence
aaataattctttatttaag

SEQ ID NO: 318 - DNA, 19 bp, Artificial sequence
  SiRNA target sequence
aataattctttatttaaga

SEQ ID NO: 319 - DNA, 19 bp, Artificial sequence
  SiRNA target sequence
ataattctttatttaagac

SEQ ID NO: 320 - DNA, 19 bp, Artificial sequence
  SiRNA target sequence
taattctttatttaagaca

SEQ ID NO: 321 - DNA, 19 bp, Artificial sequence
  SiRNA target sequence
aattctttatttaagacaa

SEQ ID NO: 322 - DNA, 19 bp, Artificial sequence
  SiRNA target sequence
attctttatttaagacaaa

SEQ ID NO: 323 - DNA, 19 bp, Artificial sequence
  SiRNA target sequence
ttctttatttaagacaaat

SEQ ID NO: 324 - DNA, 19 bp, Artificial sequence
  SiRNA target sequence
tctttatttaagacaaata

SEQ ID NO: 325 - DNA, 19 bp, Artificial sequence
  SiRNA target sequence
ctttatttaagacaaataa

SEQ ID NO: 326 - DNA, 19 bp, Artificial sequence
  SiRNA target sequence
tttatttaagacaaataat

SEQ ID NO: 327 - DNA, 19 bp, Artificial sequence
  SiRNA target sequence
ttatttaagacaaataata

SEQ ID NO: 328 - DNA, 19 bp, Artificial sequence
  SiRNA target sequence
tatttaagacaaataataa

SEQ ID NO: 329 - DNA, 19 bp, Artificial sequence
  SiRNA target sequence
atttaagacaaataataaa

SEQ ID NO: 330 - DNA, 19 bp, Artificial sequence
  SiRNA target sequence
tttaagacaaataataaag

SEQ ID NO: 331 - DNA, 19 bp, Artificial sequence
  SiRNA target sequence
ttaagacaaataataaaga

SEQ ID NO: 332 - DNA, 19 bp, Artificial sequence
  SiRNA target sequence
taagacaaataataaagat

SEQ ID NO: 333 - DNA, 19 bp, Artificial sequence
  SiRNA target sequence
aagacaaataataaagatc

SEQ ID NO: 334 - DNA, 19 bp, Artificial sequence
  SiRNA target sequence
agacaaataataaagatct

SEQ ID NO: 335 - DNA, 19 bp, Artificial sequence
  SiRNA target sequence
gacaaataataaagatcta

SEQ ID NO: 336 - DNA, 19 bp, Artificial sequence
  SiRNA target sequence
acaaataataaagatctaa

SEQ ID NO: 337 - DNA, 19 bp, Artificial sequence
  SiRNA target sequence
caaataataaagatctaat

SEQ ID NO: 338 - DNA, 19 bp, Artificial sequence
  SiRNA target sequence
aaataataaagatctaata

SEQ ID NO: 339 - DNA, 19 bp, Artificial sequence
  SiRNA target sequence
aataataaagatctaataa

SEQ ID NO: 340 - DNA, 19 bp, Artificial sequence
  SiRNA target sequence
ataataaagatctaataaa

SEQ ID NO: 341 - DNA, 19 bp, Artificial sequence
  SiRNA target sequence
taataaagatctaataaaa

SEQ ID NO: 342 - DNA, 19 bp, Artificial sequence
  SiRNA target sequence
aataaagatctaataaaaa

SEQ ID NO: 343 - DNA, 19 bp, Artificial sequence
  SiRNA target sequence
ataaagatctaataaaaat

SEQ ID NO: 344 - DNA, 19 bp, Artificial sequence
  SiRNA target sequence
taaagatctaataaaaata

SEQ ID NO: 345 - DNA, 19 bp, Artificial sequence
  SiRNA target sequence
aaagatctaataaaaataa

SEQ ID NO: 346 - DNA, 19 bp, Artificial sequence
  SiRNA target sequence
aagatctaataaaaataag

SEQ ID NO: 347 - DNA, 19 bp, Artificial sequence
  SiRNA target sequence
agatctaataaaaataaga

SEQ ID NO: 348 - DNA, 19 bp, Artificial sequence
  SiRNA target sequence
gatctaataaaaataagat

SEQ ID NO: 349 - DNA, 19 bp, Artificial sequence
  SiRNA target sequence
atctaataaaaataagatc

SEQ ID NO: 350 - DNA, 19 bp, Artificial sequence
  SiRNA target sequence
tctaataaaaataagatct

SEQ ID NO: 351 - DNA, 19 bp, Artificial sequence
  SiRNA target sequence
ctaataaaaataagatctg

SEQ ID NO: 352 - DNA, 19 bp, Artificial sequence
  SiRNA target sequence
taataaaaataagatctga

SEQ ID NO: 353 - DNA, 19 bp, Artificial sequence
  SiRNA target sequence
aataaaaataagatctgaa

SEQ ID NO: 354 - DNA, 19 bp, Artificial sequence
  SiRNA target sequence
ataaaaataagatctgaat

SEQ ID NO: 355 - DNA, 19 bp, Artificial sequence
  SiRNA target sequence
taaaaataagatctgaatg

SEQ ID NO: 356 - DNA, 19 bp, Artificial sequence
  SiRNA target sequence
aaaaataagatctgaatgt

SEQ ID NO: 357 - DNA, 19 bp, Artificial sequence
  SiRNA target sequence
aaaataagatctgaatgtt

SEQ ID NO: 358 - DNA, 19 bp, Artificial sequence
  SiRNA target sequence
aaataagatctgaatgtta

SEQ ID NO: 359 - DNA, 19 bp, Artificial sequence
  SiRNA target sequence
aataagatctgaatgttac

SEQ ID NO: 360 - DNA, 19 bp, Artificial sequence
  SiRNA target sequence
ataagatctgaatgttaca

SEQ ID NO: 361 - DNA, 19 bp, Artificial sequence
  SiRNA target sequence
taagatctgaatgttacaa

SEQ ID NO: 362 - DNA, 19 bp, Artificial sequence
  SiRNA target sequence
aagatctgaatgttacaag

SEQ ID NO: 363 - DNA, 19 bp, Artificial sequence
  SiRNA target sequence
agatctgaatgttacaagc

SEQ ID NO: 364 - DNA, 19 bp, Artificial sequence
  SiRNA target sequence
gatctgaatgttacaagca

SEQ ID NO: 365 - DNA, 19 bp, Artificial sequence
  SiRNA target sequence
atctgaatgttacaagcag

SEQ ID NO: 366 - DNA, 19 bp, Artificial sequence
  SiRNA target sequence
tctgaatgttacaagcaga

SEQ ID NO: 367 - DNA, 19 bp, Artificial sequence
  SiRNA target sequence
ctgaatgttacaagcagat

SEQ ID NO: 368 - DNA, 19 bp, Artificial sequence
  SiRNA target sequence
tgaatgttacaagcagatg

SEQ ID NO: 369 - DNA, 19 bp, Artificial sequence
  SiRNA target sequence
gaatgttacaagcagatgg

SEQ ID NO: 370 - DNA, 19 bp, Artificial sequence
  SiRNA target sequence
aatgttacaagcagatggg

SEQ ID NO: 371 - DNA, 19 bp, Artificial sequence
  SiRNA target sequence
atgttacaagcagatggga

SEQ ID NO: 372 - DNA, 19 bp, Artificial sequence
  SiRNA target sequence
tgttacaagcagatgggaa

SEQ ID NO: 373 - DNA, 19 bp, Artificial sequence
  SiRNA target sequence
gttacaagcagatgggaaa

SEQ ID NO: 374 - DNA, 19 bp, Artificial sequence
  SiRNA target sequence
ttacaagcagatgggaaat

SEQ ID NO: 375 - DNA, 19 bp, Artificial sequence
  SiRNA target sequence
tacaagcagatgggaaata

SEQ ID NO: 376 - DNA, 19 bp, Artificial sequence
  SiRNA target sequence
acaagcagatgggaaataa

SEQ ID NO: 377 - DNA, 19 bp, Artificial sequence
  SiRNA target sequence
caagcagatgggaaataaa

SEQ ID NO: 378 - DNA, 19 bp, Artificial sequence
  SiRNA target sequence
aagcagatgggaaataaaa

SEQ ID NO: 379 - DNA, 19 bp, Artificial sequence
  SiRNA target sequence
agcagatgggaaataaaaa

SEQ ID NO: 380 - DNA, 19 bp, Artificial sequence
  SiRNA target sequence
gcagatgggaaataaaaaa

SEQ ID NO: 381 - DNA, 19 bp, Artificial sequence
  SiRNA target sequence
cagatgggaaataaaaaaa

SEQ ID NO: 382 - DNA, 19 bp, Artificial sequence
  SiRNA target sequence
agatgggaaataaaaaaaa

SEQ ID NO: 383 - DNA, 19 bp, Artificial sequence
  SiRNA target sequence
gatgggaaataaaaaaaaa

SEQ ID NO: 384 - DNA, 19 bp, Artificial sequence
  SiRNA target sequence
atgggaaataaaaaaaaat

SEQ ID NO: 385 - DNA, 19 bp, Artificial sequence
  SiRNA target sequence
tgggaaataaaaaaaaatt

SEQ ID NO: 386 - DNA, 19 bp, Artificial sequence
  SiRNA target sequence
gggaaataaaaaaaaattt

SEQ ID NO: 387 - DNA, 19 bp, Artificial sequence
  SiRNA target sequence
ggaaataaaaaaaaatttc

SEQ ID NO: 388 - DNA, 19 bp, Artificial sequence
  SiRNA target sequence
gaaataaaaaaaaatttct

SEQ ID NO: 389 - DNA, 19 bp, Artificial sequence
  SiRNA target sequence
aaataaaaaaaaatttctt

SEQ ID NO: 390 - DNA, 19 bp, Artificial sequence
  SiRNA target sequence
aataaaaaaaaatttctta

SEQ ID NO: 391 - DNA, 19 bp, Artificial sequence
  SiRNA target sequence
ataaaaaaaaatttcttaa

SEQ ID NO: 392 - DNA, 19 bp, Artificial sequence
  SiRNA target sequence
taaaaaaaaatttcttaag

SEQ ID NO: 393 - DNA, 19 bp, Artificial sequence
  SiRNA target sequence
aaaaaaaaatttcttaagg

SEQ ID NO: 394 - DNA, 19 bp, Artificial sequence
  SiRNA target sequence
aaaaaaaatttcttaagga

SEQ ID NO: 395 - DNA, 19 bp, Artificial sequence
  SiRNA target sequence
aaaaaaatttcttaaggat

SEQ ID NO: 396 - DNA, 19 bp, Artificial sequence
  SiRNA target sequence
aaaaaatttcttaaggatt

SEQ ID NO: 397 - DNA, 19 bp, Artificial sequence
  SiRNA target sequence
aaaaatttcttaaggattt

SEQ ID NO: 398 - DNA, 19 bp, Artificial sequence
  SiRNA target sequence
aaaatttcttaaggattta

SEQ ID NO: 399 - DNA, 19 bp, Artificial sequence
  SiRNA target sequence
aaatttcttaaggatttag

SEQ ID NO: 400 - DNA, 19 bp, Artificial sequence
  SiRNA target sequence
aatttcttaaggatttagc

SEQ ID NO: 401 - DNA, 19 bp, Artificial sequence
  SiRNA target sequence
atttcttaaggatttagca

SEQ ID NO: 402 - DNA, 19 bp, Artificial sequence
  SiRNA target sequence
tttcttaaggatttagcac

SEQ ID NO: 403 - DNA, 19 bp, Artificial sequence
  SiRNA target sequence
ttcttaaggatttagcact

SEQ ID NO: 404 - DNA, 19 bp, Artificial sequence
  SiRNA target sequence
tcttaaggatttagcactt

SEQ ID NO: 405 - DNA, 19 bp, Artificial sequence
  SiRNA target sequence
cttaaggatttagcacttt

SEQ ID NO: 406 - DNA, 19 bp, Artificial sequence
  SiRNA target sequence
ttaaggatttagcacttta

SEQ ID NO: 407 - DNA, 19 bp, Artificial sequence
  SiRNA target sequence
taaggatttagcactttat

SEQ ID NO: 408 - DNA, 19 bp, Artificial sequence
  SiRNA target sequence
aaggatttagcactttatg

SEQ ID NO: 409 - DNA, 19 bp, Artificial sequence
  SiRNA target sequence
aggatttagcactttatga

SEQ ID NO: 410 - DNA, 19 bp, Artificial sequence
  SiRNA target sequence
ggatttagcactttatgaa

SEQ ID NO: 411 - DNA, 19 bp, Artificial sequence
  SiRNA target sequence
gatttagcactttatgaaa

SEQ ID NO: 412 - DNA, 19 bp, Artificial sequence
  SiRNA target sequence
atttagcactttatgaaac

SEQ ID NO: 413 - DNA, 19 bp, Artificial sequence
  SiRNA target sequence
tttagcactttatgaaaca

SEQ ID NO: 414 - DNA, 19 bp, Artificial sequence
  SiRNA target sequence
ttagcactttatgaaacat

SEQ ID NO: 415 - DNA, 19 bp, Artificial sequence
  SiRNA target sequence
tagcactttatgaaacatt

SEQ ID NO: 416 - DNA, 19 bp, Artificial sequence
  SiRNA target sequence
agcactttatgaaacattt

SEQ ID NO: 417 - DNA, 19 bp, Artificial sequence
  SiRNA target sequence
gcactttatgaaacatttg

SEQ ID NO: 418 - DNA, 19 bp, Artificial sequence
  SiRNA target sequence
cactttatgaaacatttgc

SEQ ID NO: 419 - DNA, 19 bp, Artificial sequence
  SiRNA target sequence
actttatgaaacatttgct

SEQ ID NO: 420 - DNA, 19 bp, Artificial sequence
  SiRNA target sequence
ctttatgaaacatttgcta

SEQ ID NO: 421 - DNA, 19 bp, Artificial sequence
  SiRNA target sequence
tttatgaaacatttgctaa

SEQ ID NO: 422 - DNA, 19 bp, Artificial sequence
  SiRNA target sequence
ttatgaaacatttgctaat

SEQ ID NO: 423 - DNA, 19 bp, Artificial sequence
  SiRNA target sequence
tatgaaacatttgctaata

SEQ ID NO: 424 - DNA, 19 bp, Artificial sequence
  SiRNA target sequence
atgaaacatttgctaataa

SEQ ID NO: 425 - DNA, 19 bp, Artificial sequence
  SiRNA target sequence
tgaaacatttgctaataat

SEQ ID NO: 426 - DNA, 19 bp, Artificial sequence
  SiRNA target sequence
gaaacatttgctaataata

SEQ ID NO: 427 - DNA, 19 bp, Artificial sequence
  SiRNA target sequence
aaacatttgctaataataa

SEQ ID NO: 428 - DNA, 19 bp, Artificial sequence
  SiRNA target sequence
aacatttgctaataataaa

SEQ ID NO: 429 - DNA, 19 bp, Artificial sequence
  SiRNA target sequence
acatttgctaataataaag

SEQ ID NO: 430 - DNA, 19 bp, Artificial sequence
  SiRNA target sequence
catttgctaataataaaga

SEQ ID NO: 431 - DNA, 19 bp, Artificial sequence
  SiRNA target sequence
atttgctaataataaagaa

SEQ ID NO: 432 - DNA, 19 bp, Artificial sequence
  SiRNA target sequence
tttgctaataataaagaag

SEQ ID NO: 433 - DNA, 19 bp, Artificial sequence
  SiRNA target sequence
ttgctaataataaagaagt

SEQ ID NO: 434 - DNA, 19 bp, Artificial sequence
  SiRNA target sequence
tgctaataataaagaagtc

SEQ ID NO: 435 - DNA, 19 bp, Artificial sequence
  SiRNA target sequence
gctaataataaagaagtcc

SEQ ID NO: 436 - DNA, 19 bp, Artificial sequence
  SiRNA target sequence
ctaataataaagaagtcca

SEQ ID NO: 437 - DNA, 19 bp, Artificial sequence
  SiRNA target sequence
taataataaagaagtccaa

SEQ ID NO: 438 - DNA, 19 bp, Artificial sequence
  SiRNA target sequence
aataataaagaagtccaag

SEQ ID NO: 439 - DNA, 19 bp, Artificial sequence
  SiRNA target sequence
ataataaagaagtccaaga

SEQ ID NO: 440 - DNA, 19 bp, Artificial sequence
  SiRNA target sequence
taataaagaagtccaagat

SEQ ID NO: 441 - DNA, 19 bp, Artificial sequence
  SiRNA target sequence
aataaagaagtccaagatg

SEQ ID NO: 442 - DNA, 19 bp, Artificial sequence
  SiRNA target sequence
ataaagaagtccaagatga

SEQ ID NO: 443 - DNA, 19 bp, Artificial sequence
  SiRNA target sequence
taaagaagtccaagatgaa

SEQ ID NO: 444 - DNA, 19 bp, Artificial sequence
  SiRNA target sequence
aaagaagtccaagatgaaa

SEQ ID NO: 445 - DNA, 19 bp, Artificial sequence
  SiRNA target sequence
aagaagtccaagatgaaat

SEQ ID NO: 446 - DNA, 19 bp, Artificial sequence
  SiRNA target sequence
agaagtccaagatgaaatt

SEQ ID NO: 447 - DNA, 19 bp, Artificial sequence
  SiRNA target sequence
gaagtccaagatgaaatta

SEQ ID NO: 448 - DNA, 19 bp, Artificial sequence
  SiRNA target sequence
aagtccaagatgaaattat

SEQ ID NO: 449 - DNA, 19 bp, Artificial sequence
  SiRNA target sequence
agtccaagatgaaattatg

SEQ ID NO: 450 - DNA, 19 bp, Artificial sequence
  SiRNA target sequence
gtccaagatgaaattatgc

SEQ ID NO: 451 - DNA, 19 bp, Artificial sequence
  SiRNA target sequence
tccaagatgaaattatgca

SEQ ID NO: 452 - DNA, 19 bp, Artificial sequence
  SiRNA target sequence
ccaagatgaaattatgcag

SEQ ID NO: 453 - DNA, 19 bp, Artificial sequence
  SiRNA target sequence
caagatgaaattatgcaga

SEQ ID NO: 454 - DNA, 19 bp, Artificial sequence
  SiRNA target sequence
aagatgaaattatgcagac

SEQ ID NO: 455 - DNA, 19 bp, Artificial sequence
  SiRNA target sequence
agatgaaattatgcagact

SEQ ID NO: 456 - DNA, 19 bp, Artificial sequence
  SiRNA target sequence
gatgaaattatgcagactg

SEQ ID NO: 457 - DNA, 19 bp, Artificial sequence
  SiRNA target sequence
atgaaattatgcagactgt

SEQ ID NO: 458 - DNA, 19 bp, Artificial sequence
  SiRNA target sequence
tgaaattatgcagactgtt

SEQ ID NO: 459 - DNA, 19 bp, Artificial sequence
  SiRNA target sequence
gaaattatgcagactgtta

SEQ ID NO: 460 - DNA, 19 bp, Artificial sequence
  SiRNA target sequence
aaattatgcagactgttaa

SEQ ID NO: 461 - DNA, 19 bp, Artificial sequence
  SiRNA target sequence
aattatgcagactgttaaa

SEQ ID NO: 462 - DNA, 19 bp, Artificial sequence
  SiRNA target sequence
attatgcagactgttaaag

SEQ ID NO: 463 - DNA, 19 bp, Artificial sequence
  SiRNA target sequence
ttatgcagactgttaaaga

SEQ ID NO: 464 - DNA, 19 bp, Artificial sequence
  SiRNA target sequence
tatgcagactgttaaagaa

SEQ ID NO: 465 - DNA, 19 bp, Artificial sequence
  SiRNA target sequence
atgcagactgttaaagaaa

SEQ ID NO: 466 - DNA, 19 bp, Artificial sequence
  SiRNA target sequence
tgcagactgttaaagaaat

SEQ ID NO: 467 - DNA, 19 bp, Artificial sequence
  SiRNA target sequence
gcagactgttaaagaaatt

SEQ ID NO: 468 - DNA, 19 bp, Artificial sequence
  SiRNA target sequence
cagactgttaaagaaattt

SEQ ID NO: 469 - DNA, 19 bp, Artificial sequence
  SiRNA target sequence
agactgttaaagaaatttg

SEQ ID NO: 470 - DNA, 19 bp, Artificial sequence
  SiRNA target sequence
gactgttaaagaaatttgt

SEQ ID NO: 471 - DNA, 19 bp, Artificial sequence
  SiRNA target sequence
actgttaaagaaatttgtg

SEQ ID NO: 472 - DNA, 19 bp, Artificial sequence
  SiRNA target sequence
ctgttaaagaaatttgtga

SEQ ID NO: 473 - DNA, 19 bp, Artificial sequence
  SiRNA target sequence
tgttaaagaaatttgtgaa

SEQ ID NO: 474 - DNA, 19 bp, Artificial sequence
  SiRNA target sequence
gttaaagaaatttgtgaag

SEQ ID NO: 475 - DNA, 19 bp, Artificial sequence
  SiRNA target sequence
ttaaagaaatttgtgaaga

SEQ ID NO: 476 - DNA, 19 bp, Artificial sequence
  SiRNA target sequence
taaagaaatttgtgaagaa

SEQ ID NO: 477 - DNA, 19 bp, Artificial sequence
  SiRNA target sequence
aaagaaatttgtgaagaag

SEQ ID NO: 478 - DNA, 19 bp, Artificial sequence
  SiRNA target sequence
aagaaatttgtgaagaaga

SEQ ID NO: 479 - DNA, 19 bp, Artificial sequence
  SiRNA target sequence
agaaatttgtgaagaagaa

SEQ ID NO: 480 - DNA, 19 bp, Artificial sequence
  SiRNA target sequence
gaaatttgtgaagaagaag

SEQ ID NO: 481 - DNA, 19 bp, Artificial sequence
  SiRNA target sequence
aaatttgtgaagaagaagt

SEQ ID NO: 482 - DNA, 19 bp, Artificial sequence
  SiRNA target sequence
aatttgtgaagaagaagtg

SEQ ID NO: 483 - DNA, 19 bp, Artificial sequence
  SiRNA target sequence
atttgtgaagaagaagtga

SEQ ID NO: 484 - DNA, 19 bp, Artificial sequence
  SiRNA target sequence
tttgtgaagaagaagtgaa

SEQ ID NO: 485 - DNA, 19 bp, Artificial sequence
  SiRNA target sequence
ttgtgaagaagaagtgaat

SEQ ID NO: 486 - DNA, 19 bp, Artificial sequence
  SiRNA target sequence
tgtgaagaagaagtgaatg

SEQ ID NO: 487 - DNA, 19 bp, Artificial sequence
  SiRNA target sequence
gtgaagaagaagtgaatga

SEQ ID NO: 488 - DNA, 19 bp, Artificial sequence
  SiRNA target sequence
tgaagaagaagtgaatgag

SEQ ID NO: 489 - DNA, 19 bp, Artificial sequence
  SiRNA target sequence
gaagaagaagtgaatgagt

SEQ ID NO: 490 - DNA, 19 bp, Artificial sequence
  SiRNA target sequence
aagaagaagtgaatgagtt

SEQ ID NO: 491 - DNA, 19 bp, Artificial sequence
  SiRNA target sequence
agaagaagtgaatgagttt

SEQ ID NO: 492 - DNA, 19 bp, Artificial sequence
  SiRNA target sequence
gaagaagtgaatgagttta

SEQ ID NO: 493 - DNA, 19 bp, Artificial sequence
  SiRNA target sequence
aagaagtgaatgagtttat

SEQ ID NO: 494 - DNA, 19 bp, Artificial sequence
  SiRNA target sequence
agaagtgaatgagtttatt

SEQ ID NO: 495 - DNA, 19 bp, Artificial sequence
  SiRNA target sequence
gaagtgaatgagtttattg

SEQ ID NO: 496 - DNA, 19 bp, Artificial sequence
  SiRNA target sequence
aagtgaatgagtttattga

SEQ ID NO: 497 - DNA, 19 bp, Artificial sequence
  SiRNA target sequence
agtgaatgagtttattgaa

SEQ ID NO: 498 - DNA, 19 bp, Artificial sequence
  SiRNA target sequence
gtgaatgagtttattgaac

SEQ ID NO: 499 - DNA, 19 bp, Artificial sequence
  SiRNA target sequence
tgaatgagtttattgaaca

SEQ ID NO: 500 - DNA, 19 bp, Artificial sequence
  SiRNA target sequence
gaatgagtttattgaacaa

SEQ ID NO: 501 - DNA, 19 bp, Artificial sequence
  SiRNA target sequence
aatgagtttattgaacaag

SEQ ID NO: 502 - DNA, 19 bp, Artificial sequence
  SiRNA target sequence
atgagtttattgaacaaga

SEQ ID NO: 503 - DNA, 19 bp, Artificial sequence
  SiRNA target sequence
tgagtttattgaacaagaa

SEQ ID NO: 504 - DNA, 19 bp, Artificial sequence
  SiRNA target sequence
gagtttattgaacaagaag

SEQ ID NO: 505 - DNA, 19 bp, Artificial sequence
  SiRNA target sequence
agtttattgaacaagaagg

SEQ ID NO: 506 - DNA, 19 bp, Artificial sequence
  SiRNA target sequence
gtttattgaacaagaaggt

SEQ ID NO: 507 - DNA, 19 bp, Artificial sequence
  SiRNA target sequence
tttattgaacaagaaggtt

SEQ ID NO: 508 - DNA, 19 bp, Artificial sequence
  SiRNA target sequence
ttattgaacaagaaggttt

SEQ ID NO: 509 - DNA, 19 bp, Artificial sequence
  SiRNA target sequence
tattgaacaagaaggttta

SEQ ID NO: 510 - DNA, 19 bp, Artificial sequence
  SiRNA target sequence
attgaacaagaaggtttaa

SEQ ID NO: 511 - DNA, 19 bp, Artificial sequence
  SiRNA target sequence
ttgaacaagaaggtttaaa

SEQ ID NO: 512 - DNA, 19 bp, Artificial sequence
  SiRNA target sequence
tgaacaagaaggtttaaaa

SEQ ID NO: 513 - DNA, 19 bp, Artificial sequence
  SiRNA target sequence
gaacaagaaggtttaaaaa

SEQ ID NO: 514 - DNA, 19 bp, Artificial sequence
  SiRNA target sequence
aacaagaaggtttaaaaat

SEQ ID NO: 515 - DNA, 19 bp, Artificial sequence
  SiRNA target sequence
acaagaaggtttaaaaatt

SEQ ID NO: 516 - DNA, 19 bp, Artificial sequence
  SiRNA target sequence
caagaaggtttaaaaatta

SEQ ID NO: 517 - DNA, 19 bp, Artificial sequence
  SiRNA target sequence
aagaaggtttaaaaattaa

SEQ ID NO: 518 - DNA, 19 bp, Artificial sequence
  SiRNA target sequence
agaaggtttaaaaattaat

SEQ ID NO: 519 - DNA, 19 bp, Artificial sequence
  SiRNA target sequence
gaaggtttaaaaattaata

SEQ ID NO: 520 - DNA, 19 bp, Artificial sequence
  SiRNA target sequence
aaggtttaaaaattaataa

SEQ ID NO: 521 - DNA, 19 bp, Artificial sequence
  SiRNA target sequence
aggtttaaaaattaataaa

SEQ ID NO: 522 - DNA, 19 bp, Artificial sequence
  SiRNA target sequence
ggtttaaaaattaataaag

SEQ ID NO: 523 - DNA, 19 bp, Artificial sequence
  SiRNA target sequence
gtttaaaaattaataaaga

SEQ ID NO: 524 - DNA, 19 bp, Artificial sequence
  SiRNA target sequence
tttaaaaattaataaagaa

SEQ ID NO: 525 - DNA, 19 bp, Artificial sequence
  SiRNA target sequence
ttaaaaattaataaagaag

SEQ ID NO: 526 - DNA, 19 bp, Artificial sequence
  SiRNA target sequence
taaaaattaataaagaaga

SEQ ID NO: 527 - DNA, 19 bp, Artificial sequence
  SiRNA target sequence
aaaaattaataaagaagat

SEQ ID NO: 528 - DNA, 19 bp, Artificial sequence
  SiRNA target sequence
aaaattaataaagaagatg

SEQ ID NO: 529 - DNA, 19 bp, Artificial sequence
  SiRNA target sequence
aaattaataaagaagatgt

SEQ ID NO: 530 - DNA, 19 bp, Artificial sequence
  SiRNA target sequence
aattaataaagaagatgtg

SEQ ID NO: 531 - DNA, 19 bp, Artificial sequence
  SiRNA target sequence
attaataaagaagatgtgc

SEQ ID NO: 532 - DNA, 19 bp, Artificial sequence
  SiRNA target sequence
ttaataaagaagatgtgct

SEQ ID NO: 533 - DNA, 19 bp, Artificial sequence
  SiRNA target sequence
taataaagaagatgtgcta

SEQ ID NO: 534 - DNA, 19 bp, Artificial sequence
  SiRNA target sequence
aataaagaagatgtgctaa

SEQ ID NO: 535 - DNA, 19 bp, Artificial sequence
  SiRNA target sequence
ataaagaagatgtgctaag

SEQ ID NO: 536 - DNA, 19 bp, Artificial sequence
  SiRNA target sequence
taaagaagatgtgctaaga

SEQ ID NO: 537 - DNA, 19 bp, Artificial sequence
  SiRNA target sequence
aaagaagatgtgctaagag

SEQ ID NO: 538 - DNA, 19 bp, Artificial sequence
  SiRNA target sequence
aagaagatgtgctaagagg

SEQ ID NO: 539 - DNA, 19 bp, Artificial sequence
  SiRNA target sequence
agaagatgtgctaagagga

SEQ ID NO: 540 - DNA, 19 bp, Artificial sequence
  SiRNA target sequence
gaagatgtgctaagaggac

SEQ ID NO: 541 - DNA, 19 bp, Artificial sequence
  SiRNA target sequence
aagatgtgctaagaggact

SEQ ID NO: 542 - DNA, 19 bp, Artificial sequence
  SiRNA target sequence
agatgtgctaagaggactt

SEQ ID NO: 543 - DNA, 19 bp, Artificial sequence
  SiRNA target sequence
gatgtgctaagaggacttg

SEQ ID NO: 544 - DNA, 19 bp, Artificial sequence
  SiRNA target sequence
atgtgctaagaggacttgt

SEQ ID NO: 545 - DNA, 19 bp, Artificial sequence
  SiRNA target sequence
tgtgctaagaggacttgtt

SEQ ID NO: 546 - DNA, 19 bp, Artificial sequence
  SiRNA target sequence
gtgctaagaggacttgttt

SEQ ID NO: 547 - DNA, 19 bp, Artificial sequence
  SiRNA target sequence
tgctaagaggacttgtttc

SEQ ID NO: 548 - DNA, 19 bp, Artificial sequence
  SiRNA target sequence
gctaagaggacttgtttca

SEQ ID NO: 549 - DNA, 19 bp, Artificial sequence
  SiRNA target sequence
ctaagaggacttgtttcaa

SEQ ID NO: 550 - DNA, 19 bp, Artificial sequence
  SiRNA target sequence
taagaggacttgtttcaat

SEQ ID NO: 551 - DNA, 19 bp, Artificial sequence
  SiRNA target sequence
aagaggacttgtttcaata

SEQ ID NO: 552 - DNA, 19 bp, Artificial sequence
  SiRNA target sequence
agaggacttgtttcaataa

SEQ ID NO: 553 - DNA, 19 bp, Artificial sequence
  SiRNA target sequence
gaggacttgtttcaataaa

SEQ ID NO: 554 - DNA, 19 bp, Artificial sequence
  SiRNA target sequence
aggacttgtttcaataaaa

SEQ ID NO: 555 - DNA, 19 bp, Artificial sequence
  SiRNA target sequence
ggacttgtttcaataaaaa

SEQ ID NO: 556 - DNA, 19 bp, Artificial sequence
  SiRNA target sequence
gacttgtttcaataaaaaa

SEQ ID NO: 557 - DNA, 19 bp, Artificial sequence
  SiRNA target sequence
acttgtttcaataaaaaat

SEQ ID NO: 558 - DNA, 19 bp, Artificial sequence
  SiRNA target sequence
cttgtttcaataaaaaata

SEQ ID NO: 559 - DNA, 19 bp, Artificial sequence
  SiRNA target sequence
ttgtttcaataaaaaatat

SEQ ID NO: 560 - DNA, 19 bp, Artificial sequence
  SiRNA target sequence
tgtttcaataaaaaatata

SEQ ID NO: 561 - DNA, 19 bp, Artificial sequence
  SiRNA target sequence
gtttcaataaaaaatataa

SEQ ID NO: 562 - DNA, 19 bp, Artificial sequence
  SiRNA target sequence
tttcaataaaaaatataaa

SEQ ID NO: 563 - DNA, 19 bp, Artificial sequence
  SiRNA target sequence
ttcaataaaaaatataaat

SEQ ID NO: 564 - DNA, 19 bp, Artificial sequence
  SiRNA target sequence
tcaataaaaaatataaatg

SEQ ID NO: 565 - DNA, 19 bp, Artificial sequence
  SiRNA target sequence
caataaaaaatataaatga

SEQ ID NO: 566 - DNA, 19 bp, Artificial sequence
  SiRNA target sequence
aataaaaaatataaatgag

SEQ ID NO: 567 - DNA, 19 bp, Artificial sequence
  SiRNA target sequence
ataaaaaatataaatgaga

SEQ ID NO: 568 - DNA, 19 bp, Artificial sequence
  SiRNA target sequence
taaaaaatataaatgagat

SEQ ID NO: 569 - DNA, 19 bp, Artificial sequence
  SiRNA target sequence
aaaaaatataaatgagatt

SEQ ID NO: 570 - DNA, 19 bp, Artificial sequence
  SiRNA target sequence
aaaaatataaatgagattt

SEQ ID NO: 571 - DNA, 19 bp, Artificial sequence
  SiRNA target sequence
aaaatataaatgagattta

SEQ ID NO: 572 - DNA, 19 bp, Artificial sequence
  SiRNA target sequence
aaatataaatgagatttat

SEQ ID NO: 573 - DNA, 19 bp, Artificial sequence
  SiRNA target sequence
aatataaatgagatttatg

SEQ ID NO: 574 - DNA, 19 bp, Artificial sequence
  SiRNA target sequence
atataaatgagatttatga

SEQ ID NO: 575 - DNA, 19 bp, Artificial sequence
  SiRNA target sequence
tataaatgagatttatgat

SEQ ID NO: 576 - DNA, 19 bp, Artificial sequence
  SiRNA target sequence
ataaatgagatttatgatg

SEQ ID NO: 577 - DNA, 19 bp, Artificial sequence
  SiRNA target sequence
taaatgagatttatgatgc

SEQ ID NO: 578 - DNA, 19 bp, Artificial sequence
  SiRNA target sequence
aaatgagatttatgatgca

SEQ ID NO: 579 - DNA, 19 bp, Artificial sequence
  SiRNA target sequence
aatgagatttatgatgcat

SEQ ID NO: 580 - DNA, 19 bp, Artificial sequence
  SiRNA target sequence
atgagatttatgatgcatt

SEQ ID NO: 581 - DNA, 19 bp, Artificial sequence
  SiRNA target sequence
tgagatttatgatgcattt

SEQ ID NO: 582 - DNA, 19 bp, Artificial sequence
  SiRNA target sequence
gagatttatgatgcatttg

SEQ ID NO: 583 - DNA, 19 bp, Artificial sequence
  SiRNA target sequence
agatttatgatgcatttgg

SEQ ID NO: 584 - DNA, 19 bp, Artificial sequence
  SiRNA target sequence
gatttatgatgcatttgga

SEQ ID NO: 585 - DNA, 19 bp, Artificial sequence
  SiRNA target sequence
atttatgatgcatttggag

SEQ ID NO: 586 - DNA, 19 bp, Artificial sequence
  SiRNA target sequence
tttatgatgcatttggagg

SEQ ID NO: 587 - DNA, 19 bp, Artificial sequence
  SiRNA target sequence
ttatgatgcatttggaggt

SEQ ID NO: 588 - DNA, 19 bp, Artificial sequence
  SiRNA target sequence
tatgatgcatttggaggta

SEQ ID NO: 589 - DNA, 19 bp, Artificial sequence
  SiRNA target sequence
atgatgcatttggaggtaa

SEQ ID NO: 590 - DNA, 19 bp, Artificial sequence
  SiRNA target sequence
tgatgcatttggaggtaaa

SEQ ID NO: 591 - DNA, 19 bp, Artificial sequence
  SiRNA target sequence
gatgcatttggaggtaaat

SEQ ID NO: 592 - DNA, 19 bp, Artificial sequence
  SiRNA target sequence
atgcatttggaggtaaatc

SEQ ID NO: 593 - DNA, 19 bp, Artificial sequence
  SiRNA target sequence
tgcatttggaggtaaatct

SEQ ID NO: 594 - DNA, 19 bp, Artificial sequence
  SiRNA target sequence
gcatttggaggtaaatcta

SEQ ID NO: 595 - DNA, 19 bp, Artificial sequence
  SiRNA target sequence
catttggaggtaaatctaa

SEQ ID NO: 596 - DNA, 19 bp, Artificial sequence
  SiRNA target sequence
atttggaggtaaatctaag

SEQ ID NO: 597 - DNA, 19 bp, Artificial sequence
  SiRNA target sequence
tttggaggtaaatctaaga

SEQ ID NO: 598 - DNA, 19 bp, Artificial sequence
  SiRNA target sequence
ttggaggtaaatctaagaa

SEQ ID NO: 599 - DNA, 19 bp, Artificial sequence
  SiRNA target sequence
tggaggtaaatctaagaag

SEQ ID NO: 600 - DNA, 19 bp, Artificial sequence
  SiRNA target sequence
ggaggtaaatctaagaagt

SEQ ID NO: 601 - DNA, 19 bp, Artificial sequence
  SiRNA target sequence
gaggtaaatctaagaagtt

SEQ ID NO: 602 - DNA, 19 bp, Artificial sequence
  SiRNA target sequence
aggtaaatctaagaagttt

SEQ ID NO: 603 - DNA, 19 bp, Artificial sequence
  SiRNA target sequence
ggtaaatctaagaagttta

SEQ ID NO: 604 - DNA, 19 bp, Artificial sequence
  SiRNA target sequence
gtaaatctaagaagtttaa

SEQ ID NO: 605 - DNA, 19 bp, Artificial sequence
  SiRNA target sequence
taaatctaagaagtttaaa

SEQ ID NO: 606 - DNA, 19 bp, Artificial sequence
  SiRNA target sequence
aaatctaagaagtttaaat

SEQ ID NO: 607 - DNA, 19 bp, Artificial sequence
  SiRNA target sequence
aatctaagaagtttaaatt

SEQ ID NO: 608 - DNA, 19 bp, Artificial sequence
  SiRNA target sequence
atctaagaagtttaaattt

SEQ ID NO: 609 - DNA, 19 bp, Artificial sequence
  SiRNA target sequence
tctaagaagtttaaatttt

SEQ ID NO: 610 - DNA, 19 bp, Artificial sequence
  SiRNA target sequence
ctaagaagtttaaattttc

SEQ ID NO: 611 - DNA, 19 bp, Artificial sequence
  SiRNA target sequence
taagaagtttaaattttct

SEQ ID NO: 612 - DNA, 19 bp, Artificial sequence
  SiRNA target sequence
aagaagtttaaattttcta

SEQ ID NO: 613 - DNA, 19 bp, Artificial sequence
  SiRNA target sequence
agaagtttaaattttctaa

SEQ ID NO: 614 - DNA, 19 bp, Artificial sequence
  SiRNA target sequence
gaagtttaaattttctaat

SEQ ID NO: 615 - DNA, 19 bp, Artificial sequence
  SiRNA target sequence
aagtttaaattttctaatg

SEQ ID NO: 616 - DNA, 19 bp, Artificial sequence
  SiRNA target sequence
agtttaaattttctaatga

SEQ ID NO: 617 - DNA, 19 bp, Artificial sequence
  SiRNA target sequence
gtttaaattttctaatgat

SEQ ID NO: 618 - DNA, 19 bp, Artificial sequence
  SiRNA target sequence
tttaaattttctaatgatg

SEQ ID NO: 619 - DNA, 19 bp, Artificial sequence
  SiRNA target sequence
ttaaattttctaatgatga

SEQ ID NO: 620 - DNA, 19 bp, Artificial sequence
  SiRNA target sequence
taaattttctaatgatgaa

SEQ ID NO: 621 - DNA, 19 bp, Artificial sequence
  SiRNA target sequence
aaattttctaatgatgaaa

SEQ ID NO: 622 - DNA, 19 bp, Artificial sequence
  SiRNA target sequence
aattttctaatgatgaaaa

SEQ ID NO: 623 - DNA, 19 bp, Artificial sequence
  SiRNA target sequence
attttctaatgatgaaaag

SEQ ID NO: 624 - DNA, 19 bp, Artificial sequence
  SiRNA target sequence
ttttctaatgatgaaaagg

SEQ ID NO: 625 - DNA, 19 bp, Artificial sequence
  SiRNA target sequence
tttctaatgatgaaaagga

SEQ ID NO: 626 - DNA, 19 bp, Artificial sequence
  SiRNA target sequence
ttctaatgatgaaaaggaa

SEQ ID NO: 627 - DNA, 19 bp, Artificial sequence
  SiRNA target sequence
tctaatgatgaaaaggaag

SEQ ID NO: 628 - DNA, 19 bp, Artificial sequence
  SiRNA target sequence
ctaatgatgaaaaggaagt

SEQ ID NO: 629 - DNA, 19 bp, Artificial sequence
  SiRNA target sequence
taatgatgaaaaggaagtg

SEQ ID NO: 630 - DNA, 19 bp, Artificial sequence
  SiRNA target sequence
aatgatgaaaaggaagtgt

SEQ ID NO: 631 - DNA, 19 bp, Artificial sequence
  SiRNA target sequence
atgatgaaaaggaagtgtt

SEQ ID NO: 632 - DNA, 19 bp, Artificial sequence
  SiRNA target sequence
tgatgaaaaggaagtgtta

SEQ ID NO: 633 - DNA, 19 bp, Artificial sequence
  SiRNA target sequence
gatgaaaaggaagtgttaa

SEQ ID NO: 634 - DNA, 19 bp, Artificial sequence
  SiRNA target sequence
atgaaaaggaagtgttaaa

SEQ ID NO: 635 - DNA, 19 bp, Artificial sequence
  SiRNA target sequence
tgaaaaggaagtgttaaat

SEQ ID NO: 636 - DNA, 19 bp, Artificial sequence
  SiRNA target sequence
gaaaaggaagtgttaaatc

SEQ ID NO: 637 - DNA, 19 bp, Artificial sequence
  SiRNA target sequence
aaaaggaagtgttaaatct

SEQ ID NO: 638 - DNA, 19 bp, Artificial sequence
  SiRNA target sequence
aaaggaagtgttaaatctt

SEQ ID NO: 639 - DNA, 19 bp, Artificial sequence
  SiRNA target sequence
aaggaagtgttaaatcttc

SEQ ID NO: 640 - DNA, 19 bp, Artificial sequence
  SiRNA target sequence
aggaagtgttaaatcttct

SEQ ID NO: 641 - DNA, 19 bp, Artificial sequence
  SiRNA target sequence
ggaagtgttaaatcttctt

SEQ ID NO: 642 - DNA, 19 bp, Artificial sequence
  SiRNA target sequence
gaagtgttaaatcttctta

SEQ ID NO: 643 - DNA, 19 bp, Artificial sequence
  SiRNA target sequence
aagtgttaaatcttcttaa

SEQ ID NO: 644 - DNA, 19 bp, Artificial sequence
  SiRNA target sequence
agtgttaaatcttcttaat

SEQ ID NO: 645 - DNA, 19 bp, Artificial sequence
  SiRNA target sequence
gtgttaaatcttcttaatg

SEQ ID NO: 646 - DNA, 19 bp, Artificial sequence
  SiRNA target sequence
tgttaaatcttcttaatgc

SEQ ID NO: 647 - DNA, 19 bp, Artificial sequence
  SiRNA target sequence
gttaaatcttcttaatgcc

SEQ ID NO: 648 - DNA, 19 bp, Artificial sequence
  SiRNA target sequence
ttaaatcttcttaatgcca

SEQ ID NO: 649 - DNA, 19 bp, Artificial sequence
  SiRNA target sequence
taaatcttcttaatgccat

SEQ ID NO: 650 - DNA, 19 bp, Artificial sequence
  SiRNA target sequence
aaatcttcttaatgccatt

SEQ ID NO: 651 - DNA, 19 bp, Artificial sequence
  SiRNA target sequence
aatcttcttaatgccatta

SEQ ID NO: 652 - DNA, 19 bp, Artificial sequence
  SiRNA target sequence
atcttcttaatgccattat

SEQ ID NO: 653 - DNA, 19 bp, Artificial sequence
  SiRNA target sequence
tcttcttaatgccattatt

SEQ ID NO: 654 - DNA, 19 bp, Artificial sequence
  SiRNA target sequence
cttcttaatgccattattt

SEQ ID NO: 655 - DNA, 19 bp, Artificial sequence
  SiRNA target sequence
ttcttaatgccattatttt

SEQ ID NO: 656 - DNA, 19 bp, Artificial sequence
  SiRNA target sequence
tcttaatgccattatttta

SEQ ID NO: 657 - DNA, 19 bp, Artificial sequence
  SiRNA target sequence
cttaatgccattattttac

SEQ ID NO: 658 - DNA, 19 bp, Artificial sequence
  SiRNA target sequence
ttaatgccattattttaca

SEQ ID NO: 659 - DNA, 19 bp, Artificial sequence
  SiRNA target sequence
taatgccattattttacac

SEQ ID NO: 660 - DNA, 19 bp, Artificial sequence
  SiRNA target sequence
aatgccattattttacacc

SEQ ID NO: 661 - DNA, 19 bp, Artificial sequence
  SiRNA target sequence
atgccattattttacacct

SEQ ID NO: 662 - DNA, 19 bp, Artificial sequence
  SiRNA target sequence
tgccattattttacaccta

SEQ ID NO: 663 - DNA, 19 bp, Artificial sequence
  SiRNA target sequence
gccattattttacacctaa

SEQ ID NO: 664 - DNA, 19 bp, Artificial sequence
  SiRNA target sequence
ccattattttacacctaaa

SEQ ID NO: 665 - DNA, 19 bp, Artificial sequence
  SiRNA target sequence
cattattttacacctaaaa

SEQ ID NO: 666 - DNA, 19 bp, Artificial sequence
  SiRNA target sequence
attattttacacctaaaag

SEQ ID NO: 667 - DNA, 19 bp, Artificial sequence
  SiRNA target sequence
ttattttacacctaaaagg

SEQ ID NO: 668 - DNA, 19 bp, Artificial sequence
  SiRNA target sequence
tattttacacctaaaagga

SEQ ID NO: 669 - DNA, 19 bp, Artificial sequence
  SiRNA target sequence
attttacacctaaaaggaa

SEQ ID NO: 670 - DNA, 19 bp, Artificial sequence
  SiRNA target sequence
ttttacacctaaaaggaaa

SEQ ID NO: 671 - DNA, 19 bp, Artificial sequence
  SiRNA target sequence
tttacacctaaaaggaaaa

SEQ ID NO: 672 - DNA, 19 bp, Artificial sequence
  SiRNA target sequence
ttacacctaaaaggaaaaa

SEQ ID NO: 673 - DNA, 19 bp, Artificial sequence
  SiRNA target sequence
tacacctaaaaggaaaaaa

SEQ ID NO: 674 - DNA, 19 bp, Artificial sequence
  SiRNA target sequence
acacctaaaaggaaaaaaa

SEQ ID NO: 675 - DNA, 19 bp, Artificial sequence
  SiRNA target sequence
cacctaaaaggaaaaaaag

SEQ ID NO: 676 - DNA, 19 bp, Artificial sequence
  SiRNA target sequence
acctaaaaggaaaaaaaga

SEQ ID NO: 677 - DNA, 19 bp, Artificial sequence
  SiRNA target sequence
cctaaaaggaaaaaaagaa

SEQ ID NO: 678 - DNA, 19 bp, Artificial sequence
  SiRNA target sequence
ctaaaaggaaaaaaagaac

SEQ ID NO: 679 - DNA, 19 bp, Artificial sequence
  SiRNA target sequence
taaaaggaaaaaaagaaca

SEQ ID NO: 680 - DNA, 19 bp, Artificial sequence
  SiRNA target sequence
aaaaggaaaaaaagaacag

SEQ ID NO: 681 - DNA, 19 bp, Artificial sequence
  SiRNA target sequence
aaaggaaaaaaagaacagg

SEQ ID NO: 682 - DNA, 19 bp, Artificial sequence
  SiRNA target sequence
aaggaaaaaaagaacaggc

SEQ ID NO: 683 - DNA, 19 bp, Artificial sequence
  SiRNA target sequence
aggaaaaaaagaacaggca

SEQ ID NO: 684 - DNA, 19 bp, Artificial sequence
  SiRNA target sequence
ggaaaaaaagaacaggcaa

SEQ ID NO: 685 - DNA, 19 bp, Artificial sequence
  SiRNA target sequence
gaaaaaaagaacaggcaat

SEQ ID NO: 686 - DNA, 19 bp, Artificial sequence
  SiRNA target sequence
aaaaaaagaacaggcaatt

SEQ ID NO: 687 - DNA, 19 bp, Artificial sequence
  SiRNA target sequence
aaaaaagaacaggcaattc

SEQ ID NO: 688 - DNA, 19 bp, Artificial sequence
  SiRNA target sequence
aaaaagaacaggcaattct

SEQ ID NO: 689 - DNA, 19 bp, Artificial sequence
  SiRNA target sequence
aaaagaacaggcaattctt

SEQ ID NO: 690 - DNA, 19 bp, Artificial sequence
  SiRNA target sequence
aaagaacaggcaattcttt

SEQ ID NO: 691 - DNA, 19 bp, Artificial sequence
  SiRNA target sequence
aagaacaggcaattctttt

SEQ ID NO: 692 - DNA, 19 bp, Artificial sequence
  SiRNA target sequence
agaacaggcaattctttta

SEQ ID NO: 693 - DNA, 19 bp, Artificial sequence
  SiRNA target sequence
gaacaggcaattcttttat

SEQ ID NO: 694 - DNA, 19 bp, Artificial sequence
  SiRNA target sequence
aacaggcaattcttttatt

SEQ ID NO: 695 - DNA, 19 bp, Artificial sequence
  SiRNA target sequence
acaggcaattcttttatta

SEQ ID NO: 696 - DNA, 19 bp, Artificial sequence
  SiRNA target sequence
caggcaattcttttattag

SEQ ID NO: 697 - DNA, 19 bp, Artificial sequence
  SiRNA target sequence
aggcaattcttttattaga

SEQ ID NO: 698 - DNA, 19 bp, Artificial sequence
  SiRNA target sequence
ggcaattcttttattagaa

SEQ ID NO: 699 - DNA, 19 bp, Artificial sequence
  SiRNA target sequence
gcaattcttttattagaaa

SEQ ID NO: 700 - DNA, 19 bp, Artificial sequence
  SiRNA target sequence
caattcttttattagaaaa

SEQ ID NO: 701 - DNA, 19 bp, Artificial sequence
  SiRNA target sequence
aattcttttattagaaaaa

SEQ ID NO: 702 - DNA, 19 bp, Artificial sequence
  SiRNA target sequence
attcttttattagaaaaat

SEQ ID NO: 703 - DNA, 19 bp, Artificial sequence
  SiRNA target sequence
ttcttttattagaaaaatc

SEQ ID NO: 704 - DNA, 19 bp, Artificial sequence
  SiRNA target sequence
tcttttattagaaaaatct

SEQ ID NO: 705 - DNA, 19 bp, Artificial sequence
  SiRNA target sequence
cttttattagaaaaatcta

SEQ ID NO: 706 - DNA, 19 bp, Artificial sequence
  SiRNA target sequence
ttttattagaaaaatctac

SEQ ID NO: 707 - DNA, 19 bp, Artificial sequence
  SiRNA target sequence
tttattagaaaaatctact

SEQ ID NO: 708 - DNA, 19 bp, Artificial sequence
  SiRNA target sequence
ttattagaaaaatctactt

SEQ ID NO: 709 - DNA, 19 bp, Artificial sequence
  SiRNA target sequence
tattagaaaaatctactta

SEQ ID NO: 710 - DNA, 19 bp, Artificial sequence
  SiRNA target sequence
attagaaaaatctacttat

SEQ ID NO: 711 - DNA, 19 bp, Artificial sequence
  SiRNA target sequence
ttagaaaaatctacttata

SEQ ID NO: 712 - DNA, 19 bp, Artificial sequence
  SiRNA target sequence
tagaaaaatctacttataa

SEQ ID NO: 713 - DNA, 19 bp, Artificial sequence
  SiRNA target sequence
agaaaaatctacttataaa

SEQ ID NO: 714 - DNA, 19 bp, Artificial sequence
  SiRNA target sequence
gaaaaatctacttataaat

SEQ ID NO: 715 - DNA, 19 bp, Artificial sequence
  SiRNA target sequence
aaaaatctacttataaata

SEQ ID NO: 716 - DNA, 19 bp, Artificial sequence
  SiRNA target sequence
aaaatctacttataaatac

SEQ ID NO: 717 - DNA, 19 bp, Artificial sequence
  SiRNA target sequence
aaatctacttataaataca

SEQ ID NO: 718 - DNA, 19 bp, Artificial sequence
  SiRNA target sequence
aatctacttataaatacag

SEQ ID NO: 719 - DNA, 19 bp, Artificial sequence
  SiRNA target sequence
atctacttataaatacagt

SEQ ID NO: 720 - DNA, 19 bp, Artificial sequence
  SiRNA target sequence
tctacttataaatacagta

SEQ ID NO: 721 - DNA, 19 bp, Artificial sequence
  SiRNA target sequence
ctacttataaatacagtat

SEQ ID NO: 722 - DNA, 19 bp, Artificial sequence
  SiRNA target sequence
tacttataaatacagtatc

SEQ ID NO: 723 - DNA, 19 bp, Artificial sequence
  SiRNA target sequence
acttataaatacagtatct

SEQ ID NO: 724 - DNA, 19 bp, Artificial sequence
  SiRNA target sequence
cttataaatacagtatctt

SEQ ID NO: 725 - DNA, 19 bp, Artificial sequence
  SiRNA target sequence
ttataaatacagtatcttg

SEQ ID NO: 726 - DNA, 19 bp, Artificial sequence
  SiRNA target sequence
tataaatacagtatcttgt

SEQ ID NO: 727 - DNA, 19 bp, Artificial sequence
  SiRNA target sequence
ataaatacagtatcttgta

SEQ ID NO: 728 - DNA, 19 bp, Artificial sequence
  SiRNA target sequence
taaatacagtatcttgtat

SEQ ID NO: 729 - DNA, 19 bp, Artificial sequence
  SiRNA target sequence
aaatacagtatcttgtata

SEQ ID NO: 730 - DNA, 19 bp, Artificial sequence
  SiRNA target sequence
aatacagtatcttgtatag

SEQ ID NO: 731 - DNA, 19 bp, Artificial sequence
  SiRNA target sequence
atacagtatcttgtataga

SEQ ID NO: 732 - DNA, 19 bp, Artificial sequence
  SiRNA target sequence
tacagtatcttgtatagag

SEQ ID NO: 733 - DNA, 19 bp, Artificial sequence
  SiRNA target sequence
acagtatcttgtatagagc

SEQ ID NO: 734 - DNA, 19 bp, Artificial sequence
  SiRNA target sequence
cagtatcttgtatagagca

SEQ ID NO: 735 - DNA, 19 bp, Artificial sequence
  SiRNA target sequence
agtatcttgtatagagcat

SEQ ID NO: 736 - DNA, 19 bp, Artificial sequence
  SiRNA target sequence
gtatcttgtatagagcata

SEQ ID NO: 737 - DNA, 19 bp, Artificial sequence
  SiRNA target sequence
tatcttgtatagagcatat

SEQ ID NO: 738 - DNA, 19 bp, Artificial sequence
  SiRNA target sequence
atcttgtatagagcatatt

SEQ ID NO: 739 - DNA, 19 bp, Artificial sequence
  SiRNA target sequence
tcttgtatagagcatattt

SEQ ID NO: 740 - DNA, 19 bp, Artificial sequence
  SiRNA target sequence
cttgtatagagcatatttt

SEQ ID NO: 741 - DNA, 19 bp, Artificial sequence
  SiRNA target sequence
ttgtatagagcatattttc

SEQ ID NO: 742 - DNA, 19 bp, Artificial sequence
  SiRNA target sequence
tgtatagagcatattttct

SEQ ID NO: 743 - DNA, 19 bp, Artificial sequence
  SiRNA target sequence
gtatagagcatattttctt

SEQ ID NO: 744 - DNA, 19 bp, Artificial sequence
  SiRNA target sequence
tatagagcatattttctta

SEQ ID NO: 745 - DNA, 19 bp, Artificial sequence
  SiRNA target sequence
atagagcatattttcttac

SEQ ID NO: 746 - DNA, 19 bp, Artificial sequence
  SiRNA target sequence
tagagcatattttcttaca

SEQ ID NO: 747 - DNA, 19 bp, Artificial sequence
  SiRNA target sequence
agagcatattttcttacat

SEQ ID NO: 748 - DNA, 19 bp, Artificial sequence
  SiRNA target sequence
gagcatattttcttacatt

SEQ ID NO: 749 - DNA, 19 bp, Artificial sequence
  SiRNA target sequence
agcatattttcttacattg

SEQ ID NO: 750 - DNA, 19 bp, Artificial sequence
  SiRNA target sequence
gcatattttcttacattga

SEQ ID NO: 751 - DNA, 19 bp, Artificial sequence
  SiRNA target sequence
catattttcttacattgaa

SEQ ID NO: 752 - DNA, 19 bp, Artificial sequence
  SiRNA target sequence
atattttcttacattgaag

SEQ ID NO: 753 - DNA, 19 bp, Artificial sequence
  SiRNA target sequence
tattttcttacattgaaga

SEQ ID NO: 754 - DNA, 19 bp, Artificial sequence
  SiRNA target sequence
attttcttacattgaagaa

SEQ ID NO: 755 - DNA, 19 bp, Artificial sequence
  SiRNA target sequence
ttttcttacattgaagaat

SEQ ID NO: 756 - DNA, 19 bp, Artificial sequence
  SiRNA target sequence
tttcttacattgaagaatg

SEQ ID NO: 757 - DNA, 19 bp, Artificial sequence
  SiRNA target sequence
ttcttacattgaagaatga

SEQ ID NO: 758 - DNA, 19 bp, Artificial sequence
  SiRNA target sequence
tcttacattgaagaatgaa

SEQ ID NO: 759 - DNA, 19 bp, Artificial sequence
  SiRNA target sequence
cttacattgaagaatgaat

SEQ ID NO: 760 - DNA, 19 bp, Artificial sequence
  SiRNA target sequence
ttacattgaagaatgaata

SEQ ID NO: 761 - DNA, 19 bp, Artificial sequence
  SiRNA target sequence
tacattgaagaatgaatat

SEQ ID NO: 762 - DNA, 19 bp, Artificial sequence
  SiRNA target sequence
acattgaagaatgaatata

SEQ ID NO: 763 - DNA, 19 bp, Artificial sequence
  SiRNA target sequence
cattgaagaatgaatatat

SEQ ID NO: 764 - DNA, 19 bp, Artificial sequence
  SiRNA target sequence
attgaagaatgaatatatt

SEQ ID NO: 765 - DNA, 19 bp, Artificial sequence
  SiRNA target sequence
ttgaagaatgaatatattt

SEQ ID NO: 766 - DNA, 19 bp, Artificial sequence
  SiRNA target sequence
tgaagaatgaatatatttc

SEQ ID NO: 767 - DNA, 19 bp, Artificial sequence
  SiRNA target sequence
gaagaatgaatatatttca

SEQ ID NO: 768 - DNA, 19 bp, Artificial sequence
  SiRNA target sequence
aagaatgaatatatttcat

SEQ ID NO: 769 - DNA, 19 bp, Artificial sequence
  SiRNA target sequence
agaatgaatatatttcatc

SEQ ID NO: 770 - DNA, 19 bp, Artificial sequence
  SiRNA target sequence
gaatgaatatatttcatct

SEQ ID NO: 771 - DNA, 19 bp, Artificial sequence
  SiRNA target sequence
aatgaatatatttcatctt

SEQ ID NO: 772 - DNA, 19 bp, Artificial sequence
  SiRNA target sequence
atgaatatatttcatcttc

SEQ ID NO: 773 - DNA, 19 bp, Artificial sequence
  SiRNA target sequence
tgaatatatttcatcttca

SEQ ID NO: 774 - DNA, 19 bp, Artificial sequence
  SiRNA target sequence
gaatatatttcatcttcat

SEQ ID NO: 775 - DNA, 19 bp, Artificial sequence
  SiRNA target sequence
aatatatttcatcttcatt

SEQ ID NO: 776 - DNA, 19 bp, Artificial sequence
  SiRNA target sequence
atatatttcatcttcattg

SEQ ID NO: 777 - DNA, 19 bp, Artificial sequence
  SiRNA target sequence
tatatttcatcttcattgc

SEQ ID NO: 778 - DNA, 19 bp, Artificial sequence
  SiRNA target sequence
atatttcatcttcattgcc

SEQ ID NO: 779 - DNA, 19 bp, Artificial sequence
  SiRNA target sequence
tatttcatcttcattgcct

SEQ ID NO: 780 - DNA, 19 bp, Artificial sequence
  SiRNA target sequence
atttcatcttcattgcctt

SEQ ID NO: 781 - DNA, 19 bp, Artificial sequence
  SiRNA target sequence
tttcatcttcattgccttt

SEQ ID NO: 782 - DNA, 19 bp, Artificial sequence
  SiRNA target sequence
ttcatcttcattgccttta

SEQ ID NO: 783 - DNA, 19 bp, Artificial sequence
  SiRNA target sequence
tcatcttcattgcctttag

SEQ ID NO: 784 - DNA, 19 bp, Artificial sequence
  SiRNA target sequence
catcttcattgcctttaga

SEQ ID NO: 785 - DNA, 19 bp, Artificial sequence
  SiRNA target sequence
atcttcattgcctttagat

SEQ ID NO: 786 - DNA, 19 bp, Artificial sequence
  SiRNA target sequence
tcttcattgcctttagatg

SEQ ID NO: 787 - DNA, 19 bp, Artificial sequence
  SiRNA target sequence
cttcattgcctttagatga

SEQ ID NO: 788 - DNA, 19 bp, Artificial sequence
  SiRNA target sequence
ttcattgcctttagatgac

SEQ ID NO: 789 - DNA, 19 bp, Artificial sequence
  SiRNA target sequence
tcattgcctttagatgacg

SEQ ID NO: 790 - DNA, 19 bp, Artificial sequence
  SiRNA target sequence
cattgcctttagatgacga

SEQ ID NO: 791 - DNA, 19 bp, Artificial sequence
  SiRNA target sequence
attgcctttagatgacgag

SEQ ID NO: 792 - DNA, 19 bp, Artificial sequence
  SiRNA target sequence
ttgcctttagatgacgaga

SEQ ID NO: 793 - DNA, 19 bp, Artificial sequence
  SiRNA target sequence
tgcctttagatgacgagat

SEQ ID NO: 794 - DNA, 19 bp, Artificial sequence
  SiRNA target sequence
gcctttagatgacgagatt

SEQ ID NO: 795 - DNA, 19 bp, Artificial sequence
  SiRNA target sequence
cctttagatgacgagatta

SEQ ID NO: 796 - DNA, 19 bp, Artificial sequence
  SiRNA target sequence
ctttagatgacgagattac

SEQ ID NO: 797 - DNA, 19 bp, Artificial sequence
  SiRNA target sequence
tttagatgacgagattact

SEQ ID NO: 798 - DNA, 19 bp, Artificial sequence
  SiRNA target sequence
ttagatgacgagattacta

SEQ ID NO: 799 - DNA, 19 bp, Artificial sequence
  SiRNA target sequence
tagatgacgagattactac

SEQ ID NO: 800 - DNA, 19 bp, Artificial sequence
  SiRNA target sequence
agatgacgagattactacg

SEQ ID NO: 801 - DNA, 19 bp, Artificial sequence
  SiRNA target sequence
gatgacgagattactacgc

SEQ ID NO: 802 - DNA, 19 bp, Artificial sequence
  SiRNA target sequence
atgacgagattactacgct

SEQ ID NO: 803 - DNA, 19 bp, Artificial sequence
  SiRNA target sequence
tgacgagattactacgctt

SEQ ID NO: 804 - DNA, 19 bp, Artificial sequence
  SiRNA target sequence
gacgagattactacgcttt

SEQ ID NO: 805 - DNA, 19 bp, Artificial sequence
  SiRNA target sequence
acgagattactacgcttta

SEQ ID NO: 806 - DNA, 19 bp, Artificial sequence
  SiRNA target sequence
cgagattactacgctttac

SEQ ID NO: 807 - DNA, 19 bp, Artificial sequence
  SiRNA target sequence
gagattactacgctttact

SEQ ID NO: 808 - DNA, 19 bp, Artificial sequence
  SiRNA target sequence
agattactacgctttactt

SEQ ID NO: 809 - DNA, 19 bp, Artificial sequence
  SiRNA target sequence
gattactacgctttacttg

SEQ ID NO: 810 - DNA, 19 bp, Artificial sequence
  SiRNA target sequence
attactacgctttacttgt

SEQ ID NO: 811 - DNA, 19 bp, Artificial sequence
  SiRNA target sequence
ttactacgctttacttgta

SEQ ID NO: 812 - DNA, 19 bp, Artificial sequence
  SiRNA target sequence
tactacgctttacttgtat

SEQ ID NO: 813 - DNA, 19 bp, Artificial sequence
  SiRNA target sequence
actacgctttacttgtatt

SEQ ID NO: 814 - DNA, 19 bp, Artificial sequence
  SiRNA target sequence
ctacgctttacttgtattc

SEQ ID NO: 815 - DNA, 19 bp, Artificial sequence
  SiRNA target sequence
tacgctttacttgtattct

SEQ ID NO: 816 - DNA, 19 bp, Artificial sequence
  SiRNA target sequence
acgctttacttgtattcta

SEQ ID NO: 817 - DNA, 19 bp, Artificial sequence
  SiRNA target sequence
cgctttacttgtattctaa

SEQ ID NO: 818 - DNA, 19 bp, Artificial sequence
  SiRNA target sequence
gctttacttgtattctaag

SEQ ID NO: 819 - DNA, 19 bp, Artificial sequence
  SiRNA target sequence
ctttacttgtattctaaga

SEQ ID NO: 820 - DNA, 19 bp, Artificial sequence
  SiRNA target sequence
tttacttgtattctaagat

SEQ ID NO: 821 - DNA, 19 bp, Artificial sequence
  SiRNA target sequence
ttacttgtattctaagatt

SEQ ID NO: 822 - DNA, 19 bp, Artificial sequence
  SiRNA target sequence
tacttgtattctaagattt

SEQ ID NO: 823 - DNA, 19 bp, Artificial sequence
  SiRNA target sequence
acttgtattctaagatttt

SEQ ID NO: 824 - DNA, 19 bp, Artificial sequence
  SiRNA target sequence
cttgtattctaagattttt

SEQ ID NO: 825 - DNA, 19 bp, Artificial sequence
  SiRNA target sequence
ttgtattctaagattttta

SEQ ID NO: 826 - DNA, 19 bp, Artificial sequence
  SiRNA target sequence
tgtattctaagatttttaa

SEQ ID NO: 827 - DNA, 19 bp, Artificial sequence
  SiRNA target sequence
gtattctaagatttttaaa

SEQ ID NO: 828 - DNA, 19 bp, Artificial sequence
  SiRNA target sequence
tattctaagatttttaaag

SEQ ID NO: 829 - DNA, 19 bp, Artificial sequence
  SiRNA target sequence
attctaagatttttaaaga

SEQ ID NO: 830 - DNA, 19 bp, Artificial sequence
  SiRNA target sequence
ttctaagatttttaaagat

SEQ ID NO: 831 - DNA, 19 bp, Artificial sequence
  SiRNA target sequence
tctaagatttttaaagata

SEQ ID NO: 832 - DNA, 19 bp, Artificial sequence
  SiRNA target sequence
ctaagatttttaaagataa

SEQ ID NO: 833 - DNA, 19 bp, Artificial sequence
  SiRNA target sequence
taagatttttaaagataaa

SEQ ID NO: 834 - DNA, 19 bp, Artificial sequence
  SiRNA target sequence
aagatttttaaagataaat

SEQ ID NO: 835 - DNA, 19 bp, Artificial sequence
  SiRNA target sequence
agatttttaaagataaatc

SEQ ID NO: 836 - DNA, 19 bp, Artificial sequence
  SiRNA target sequence
gatttttaaagataaatct

SEQ ID NO: 837 - DNA, 19 bp, Artificial sequence
  SiRNA target sequence
atttttaaagataaatctg

SEQ ID NO: 838 - DNA, 19 bp, Artificial sequence
  SiRNA target sequence
tttttaaagataaatctga

SEQ ID NO: 839 - DNA, 19 bp, Artificial sequence
  SiRNA target sequence
ttttaaagataaatctgat

SEQ ID NO: 840 - DNA, 19 bp, Artificial sequence
  SiRNA target sequence
tttaaagataaatctgata

SEQ ID NO: 841 - DNA, 19 bp, Artificial sequence
  SiRNA target sequence
ttaaagataaatctgatac

SEQ ID NO: 842 - DNA, 19 bp, Artificial sequence
  SiRNA target sequence
taaagataaatctgatact

SEQ ID NO: 843 - DNA, 19 bp, Artificial sequence
  SiRNA target sequence
aaagataaatctgatactt

SEQ ID NO: 844 - DNA, 19 bp, Artificial sequence
  SiRNA target sequence
aagataaatctgatactta

SEQ ID NO: 845 - DNA, 19 bp, Artificial sequence
  SiRNA target sequence
agataaatctgatacttac

SEQ ID NO: 846 - DNA, 19 bp, Artificial sequence
  SiRNA target sequence
gataaatctgatacttacc

SEQ ID NO: 847 - DNA, 19 bp, Artificial sequence
  SiRNA target sequence
ataaatctgatacttacct

SEQ ID NO: 848 - DNA, 19 bp, Artificial sequence
  SiRNA target sequence
taaatctgatacttacctt

SEQ ID NO: 849 - DNA, 19 bp, Artificial sequence
  SiRNA target sequence
aaatctgatacttacctta

SEQ ID NO: 850 - DNA, 19 bp, Artificial sequence
  SiRNA target sequence
aatctgatacttaccttaa

SEQ ID NO: 851 - DNA, 19 bp, Artificial sequence
  SiRNA target sequence
atctgatacttaccttaaa

SEQ ID NO: 852 - DNA, 19 bp, Artificial sequence
  SiRNA target sequence
tctgatacttaccttaaat

SEQ ID NO: 853 - DNA, 19 bp, Artificial sequence
  SiRNA target sequence
ctgatacttaccttaaatc

SEQ ID NO: 854 - DNA, 19 bp, Artificial sequence
  SiRNA target sequence
tgatacttaccttaaatct

SEQ ID NO: 855 - DNA, 19 bp, Artificial sequence
  SiRNA target sequence
gatacttaccttaaatctg

SEQ ID NO: 856 - DNA, 19 bp, Artificial sequence
  SiRNA target sequence
atacttaccttaaatctgc

SEQ ID NO: 857 - DNA, 19 bp, Artificial sequence
  SiRNA target sequence
tacttaccttaaatctgct

SEQ ID NO: 858 - DNA, 19 bp, Artificial sequence
  SiRNA target sequence
acttaccttaaatctgcta

SEQ ID NO: 859 - DNA, 19 bp, Artificial sequence
  SiRNA target sequence
cttaccttaaatctgctat

SEQ ID NO: 860 - DNA, 19 bp, Artificial sequence
  SiRNA target sequence
ttaccttaaatctgctata

SEQ ID NO: 861 - DNA, 19 bp, Artificial sequence
  SiRNA target sequence
taccttaaatctgctatag

SEQ ID NO: 862 - DNA, 19 bp, Artificial sequence
  SiRNA target sequence
accttaaatctgctataga

SEQ ID NO: 863 - DNA, 19 bp, Artificial sequence
  SiRNA target sequence
ccttaaatctgctatagat

SEQ ID NO: 864 - DNA, 19 bp, Artificial sequence
  SiRNA target sequence
cttaaatctgctatagata

SEQ ID NO: 865 - DNA, 19 bp, Artificial sequence
  SiRNA target sequence
ttaaatctgctatagataa

SEQ ID NO: 866 - DNA, 19 bp, Artificial sequence
  SiRNA target sequence
taaatctgctatagataaa

SEQ ID NO: 867 - DNA, 19 bp, Artificial sequence
  SiRNA target sequence
aaatctgctatagataaat

SEQ ID NO: 868 - DNA, 19 bp, Artificial sequence
  SiRNA target sequence
aatctgctatagataaatc

SEQ ID NO: 869 - DNA, 19 bp, Artificial sequence
  SiRNA target sequence
atctgctatagataaatca

SEQ ID NO: 870 - DNA, 19 bp, Artificial sequence
  SiRNA target sequence
tctgctatagataaatcag

SEQ ID NO: 871 - DNA, 19 bp, Artificial sequence
  SiRNA target sequence
ctgctatagataaatcagt

SEQ ID NO: 872 - DNA, 19 bp, Artificial sequence
  SiRNA target sequence
tgctatagataaatcagta

SEQ ID NO: 873 - DNA, 19 bp, Artificial sequence
  SiRNA target sequence
gctatagataaatcagtag

SEQ ID NO: 874 - DNA, 19 bp, Artificial sequence
  SiRNA target sequence
ctatagataaatcagtaga

SEQ ID NO: 875 - DNA, 19 bp, Artificial sequence
  SiRNA target sequence
tatagataaatcagtagat

SEQ ID NO: 876 - DNA, 19 bp, Artificial sequence
  SiRNA target sequence
atagataaatcagtagatc

SEQ ID NO: 877 - DNA, 19 bp, Artificial sequence
  SiRNA target sequence
tagataaatcagtagatct

SEQ ID NO: 878 - DNA, 19 bp, Artificial sequence
  SiRNA target sequence
agataaatcagtagatcta

SEQ ID NO: 879 - DNA, 19 bp, Artificial sequence
  SiRNA target sequence
gataaatcagtagatctac

SEQ ID NO: 880 - DNA, 19 bp, Artificial sequence
  SiRNA target sequence
ataaatcagtagatctacc

SEQ ID NO: 881 - DNA, 19 bp, Artificial sequence
  SiRNA target sequence
taaatcagtagatctacct

SEQ ID NO: 882 - DNA, 19 bp, Artificial sequence
  SiRNA target sequence
aaatcagtagatctaccta

SEQ ID NO: 883 - DNA, 19 bp, Artificial sequence
  SiRNA target sequence
aatcagtagatctacctat

SEQ ID NO: 884 - DNA, 19 bp, Artificial sequence
  SiRNA target sequence
atcagtagatctacctatt

SEQ ID NO: 885 - DNA, 19 bp, Artificial sequence
  SiRNA target sequence
tcagtagatctacctattg

SEQ ID NO: 886 - DNA, 19 bp, Artificial sequence
  SiRNA target sequence
cagtagatctacctattga

SEQ ID NO: 887 - DNA, 19 bp, Artificial sequence
  SiRNA target sequence
agtagatctacctattgaa

SEQ ID NO: 888 - DNA, 19 bp, Artificial sequence
  SiRNA target sequence
gtagatctacctattgaac

SEQ ID NO: 889 - DNA, 19 bp, Artificial sequence
  SiRNA target sequence
tagatctacctattgaaca

SEQ ID NO: 890 - DNA, 19 bp, Artificial sequence
  SiRNA target sequence
agatctacctattgaacag

SEQ ID NO: 891 - DNA, 19 bp, Artificial sequence
  SiRNA target sequence
gatctacctattgaacaga

SEQ ID NO: 892 - DNA, 19 bp, Artificial sequence
  SiRNA target sequence
atctacctattgaacagaa

SEQ ID NO: 893 - DNA, 19 bp, Artificial sequence
  SiRNA target sequence
tctacctattgaacagaaa

SEQ ID NO: 894 - DNA, 19 bp, Artificial sequence
  SiRNA target sequence
ctacctattgaacagaaag

SEQ ID NO: 895 - DNA, 19 bp, Artificial sequence
  SiRNA target sequence
tacctattgaacagaaaga

SEQ ID NO: 896 - DNA, 19 bp, Artificial sequence
  SiRNA target sequence
acctattgaacagaaagac

SEQ ID NO: 897 - DNA, 19 bp, Artificial sequence
  SiRNA target sequence
cctattgaacagaaagact

SEQ ID NO: 898 - DNA, 19 bp, Artificial sequence
  SiRNA target sequence
ctattgaacagaaagactt

SEQ ID NO: 899 - DNA, 19 bp, Artificial sequence
  SiRNA target sequence
tattgaacagaaagacttt

SEQ ID NO: 900 - DNA, 19 bp, Artificial sequence
  SiRNA target sequence
attgaacagaaagactttc

SEQ ID NO: 901 - DNA, 19 bp, Artificial sequence
  SiRNA target sequence
ttgaacagaaagactttct

SEQ ID NO: 902 - DNA, 19 bp, Artificial sequence
  SiRNA target sequence
tgaacagaaagactttctg

SEQ ID NO: 903 - DNA, 19 bp, Artificial sequence
  SiRNA target sequence
gaacagaaagactttctgt

SEQ ID NO: 904 - DNA, 19 bp, Artificial sequence
  SiRNA target sequence
aacagaaagactttctgta

SEQ ID NO: 905 - DNA, 19 bp, Artificial sequence
  SiRNA target sequence
acagaaagactttctgtac

SEQ ID NO: 906 - DNA, 19 bp, Artificial sequence
  SiRNA target sequence
cagaaagactttctgtacg

SEQ ID NO: 907 - DNA, 19 bp, Artificial sequence
  SiRNA target sequence
agaaagactttctgtacgt

SEQ ID NO: 908 - DNA, 19 bp, Artificial sequence
  SiRNA target sequence
gaaagactttctgtacgta

SEQ ID NO: 909 - DNA, 19 bp, Artificial sequence
  SiRNA target sequence
aaagactttctgtacgtag

SEQ ID NO: 910 - DNA, 19 bp, Artificial sequence
  SiRNA target sequence
aagactttctgtacgtaga

SEQ ID NO: 911 - DNA, 19 bp, Artificial sequence
  SiRNA target sequence
agactttctgtacgtagat

SEQ ID NO: 912 - DNA, 19 bp, Artificial sequence
  SiRNA target sequence
gactttctgtacgtagatc

SEQ ID NO: 913 - DNA, 19 bp, Artificial sequence
  SiRNA target sequence
actttctgtacgtagatct

SEQ ID NO: 914 - DNA, 19 bp, Artificial sequence
  SiRNA target sequence
ctttctgtacgtagatctt

SEQ ID NO: 915 - DNA, 19 bp, Artificial sequence
  SiRNA target sequence
tttctgtacgtagatcttc

SEQ ID NO: 916 - DNA, 19 bp, Artificial sequence
  SiRNA target sequence
ttctgtacgtagatcttct

SEQ ID NO: 917 - DNA, 19 bp, Artificial sequence
  SiRNA target sequence
tctgtacgtagatcttctt

SEQ ID NO: 918 - DNA, 19 bp, Artificial sequence
  SiRNA target sequence
ctgtacgtagatcttcttg

SEQ ID NO: 919 - DNA, 19 bp, Artificial sequence
  SiRNA target sequence
tgtacgtagatcttcttgt

SEQ ID NO: 920 - DNA, 19 bp, Artificial sequence
  SiRNA target sequence
gtacgtagatcttcttgta

SEQ ID NO: 921 - DNA, 19 bp, Artificial sequence
  SiRNA target sequence
tacgtagatcttcttgtat

SEQ ID NO: 922 - DNA, 19 bp, Artificial sequence
  SiRNA target sequence
acgtagatcttcttgtatt

SEQ ID NO: 923 - DNA, 19 bp, Artificial sequence
  SiRNA target sequence
cgtagatcttcttgtattt

SEQ ID NO: 924 - DNA, 19 bp, Artificial sequence
  SiRNA target sequence
gtagatcttcttgtatttt

SEQ ID NO: 925 - DNA, 19 bp, Artificial sequence
  SiRNA target sequence
tagatcttcttgtatttta

SEQ ID NO: 926 - DNA, 19 bp, Artificial sequence
  SiRNA target sequence
agatcttcttgtattttac

SEQ ID NO: 927 - DNA, 19 bp, Artificial sequence
  SiRNA target sequence
gatcttcttgtattttaca

SEQ ID NO: 928 - DNA, 19 bp, Artificial sequence
  SiRNA target sequence
atcttcttgtattttacat

SEQ ID NO: 929 - DNA, 19 bp, Artificial sequence
  SiRNA target sequence
tcttcttgtattttacatt

SEQ ID NO: 930 - DNA, 19 bp, Artificial sequence
  SiRNA target sequence
cttcttgtattttacattt

SEQ ID NO: 931 - DNA, 19 bp, Artificial sequence
  SiRNA target sequence
ttcttgtattttacatttc

SEQ ID NO: 932 - DNA, 19 bp, Artificial sequence
  SiRNA target sequence
tcttgtattttacatttct

SEQ ID NO: 933 - DNA, 19 bp, Artificial sequence
  SiRNA target sequence
cttgtattttacatttcta

SEQ ID NO: 934 - DNA, 19 bp, Artificial sequence
  SiRNA target sequence
ttgtattttacatttctaa

SEQ ID NO: 935 - DNA, 19 bp, Artificial sequence
  SiRNA target sequence
tgtattttacatttctaaa

SEQ ID NO: 936 - DNA, 19 bp, Artificial sequence
  SiRNA target sequence
gtattttacatttctaaaa

SEQ ID NO: 937 - DNA, 19 bp, Artificial sequence
  SiRNA target sequence
tattttacatttctaaaaa

SEQ ID NO: 938 - DNA, 19 bp, Artificial sequence
  SiRNA target sequence
attttacatttctaaaaag

SEQ ID NO: 939 - DNA, 19 bp, Artificial sequence
  SiRNA target sequence
ttttacatttctaaaaagg

SEQ ID NO: 940 - DNA, 19 bp, Artificial sequence
  SiRNA target sequence
tttacatttctaaaaagga

SEQ ID NO: 941 - DNA, 19 bp, Artificial sequence
  SiRNA target sequence
ttacatttctaaaaaggat

SEQ ID NO: 942 - DNA, 19 bp, Artificial sequence
  SiRNA target sequence
tacatttctaaaaaggatg

SEQ ID NO: 943 - DNA, 19 bp, Artificial sequence
  SiRNA target sequence
acatttctaaaaaggatgt

SEQ ID NO: 944 - DNA, 19 bp, Artificial sequence
  SiRNA target sequence
catttctaaaaaggatgtt

SEQ ID NO: 945 - DNA, 19 bp, Artificial sequence
  SiRNA target sequence
atttctaaaaaggatgttg

SEQ ID NO: 946 - DNA, 19 bp, Artificial sequence
  SiRNA target sequence
tttctaaaaaggatgttga

SEQ ID NO: 947 - DNA, 19 bp, Artificial sequence
  SiRNA target sequence
ttctaaaaaggatgttgaa

SEQ ID NO: 948 - DNA, 19 bp, Artificial sequence
  SiRNA target sequence
tctaaaaaggatgttgaaa

SEQ ID NO: 949 - DNA, 19 bp, Artificial sequence
  SiRNA target sequence
ctaaaaaggatgttgaaaa

SEQ ID NO: 950 - DNA, 19 bp, Artificial sequence
  SiRNA target sequence
taaaaaggatgttgaaaaa

SEQ ID NO: 951 - DNA, 19 bp, Artificial sequence
  SiRNA target sequence
aaaaaggatgttgaaaaag

SEQ ID NO: 952 - DNA, 19 bp, Artificial sequence
  SiRNA target sequence
aaaaggatgttgaaaaagt

SEQ ID NO: 953 - DNA, 19 bp, Artificial sequence
  SiRNA target sequence
aaaggatgttgaaaaagtt

SEQ ID NO: 954 - DNA, 19 bp, Artificial sequence
  SiRNA target sequence
aaggatgttgaaaaagtta

SEQ ID NO: 955 - DNA, 19 bp, Artificial sequence
  SiRNA target sequence
aggatgttgaaaaagttaa

SEQ ID NO: 956 - DNA, 19 bp, Artificial sequence
  SiRNA target sequence
ggatgttgaaaaagttaat

SEQ ID NO: 957 - DNA, 19 bp, Artificial sequence
  SiRNA target sequence
gatgttgaaaaagttaatg

SEQ ID NO: 958 - DNA, 19 bp, Artificial sequence
  SiRNA target sequence
atgttgaaaaagttaatga

SEQ ID NO: 959 - DNA, 19 bp, Artificial sequence
  SiRNA target sequence
tgttgaaaaagttaatgaa

SEQ ID NO: 960 - DNA, 19 bp, Artificial sequence
  SiRNA target sequence
gttgaaaaagttaatgaaa

SEQ ID NO: 961 - DNA, 19 bp, Artificial sequence
  SiRNA target sequence
ttgaaaaagttaatgaaac

SEQ ID NO: 962 - DNA, 19 bp, Artificial sequence
  SiRNA target sequence
tgaaaaagttaatgaaaca

SEQ ID NO: 963 - DNA, 19 bp, Artificial sequence
  SiRNA target sequence
gaaaaagttaatgaaacaa

SEQ ID NO: 964 - DNA, 19 bp, Artificial sequence
  SiRNA target sequence
aaaaagttaatgaaacaat

SEQ ID NO: 965 - DNA, 19 bp, Artificial sequence
  SiRNA target sequence
aaaagttaatgaaacaatt

SEQ ID NO: 966 - DNA, 19 bp, Artificial sequence
  SiRNA target sequence
aaagttaatgaaacaatta

SEQ ID NO: 967 - DNA, 19 bp, Artificial sequence
  SiRNA target sequence
aagttaatgaaacaattaa

SEQ ID NO: 968 - DNA, 19 bp, Artificial sequence
  SiRNA target sequence
agttaatgaaacaattaat

SEQ ID NO: 969 - DNA, 19 bp, Artificial sequence
  SiRNA target sequence
gttaatgaaacaattaata

SEQ ID NO: 970 - DNA, 19 bp, Artificial sequence
  SiRNA target sequence
ttaatgaaacaattaataa

SEQ ID NO: 971 - DNA, 19 bp, Artificial sequence
  SiRNA target sequence
taatgaaacaattaataat

SEQ ID NO: 972 - DNA, 19 bp, Artificial sequence
  SiRNA target sequence
aatgaaacaattaataatt

SEQ ID NO: 973 - DNA, 19 bp, Artificial sequence
  SiRNA target sequence
atgaaacaattaataattt

SEQ ID NO: 974 - DNA, 19 bp, Artificial sequence
  SiRNA target sequence
tgaaacaattaataattta

SEQ ID NO: 975 - DNA, 19 bp, Artificial sequence
  SiRNA target sequence
gaaacaattaataatttaa

SEQ ID NO: 976 - DNA, 19 bp, Artificial sequence
  SiRNA target sequence
aaacaattaataatttaaa

SEQ ID NO: 977 - DNA, 19 bp, Artificial sequence
  SiRNA target sequence
aacaattaataatttaaaa

SEQ ID NO: 978 - DNA, 19 bp, Artificial sequence
  SiRNA target sequence
acaattaataatttaaaag

SEQ ID NO: 979 - DNA, 19 bp, Artificial sequence
  SiRNA target sequence
caattaataatttaaaaga

SEQ ID NO: 980 - DNA, 19 bp, Artificial sequence
  SiRNA target sequence
aattaataatttaaaagag

SEQ ID NO: 981 - DNA, 19 bp, Artificial sequence
  SiRNA target sequence
attaataatttaaaagaga

SEQ ID NO: 982 - DNA, 19 bp, Artificial sequence
  SiRNA target sequence
ttaataatttaaaagagac

SEQ ID NO: 983 - DNA, 19 bp, Artificial sequence
  SiRNA target sequence
taataatttaaaagagact

SEQ ID NO: 984 - DNA, 19 bp, Artificial sequence
  SiRNA target sequence
aataatttaaaagagactc

SEQ ID NO: 985 - DNA, 19 bp, Artificial sequence
  SiRNA target sequence
ataatttaaaagagactct

SEQ ID NO: 986 - DNA, 19 bp, Artificial sequence
  SiRNA target sequence
taatttaaaagagactctt

SEQ ID NO: 987 - DNA, 19 bp, Artificial sequence
  SiRNA target sequence
aatttaaaagagactctta

SEQ ID NO: 988 - DNA, 19 bp, Artificial sequence
  SiRNA target sequence
atttaaaagagactcttac

SEQ ID NO: 989 - DNA, 19 bp, Artificial sequence
  SiRNA target sequence
tttaaaagagactcttacc

SEQ ID NO: 990 - DNA, 19 bp, Artificial sequence
  SiRNA target sequence
ttaaaagagactcttaccc

SEQ ID NO: 991 - DNA, 19 bp, Artificial sequence
  SiRNA target sequence
taaaagagactcttacccc

SEQ ID NO: 992 - DNA, 19 bp, Artificial sequence
  SiRNA target sequence
aaaagagactcttaccccc

SEQ ID NO: 993 - DNA, 19 bp, Artificial sequence
  SiRNA target sequence
aaagagactcttaccccca

SEQ ID NO: 994 - DNA, 19 bp, Artificial sequence
  SiRNA target sequence
aagagactcttacccccac

SEQ ID NO: 995 - DNA, 19 bp, Artificial sequence
  SiRNA target sequence
agagactcttacccccact

SEQ ID NO: 996 - DNA, 19 bp, Artificial sequence
  SiRNA target sequence
gagactcttacccccactt

SEQ ID NO: 997 - DNA, 19 bp, Artificial sequence
  SiRNA target sequence
agactcttacccccacttt

SEQ ID NO: 998 - DNA, 19 bp, Artificial sequence
  SiRNA target sequence
gactcttacccccacttta

SEQ ID NO: 999 - DNA, 19 bp, Artificial sequence
  SiRNA target sequence
actcttacccccactttat

SEQ ID NO: 1000 - DNA, 19 bp, Artificial sequence
  SiRNA target sequence
ctcttacccccactttatt

SEQ ID NO: 1001 - DNA, 19 bp, Artificial sequence
  SiRNA target sequence
tcttacccccactttattg

SEQ ID NO: 1002 - DNA, 19 bp, Artificial sequence
  SiRNA target sequence
cttacccccactttattgg

SEQ ID NO: 1003 - DNA, 19 bp, Artificial sequence
  SiRNA target sequence
ttacccccactttattgga

SEQ ID NO: 1004 - DNA, 19 bp, Artificial sequence
  SiRNA target sequence
tacccccactttattggaa

SEQ ID NO: 1005 - DNA, 19 bp, Artificial sequence
  SiRNA target sequence
acccccactttattggaac

SEQ ID NO: 1006 - DNA, 19 bp, Artificial sequence
  SiRNA target sequence
cccccactttattggaact

SEQ ID NO: 1007 - DNA, 19 bp, Artificial sequence
  SiRNA target sequence
ccccactttattggaactt

SEQ ID NO: 1008 - DNA, 19 bp, Artificial sequence
  SiRNA target sequence
cccactttattggaactta

SEQ ID NO: 1009 - DNA, 19 bp, Artificial sequence
  SiRNA target sequence
ccactttattggaacttat

SEQ ID NO: 1010 - DNA, 19 bp, Artificial sequence
  SiRNA target sequence
cactttattggaacttatt

SEQ ID NO: 1011 - DNA, 19 bp, Artificial sequence
  SiRNA target sequence
actttattggaacttattg

SEQ ID NO: 1012 - DNA, 19 bp, Artificial sequence
  SiRNA target sequence
ctttattggaacttattgg

SEQ ID NO: 1013 - DNA, 19 bp, Artificial sequence
  SiRNA target sequence
tttattggaacttattgga

SEQ ID NO: 1014 - DNA, 19 bp, Artificial sequence
  SiRNA target sequence
ttattggaacttattggag

SEQ ID NO: 1015 - DNA, 19 bp, Artificial sequence
  SiRNA target sequence
tattggaacttattggaga

SEQ ID NO: 1016 - DNA, 19 bp, Artificial sequence
  SiRNA target sequence
attggaacttattggagaa

SEQ ID NO: 1017 - DNA, 19 bp, Artificial sequence
  SiRNA target sequence
ttggaacttattggagaat

SEQ ID NO: 1018 - DNA, 19 bp, Artificial sequence
  SiRNA target sequence
tggaacttattggagaata

SEQ ID NO: 1019 - DNA, 19 bp, Artificial sequence
  SiRNA target sequence
ggaacttattggagaatat

SEQ ID NO: 1020 - DNA, 19 bp, Artificial sequence
  SiRNA target sequence
gaacttattggagaatatt

SEQ ID NO: 1021 - DNA, 19 bp, Artificial sequence
  SiRNA target sequence
aacttattggagaatatta

SEQ ID NO: 1022 - DNA, 19 bp, Artificial sequence
  SiRNA target sequence
acttattggagaatattat

SEQ ID NO: 1023 - DNA, 19 bp, Artificial sequence
  SiRNA target sequence
cttattggagaatattatt

SEQ ID NO: 1024 - DNA, 19 bp, Artificial sequence
  SiRNA target sequence
ttattggagaatattattt

SEQ ID NO: 1025 - DNA, 19 bp, Artificial sequence
  SiRNA target sequence
tattggagaatattattta

SEQ ID NO: 1026 - DNA, 19 bp, Artificial sequence
  SiRNA target sequence
attggagaatattatttaa

SEQ ID NO: 1027 - DNA, 19 bp, Artificial sequence
  SiRNA target sequence
ttggagaatattatttaaa

SEQ ID NO: 1028 - DNA, 19 bp, Artificial sequence
  SiRNA target sequence
tggagaatattatttaaaa

SEQ ID NO: 1029 - DNA, 19 bp, Artificial sequence
  SiRNA target sequence
ggagaatattatttaaaaa

SEQ ID NO: 1030 - DNA, 19 bp, Artificial sequence
  SiRNA target sequence
gagaatattatttaaaaag

SEQ ID NO: 1031 - DNA, 19 bp, Artificial sequence
  SiRNA target sequence
agaatattatttaaaaagt

SEQ ID NO: 1032 - DNA, 19 bp, Artificial sequence
  SiRNA target sequence
gaatattatttaaaaagtg

SEQ ID NO: 1033 - DNA, 19 bp, Artificial sequence
  SiRNA target sequence
aatattatttaaaaagtgg

SEQ ID NO: 1034 - DNA, 19 bp, Artificial sequence
  SiRNA target sequence
atattatttaaaaagtgga

SEQ ID NO: 1035 - DNA, 19 bp, Artificial sequence
  SiRNA target sequence
tattatttaaaaagtggaa

SEQ ID NO: 1036 - DNA, 19 bp, Artificial sequence
  SiRNA target sequence
attatttaaaaagtggaaa

SEQ ID NO: 1037 - DNA, 19 bp, Artificial sequence
  SiRNA target sequence
ttatttaaaaagtggaaat

SEQ ID NO: 1038 - DNA, 19 bp, Artificial sequence
  SiRNA target sequence
tatttaaaaagtggaaatc

SEQ ID NO: 1039 - DNA, 19 bp, Artificial sequence
  SiRNA target sequence
atttaaaaagtggaaatca

SEQ ID NO: 1040 - DNA, 19 bp, Artificial sequence
  SiRNA target sequence
tttaaaaagtggaaatcac

SEQ ID NO: 1041 - DNA, 19 bp, Artificial sequence
  SiRNA target sequence
ttaaaaagtggaaatcact

SEQ ID NO: 1042 - DNA, 19 bp, Artificial sequence
  SiRNA target sequence
taaaaagtggaaatcactc

SEQ ID NO: 1043 - DNA, 19 bp, Artificial sequence
  SiRNA target sequence
aaaaagtggaaatcactct

SEQ ID NO: 1044 - DNA, 19 bp, Artificial sequence
  SiRNA target sequence
aaaagtggaaatcactcta

SEQ ID NO: 1045 - DNA, 19 bp, Artificial sequence
  SiRNA target sequence
aaagtggaaatcactctaa

SEQ ID NO: 1046 - DNA, 19 bp, Artificial sequence
  SiRNA target sequence
aagtggaaatcactctaaa

SEQ ID NO: 1047 - DNA, 19 bp, Artificial sequence
  SiRNA target sequence
agtggaaatcactctaaaa

SEQ ID NO: 1048 - DNA, 19 bp, Artificial sequence
  SiRNA target sequence
gtggaaatcactctaaaat

SEQ ID NO: 1049 - DNA, 19 bp, Artificial sequence
  SiRNA target sequence
tggaaatcactctaaaatg

SEQ ID NO: 1050 - DNA, 19 bp, Artificial sequence
  SiRNA target sequence
ggaaatcactctaaaatgt

SEQ ID NO: 1051 - DNA, 19 bp, Artificial sequence
  SiRNA target sequence
gaaatcactctaaaatgtt

SEQ ID NO: 1052 - DNA, 19 bp, Artificial sequence
  SiRNA target sequence
aaatcactctaaaatgtta

SEQ ID NO: 1053 - DNA, 19 bp, Artificial sequence
  SiRNA target sequence
aatcactctaaaatgttag

SEQ ID NO: 1054 - DNA, 19 bp, Artificial sequence
  SiRNA target sequence
atcactctaaaatgttaga

SEQ ID NO: 1055 - DNA, 19 bp, Artificial sequence
  SiRNA target sequence
tcactctaaaatgttagat

SEQ ID NO: 1056 - DNA, 19 bp, Artificial sequence
  SiRNA target sequence
cactctaaaatgttagatc

SEQ ID NO: 1057 - DNA, 19 bp, Artificial sequence
  SiRNA target sequence
actctaaaatgttagatct

SEQ ID NO: 1058 - DNA, 19 bp, Artificial sequence
  SiRNA target sequence
ctctaaaatgttagatcta

SEQ ID NO: 1059 - DNA, 19 bp, Artificial sequence
  SiRNA target sequence
tctaaaatgttagatctat

SEQ ID NO: 1060 - DNA, 19 bp, Artificial sequence
  SiRNA target sequence
ctaaaatgttagatctatt

SEQ ID NO: 1061 - DNA, 19 bp, Artificial sequence
  SiRNA target sequence
taaaatgttagatctatta

SEQ ID NO: 1062 - DNA, 19 bp, Artificial sequence
  SiRNA target sequence
aaaatgttagatctattat

SEQ ID NO: 1063 - DNA, 19 bp, Artificial sequence
  SiRNA target sequence
aaatgttagatctattatc

SEQ ID NO: 1064 - DNA, 19 bp, Artificial sequence
  SiRNA target sequence
aatgttagatctattatct

SEQ ID NO: 1065 - DNA, 19 bp, Artificial sequence
  SiRNA target sequence
atgttagatctattatcta

SEQ ID NO: 1066 - DNA, 19 bp, Artificial sequence
  SiRNA target sequence
tgttagatctattatctag

SEQ ID NO: 1067 - DNA, 19 bp, Artificial sequence
  SiRNA target sequence
gttagatctattatctagt

SEQ ID NO: 1068 - DNA, 19 bp, Artificial sequence
  SiRNA target sequence
ttagatctattatctagtc

SEQ ID NO: 1069 - DNA, 19 bp, Artificial sequence
  SiRNA target sequence
tagatctattatctagtca

SEQ ID NO: 1070 - DNA, 19 bp, Artificial sequence
  SiRNA target sequence
agatctattatctagtcat

SEQ ID NO: 1071 - DNA, 19 bp, Artificial sequence
  SiRNA target sequence
gatctattatctagtcatc

SEQ ID NO: 1072 - DNA, 19 bp, Artificial sequence
  SiRNA target sequence
atctattatctagtcatcc

SEQ ID NO: 1073 - DNA, 19 bp, Artificial sequence
  SiRNA target sequence
tctattatctagtcatcca

SEQ ID NO: 1074 - DNA, 19 bp, Artificial sequence
  SiRNA target sequence
ctattatctagtcatccag

SEQ ID NO: 1075 - DNA, 19 bp, Artificial sequence
  SiRNA target sequence
tattatctagtcatccaga

SEQ ID NO: 1076 - DNA, 19 bp, Artificial sequence
  SiRNA target sequence
attatctagtcatccagat

SEQ ID NO: 1077 - DNA, 19 bp, Artificial sequence
  SiRNA target sequence
ttatctagtcatccagata

SEQ ID NO: 1078 - DNA, 19 bp, Artificial sequence
  SiRNA target sequence
tatctagtcatccagatac

SEQ ID NO: 1079 - DNA, 19 bp, Artificial sequence
  SiRNA target sequence
atctagtcatccagatact

SEQ ID NO: 1080 - DNA, 19 bp, Artificial sequence
  SiRNA target sequence
tctagtcatccagatactc

SEQ ID NO: 1081 - DNA, 19 bp, Artificial sequence
  SiRNA target sequence
ctagtcatccagatactcc

SEQ ID NO: 1082 - DNA, 19 bp, Artificial sequence
  SiRNA target sequence
tagtcatccagatactcct

SEQ ID NO: 1083 - DNA, 19 bp, Artificial sequence
  SiRNA target sequence
agtcatccagatactcctg

SEQ ID NO: 1084 - DNA, 19 bp, Artificial sequence
  SiRNA target sequence
gtcatccagatactcctgg

SEQ ID NO: 1085 - DNA, 19 bp, Artificial sequence
  SiRNA target sequence
tcatccagatactcctggt

SEQ ID NO: 1086 - DNA, 19 bp, Artificial sequence
  SiRNA target sequence
catccagatactcctggta

SEQ ID NO: 1087 - DNA, 19 bp, Artificial sequence
  SiRNA target sequence
atccagatactcctggtaa

SEQ ID NO: 1088 - DNA, 19 bp, Artificial sequence
  SiRNA target sequence
tccagatactcctggtaaa

SEQ ID NO: 1089 - DNA, 19 bp, Artificial sequence
  SiRNA target sequence
ccagatactcctggtaaat

SEQ ID NO: 1090 - DNA, 19 bp, Artificial sequence
  SiRNA target sequence
cagatactcctggtaaatt

SEQ ID NO: 1091 - DNA, 19 bp, Artificial sequence
  SiRNA target sequence
agatactcctggtaaatta

SEQ ID NO: 1092 - DNA, 19 bp, Artificial sequence
  SiRNA target sequence
gatactcctggtaaattac

SEQ ID NO: 1093 - DNA, 19 bp, Artificial sequence
  SiRNA target sequence
atactcctggtaaattact

SEQ ID NO: 1094 - DNA, 19 bp, Artificial sequence
  SiRNA target sequence
tactcctggtaaattactt

SEQ ID NO: 1095 - DNA, 19 bp, Artificial sequence
  SiRNA target sequence
actcctggtaaattacttt

SEQ ID NO: 1096 - DNA, 19 bp, Artificial sequence
  SiRNA target sequence
ctcctggtaaattactttt

SEQ ID NO: 1097 - DNA, 19 bp, Artificial sequence
  SiRNA target sequence
tcctggtaaattactttta

SEQ ID NO: 1098 - DNA, 19 bp, Artificial sequence
  SiRNA target sequence
cctggtaaattacttttaa

SEQ ID NO: 1099 - DNA, 19 bp, Artificial sequence
  SiRNA target sequence
ctggtaaattacttttaac

SEQ ID NO: 1100 - DNA, 19 bp, Artificial sequence
  SiRNA target sequence
tggtaaattacttttaacg

SEQ ID NO: 1101 - DNA, 19 bp, Artificial sequence
  SiRNA target sequence
ggtaaattacttttaacgg

SEQ ID NO: 1102 - DNA, 19 bp, Artificial sequence
  SiRNA target sequence
gtaaattacttttaacggc

SEQ ID NO: 1103 - DNA, 19 bp, Artificial sequence
  SiRNA target sequence
taaattacttttaacggca

SEQ ID NO: 1104 - DNA, 19 bp, Artificial sequence
  SiRNA target sequence
aaattacttttaacggcac

SEQ ID NO: 1105 - DNA, 19 bp, Artificial sequence
  SiRNA target sequence
aattacttttaacggcact

SEQ ID NO: 1106 - DNA, 19 bp, Artificial sequence
  SiRNA target sequence
attacttttaacggcactt

SEQ ID NO: 1107 - DNA, 19 bp, Artificial sequence
  SiRNA target sequence
ttacttttaacggcacttt

SEQ ID NO: 1108 - DNA, 19 bp, Artificial sequence
  SiRNA target sequence
tacttttaacggcacttta

SEQ ID NO: 1109 - DNA, 19 bp, Artificial sequence
  SiRNA target sequence
acttttaacggcactttat

SEQ ID NO: 1110 - DNA, 19 bp, Artificial sequence
  SiRNA target sequence
cttttaacggcactttatg

SEQ ID NO: 1111 - DNA, 19 bp, Artificial sequence
  SiRNA target sequence
ttttaacggcactttatgc

SEQ ID NO: 1112 - DNA, 19 bp, Artificial sequence
  SiRNA target sequence
tttaacggcactttatgca

SEQ ID NO: 1113 - DNA, 19 bp, Artificial sequence
  SiRNA target sequence
ttaacggcactttatgcaa

SEQ ID NO: 1114 - DNA, 19 bp, Artificial sequence
  SiRNA target sequence
taacggcactttatgcaat

SEQ ID NO: 1115 - DNA, 19 bp, Artificial sequence
  SiRNA target sequence
aacggcactttatgcaata

SEQ ID NO: 1116 - DNA, 19 bp, Artificial sequence
  SiRNA target sequence
acggcactttatgcaataa

SEQ ID NO: 1117 - DNA, 19 bp, Artificial sequence
  SiRNA target sequence
cggcactttatgcaataag

SEQ ID NO: 1118 - DNA, 19 bp, Artificial sequence
  SiRNA target sequence
ggcactttatgcaataagt

SEQ ID NO: 1119 - DNA, 19 bp, Artificial sequence
  SiRNA target sequence
gcactttatgcaataagta

SEQ ID NO: 1120 - DNA, 19 bp, Artificial sequence
  SiRNA target sequence
cactttatgcaataagtat

SEQ ID NO: 1121 - DNA, 19 bp, Artificial sequence
  SiRNA target sequence
actttatgcaataagtatt

SEQ ID NO: 1122 - DNA, 19 bp, Artificial sequence
  SiRNA target sequence
ctttatgcaataagtattg

SEQ ID NO: 1123 - DNA, 19 bp, Artificial sequence
  SiRNA target sequence
tttatgcaataagtattga

SEQ ID NO: 1124 - DNA, 19 bp, Artificial sequence
  SiRNA target sequence
ttatgcaataagtattgat

SEQ ID NO: 1125 - DNA, 19 bp, Artificial sequence
  SiRNA target sequence
tatgcaataagtattgata

SEQ ID NO: 1126 - DNA, 19 bp, Artificial sequence
  SiRNA target sequence
atgcaataagtattgataa

SEQ ID NO: 1127 - DNA, 19 bp, Artificial sequence
  SiRNA target sequence
tgcaataagtattgataag

SEQ ID NO: 1128 - DNA, 19 bp, Artificial sequence
  SiRNA target sequence
gcaataagtattgataaga

SEQ ID NO: 1129 - DNA, 19 bp, Artificial sequence
  SiRNA target sequence
caataagtattgataagaa

SEQ ID NO: 1130 - DNA, 19 bp, Artificial sequence
  SiRNA target sequence
aataagtattgataagaaa

SEQ ID NO: 1131 - DNA, 19 bp, Artificial sequence
  SiRNA target sequence
ataagtattgataagaaaa

SEQ ID NO: 1132 - DNA, 19 bp, Artificial sequence
  SiRNA target sequence
taagtattgataagaaaaa

SEQ ID NO: 1133 - DNA, 19 bp, Artificial sequence
  SiRNA target sequence
aagtattgataagaaaaag

SEQ ID NO: 1134 - DNA, 19 bp, Artificial sequence
  SiRNA target sequence
agtattgataagaaaaagg

SEQ ID NO: 1135 - DNA, 19 bp, Artificial sequence
  SiRNA target sequence
gtattgataagaaaaagga

SEQ ID NO: 1136 - DNA, 19 bp, Artificial sequence
  SiRNA target sequence
tattgataagaaaaaggat

SEQ ID NO: 1137 - DNA, 19 bp, Artificial sequence
  SiRNA target sequence
attgataagaaaaaggatg

SEQ ID NO: 1138 - DNA, 19 bp, Artificial sequence
  SiRNA target sequence
ttgataagaaaaaggatgc

SEQ ID NO: 1139 - DNA, 19 bp, Artificial sequence
  SiRNA target sequence
tgataagaaaaaggatgct

SEQ ID NO: 1140 - DNA, 19 bp, Artificial sequence
  SiRNA target sequence
gataagaaaaaggatgcta

SEQ ID NO: 1141 - DNA, 19 bp, Artificial sequence
  SiRNA target sequence
ataagaaaaaggatgctat

SEQ ID NO: 1142 - DNA, 19 bp, Artificial sequence
  SiRNA target sequence
taagaaaaaggatgctata

SEQ ID NO: 1143 - DNA, 19 bp, Artificial sequence
  SiRNA target sequence
aagaaaaaggatgctatag

SEQ ID NO: 1144 - DNA, 19 bp, Artificial sequence
  SiRNA target sequence
agaaaaaggatgctataga

SEQ ID NO: 1145 - DNA, 19 bp, Artificial sequence
  SiRNA target sequence
gaaaaaggatgctatagaa

SEQ ID NO: 1146 - DNA, 19 bp, Artificial sequence
  SiRNA target sequence
aaaaaggatgctatagaaa

SEQ ID NO: 1147 - DNA, 19 bp, Artificial sequence
  SiRNA target sequence
aaaaggatgctatagaaat

SEQ ID NO: 1148 - DNA, 19 bp, Artificial sequence
  SiRNA target sequence
aaaggatgctatagaaatt

SEQ ID NO: 1149 - DNA, 19 bp, Artificial sequence
  SiRNA target sequence
aaggatgctatagaaattt

SEQ ID NO: 1150 - DNA, 19 bp, Artificial sequence
  SiRNA target sequence
aggatgctatagaaatttt

SEQ ID NO: 1151 - DNA, 19 bp, Artificial sequence
  SiRNA target sequence
ggatgctatagaaatttta

SEQ ID NO: 1152 - DNA, 19 bp, Artificial sequence
  SiRNA target sequence
gatgctatagaaattttat

SEQ ID NO: 1153 - DNA, 19 bp, Artificial sequence
  SiRNA target sequence
atgctatagaaattttata

SEQ ID NO: 1154 - DNA, 19 bp, Artificial sequence
  SiRNA target sequence
tgctatagaaattttatat

SEQ ID NO: 1155 - DNA, 19 bp, Artificial sequence
  SiRNA target sequence
gctatagaaattttatata

SEQ ID NO: 1156 - DNA, 19 bp, Artificial sequence
  SiRNA target sequence
ctatagaaattttatatag

SEQ ID NO: 1157 - DNA, 19 bp, Artificial sequence
  SiRNA target sequence
tatagaaattttatataga

SEQ ID NO: 1158 - DNA, 19 bp, Artificial sequence
  SiRNA target sequence
atagaaattttatatagaa

SEQ ID NO: 1159 - DNA, 19 bp, Artificial sequence
  SiRNA target sequence
tagaaattttatatagaag

SEQ ID NO: 1160 - DNA, 19 bp, Artificial sequence
  SiRNA target sequence
agaaattttatatagaagt

SEQ ID NO: 1161 - DNA, 19 bp, Artificial sequence
  SiRNA target sequence
gaaattttatatagaagta

SEQ ID NO: 1162 - DNA, 19 bp, Artificial sequence
  SiRNA target sequence
aaattttatatagaagtat

SEQ ID NO: 1163 - DNA, 19 bp, Artificial sequence
  SiRNA target sequence
aattttatatagaagtata

SEQ ID NO: 1164 - DNA, 19 bp, Artificial sequence
  SiRNA target sequence
attttatatagaagtatat

SEQ ID NO: 1165 - DNA, 19 bp, Artificial sequence
  SiRNA target sequence
ttttatatagaagtatatc

SEQ ID NO: 1166 - DNA, 19 bp, Artificial sequence
  SiRNA target sequence
tttatatagaagtatatca

SEQ ID NO: 1167 - DNA, 19 bp, Artificial sequence
  SiRNA target sequence
ttatatagaagtatatcag

SEQ ID NO: 1168 - DNA, 19 bp, Artificial sequence
  SiRNA target sequence
tatatagaagtatatcaga

SEQ ID NO: 1169 - DNA, 19 bp, Artificial sequence
  SiRNA target sequence
atatagaagtatatcagaa

SEQ ID NO: 1170 - DNA, 19 bp, Artificial sequence
  SiRNA target sequence
tatagaagtatatcagaat

SEQ ID NO: 1171 - DNA, 19 bp, Artificial sequence
  SiRNA target sequence
atagaagtatatcagaata

SEQ ID NO: 1172 - DNA, 19 bp, Artificial sequence
  SiRNA target sequence
tagaagtatatcagaatat

SEQ ID NO: 1173 - DNA, 19 bp, Artificial sequence
  SiRNA target sequence
agaagtatatcagaatatt

SEQ ID NO: 1174 - DNA, 19 bp, Artificial sequence
  SiRNA target sequence
gaagtatatcagaatattc

SEQ ID NO: 1175 - DNA, 19 bp, Artificial sequence
  SiRNA target sequence
aagtatatcagaatattca

SEQ ID NO: 1176 - DNA, 19 bp, Artificial sequence
  SiRNA target sequence
agtatatcagaatattcat

SEQ ID NO: 1177 - DNA, 19 bp, Artificial sequence
  SiRNA target sequence
gtatatcagaatattcatc

SEQ ID NO: 1178 - DNA, 19 bp, Artificial sequence
  SiRNA target sequence
tatatcagaatattcatct

SEQ ID NO: 1179 - DNA, 19 bp, Artificial sequence
  SiRNA target sequence
atatcagaatattcatctt

SEQ ID NO: 1180 - DNA, 19 bp, Artificial sequence
  SiRNA target sequence
tatcagaatattcatctta

SEQ ID NO: 1181 - DNA, 19 bp, Artificial sequence
  SiRNA target sequence
atcagaatattcatcttat

SEQ ID NO: 1182 - DNA, 19 bp, Artificial sequence
  SiRNA target sequence
tcagaatattcatcttatt

SEQ ID NO: 1183 - DNA, 19 bp, Artificial sequence
  SiRNA target sequence
cagaatattcatcttattt

SEQ ID NO: 1184 - DNA, 19 bp, Artificial sequence
  SiRNA target sequence
agaatattcatcttatttt

SEQ ID NO: 1185 - DNA, 19 bp, Artificial sequence
  SiRNA target sequence
gaatattcatcttatttta

SEQ ID NO: 1186 - DNA, 19 bp, Artificial sequence
  SiRNA target sequence
aatattcatcttattttaa

SEQ ID NO: 1187 - DNA, 19 bp, Artificial sequence
  SiRNA target sequence
atattcatcttattttaaa

SEQ ID NO: 1188 - DNA, 19 bp, Artificial sequence
  SiRNA target sequence
tattcatcttattttaaat

SEQ ID NO: 1189 - DNA, 19 bp, Artificial sequence
  SiRNA target sequence
attcatcttattttaaatc

SEQ ID NO: 1190 - DNA, 19 bp, Artificial sequence
  SiRNA target sequence
ttcatcttattttaaatct

SEQ ID NO: 1191 - DNA, 19 bp, Artificial sequence
  SiRNA target sequence
tcatcttattttaaatctt

SEQ ID NO: 1192 - DNA, 19 bp, Artificial sequence
  SiRNA target sequence
catcttattttaaatctta

SEQ ID NO: 1193 - DNA, 19 bp, Artificial sequence
  SiRNA target sequence
atcttattttaaatcttat

SEQ ID NO: 1194 - DNA, 19 bp, Artificial sequence
  SiRNA target sequence
tcttattttaaatcttatt

SEQ ID NO: 1195 - DNA, 19 bp, Artificial sequence
  SiRNA target sequence
cttattttaaatcttattt

SEQ ID NO: 1196 - DNA, 19 bp, Artificial sequence
  SiRNA target sequence
ttattttaaatcttatttg

SEQ ID NO: 1197 - DNA, 19 bp, Artificial sequence
  SiRNA target sequence
tattttaaatcttatttgt

SEQ ID NO: 1198 - DNA, 19 bp, Artificial sequence
  SiRNA target sequence
attttaaatcttatttgta

SEQ ID NO: 1199 - DNA, 19 bp, Artificial sequence
  SiRNA target sequence
ttttaaatcttatttgtat

SEQ ID NO: 1200 - DNA, 19 bp, Artificial sequence
  SiRNA target sequence
tttaaatcttatttgtatt

SEQ ID NO: 1201 - DNA, 19 bp, Artificial sequence
  SiRNA target sequence
ttaaatcttatttgtattt

SEQ ID NO: 1202 - DNA, 19 bp, Artificial sequence
  SiRNA target sequence
taaatcttatttgtattta

SEQ ID NO: 1203 - DNA, 19 bp, Artificial sequence
  SiRNA target sequence
aaatcttatttgtatttag

SEQ ID NO: 1204 - DNA, 19 bp, Artificial sequence
  SiRNA target sequence
aatcttatttgtatttagg

SEQ ID NO: 1205 - DNA, 19 bp, Artificial sequence
  SiRNA target sequence
atcttatttgtatttagga

SEQ ID NO: 1206 - DNA, 19 bp, Artificial sequence
  SiRNA target sequence
tcttatttgtatttaggaa

SEQ ID NO: 1207 - DNA, 19 bp, Artificial sequence
  SiRNA target sequence
cttatttgtatttaggaaa

SEQ ID NO: 1208 - DNA, 19 bp, Artificial sequence
  SiRNA target sequence
ttatttgtatttaggaaat

SEQ ID NO: 1209 - DNA, 19 bp, Artificial sequence
  SiRNA target sequence
tatttgtatttaggaaata

SEQ ID NO: 1210 - DNA, 19 bp, Artificial sequence
  SiRNA target sequence
atttgtatttaggaaatat

SEQ ID NO: 1211 - DNA, 19 bp, Artificial sequence
  SiRNA target sequence
tttgtatttaggaaatatt

SEQ ID NO: 1212 - DNA, 19 bp, Artificial sequence
  SiRNA target sequence
ttgtatttaggaaatattt

SEQ ID NO: 1213 - DNA, 19 bp, Artificial sequence
  SiRNA target sequence
tgtatttaggaaatatttt

SEQ ID NO: 1214 - DNA, 19 bp, Artificial sequence
  SiRNA target sequence
gtatttaggaaatatttta

SEQ ID NO: 1215 - DNA, 19 bp, Artificial sequence
  SiRNA target sequence
tatttaggaaatattttaa

SEQ ID NO: 1216 - DNA, 19 bp, Artificial sequence
  SiRNA target sequence
atttaggaaatattttaat

SEQ ID NO: 1217 - DNA, 19 bp, Artificial sequence
  SiRNA target sequence
tttaggaaatattttaata

SEQ ID NO: 1218 - DNA, 19 bp, Artificial sequence
  SiRNA target sequence
ttaggaaatattttaataa

SEQ ID NO: 1219 - DNA, 19 bp, Artificial sequence
  SiRNA target sequence
taggaaatattttaataaa

SEQ ID NO: 1220 - DNA, 19 bp, Artificial sequence
  SiRNA target sequence
aggaaatattttaataaat

SEQ ID NO: 1221 - DNA, 19 bp, Artificial sequence
  SiRNA target sequence
ggaaatattttaataaatg

SEQ ID NO: 1222 - DNA, 19 bp, Artificial sequence
  SiRNA target sequence
gaaatattttaataaatga

SEQ ID NO: 1223 - DNA, 19 bp, Artificial sequence
  SiRNA target sequence
aaatattttaataaatgat

SEQ ID NO: 1224 - DNA, 19 bp, Artificial sequence
  SiRNA target sequence
aatattttaataaatgatg

SEQ ID NO: 1225 - DNA, 19 bp, Artificial sequence
  SiRNA target sequence
atattttaataaatgatga

SEQ ID NO: 1226 - DNA, 19 bp, Artificial sequence
  SiRNA target sequence
tattttaataaatgatgac

SEQ ID NO: 1227 - DNA, 19 bp, Artificial sequence
  SiRNA target sequence
attttaataaatgatgact

SEQ ID NO: 1228 - DNA, 19 bp, Artificial sequence
  SiRNA target sequence
ttttaataaatgatgactt

SEQ ID NO: 1229 - DNA, 19 bp, Artificial sequence
  SiRNA target sequence
tttaataaatgatgactta

SEQ ID NO: 1230 - DNA, 19 bp, Artificial sequence
  SiRNA target sequence
ttaataaatgatgacttaa

SEQ ID NO: 1231 - DNA, 19 bp, Artificial sequence
  SiRNA target sequence
taataaatgatgacttaaa

SEQ ID NO: 1232 - DNA, 19 bp, Artificial sequence
  SiRNA target sequence
aataaatgatgacttaaat

SEQ ID NO: 1233 - DNA, 19 bp, Artificial sequence
  SiRNA target sequence
ataaatgatgacttaaatg

SEQ ID NO: 1234 - DNA, 19 bp, Artificial sequence
  SiRNA target sequence
taaatgatgacttaaatga

SEQ ID NO: 1235 - DNA, 19 bp, Artificial sequence
  SiRNA target sequence
aaatgatgacttaaatgaa

SEQ ID NO: 1236 - DNA, 19 bp, Artificial sequence
  SiRNA target sequence
aatgatgacttaaatgaat

SEQ ID NO: 1237 - DNA, 19 bp, Artificial sequence
  SiRNA target sequence
atgatgacttaaatgaatg

SEQ ID NO: 1238 - DNA, 19 bp, Artificial sequence
  SiRNA target sequence
tgatgacttaaatgaatgc

SEQ ID NO: 1239 - DNA, 19 bp, Artificial sequence
  SiRNA target sequence
gatgacttaaatgaatgca

SEQ ID NO: 1240 - DNA, 19 bp, Artificial sequence
  SiRNA target sequence
atgacttaaatgaatgcag

SEQ ID NO: 1241 - DNA, 19 bp, Artificial sequence
  SiRNA target sequence
tgacttaaatgaatgcagg

SEQ ID NO: 1242 - DNA, 19 bp, Artificial sequence
  SiRNA target sequence
gacttaaatgaatgcagga

SEQ ID NO: 1243 - DNA, 19 bp, Artificial sequence
  SiRNA target sequence
acttaaatgaatgcaggaa

SEQ ID NO: 1244 - DNA, 19 bp, Artificial sequence
  SiRNA target sequence
cttaaatgaatgcaggaaa

SEQ ID NO: 1245 - DNA, 19 bp, Artificial sequence
  SiRNA target sequence
ttaaatgaatgcaggaaat

SEQ ID NO: 1246 - DNA, 19 bp, Artificial sequence
  SiRNA target sequence
taaatgaatgcaggaaatt

SEQ ID NO: 1247 - DNA, 19 bp, Artificial sequence
  SiRNA target sequence
aaatgaatgcaggaaattg

SEQ ID NO: 1248 - DNA, 19 bp, Artificial sequence
  SiRNA target sequence
aatgaatgcaggaaattgt

SEQ ID NO: 1249 - DNA, 19 bp, Artificial sequence
  SiRNA target sequence
atgaatgcaggaaattgtt

SEQ ID NO: 1250 - DNA, 19 bp, Artificial sequence
  SiRNA target sequence
tgaatgcaggaaattgttt

SEQ ID NO: 1251 - DNA, 19 bp, Artificial sequence
  SiRNA target sequence
gaatgcaggaaattgttta

SEQ ID NO: 1252 - DNA, 19 bp, Artificial sequence
  SiRNA target sequence
aatgcaggaaattgtttaa

SEQ ID NO: 1253 - DNA, 19 bp, Artificial sequence
  SiRNA target sequence
atgcaggaaattgtttaat

SEQ ID NO: 1254 - DNA, 19 bp, Artificial sequence
  SiRNA target sequence
tgcaggaaattgtttaata

SEQ ID NO: 1255 - DNA, 19 bp, Artificial sequence
  SiRNA target sequence
gcaggaaattgtttaatac

SEQ ID NO: 1256 - DNA, 19 bp, Artificial sequence
  SiRNA target sequence
caggaaattgtttaataca

SEQ ID NO: 1257 - DNA, 19 bp, Artificial sequence
  SiRNA target sequence
aggaaattgtttaatacat

SEQ ID NO: 1258 - DNA, 19 bp, Artificial sequence
  SiRNA target sequence
ggaaattgtttaatacatc

SEQ ID NO: 1259 - DNA, 19 bp, Artificial sequence
  SiRNA target sequence
gaaattgtttaatacatca

SEQ ID NO: 1260 - DNA, 19 bp, Artificial sequence
  SiRNA target sequence
aaattgtttaatacatcac

SEQ ID NO: 1261 - DNA, 19 bp, Artificial sequence
  SiRNA target sequence
aattgtttaatacatcact

SEQ ID NO: 1262 - DNA, 19 bp, Artificial sequence
  SiRNA target sequence
attgtttaatacatcactt

SEQ ID NO: 1263 - DNA, 19 bp, Artificial sequence
  SiRNA target sequence
ttgtttaatacatcacttc

SEQ ID NO: 1264 - DNA, 19 bp, Artificial sequence
  SiRNA target sequence
tgtttaatacatcacttca

SEQ ID NO: 1265 - DNA, 19 bp, Artificial sequence
  SiRNA target sequence
gtttaatacatcacttcaa

SEQ ID NO: 1266 - DNA, 19 bp, Artificial sequence
  SiRNA target sequence
tttaatacatcacttcaat

SEQ ID NO: 1267 - DNA, 19 bp, Artificial sequence
  SiRNA target sequence
ttaatacatcacttcaata

SEQ ID NO: 1268 - DNA, 19 bp, Artificial sequence
  SiRNA target sequence
taatacatcacttcaatat

SEQ ID NO: 1269 - DNA, 19 bp, Artificial sequence
  SiRNA target sequence
aatacatcacttcaatatt

SEQ ID NO: 1270 - DNA, 19 bp, Artificial sequence
  SiRNA target sequence
atacatcacttcaatattg

SEQ ID NO: 1271 - DNA, 19 bp, Artificial sequence
  SiRNA target sequence
tacatcacttcaatattgt

SEQ ID NO: 1272 - DNA, 19 bp, Artificial sequence
  SiRNA target sequence
acatcacttcaatattgtt

SEQ ID NO: 1273 - DNA, 19 bp, Artificial sequence
  SiRNA target sequence
catcacttcaatattgttg

SEQ ID NO: 1274 - DNA, 19 bp, Artificial sequence
  SiRNA target sequence
atcacttcaatattgttgt

SEQ ID NO: 1275 - DNA, 19 bp, Artificial sequence
  SiRNA target sequence
tcacttcaatattgttgta

SEQ ID NO: 1276 - DNA, 19 bp, Artificial sequence
  SiRNA target sequence
cacttcaatattgttgtaa

SEQ ID NO: 1277 - DNA, 19 bp, Artificial sequence
  SiRNA target sequence
acttcaatattgttgtaat

SEQ ID NO: 1278 - DNA, 19 bp, Artificial sequence
  SiRNA target sequence
cttcaatattgttgtaatt

SEQ ID NO: 1279 - DNA, 19 bp, Artificial sequence
  SiRNA target sequence
ttcaatattgttgtaattc

SEQ ID NO: 1280 - DNA, 19 bp, Artificial sequence
  SiRNA target sequence
tcaatattgttgtaattct

SEQ ID NO: 1281 - DNA, 19 bp, Artificial sequence
  SiRNA target sequence
caatattgttgtaattctg

SEQ ID NO: 1282 - DNA, 19 bp, Artificial sequence
  SiRNA target sequence
aatattgttgtaattctga

SEQ ID NO: 1283 - DNA, 19 bp, Artificial sequence
  SiRNA target sequence
atattgttgtaattctgat

SEQ ID NO: 1284 - DNA, 19 bp, Artificial sequence
  SiRNA target sequence
tattgttgtaattctgatg

SEQ ID NO: 1285 - DNA, 19 bp, Artificial sequence
  SiRNA target sequence
attgttgtaattctgatga

SEQ ID NO: 1286 - DNA, 19 bp, Artificial sequence
  SiRNA target sequence
ttgttgtaattctgatgag

SEQ ID NO: 1287 - DNA, 19 bp, Artificial sequence
  SiRNA target sequence
tgttgtaattctgatgagg

SEQ ID NO: 1288 - DNA, 19 bp, Artificial sequence
  SiRNA target sequence
gttgtaattctgatgaggt

SEQ ID NO: 1289 - DNA, 19 bp, Artificial sequence
  SiRNA target sequence
ttgtaattctgatgaggtt

SEQ ID NO: 1290 - DNA, 19 bp, Artificial sequence
  SiRNA target sequence
tgtaattctgatgaggttt

SEQ ID NO: 1291 - DNA, 19 bp, Artificial sequence
  SiRNA target sequence
gtaattctgatgaggtttt

SEQ ID NO: 1292 - DNA, 19 bp, Artificial sequence
  SiRNA target sequence
taattctgatgaggttttt

SEQ ID NO: 1293 - DNA, 19 bp, Artificial sequence
  SiRNA target sequence
aattctgatgaggttttta

SEQ ID NO: 1294 - DNA, 19 bp, Artificial sequence
  SiRNA target sequence
attctgatgaggtttttat

SEQ ID NO: 1295 - DNA, 19 bp, Artificial sequence
  SiRNA target sequence
ttctgatgaggtttttatt

SEQ ID NO: 1296 - DNA, 19 bp, Artificial sequence
  SiRNA target sequence
tctgatgaggtttttattg

SEQ ID NO: 1297 - DNA, 19 bp, Artificial sequence
  SiRNA target sequence
ctgatgaggtttttattgt

SEQ ID NO: 1298 - DNA, 19 bp, Artificial sequence
  SiRNA target sequence
tgatgaggtttttattgtt

SEQ ID NO: 1299 - DNA, 19 bp, Artificial sequence
  SiRNA target sequence
gatgaggtttttattgtta

SEQ ID NO: 1300 - DNA, 19 bp, Artificial sequence
  SiRNA target sequence
atgaggtttttattgttaa

SEQ ID NO: 1301 - DNA, 19 bp, Artificial sequence
  SiRNA target sequence
tgaggtttttattgttaag

SEQ ID NO: 1302 - DNA, 19 bp, Artificial sequence
  SiRNA target sequence
gaggtttttattgttaagc

SEQ ID NO: 1303 - DNA, 19 bp, Artificial sequence
  SiRNA target sequence
aggtttttattgttaagca

SEQ ID NO: 1304 - DNA, 19 bp, Artificial sequence
  SiRNA target sequence
ggtttttattgttaagcag

SEQ ID NO: 1305 - DNA, 19 bp, Artificial sequence
  SiRNA target sequence
gtttttattgttaagcagt

SEQ ID NO: 1306 - DNA, 19 bp, Artificial sequence
  SiRNA target sequence
tttttattgttaagcagtc

SEQ ID NO: 1307 - DNA, 19 bp, Artificial sequence
  SiRNA target sequence
ttttattgttaagcagtca

SEQ ID NO: 1308 - DNA, 19 bp, Artificial sequence
  SiRNA target sequence
tttattgttaagcagtcac

SEQ ID NO: 1309 - DNA, 19 bp, Artificial sequence
  SiRNA target sequence
ttattgttaagcagtcact

SEQ ID NO: 1310 - DNA, 19 bp, Artificial sequence
  SiRNA target sequence
tattgttaagcagtcactt

SEQ ID NO: 1311 - DNA, 19 bp, Artificial sequence
  SiRNA target sequence
attgttaagcagtcactta

SEQ ID NO: 1312 - DNA, 19 bp, Artificial sequence
  SiRNA target sequence
ttgttaagcagtcacttat

SEQ ID NO: 1313 - DNA, 19 bp, Artificial sequence
  SiRNA target sequence
tgttaagcagtcacttatt

SEQ ID NO: 1314 - DNA, 19 bp, Artificial sequence
  SiRNA target sequence
gttaagcagtcacttattt

SEQ ID NO: 1315 - DNA, 19 bp, Artificial sequence
  SiRNA target sequence
ttaagcagtcacttatttt

SEQ ID NO: 1316 - DNA, 19 bp, Artificial sequence
  SiRNA target sequence
taagcagtcacttatttta

SEQ ID NO: 1317 - DNA, 19 bp, Artificial sequence
  SiRNA target sequence
aagcagtcacttattttaa

SEQ ID NO: 1318 - DNA, 19 bp, Artificial sequence
  SiRNA target sequence
agcagtcacttattttaat

SEQ ID NO: 1319 - DNA, 19 bp, Artificial sequence
  SiRNA target sequence
gcagtcacttattttaata

SEQ ID NO: 1320 - DNA, 19 bp, Artificial sequence
  SiRNA target sequence
cagtcacttattttaatag

SEQ ID NO: 1321 - DNA, 19 bp, Artificial sequence
  SiRNA target sequence
agtcacttattttaataga

SEQ ID NO: 1322 - DNA, 19 bp, Artificial sequence
  SiRNA target sequence
gtcacttattttaatagaa

SEQ ID NO: 1323 - DNA, 19 bp, Artificial sequence
  SiRNA target sequence
tcacttattttaatagaag

SEQ ID NO: 1324 - DNA, 19 bp, Artificial sequence
  SiRNA target sequence
cacttattttaatagaagt

SEQ ID NO: 1325 - DNA, 19 bp, Artificial sequence
  SiRNA target sequence
acttattttaatagaagta

SEQ ID NO: 1326 - DNA, 19 bp, Artificial sequence
  SiRNA target sequence
cttattttaatagaagtac

SEQ ID NO: 1327 - DNA, 19 bp, Artificial sequence
  SiRNA target sequence
ttattttaatagaagtaca

SEQ ID NO: 1328 - DNA, 19 bp, Artificial sequence
  SiRNA target sequence
tattttaatagaagtacat

SEQ ID NO: 1329 - DNA, 19 bp, Artificial sequence
  SiRNA target sequence
attttaatagaagtacatg

SEQ ID NO: 1330 - DNA, 19 bp, Artificial sequence
  SiRNA target sequence
ttttaatagaagtacatga

SEQ ID NO: 1331 - DNA, 19 bp, Artificial sequence
  SiRNA target sequence
tttaatagaagtacatgaa

SEQ ID NO: 1332 - DNA, 19 bp, Artificial sequence
  SiRNA target sequence
ttaatagaagtacatgaat

SEQ ID NO: 1333 - DNA, 19 bp, Artificial sequence
  SiRNA target sequence
taatagaagtacatgaata

SEQ ID NO: 1334 - DNA, 19 bp, Artificial sequence
  SiRNA target sequence
aatagaagtacatgaatac

SEQ ID NO: 1335 - DNA, 19 bp, Artificial sequence
  SiRNA target sequence
atagaagtacatgaataca

SEQ ID NO: 1336 - DNA, 19 bp, Artificial sequence
  SiRNA target sequence
tagaagtacatgaatacat

SEQ ID NO: 1337 - DNA, 19 bp, Artificial sequence
  SiRNA target sequence
agaagtacatgaatacatc

SEQ ID NO: 1338 - DNA, 19 bp, Artificial sequence
  SiRNA target sequence
gaagtacatgaatacatca

SEQ ID NO: 1339 - DNA, 19 bp, Artificial sequence
  SiRNA target sequence
aagtacatgaatacatcaa

SEQ ID NO: 1340 - DNA, 19 bp, Artificial sequence
  SiRNA target sequence
agtacatgaatacatcaaa

SEQ ID NO: 1341 - DNA, 19 bp, Artificial sequence
  SiRNA target sequence
gtacatgaatacatcaaag

SEQ ID NO: 1342 - DNA, 19 bp, Artificial sequence
  SiRNA target sequence
tacatgaatacatcaaaga

SEQ ID NO: 1343 - DNA, 19 bp, Artificial sequence
  SiRNA target sequence
acatgaatacatcaaagaa

SEQ ID NO: 1344 - DNA, 19 bp, Artificial sequence
  SiRNA target sequence
catgaatacatcaaagaaa

SEQ ID NO: 1345 - DNA, 19 bp, Artificial sequence
  SiRNA target sequence
atgaatacatcaaagaaaa

SEQ ID NO: 1346 - DNA, 19 bp, Artificial sequence
  SiRNA target sequence
tgaatacatcaaagaaaat

SEQ ID NO: 1347 - DNA, 19 bp, Artificial sequence
  SiRNA target sequence
gaatacatcaaagaaaata

SEQ ID NO: 1348 - DNA, 19 bp, Artificial sequence
  SiRNA target sequence
aatacatcaaagaaaataa

SEQ ID NO: 1349 - DNA, 19 bp, Artificial sequence
  SiRNA target sequence
atacatcaaagaaaataaa

SEQ ID NO: 1350 - DNA, 19 bp, Artificial sequence
  SiRNA target sequence
tacatcaaagaaaataaaa

SEQ ID NO: 1351 - DNA, 19 bp, Artificial sequence
  SiRNA target sequence
acatcaaagaaaataaaat

SEQ ID NO: 1352 - DNA, 19 bp, Artificial sequence
  SiRNA target sequence
catcaaagaaaataaaata

SEQ ID NO: 1353 - DNA, 19 bp, Artificial sequence
  SiRNA target sequence
atcaaagaaaataaaatat

SEQ ID NO: 1354 - DNA, 19 bp, Artificial sequence
  SiRNA target sequence
tcaaagaaaataaaatata

SEQ ID NO: 1355 - DNA, 19 bp, Artificial sequence
  SiRNA target sequence
caaagaaaataaaatataa

SEQ ID NO: 1356 - DNA, 20 bp, Artificial sequence
  SiRNA target sequence
atgaaacgaaaaacagaaat

SEQ ID NO: 1357 - DNA, 20 bp, Artificial sequence
  SiRNA target sequence
tgaaacgaaaaacagaaata

SEQ ID NO: 1358 - DNA, 20 bp, Artificial sequence
  SiRNA target sequence
gaaacgaaaaacagaaatat

SEQ ID NO: 1359 - DNA, 20 bp, Artificial sequence
  SiRNA target sequence
aaacgaaaaacagaaatatt

SEQ ID NO: 1360 - DNA, 20 bp, Artificial sequence
  SiRNA target sequence
aacgaaaaacagaaatattt

SEQ ID NO: 1361 - DNA, 20 bp, Artificial sequence
  SiRNA target sequence
acgaaaaacagaaatattta

SEQ ID NO: 1362 - DNA, 20 bp, Artificial sequence
  SiRNA target sequence
cgaaaaacagaaatatttat

SEQ ID NO: 1363 - DNA, 20 bp, Artificial sequence
  SiRNA target sequence
gaaaaacagaaatatttatt

SEQ ID NO: 1364 - DNA, 20 bp, Artificial sequence
  SiRNA target sequence
aaaaacagaaatatttattg

SEQ ID NO: 1365 - DNA, 20 bp, Artificial sequence
  SiRNA target sequence
aaaacagaaatatttattgc

SEQ ID NO: 1366 - DNA, 20 bp, Artificial sequence
  SiRNA target sequence
aaacagaaatatttattgct

SEQ ID NO: 1367 - DNA, 20 bp, Artificial sequence
  SiRNA target sequence
aacagaaatatttattgcta

SEQ ID NO: 1368 - DNA, 20 bp, Artificial sequence
  SiRNA target sequence
acagaaatatttattgctat

SEQ ID NO: 1369 - DNA, 20 bp, Artificial sequence
  SiRNA target sequence
cagaaatatttattgctatt

SEQ ID NO: 1370 - DNA, 20 bp, Artificial sequence
  SiRNA target sequence
agaaatatttattgctatta

SEQ ID NO: 1371 - DNA, 20 bp, Artificial sequence
  SiRNA target sequence
gaaatatttattgctattac

SEQ ID NO: 1372 - DNA, 20 bp, Artificial sequence
  SiRNA target sequence
aaatatttattgctattaca

SEQ ID NO: 1373 - DNA, 20 bp, Artificial sequence
  SiRNA target sequence
aatatttattgctattacag

SEQ ID NO: 1374 - DNA, 20 bp, Artificial sequence
  SiRNA target sequence
atatttattgctattacagt

SEQ ID NO: 1375 - DNA, 20 bp, Artificial sequence
  SiRNA target sequence
tatttattgctattacagta

SEQ ID NO: 1376 - DNA, 20 bp, Artificial sequence
  SiRNA target sequence
atttattgctattacagtag

SEQ ID NO: 1377 - DNA, 20 bp, Artificial sequence
  SiRNA target sequence
tttattgctattacagtagt

SEQ ID NO: 1378 - DNA, 20 bp, Artificial sequence
  SiRNA target sequence
ttattgctattacagtagtc

SEQ ID NO: 1379 - DNA, 20 bp, Artificial sequence
  SiRNA target sequence
tattgctattacagtagtca

SEQ ID NO: 1380 - DNA, 20 bp, Artificial sequence
  SiRNA target sequence
attgctattacagtagtcac

SEQ ID NO: 1381 - DNA, 20 bp, Artificial sequence
  SiRNA target sequence
ttgctattacagtagtcact

SEQ ID NO: 1382 - DNA, 20 bp, Artificial sequence
  SiRNA target sequence
tgctattacagtagtcactg

SEQ ID NO: 1383 - DNA, 20 bp, Artificial sequence
  SiRNA target sequence
gctattacagtagtcactgc

SEQ ID NO: 1384 - DNA, 20 bp, Artificial sequence
  SiRNA target sequence
ctattacagtagtcactgca

SEQ ID NO: 1385 - DNA, 20 bp, Artificial sequence
  SiRNA target sequence
tattacagtagtcactgcag

SEQ ID NO: 1386 - DNA, 20 bp, Artificial sequence
  SiRNA target sequence
attacagtagtcactgcagt

SEQ ID NO: 1387 - DNA, 20 bp, Artificial sequence
  SiRNA target sequence
ttacagtagtcactgcagtg

SEQ ID NO: 1388 - DNA, 20 bp, Artificial sequence
  SiRNA target sequence
tacagtagtcactgcagtga

SEQ ID NO: 1389 - DNA, 20 bp, Artificial sequence
  SiRNA target sequence
acagtagtcactgcagtgac

SEQ ID NO: 1390 - DNA, 20 bp, Artificial sequence
  SiRNA target sequence
cagtagtcactgcagtgaca

SEQ ID NO: 1391 - DNA, 20 bp, Artificial sequence
  SiRNA target sequence
agtagtcactgcagtgacat

SEQ ID NO: 1392 - DNA, 20 bp, Artificial sequence
  SiRNA target sequence
gtagtcactgcagtgacatg

SEQ ID NO: 1393 - DNA, 20 bp, Artificial sequence
  SiRNA target sequence
tagtcactgcagtgacatgt

SEQ ID NO: 1394 - DNA, 20 bp, Artificial sequence
  SiRNA target sequence
agtcactgcagtgacatgtt

SEQ ID NO: 1395 - DNA, 20 bp, Artificial sequence
  SiRNA target sequence
gtcactgcagtgacatgtta

SEQ ID NO: 1396 - DNA, 20 bp, Artificial sequence
  SiRNA target sequence
tcactgcagtgacatgttac

SEQ ID NO: 1397 - DNA, 20 bp, Artificial sequence
  SiRNA target sequence
cactgcagtgacatgttact

SEQ ID NO: 1398 - DNA, 20 bp, Artificial sequence
  SiRNA target sequence
actgcagtgacatgttactt

SEQ ID NO: 1399 - DNA, 20 bp, Artificial sequence
  SiRNA target sequence
ctgcagtgacatgttactta

SEQ ID NO: 1400 - DNA, 20 bp, Artificial sequence
  SiRNA target sequence
tgcagtgacatgttacttat

SEQ ID NO: 1401 - DNA, 20 bp, Artificial sequence
  SiRNA target sequence
gcagtgacatgttacttatt

SEQ ID NO: 1402 - DNA, 20 bp, Artificial sequence
  SiRNA target sequence
cagtgacatgttacttattt

SEQ ID NO: 1403 - DNA, 20 bp, Artificial sequence
  SiRNA target sequence
agtgacatgttacttattta

SEQ ID NO: 1404 - DNA, 20 bp, Artificial sequence
  SiRNA target sequence
gtgacatgttacttatttaa

SEQ ID NO: 1405 - DNA, 20 bp, Artificial sequence
  SiRNA target sequence
tgacatgttacttatttaaa

SEQ ID NO: 1406 - DNA, 20 bp, Artificial sequence
  SiRNA target sequence
gacatgttacttatttaaaa

SEQ ID NO: 1407 - DNA, 20 bp, Artificial sequence
  SiRNA target sequence
acatgttacttatttaaaaa

SEQ ID NO: 1408 - DNA, 20 bp, Artificial sequence
  SiRNA target sequence
catgttacttatttaaaaaa

SEQ ID NO: 1409 - DNA, 20 bp, Artificial sequence
  SiRNA target sequence
atgttacttatttaaaaaaa

SEQ ID NO: 1410 - DNA, 20 bp, Artificial sequence
  SiRNA target sequence
tgttacttatttaaaaaaat

SEQ ID NO: 1411 - DNA, 20 bp, Artificial sequence
  SiRNA target sequence
gttacttatttaaaaaaata

SEQ ID NO: 1412 - DNA, 20 bp, Artificial sequence
  SiRNA target sequence
ttacttatttaaaaaaataa

SEQ ID NO: 1413 - DNA, 20 bp, Artificial sequence
  SiRNA target sequence
tacttatttaaaaaaataat

SEQ ID NO: 1414 - DNA, 20 bp, Artificial sequence
  SiRNA target sequence
acttatttaaaaaaataata

SEQ ID NO: 1415 - DNA, 20 bp, Artificial sequence
  SiRNA target sequence
cttatttaaaaaaataataa

SEQ ID NO: 1416 - DNA, 20 bp, Artificial sequence
  SiRNA target sequence
ttatttaaaaaaataataaa

SEQ ID NO: 1417 - DNA, 20 bp, Artificial sequence
  SiRNA target sequence
tatttaaaaaaataataaat

SEQ ID NO: 1418 - DNA, 20 bp, Artificial sequence
  SiRNA target sequence
atttaaaaaaataataaata

SEQ ID NO: 1419 - DNA, 20 bp, Artificial sequence
  SiRNA target sequence
tttaaaaaaataataaatag

SEQ ID NO: 1420 - DNA, 20 bp, Artificial sequence
  SiRNA target sequence
ttaaaaaaataataaataga

SEQ ID NO: 1421 - DNA, 20 bp, Artificial sequence
  SiRNA target sequence
taaaaaaataataaatagac

SEQ ID NO: 1422 - DNA, 20 bp, Artificial sequence
  SiRNA target sequence
aaaaaaataataaatagaca

SEQ ID NO: 1423 - DNA, 20 bp, Artificial sequence
  SiRNA target sequence
aaaaaataataaatagacaa

SEQ ID NO: 1424 - DNA, 20 bp, Artificial sequence
  SiRNA target sequence
aaaaataataaatagacaaa

SEQ ID NO: 1425 - DNA, 20 bp, Artificial sequence
  SiRNA target sequence
aaaataataaatagacaaaa

SEQ ID NO: 1426 - DNA, 20 bp, Artificial sequence
  SiRNA target sequence
aaataataaatagacaaaag

SEQ ID NO: 1427 - DNA, 20 bp, Artificial sequence
  SiRNA target sequence
aataataaatagacaaaagt

SEQ ID NO: 1428 - DNA, 20 bp, Artificial sequence
  SiRNA target sequence
ataataaatagacaaaagtc

SEQ ID NO: 1429 - DNA, 20 bp, Artificial sequence
  SiRNA target sequence
taataaatagacaaaagtct

SEQ ID NO: 1430 - DNA, 20 bp, Artificial sequence
  SiRNA target sequence
aataaatagacaaaagtctg

SEQ ID NO: 1431 - DNA, 20 bp, Artificial sequence
  SiRNA target sequence
ataaatagacaaaagtctga

SEQ ID NO: 1432 - DNA, 20 bp, Artificial sequence
  SiRNA target sequence
taaatagacaaaagtctgat

SEQ ID NO: 1433 - DNA, 20 bp, Artificial sequence
  SiRNA target sequence
aaatagacaaaagtctgatt

SEQ ID NO: 1434 - DNA, 20 bp, Artificial sequence
  SiRNA target sequence
aatagacaaaagtctgatta

SEQ ID NO: 1435 - DNA, 20 bp, Artificial sequence
  SiRNA target sequence
atagacaaaagtctgattat

SEQ ID NO: 1436 - DNA, 20 bp, Artificial sequence
  SiRNA target sequence
tagacaaaagtctgattata

SEQ ID NO: 1437 - DNA, 20 bp, Artificial sequence
  SiRNA target sequence
agacaaaagtctgattatac

SEQ ID NO: 1438 - DNA, 20 bp, Artificial sequence
  SiRNA target sequence
gacaaaagtctgattataca

SEQ ID NO: 1439 - DNA, 20 bp, Artificial sequence
  SiRNA target sequence
acaaaagtctgattatacat

SEQ ID NO: 1440 - DNA, 20 bp, Artificial sequence
  SiRNA target sequence
caaaagtctgattatacatc

SEQ ID NO: 1441 - DNA, 20 bp, Artificial sequence
  SiRNA target sequence
aaaagtctgattatacatca

SEQ ID NO: 1442 - DNA, 20 bp, Artificial sequence
  SiRNA target sequence
aaagtctgattatacatcaa

SEQ ID NO: 1443 - DNA, 20 bp, Artificial sequence
  SiRNA target sequence
aagtctgattatacatcaat

SEQ ID NO: 1444 - DNA, 20 bp, Artificial sequence
  SiRNA target sequence
agtctgattatacatcaata

SEQ ID NO: 1445 - DNA, 20 bp, Artificial sequence
  SiRNA target sequence
gtctgattatacatcaataa

SEQ ID NO: 1446 - DNA, 20 bp, Artificial sequence
  SiRNA target sequence
tctgattatacatcaataaa

SEQ ID NO: 1447 - DNA, 20 bp, Artificial sequence
  SiRNA target sequence
ctgattatacatcaataaaa

SEQ ID NO: 1448 - DNA, 20 bp, Artificial sequence
  SiRNA target sequence
tgattatacatcaataaaac

SEQ ID NO: 1449 - DNA, 20 bp, Artificial sequence
  SiRNA target sequence
gattatacatcaataaaaca

SEQ ID NO: 1450 - DNA, 20 bp, Artificial sequence
  SiRNA target sequence
attatacatcaataaaacag

SEQ ID NO: 1451 - DNA, 20 bp, Artificial sequence
  SiRNA target sequence
ttatacatcaataaaacagg

SEQ ID NO: 1452 - DNA, 20 bp, Artificial sequence
  SiRNA target sequence
tatacatcaataaaacagga

SEQ ID NO: 1453 - DNA, 20 bp, Artificial sequence
  SiRNA target sequence
atacatcaataaaacaggaa

SEQ ID NO: 1454 - DNA, 20 bp, Artificial sequence
  SiRNA target sequence
tacatcaataaaacaggaag

SEQ ID NO: 1455 - DNA, 20 bp, Artificial sequence
  SiRNA target sequence
acatcaataaaacaggaagc

SEQ ID NO: 1456 - DNA, 20 bp, Artificial sequence
  SiRNA target sequence
catcaataaaacaggaagca

SEQ ID NO: 1457 - DNA, 20 bp, Artificial sequence
  SiRNA target sequence
atcaataaaacaggaagcag

SEQ ID NO: 1458 - DNA, 20 bp, Artificial sequence
  SiRNA target sequence
tcaataaaacaggaagcaga

SEQ ID NO: 1459 - DNA, 20 bp, Artificial sequence
  SiRNA target sequence
caataaaacaggaagcagat

SEQ ID NO: 1460 - DNA, 20 bp, Artificial sequence
  SiRNA target sequence
aataaaacaggaagcagata

SEQ ID NO: 1461 - DNA, 20 bp, Artificial sequence
  SiRNA target sequence
ataaaacaggaagcagataa

SEQ ID NO: 1462 - DNA, 20 bp, Artificial sequence
  SiRNA target sequence
taaaacaggaagcagataaa

SEQ ID NO: 1463 - DNA, 20 bp, Artificial sequence
  SiRNA target sequence
aaaacaggaagcagataaat

SEQ ID NO: 1464 - DNA, 20 bp, Artificial sequence
  SiRNA target sequence
aaacaggaagcagataaata

SEQ ID NO: 1465 - DNA, 20 bp, Artificial sequence
  SiRNA target sequence
aacaggaagcagataaatat

SEQ ID NO: 1466 - DNA, 20 bp, Artificial sequence
  SiRNA target sequence
acaggaagcagataaatatt

SEQ ID NO: 1467 - DNA, 20 bp, Artificial sequence
  SiRNA target sequence
caggaagcagataaatattt

SEQ ID NO: 1468 - DNA, 20 bp, Artificial sequence
  SiRNA target sequence
aggaagcagataaatatttt

SEQ ID NO: 1469 - DNA, 20 bp, Artificial sequence
  SiRNA target sequence
ggaagcagataaatatttta

SEQ ID NO: 1470 - DNA, 20 bp, Artificial sequence
  SiRNA target sequence
gaagcagataaatattttat

SEQ ID NO: 1471 - DNA, 20 bp, Artificial sequence
  SiRNA target sequence
aagcagataaatattttata

SEQ ID NO: 1472 - DNA, 20 bp, Artificial sequence
  SiRNA target sequence
agcagataaatattttatac

SEQ ID NO: 1473 - DNA, 20 bp, Artificial sequence
  SiRNA target sequence
gcagataaatattttataca

SEQ ID NO: 1474 - DNA, 20 bp, Artificial sequence
  SiRNA target sequence
cagataaatattttatacaa

SEQ ID NO: 1475 - DNA, 20 bp, Artificial sequence
  SiRNA target sequence
agataaatattttatacaag

SEQ ID NO: 1476 - DNA, 20 bp, Artificial sequence
  SiRNA target sequence
gataaatattttatacaaga

SEQ ID NO: 1477 - DNA, 20 bp, Artificial sequence
  SiRNA target sequence
ataaatattttatacaagaa

SEQ ID NO: 1478 - DNA, 20 bp, Artificial sequence
  SiRNA target sequence
taaatattttatacaagaag

SEQ ID NO: 1479 - DNA, 20 bp, Artificial sequence
  SiRNA target sequence
aaatattttatacaagaaga

SEQ ID NO: 1480 - DNA, 20 bp, Artificial sequence
  SiRNA target sequence
aatattttatacaagaagat

SEQ ID NO: 1481 - DNA, 20 bp, Artificial sequence
  SiRNA target sequence
atattttatacaagaagatt

SEQ ID NO: 1482 - DNA, 20 bp, Artificial sequence
  SiRNA target sequence
tattttatacaagaagatta

SEQ ID NO: 1483 - DNA, 20 bp, Artificial sequence
  SiRNA target sequence
attttatacaagaagattat

SEQ ID NO: 1484 - DNA, 20 bp, Artificial sequence
  SiRNA target sequence
ttttatacaagaagattata

SEQ ID NO: 1485 - DNA, 20 bp, Artificial sequence
  SiRNA target sequence
tttatacaagaagattataa

SEQ ID NO: 1486 - DNA, 20 bp, Artificial sequence
  SiRNA target sequence
ttatacaagaagattataaa

SEQ ID NO: 1487 - DNA, 20 bp, Artificial sequence
  SiRNA target sequence
tatacaagaagattataaaa

SEQ ID NO: 1488 - DNA, 20 bp, Artificial sequence
  SiRNA target sequence
atacaagaagattataaaaa

SEQ ID NO: 1489 - DNA, 20 bp, Artificial sequence
  SiRNA target sequence
tacaagaagattataaaaat

SEQ ID NO: 1490 - DNA, 20 bp, Artificial sequence
  SiRNA target sequence
acaagaagattataaaaatg

SEQ ID NO: 1491 - DNA, 20 bp, Artificial sequence
  SiRNA target sequence
caagaagattataaaaatgc

SEQ ID NO: 1492 - DNA, 20 bp, Artificial sequence
  SiRNA target sequence
aagaagattataaaaatgct

SEQ ID NO: 1493 - DNA, 20 bp, Artificial sequence
  SiRNA target sequence
agaagattataaaaatgcta

SEQ ID NO: 1494 - DNA, 20 bp, Artificial sequence
  SiRNA target sequence
gaagattataaaaatgctat

SEQ ID NO: 1495 - DNA, 20 bp, Artificial sequence
  SiRNA target sequence
aagattataaaaatgctatt

SEQ ID NO: 1496 - DNA, 20 bp, Artificial sequence
  SiRNA target sequence
agattataaaaatgctattc

SEQ ID NO: 1497 - DNA, 20 bp, Artificial sequence
  SiRNA target sequence
gattataaaaatgctattct

SEQ ID NO: 1498 - DNA, 20 bp, Artificial sequence
  SiRNA target sequence
attataaaaatgctattctg

SEQ ID NO: 1499 - DNA, 20 bp, Artificial sequence
  SiRNA target sequence
ttataaaaatgctattctgt

SEQ ID NO: 1500 - DNA, 20 bp, Artificial sequence
  SiRNA target sequence
tataaaaatgctattctgtt

SEQ ID NO: 1501 - DNA, 20 bp, Artificial sequence
  SiRNA target sequence
ataaaaatgctattctgttg

SEQ ID NO: 1502 - DNA, 20 bp, Artificial sequence
  SiRNA target sequence
taaaaatgctattctgttgt

SEQ ID NO: 1503 - DNA, 20 bp, Artificial sequence
  SiRNA target sequence
aaaaatgctattctgttgta

SEQ ID NO: 1504 - DNA, 20 bp, Artificial sequence
  SiRNA target sequence
aaaatgctattctgttgtac

SEQ ID NO: 1505 - DNA, 20 bp, Artificial sequence
  SiRNA target sequence
aaatgctattctgttgtaca

SEQ ID NO: 1506 - DNA, 20 bp, Artificial sequence
  SiRNA target sequence
aatgctattctgttgtacac

SEQ ID NO: 1507 - DNA, 20 bp, Artificial sequence
  SiRNA target sequence
atgctattctgttgtacact

SEQ ID NO: 1508 - DNA, 20 bp, Artificial sequence
  SiRNA target sequence
tgctattctgttgtacacta

SEQ ID NO: 1509 - DNA, 20 bp, Artificial sequence
  SiRNA target sequence
gctattctgttgtacactaa

SEQ ID NO: 1510 - DNA, 20 bp, Artificial sequence
  SiRNA target sequence
ctattctgttgtacactaaa

SEQ ID NO: 1511 - DNA, 20 bp, Artificial sequence
  SiRNA target sequence
tattctgttgtacactaaat

SEQ ID NO: 1512 - DNA, 20 bp, Artificial sequence
  SiRNA target sequence
attctgttgtacactaaatg

SEQ ID NO: 1513 - DNA, 20 bp, Artificial sequence
  SiRNA target sequence
ttctgttgtacactaaatgt

SEQ ID NO: 1514 - DNA, 20 bp, Artificial sequence
  SiRNA target sequence
tctgttgtacactaaatgta

SEQ ID NO: 1515 - DNA, 20 bp, Artificial sequence
  SiRNA target sequence
ctgttgtacactaaatgtaa

SEQ ID NO: 1516 - DNA, 20 bp, Artificial sequence
  SiRNA target sequence
tgttgtacactaaatgtaaa

SEQ ID NO: 1517 - DNA, 20 bp, Artificial sequence
  SiRNA target sequence
gttgtacactaaatgtaaat

SEQ ID NO: 1518 - DNA, 20 bp, Artificial sequence
  SiRNA target sequence
ttgtacactaaatgtaaata

SEQ ID NO: 1519 - DNA, 20 bp, Artificial sequence
  SiRNA target sequence
tgtacactaaatgtaaatat

SEQ ID NO: 1520 - DNA, 20 bp, Artificial sequence
  SiRNA target sequence
gtacactaaatgtaaatata

SEQ ID NO: 1521 - DNA, 20 bp, Artificial sequence
  SiRNA target sequence
tacactaaatgtaaatatat

SEQ ID NO: 1522 - DNA, 20 bp, Artificial sequence
  SiRNA target sequence
acactaaatgtaaatatatg

SEQ ID NO: 1523 - DNA, 20 bp, Artificial sequence
  SiRNA target sequence
cactaaatgtaaatatatga

SEQ ID NO: 1524 - DNA, 20 bp, Artificial sequence
  SiRNA target sequence
actaaatgtaaatatatgaa

SEQ ID NO: 1525 - DNA, 20 bp, Artificial sequence
  SiRNA target sequence
ctaaatgtaaatatatgaaa

SEQ ID NO: 1526 - DNA, 20 bp, Artificial sequence
  SiRNA target sequence
taaatgtaaatatatgaaaa

SEQ ID NO: 1527 - DNA, 20 bp, Artificial sequence
  SiRNA target sequence
aaatgtaaatatatgaaaag

SEQ ID NO: 1528 - DNA, 20 bp, Artificial sequence
  SiRNA target sequence
aatgtaaatatatgaaaagt

SEQ ID NO: 1529 - DNA, 20 bp, Artificial sequence
  SiRNA target sequence
atgtaaatatatgaaaagtg

SEQ ID NO: 1530 - DNA, 20 bp, Artificial sequence
  SiRNA target sequence
tgtaaatatatgaaaagtga

SEQ ID NO: 1531 - DNA, 20 bp, Artificial sequence
  SiRNA target sequence
gtaaatatatgaaaagtgat

SEQ ID NO: 1532 - DNA, 20 bp, Artificial sequence
  SiRNA target sequence
taaatatatgaaaagtgatg

SEQ ID NO: 1533 - DNA, 20 bp, Artificial sequence
  SiRNA target sequence
aaatatatgaaaagtgatgc

SEQ ID NO: 1534 - DNA, 20 bp, Artificial sequence
  SiRNA target sequence
aatatatgaaaagtgatgct

SEQ ID NO: 1535 - DNA, 20 bp, Artificial sequence
  SiRNA target sequence
atatatgaaaagtgatgctg

SEQ ID NO: 1536 - DNA, 20 bp, Artificial sequence
  SiRNA target sequence
tatatgaaaagtgatgctga

SEQ ID NO: 1537 - DNA, 20 bp, Artificial sequence
  SiRNA target sequence
atatgaaaagtgatgctgaa

SEQ ID NO: 1538 - DNA, 20 bp, Artificial sequence
  SiRNA target sequence
tatgaaaagtgatgctgaaa

SEQ ID NO: 1539 - DNA, 20 bp, Artificial sequence
  SiRNA target sequence
atgaaaagtgatgctgaaat

SEQ ID NO: 1540 - DNA, 20 bp, Artificial sequence
  SiRNA target sequence
tgaaaagtgatgctgaaatt

SEQ ID NO: 1541 - DNA, 20 bp, Artificial sequence
  SiRNA target sequence
gaaaagtgatgctgaaattc

SEQ ID NO: 1542 - DNA, 20 bp, Artificial sequence
  SiRNA target sequence
aaaagtgatgctgaaattct

SEQ ID NO: 1543 - DNA, 20 bp, Artificial sequence
  SiRNA target sequence
aaagtgatgctgaaattctt

SEQ ID NO: 1544 - DNA, 20 bp, Artificial sequence
  SiRNA target sequence
aagtgatgctgaaattctta

SEQ ID NO: 1545 - DNA, 20 bp, Artificial sequence
  SiRNA target sequence
agtgatgctgaaattcttac

SEQ ID NO: 1546 - DNA, 20 bp, Artificial sequence
  SiRNA target sequence
gtgatgctgaaattcttact

SEQ ID NO: 1547 - DNA, 20 bp, Artificial sequence
  SiRNA target sequence
tgatgctgaaattcttacta

SEQ ID NO: 1548 - DNA, 20 bp, Artificial sequence
  SiRNA target sequence
gatgctgaaattcttactaa

SEQ ID NO: 1549 - DNA, 20 bp, Artificial sequence
  SiRNA target sequence
atgctgaaattcttactaaa

SEQ ID NO: 1550 - DNA, 20 bp, Artificial sequence
  SiRNA target sequence
tgctgaaattcttactaaaa

SEQ ID NO: 1551 - DNA, 20 bp, Artificial sequence
  SiRNA target sequence
gctgaaattcttactaaaat

SEQ ID NO: 1552 - DNA, 20 bp, Artificial sequence
  SiRNA target sequence
ctgaaattcttactaaaatt

SEQ ID NO: 1553 - DNA, 20 bp, Artificial sequence
  SiRNA target sequence
tgaaattcttactaaaatta

SEQ ID NO: 1554 - DNA, 20 bp, Artificial sequence
  SiRNA target sequence
gaaattcttactaaaattag

SEQ ID NO: 1555 - DNA, 20 bp, Artificial sequence
  SiRNA target sequence
aaattcttactaaaattagt

SEQ ID NO: 1556 - DNA, 20 bp, Artificial sequence
  SiRNA target sequence
aattcttactaaaattagtc

SEQ ID NO: 1557 - DNA, 20 bp, Artificial sequence
  SiRNA target sequence
attcttactaaaattagtct

SEQ ID NO: 1558 - DNA, 20 bp, Artificial sequence
  SiRNA target sequence
ttcttactaaaattagtctc

SEQ ID NO: 1559 - DNA, 20 bp, Artificial sequence
  SiRNA target sequence
tcttactaaaattagtctct

SEQ ID NO: 1560 - DNA, 20 bp, Artificial sequence
  SiRNA target sequence
cttactaaaattagtctctg

SEQ ID NO: 1561 - DNA, 20 bp, Artificial sequence
  SiRNA target sequence
ttactaaaattagtctctgt

SEQ ID NO: 1562 - DNA, 20 bp, Artificial sequence
  SiRNA target sequence
tactaaaattagtctctgta

SEQ ID NO: 1563 - DNA, 20 bp, Artificial sequence
  SiRNA target sequence
actaaaattagtctctgtaa

SEQ ID NO: 1564 - DNA, 20 bp, Artificial sequence
  SiRNA target sequence
ctaaaattagtctctgtaat

SEQ ID NO: 1565 - DNA, 20 bp, Artificial sequence
  SiRNA target sequence
taaaattagtctctgtaatt

SEQ ID NO: 1566 - DNA, 20 bp, Artificial sequence
  SiRNA target sequence
aaaattagtctctgtaatta

SEQ ID NO: 1567 - DNA, 20 bp, Artificial sequence
  SiRNA target sequence
aaattagtctctgtaattat

SEQ ID NO: 1568 - DNA, 20 bp, Artificial sequence
  SiRNA target sequence
aattagtctctgtaattatt

SEQ ID NO: 1569 - DNA, 20 bp, Artificial sequence
  SiRNA target sequence
attagtctctgtaattattt

SEQ ID NO: 1570 - DNA, 20 bp, Artificial sequence
  SiRNA target sequence
ttagtctctgtaattatttc

SEQ ID NO: 1571 - DNA, 20 bp, Artificial sequence
  SiRNA target sequence
tagtctctgtaattatttct

SEQ ID NO: 1572 - DNA, 20 bp, Artificial sequence
  SiRNA target sequence
agtctctgtaattatttctt

SEQ ID NO: 1573 - DNA, 20 bp, Artificial sequence
  SiRNA target sequence
gtctctgtaattatttctta

SEQ ID NO: 1574 - DNA, 20 bp, Artificial sequence
  SiRNA target sequence
tctctgtaattatttcttaa

SEQ ID NO: 1575 - DNA, 20 bp, Artificial sequence
  SiRNA target sequence
ctctgtaattatttcttaaa

SEQ ID NO: 1576 - DNA, 20 bp, Artificial sequence
  SiRNA target sequence
tctgtaattatttcttaaaa

SEQ ID NO: 1577 - DNA, 20 bp, Artificial sequence
  SiRNA target sequence
ctgtaattatttcttaaaaa

SEQ ID NO: 1578 - DNA, 20 bp, Artificial sequence
  SiRNA target sequence
tgtaattatttcttaaaaaa

SEQ ID NO: 1579 - DNA, 20 bp, Artificial sequence
  SiRNA target sequence
gtaattatttcttaaaaaat

SEQ ID NO: 1580 - DNA, 20 bp, Artificial sequence
  SiRNA target sequence
taattatttcttaaaaaatt

SEQ ID NO: 1581 - DNA, 20 bp, Artificial sequence
  SiRNA target sequence
aattatttcttaaaaaatta

SEQ ID NO: 1582 - DNA, 20 bp, Artificial sequence
  SiRNA target sequence
attatttcttaaaaaattat

SEQ ID NO: 1583 - DNA, 20 bp, Artificial sequence
  SiRNA target sequence
ttatttcttaaaaaattatc

SEQ ID NO: 1584 - DNA, 20 bp, Artificial sequence
  SiRNA target sequence
tatttcttaaaaaattatca

SEQ ID NO: 1585 - DNA, 20 bp, Artificial sequence
  SiRNA target sequence
atttcttaaaaaattatcaa

SEQ ID NO: 1586 - DNA, 20 bp, Artificial sequence
  SiRNA target sequence
tttcttaaaaaattatcaag

SEQ ID NO: 1587 - DNA, 20 bp, Artificial sequence
  SiRNA target sequence
ttcttaaaaaattatcaaga

SEQ ID NO: 1588 - DNA, 20 bp, Artificial sequence
  SiRNA target sequence
tcttaaaaaattatcaagaa

SEQ ID NO: 1589 - DNA, 20 bp, Artificial sequence
  SiRNA target sequence
cttaaaaaattatcaagaag

SEQ ID NO: 1590 - DNA, 20 bp, Artificial sequence
  SiRNA target sequence
ttaaaaaattatcaagaagt

SEQ ID NO: 1591 - DNA, 20 bp, Artificial sequence
  SiRNA target sequence
taaaaaattatcaagaagtt

SEQ ID NO: 1592 - DNA, 20 bp, Artificial sequence
  SiRNA target sequence
aaaaaattatcaagaagtta

SEQ ID NO: 1593 - DNA, 20 bp, Artificial sequence
  SiRNA target sequence
aaaaattatcaagaagttat

SEQ ID NO: 1594 - DNA, 20 bp, Artificial sequence
  SiRNA target sequence
aaaattatcaagaagttata

SEQ ID NO: 1595 - DNA, 20 bp, Artificial sequence
  SiRNA target sequence
aaattatcaagaagttataa

SEQ ID NO: 1596 - DNA, 20 bp, Artificial sequence
  SiRNA target sequence
aattatcaagaagttataaa

SEQ ID NO: 1597 - DNA, 20 bp, Artificial sequence
  SiRNA target sequence
attatcaagaagttataaat

SEQ ID NO: 1598 - DNA, 20 bp, Artificial sequence
  SiRNA target sequence
ttatcaagaagttataaata

SEQ ID NO: 1599 - DNA, 20 bp, Artificial sequence
  SiRNA target sequence
tatcaagaagttataaataa

SEQ ID NO: 1600 - DNA, 20 bp, Artificial sequence
  SiRNA target sequence
atcaagaagttataaataat

SEQ ID NO: 1601 - DNA, 20 bp, Artificial sequence
  SiRNA target sequence
tcaagaagttataaataatt

SEQ ID NO: 1602 - DNA, 20 bp, Artificial sequence
  SiRNA target sequence
caagaagttataaataattc

SEQ ID NO: 1603 - DNA, 20 bp, Artificial sequence
  SiRNA target sequence
aagaagttataaataattct

SEQ ID NO: 1604 - DNA, 20 bp, Artificial sequence
  SiRNA target sequence
agaagttataaataattctt

SEQ ID NO: 1605 - DNA, 20 bp, Artificial sequence
  SiRNA target sequence
gaagttataaataattcttt

SEQ ID NO: 1606 - DNA, 20 bp, Artificial sequence
  SiRNA target sequence
aagttataaataattcttta

SEQ ID NO: 1607 - DNA, 20 bp, Artificial sequence
  SiRNA target sequence
agttataaataattctttat

SEQ ID NO: 1608 - DNA, 20 bp, Artificial sequence
  SiRNA target sequence
gttataaataattctttatt

SEQ ID NO: 1609 - DNA, 20 bp, Artificial sequence
  SiRNA target sequence
ttataaataattctttattt

SEQ ID NO: 1610 - DNA, 20 bp, Artificial sequence
  SiRNA target sequence
tataaataattctttattta

SEQ ID NO: 1611 - DNA, 20 bp, Artificial sequence
  SiRNA target sequence
ataaataattctttatttaa

SEQ ID NO: 1612 - DNA, 20 bp, Artificial sequence
  SiRNA target sequence
taaataattctttatttaag

SEQ ID NO: 1613 - DNA, 20 bp, Artificial sequence
  SiRNA target sequence
aaataattctttatttaaga

SEQ ID NO: 1614 - DNA, 20 bp, Artificial sequence
  SiRNA target sequence
aataattctttatttaagac

SEQ ID NO: 1615 - DNA, 20 bp, Artificial sequence
  SiRNA target sequence
ataattctttatttaagaca

SEQ ID NO: 1616 - DNA, 20 bp, Artificial sequence
  SiRNA target sequence
taattctttatttaagacaa

SEQ ID NO: 1617 - DNA, 20 bp, Artificial sequence
  SiRNA target sequence
aattctttatttaagacaaa

SEQ ID NO: 1618 - DNA, 20 bp, Artificial sequence
  SiRNA target sequence
attctttatttaagacaaat

SEQ ID NO: 1619 - DNA, 20 bp, Artificial sequence
  SiRNA target sequence
ttctttatttaagacaaata

SEQ ID NO: 1620 - DNA, 20 bp, Artificial sequence
  SiRNA target sequence
tctttatttaagacaaataa

SEQ ID NO: 1621 - DNA, 20 bp, Artificial sequence
  SiRNA target sequence
ctttatttaagacaaataat

SEQ ID NO: 1622 - DNA, 20 bp, Artificial sequence
  SiRNA target sequence
tttatttaagacaaataata

SEQ ID NO: 1623 - DNA, 20 bp, Artificial sequence
  SiRNA target sequence
ttatttaagacaaataataa

SEQ ID NO: 1624 - DNA, 20 bp, Artificial sequence
  SiRNA target sequence
tatttaagacaaataataaa

SEQ ID NO: 1625 - DNA, 20 bp, Artificial sequence
  SiRNA target sequence
atttaagacaaataataaag

SEQ ID NO: 1626 - DNA, 20 bp, Artificial sequence
  SiRNA target sequence
tttaagacaaataataaaga

SEQ ID NO: 1627 - DNA, 20 bp, Artificial sequence
  SiRNA target sequence
ttaagacaaataataaagat

SEQ ID NO: 1628 - DNA, 20 bp, Artificial sequence
  SiRNA target sequence
taagacaaataataaagatc

SEQ ID NO: 1629 - DNA, 20 bp, Artificial sequence
  SiRNA target sequence
aagacaaataataaagatct

SEQ ID NO: 1630 - DNA, 20 bp, Artificial sequence
  SiRNA target sequence
agacaaataataaagatcta

SEQ ID NO: 1631 - DNA, 20 bp, Artificial sequence
  SiRNA target sequence
gacaaataataaagatctaa

SEQ ID NO: 1632 - DNA, 20 bp, Artificial sequence
  SiRNA target sequence
acaaataataaagatctaat

SEQ ID NO: 1633 - DNA, 20 bp, Artificial sequence
  SiRNA target sequence
caaataataaagatctaata

SEQ ID NO: 1634 - DNA, 20 bp, Artificial sequence
  SiRNA target sequence
aaataataaagatctaataa

SEQ ID NO: 1635 - DNA, 20 bp, Artificial sequence
  SiRNA target sequence
aataataaagatctaataaa

SEQ ID NO: 1636 - DNA, 20 bp, Artificial sequence
  SiRNA target sequence
ataataaagatctaataaaa

SEQ ID NO: 1637 - DNA, 20 bp, Artificial sequence
  SiRNA target sequence
taataaagatctaataaaaa

SEQ ID NO: 1638 - DNA, 20 bp, Artificial sequence
  SiRNA target sequence
aataaagatctaataaaaat

SEQ ID NO: 1639 - DNA, 20 bp, Artificial sequence
  SiRNA target sequence
ataaagatctaataaaaata

SEQ ID NO: 1640 - DNA, 20 bp, Artificial sequence
  SiRNA target sequence
taaagatctaataaaaataa

SEQ ID NO: 1641 - DNA, 20 bp, Artificial sequence
  SiRNA target sequence
aaagatctaataaaaataag

SEQ ID NO: 1642 - DNA, 20 bp, Artificial sequence
  SiRNA target sequence
aagatctaataaaaataaga

SEQ ID NO: 1643 - DNA, 20 bp, Artificial sequence
  SiRNA target sequence
agatctaataaaaataagat

SEQ ID NO: 1644 - DNA, 20 bp, Artificial sequence
  SiRNA target sequence
gatctaataaaaataagatc

SEQ ID NO: 1645 - DNA, 20 bp, Artificial sequence
  SiRNA target sequence
atctaataaaaataagatct

SEQ ID NO: 1646 - DNA, 20 bp, Artificial sequence
  SiRNA target sequence
tctaataaaaataagatctg

SEQ ID NO: 1647 - DNA, 20 bp, Artificial sequence
  SiRNA target sequence
ctaataaaaataagatctga

SEQ ID NO: 1648 - DNA, 20 bp, Artificial sequence
  SiRNA target sequence
taataaaaataagatctgaa

SEQ ID NO: 1649 - DNA, 20 bp, Artificial sequence
  SiRNA target sequence
aataaaaataagatctgaat

SEQ ID NO: 1650 - DNA, 20 bp, Artificial sequence
  SiRNA target sequence
ataaaaataagatctgaatg

SEQ ID NO: 1651 - DNA, 20 bp, Artificial sequence
  SiRNA target sequence
taaaaataagatctgaatgt

SEQ ID NO: 1652 - DNA, 20 bp, Artificial sequence
  SiRNA target sequence
aaaaataagatctgaatgtt

SEQ ID NO: 1653 - DNA, 20 bp, Artificial sequence
  SiRNA target sequence
aaaataagatctgaatgtta

SEQ ID NO: 1654 - DNA, 20 bp, Artificial sequence
  SiRNA target sequence
aaataagatctgaatgttac

SEQ ID NO: 1655 - DNA, 20 bp, Artificial sequence
  SiRNA target sequence
aataagatctgaatgttaca

SEQ ID NO: 1656 - DNA, 20 bp, Artificial sequence
  SiRNA target sequence
ataagatctgaatgttacaa

SEQ ID NO: 1657 - DNA, 20 bp, Artificial sequence
  SiRNA target sequence
taagatctgaatgttacaag

SEQ ID NO: 1658 - DNA, 20 bp, Artificial sequence
  SiRNA target sequence
aagatctgaatgttacaagc

SEQ ID NO: 1659 - DNA, 20 bp, Artificial sequence
  SiRNA target sequence
agatctgaatgttacaagca

SEQ ID NO: 1660 - DNA, 20 bp, Artificial sequence
  SiRNA target sequence
gatctgaatgttacaagcag

SEQ ID NO: 1661 - DNA, 20 bp, Artificial sequence
  SiRNA target sequence
atctgaatgttacaagcaga

SEQ ID NO: 1662 - DNA, 20 bp, Artificial sequence
  SiRNA target sequence
tctgaatgttacaagcagat

SEQ ID NO: 1663 - DNA, 20 bp, Artificial sequence
  SiRNA target sequence
ctgaatgttacaagcagatg

SEQ ID NO: 1664 - DNA, 20 bp, Artificial sequence
  SiRNA target sequence
tgaatgttacaagcagatgg

SEQ ID NO: 1665 - DNA, 20 bp, Artificial sequence
  SiRNA target sequence
gaatgttacaagcagatggg

SEQ ID NO: 1666 - DNA, 20 bp, Artificial sequence
  SiRNA target sequence
aatgttacaagcagatggga

SEQ ID NO: 1667 - DNA, 20 bp, Artificial sequence
  SiRNA target sequence
atgttacaagcagatgggaa

SEQ ID NO: 1668 - DNA, 20 bp, Artificial sequence
  SiRNA target sequence
tgttacaagcagatgggaaa

SEQ ID NO: 1669 - DNA, 20 bp, Artificial sequence
  SiRNA target sequence
gttacaagcagatgggaaat

SEQ ID NO: 1670 - DNA, 20 bp, Artificial sequence
  SiRNA target sequence
ttacaagcagatgggaaata

SEQ ID NO: 1671 - DNA, 20 bp, Artificial sequence
  SiRNA target sequence
tacaagcagatgggaaataa

SEQ ID NO: 1672 - DNA, 20 bp, Artificial sequence
  SiRNA target sequence
acaagcagatgggaaataaa

SEQ ID NO: 1673 - DNA, 20 bp, Artificial sequence
  SiRNA target sequence
caagcagatgggaaataaaa

SEQ ID NO: 1674 - DNA, 20 bp, Artificial sequence
  SiRNA target sequence
aagcagatgggaaataaaaa

SEQ ID NO: 1675 - DNA, 20 bp, Artificial sequence
  SiRNA target sequence
agcagatgggaaataaaaaa

SEQ ID NO: 1676 - DNA, 20 bp, Artificial sequence
  SiRNA target sequence
gcagatgggaaataaaaaaa

SEQ ID NO: 1677 - DNA, 20 bp, Artificial sequence
  SiRNA target sequence
cagatgggaaataaaaaaaa

SEQ ID NO: 1678 - DNA, 20 bp, Artificial sequence
  SiRNA target sequence
agatgggaaataaaaaaaaa

SEQ ID NO: 1679 - DNA, 20 bp, Artificial sequence
  SiRNA target sequence
gatgggaaataaaaaaaaat

SEQ ID NO: 1680 - DNA, 20 bp, Artificial sequence
  SiRNA target sequence
atgggaaataaaaaaaaatt

SEQ ID NO: 1681 - DNA, 20 bp, Artificial sequence
  SiRNA target sequence
tgggaaataaaaaaaaattt

SEQ ID NO: 1682 - DNA, 20 bp, Artificial sequence
  SiRNA target sequence
gggaaataaaaaaaaatttc

SEQ ID NO: 1683 - DNA, 20 bp, Artificial sequence
  SiRNA target sequence
ggaaataaaaaaaaatttct

SEQ ID NO: 1684 - DNA, 20 bp, Artificial sequence
  SiRNA target sequence
gaaataaaaaaaaatttctt

SEQ ID NO: 1685 - DNA, 20 bp, Artificial sequence
  SiRNA target sequence
aaataaaaaaaaatttctta

SEQ ID NO: 1686 - DNA, 20 bp, Artificial sequence
  SiRNA target sequence
aataaaaaaaaatttcttaa

SEQ ID NO: 1687 - DNA, 20 bp, Artificial sequence
  SiRNA target sequence
ataaaaaaaaatttcttaag

SEQ ID NO: 1688 - DNA, 20 bp, Artificial sequence
  SiRNA target sequence
taaaaaaaaatttcttaagg

SEQ ID NO: 1689 - DNA, 20 bp, Artificial sequence
  SiRNA target sequence
aaaaaaaaatttcttaagga

SEQ ID NO: 1690 - DNA, 20 bp, Artificial sequence
  SiRNA target sequence
aaaaaaaatttcttaaggat

SEQ ID NO: 1691 - DNA, 20 bp, Artificial sequence
  SiRNA target sequence
aaaaaaatttcttaaggatt

SEQ ID NO: 1692 - DNA, 20 bp, Artificial sequence
  SiRNA target sequence
aaaaaatttcttaaggattt

SEQ ID NO: 1693 - DNA, 20 bp, Artificial sequence
  SiRNA target sequence
aaaaatttcttaaggattta

SEQ ID NO: 1694 - DNA, 20 bp, Artificial sequence
  SiRNA target sequence
aaaatttcttaaggatttag

SEQ ID NO: 1695 - DNA, 20 bp, Artificial sequence
  SiRNA target sequence
aaatttcttaaggatttagc

SEQ ID NO: 1696 - DNA, 20 bp, Artificial sequence
  SiRNA target sequence
aatttcttaaggatttagca

SEQ ID NO: 1697 - DNA, 20 bp, Artificial sequence
  SiRNA target sequence
atttcttaaggatttagcac

SEQ ID NO: 1698 - DNA, 20 bp, Artificial sequence
  SiRNA target sequence
tttcttaaggatttagcact

SEQ ID NO: 1699 - DNA, 20 bp, Artificial sequence
  SiRNA target sequence
ttcttaaggatttagcactt

SEQ ID NO: 1700 - DNA, 20 bp, Artificial sequence
  SiRNA target sequence
tcttaaggatttagcacttt

SEQ ID NO: 1701 - DNA, 20 bp, Artificial sequence
  SiRNA target sequence
cttaaggatttagcacttta

SEQ ID NO: 1702 - DNA, 20 bp, Artificial sequence
  SiRNA target sequence
ttaaggatttagcactttat

SEQ ID NO: 1703 - DNA, 20 bp, Artificial sequence
  SiRNA target sequence
taaggatttagcactttatg

SEQ ID NO: 1704 - DNA, 20 bp, Artificial sequence
  SiRNA target sequence
aaggatttagcactttatga

SEQ ID NO: 1705 - DNA, 20 bp, Artificial sequence
  SiRNA target sequence
aggatttagcactttatgaa

SEQ ID NO: 1706 - DNA, 20 bp, Artificial sequence
  SiRNA target sequence
ggatttagcactttatgaaa

SEQ ID NO: 1707 - DNA, 20 bp, Artificial sequence
  SiRNA target sequence
gatttagcactttatgaaac

SEQ ID NO: 1708 - DNA, 20 bp, Artificial sequence
  SiRNA target sequence
atttagcactttatgaaaca

SEQ ID NO: 1709 - DNA, 20 bp, Artificial sequence
  SiRNA target sequence
tttagcactttatgaaacat

SEQ ID NO: 1710 - DNA, 20 bp, Artificial sequence
  SiRNA target sequence
ttagcactttatgaaacatt

SEQ ID NO: 1711 - DNA, 20 bp, Artificial sequence
  SiRNA target sequence
tagcactttatgaaacattt

SEQ ID NO: 1712 - DNA, 20 bp, Artificial sequence
  SiRNA target sequence
agcactttatgaaacatttg

SEQ ID NO: 1713 - DNA, 20 bp, Artificial sequence
  SiRNA target sequence
gcactttatgaaacatttgc

SEQ ID NO: 1714 - DNA, 20 bp, Artificial sequence
  SiRNA target sequence
cactttatgaaacatttgct

SEQ ID NO: 1715 - DNA, 20 bp, Artificial sequence
  SiRNA target sequence
actttatgaaacatttgcta

SEQ ID NO: 1716 - DNA, 20 bp, Artificial sequence
  SiRNA target sequence
ctttatgaaacatttgctaa

SEQ ID NO: 1717 - DNA, 20 bp, Artificial sequence
  SiRNA target sequence
tttatgaaacatttgctaat

SEQ ID NO: 1718 - DNA, 20 bp, Artificial sequence
  SiRNA target sequence
ttatgaaacatttgctaata

SEQ ID NO: 1719 - DNA, 20 bp, Artificial sequence
  SiRNA target sequence
tatgaaacatttgctaataa

SEQ ID NO: 1720 - DNA, 20 bp, Artificial sequence
  SiRNA target sequence
atgaaacatttgctaataat

SEQ ID NO: 1721 - DNA, 20 bp, Artificial sequence
  SiRNA target sequence
tgaaacatttgctaataata

SEQ ID NO: 1722 - DNA, 20 bp, Artificial sequence
  SiRNA target sequence
gaaacatttgctaataataa

SEQ ID NO: 1723 - DNA, 20 bp, Artificial sequence
  SiRNA target sequence
aaacatttgctaataataaa

SEQ ID NO: 1724 - DNA, 20 bp, Artificial sequence
  SiRNA target sequence
aacatttgctaataataaag

SEQ ID NO: 1725 - DNA, 20 bp, Artificial sequence
  SiRNA target sequence
acatttgctaataataaaga

SEQ ID NO: 1726 - DNA, 20 bp, Artificial sequence
  SiRNA target sequence
catttgctaataataaagaa

SEQ ID NO: 1727 - DNA, 20 bp, Artificial sequence
  SiRNA target sequence
atttgctaataataaagaag

SEQ ID NO: 1728 - DNA, 20 bp, Artificial sequence
  SiRNA target sequence
tttgctaataataaagaagt

SEQ ID NO: 1729 - DNA, 20 bp, Artificial sequence
  SiRNA target sequence
ttgctaataataaagaagtc

SEQ ID NO: 1730 - DNA, 20 bp, Artificial sequence
  SiRNA target sequence
tgctaataataaagaagtcc

SEQ ID NO: 1731 - DNA, 20 bp, Artificial sequence
  SiRNA target sequence
gctaataataaagaagtcca

SEQ ID NO: 1732 - DNA, 20 bp, Artificial sequence
  SiRNA target sequence
ctaataataaagaagtccaa

SEQ ID NO: 1733 - DNA, 20 bp, Artificial sequence
  SiRNA target sequence
taataataaagaagtccaag

SEQ ID NO: 1734 - DNA, 20 bp, Artificial sequence
  SiRNA target sequence
aataataaagaagtccaaga

SEQ ID NO: 1735 - DNA, 20 bp, Artificial sequence
  SiRNA target sequence
ataataaagaagtccaagat

SEQ ID NO: 1736 - DNA, 20 bp, Artificial sequence
  SiRNA target sequence
taataaagaagtccaagatg

SEQ ID NO: 1737 - DNA, 20 bp, Artificial sequence
  SiRNA target sequence
aataaagaagtccaagatga

SEQ ID NO: 1738 - DNA, 20 bp, Artificial sequence
  SiRNA target sequence
ataaagaagtccaagatgaa

SEQ ID NO: 1739 - DNA, 20 bp, Artificial sequence
  SiRNA target sequence
taaagaagtccaagatgaaa

SEQ ID NO: 1740 - DNA, 20 bp, Artificial sequence
  SiRNA target sequence
aaagaagtccaagatgaaat

SEQ ID NO: 1741 - DNA, 20 bp, Artificial sequence
  SiRNA target sequence
aagaagtccaagatgaaatt

SEQ ID NO: 1742 - DNA, 20 bp, Artificial sequence
  SiRNA target sequence
agaagtccaagatgaaatta

SEQ ID NO: 1743 - DNA, 20 bp, Artificial sequence
  SiRNA target sequence
gaagtccaagatgaaattat

SEQ ID NO: 1744 - DNA, 20 bp, Artificial sequence
  SiRNA target sequence
aagtccaagatgaaattatg

SEQ ID NO: 1745 - DNA, 20 bp, Artificial sequence
  SiRNA target sequence
agtccaagatgaaattatgc

SEQ ID NO: 1746 - DNA, 20 bp, Artificial sequence
  SiRNA target sequence
gtccaagatgaaattatgca

SEQ ID NO: 1747 - DNA, 20 bp, Artificial sequence
  SiRNA target sequence
tccaagatgaaattatgcag

SEQ ID NO: 1748 - DNA, 20 bp, Artificial sequence
  SiRNA target sequence
ccaagatgaaattatgcaga

SEQ ID NO: 1749 - DNA, 20 bp, Artificial sequence
  SiRNA target sequence
caagatgaaattatgcagac

SEQ ID NO: 1750 - DNA, 20 bp, Artificial sequence
  SiRNA target sequence
aagatgaaattatgcagact

SEQ ID NO: 1751 - DNA, 20 bp, Artificial sequence
  SiRNA target sequence
agatgaaattatgcagactg

SEQ ID NO: 1752 - DNA, 20 bp, Artificial sequence
  SiRNA target sequence
gatgaaattatgcagactgt

SEQ ID NO: 1753 - DNA, 20 bp, Artificial sequence
  SiRNA target sequence
atgaaattatgcagactgtt

SEQ ID NO: 1754 - DNA, 20 bp, Artificial sequence
  SiRNA target sequence
tgaaattatgcagactgtta

SEQ ID NO: 1755 - DNA, 20 bp, Artificial sequence
  SiRNA target sequence
gaaattatgcagactgttaa

SEQ ID NO: 1756 - DNA, 20 bp, Artificial sequence
  SiRNA target sequence
aaattatgcagactgttaaa

SEQ ID NO: 1757 - DNA, 20 bp, Artificial sequence
  SiRNA target sequence
aattatgcagactgttaaag

SEQ ID NO: 1758 - DNA, 20 bp, Artificial sequence
  SiRNA target sequence
attatgcagactgttaaaga

SEQ ID NO: 1759 - DNA, 20 bp, Artificial sequence
  SiRNA target sequence
ttatgcagactgttaaagaa

SEQ ID NO: 1760 - DNA, 20 bp, Artificial sequence
  SiRNA target sequence
tatgcagactgttaaagaaa

SEQ ID NO: 1761 - DNA, 20 bp, Artificial sequence
  SiRNA target sequence
atgcagactgttaaagaaat

SEQ ID NO: 1762 - DNA, 20 bp, Artificial sequence
  SiRNA target sequence
tgcagactgttaaagaaatt

SEQ ID NO: 1763 - DNA, 20 bp, Artificial sequence
  SiRNA target sequence
gcagactgttaaagaaattt

SEQ ID NO: 1764 - DNA, 20 bp, Artificial sequence
  SiRNA target sequence
cagactgttaaagaaatttg

SEQ ID NO: 1765 - DNA, 20 bp, Artificial sequence
  SiRNA target sequence
agactgttaaagaaatttgt

SEQ ID NO: 1766 - DNA, 20 bp, Artificial sequence
  SiRNA target sequence
gactgttaaagaaatttgtg

SEQ ID NO: 1767 - DNA, 20 bp, Artificial sequence
  SiRNA target sequence
actgttaaagaaatttgtga

SEQ ID NO: 1768 - DNA, 20 bp, Artificial sequence
  SiRNA target sequence
ctgttaaagaaatttgtgaa

SEQ ID NO: 1769 - DNA, 20 bp, Artificial sequence
  SiRNA target sequence
tgttaaagaaatttgtgaag

SEQ ID NO: 1770 - DNA, 20 bp, Artificial sequence
  SiRNA target sequence
gttaaagaaatttgtgaaga

SEQ ID NO: 1771 - DNA, 20 bp, Artificial sequence
  SiRNA target sequence
ttaaagaaatttgtgaagaa

SEQ ID NO: 1772 - DNA, 20 bp, Artificial sequence
  SiRNA target sequence
taaagaaatttgtgaagaag

SEQ ID NO: 1773 - DNA, 20 bp, Artificial sequence
  SiRNA target sequence
aaagaaatttgtgaagaaga

SEQ ID NO: 1774 - DNA, 20 bp, Artificial sequence
  SiRNA target sequence
aagaaatttgtgaagaagaa

SEQ ID NO: 1775 - DNA, 20 bp, Artificial sequence
  SiRNA target sequence
agaaatttgtgaagaagaag

SEQ ID NO: 1776 - DNA, 20 bp, Artificial sequence
  SiRNA target sequence
gaaatttgtgaagaagaagt

SEQ ID NO: 1777 - DNA, 20 bp, Artificial sequence
  SiRNA target sequence
aaatttgtgaagaagaagtg

SEQ ID NO: 1778 - DNA, 20 bp, Artificial sequence
  SiRNA target sequence
aatttgtgaagaagaagtga

SEQ ID NO: 1779 - DNA, 20 bp, Artificial sequence
  SiRNA target sequence
atttgtgaagaagaagtgaa

SEQ ID NO: 1780 - DNA, 20 bp, Artificial sequence
  SiRNA target sequence
tttgtgaagaagaagtgaat

SEQ ID NO: 1781 - DNA, 20 bp, Artificial sequence
  SiRNA target sequence
ttgtgaagaagaagtgaatg

SEQ ID NO: 1782 - DNA, 20 bp, Artificial sequence
  SiRNA target sequence
tgtgaagaagaagtgaatga

SEQ ID NO: 1783 - DNA, 20 bp, Artificial sequence
  SiRNA target sequence
gtgaagaagaagtgaatgag

SEQ ID NO: 1784 - DNA, 20 bp, Artificial sequence
  SiRNA target sequence
tgaagaagaagtgaatgagt

SEQ ID NO: 1785 - DNA, 20 bp, Artificial sequence
  SiRNA target sequence
gaagaagaagtgaatgagtt

SEQ ID NO: 1786 - DNA, 20 bp, Artificial sequence
  SiRNA target sequence
aagaagaagtgaatgagttt

SEQ ID NO: 1787 - DNA, 20 bp, Artificial sequence
  SiRNA target sequence
agaagaagtgaatgagttta

SEQ ID NO: 1788 - DNA, 20 bp, Artificial sequence
  SiRNA target sequence
gaagaagtgaatgagtttat

SEQ ID NO: 1789 - DNA, 20 bp, Artificial sequence
  SiRNA target sequence
aagaagtgaatgagtttatt

SEQ ID NO: 1790 - DNA, 20 bp, Artificial sequence
  SiRNA target sequence
agaagtgaatgagtttattg

SEQ ID NO: 1791 - DNA, 20 bp, Artificial sequence
  SiRNA target sequence
gaagtgaatgagtttattga

SEQ ID NO: 1792 - DNA, 20 bp, Artificial sequence
  SiRNA target sequence
aagtgaatgagtttattgaa

SEQ ID NO: 1793 - DNA, 20 bp, Artificial sequence
  SiRNA target sequence
agtgaatgagtttattgaac

SEQ ID NO: 1794 - DNA, 20 bp, Artificial sequence
  SiRNA target sequence
gtgaatgagtttattgaaca

SEQ ID NO: 1795 - DNA, 20 bp, Artificial sequence
  SiRNA target sequence
tgaatgagtttattgaacaa

SEQ ID NO: 1796 - DNA, 20 bp, Artificial sequence
  SiRNA target sequence
gaatgagtttattgaacaag

SEQ ID NO: 1797 - DNA, 20 bp, Artificial sequence
  SiRNA target sequence
aatgagtttattgaacaaga

SEQ ID NO: 1798 - DNA, 20 bp, Artificial sequence
  SiRNA target sequence
atgagtttattgaacaagaa

SEQ ID NO: 1799 - DNA, 20 bp, Artificial sequence
  SiRNA target sequence
tgagtttattgaacaagaag

SEQ ID NO: 1800 - DNA, 20 bp, Artificial sequence
  SiRNA target sequence
gagtttattgaacaagaagg

SEQ ID NO: 1801 - DNA, 20 bp, Artificial sequence
  SiRNA target sequence
agtttattgaacaagaaggt

SEQ ID NO: 1802 - DNA, 20 bp, Artificial sequence
  SiRNA target sequence
gtttattgaacaagaaggtt

SEQ ID NO: 1803 - DNA, 20 bp, Artificial sequence
  SiRNA target sequence
tttattgaacaagaaggttt

SEQ ID NO: 1804 - DNA, 20 bp, Artificial sequence
  SiRNA target sequence
ttattgaacaagaaggttta

SEQ ID NO: 1805 - DNA, 20 bp, Artificial sequence
  SiRNA target sequence
tattgaacaagaaggtttaa

SEQ ID NO: 1806 - DNA, 20 bp, Artificial sequence
  SiRNA target sequence
attgaacaagaaggtttaaa

SEQ ID NO: 1807 - DNA, 20 bp, Artificial sequence
  SiRNA target sequence
ttgaacaagaaggtttaaaa

SEQ ID NO: 1808 - DNA, 20 bp, Artificial sequence
  SiRNA target sequence
tgaacaagaaggtttaaaaa

SEQ ID NO: 1809 - DNA, 20 bp, Artificial sequence
  SiRNA target sequence
gaacaagaaggtttaaaaat

SEQ ID NO: 1810 - DNA, 20 bp, Artificial sequence
  SiRNA target sequence
aacaagaaggtttaaaaatt

SEQ ID NO: 1811 - DNA, 20 bp, Artificial sequence
  SiRNA target sequence
acaagaaggtttaaaaatta

SEQ ID NO: 1812 - DNA, 20 bp, Artificial sequence
  SiRNA target sequence
caagaaggtttaaaaattaa

SEQ ID NO: 1813 - DNA, 20 bp, Artificial sequence
  SiRNA target sequence
aagaaggtttaaaaattaat

SEQ ID NO: 1814 - DNA, 20 bp, Artificial sequence
  SiRNA target sequence
agaaggtttaaaaattaata

SEQ ID NO: 1815 - DNA, 20 bp, Artificial sequence
  SiRNA target sequence
gaaggtttaaaaattaataa

SEQ ID NO: 1816 - DNA, 20 bp, Artificial sequence
  SiRNA target sequence
aaggtttaaaaattaataaa

SEQ ID NO: 1817 - DNA, 20 bp, Artificial sequence
  SiRNA target sequence
aggtttaaaaattaataaag

SEQ ID NO: 1818 - DNA, 20 bp, Artificial sequence
  SiRNA target sequence
ggtttaaaaattaataaaga

SEQ ID NO: 1819 - DNA, 20 bp, Artificial sequence
  SiRNA target sequence
gtttaaaaattaataaagaa

SEQ ID NO: 1820 - DNA, 20 bp, Artificial sequence
  SiRNA target sequence
tttaaaaattaataaagaag

SEQ ID NO: 1821 - DNA, 20 bp, Artificial sequence
  SiRNA target sequence
ttaaaaattaataaagaaga

SEQ ID NO: 1822 - DNA, 20 bp, Artificial sequence
  SiRNA target sequence
taaaaattaataaagaagat

SEQ ID NO: 1823 - DNA, 20 bp, Artificial sequence
  SiRNA target sequence
aaaaattaataaagaagatg

SEQ ID NO: 1824 - DNA, 20 bp, Artificial sequence
  SiRNA target sequence
aaaattaataaagaagatgt

SEQ ID NO: 1825 - DNA, 20 bp, Artificial sequence
  SiRNA target sequence
aaattaataaagaagatgtg

SEQ ID NO: 1826 - DNA, 20 bp, Artificial sequence
  SiRNA target sequence
aattaataaagaagatgtgc

SEQ ID NO: 1827 - DNA, 20 bp, Artificial sequence
  SiRNA target sequence
attaataaagaagatgtgct

SEQ ID NO: 1828 - DNA, 20 bp, Artificial sequence
  SiRNA target sequence
ttaataaagaagatgtgcta

SEQ ID NO: 1829 - DNA, 20 bp, Artificial sequence
  SiRNA target sequence
taataaagaagatgtgctaa

SEQ ID NO: 1830 - DNA, 20 bp, Artificial sequence
  SiRNA target sequence
aataaagaagatgtgctaag

SEQ ID NO: 1831 - DNA, 20 bp, Artificial sequence
  SiRNA target sequence
ataaagaagatgtgctaaga

SEQ ID NO: 1832 - DNA, 20 bp, Artificial sequence
  SiRNA target sequence
taaagaagatgtgctaagag

SEQ ID NO: 1833 - DNA, 20 bp, Artificial sequence
  SiRNA target sequence
aaagaagatgtgctaagagg

SEQ ID NO: 1834 - DNA, 20 bp, Artificial sequence
  SiRNA target sequence
aagaagatgtgctaagagga

SEQ ID NO: 1835 - DNA, 20 bp, Artificial sequence
  SiRNA target sequence
agaagatgtgctaagaggac

SEQ ID NO: 1836 - DNA, 20 bp, Artificial sequence
  SiRNA target sequence
gaagatgtgctaagaggact

SEQ ID NO: 1837 - DNA, 20 bp, Artificial sequence
  SiRNA target sequence
aagatgtgctaagaggactt

SEQ ID NO: 1838 - DNA, 20 bp, Artificial sequence
  SiRNA target sequence
agatgtgctaagaggacttg

SEQ ID NO: 1839 - DNA, 20 bp, Artificial sequence
  SiRNA target sequence
gatgtgctaagaggacttgt

SEQ ID NO: 1840 - DNA, 20 bp, Artificial sequence
  SiRNA target sequence
atgtgctaagaggacttgtt

SEQ ID NO: 1841 - DNA, 20 bp, Artificial sequence
  SiRNA target sequence
tgtgctaagaggacttgttt

SEQ ID NO: 1842 - DNA, 20 bp, Artificial sequence
  SiRNA target sequence
gtgctaagaggacttgtttc

SEQ ID NO: 1843 - DNA, 20 bp, Artificial sequence
  SiRNA target sequence
tgctaagaggacttgtttca

SEQ ID NO: 1844 - DNA, 20 bp, Artificial sequence
  SiRNA target sequence
gctaagaggacttgtttcaa

SEQ ID NO: 1845 - DNA, 20 bp, Artificial sequence
  SiRNA target sequence
ctaagaggacttgtttcaat

SEQ ID NO: 1846 - DNA, 20 bp, Artificial sequence
  SiRNA target sequence
taagaggacttgtttcaata

SEQ ID NO: 1847 - DNA, 20 bp, Artificial sequence
  SiRNA target sequence
aagaggacttgtttcaataa

SEQ ID NO: 1848 - DNA, 20 bp, Artificial sequence
  SiRNA target sequence
agaggacttgtttcaataaa

SEQ ID NO: 1849 - DNA, 20 bp, Artificial sequence
  SiRNA target sequence
gaggacttgtttcaataaaa

SEQ ID NO: 1850 - DNA, 20 bp, Artificial sequence
  SiRNA target sequence
aggacttgtttcaataaaaa

SEQ ID NO: 1851 - DNA, 20 bp, Artificial sequence
  SiRNA target sequence
ggacttgtttcaataaaaaa

SEQ ID NO: 1852 - DNA, 20 bp, Artificial sequence
  SiRNA target sequence
gacttgtttcaataaaaaat

SEQ ID NO: 1853 - DNA, 20 bp, Artificial sequence
  SiRNA target sequence
acttgtttcaataaaaaata

SEQ ID NO: 1854 - DNA, 20 bp, Artificial sequence
  SiRNA target sequence
cttgtttcaataaaaaatat

SEQ ID NO: 1855 - DNA, 20 bp, Artificial sequence
  SiRNA target sequence
ttgtttcaataaaaaatata

SEQ ID NO: 1856 - DNA, 20 bp, Artificial sequence
  SiRNA target sequence
tgtttcaataaaaaatataa

SEQ ID NO: 1857 - DNA, 20 bp, Artificial sequence
  SiRNA target sequence
gtttcaataaaaaatataaa

SEQ ID NO: 1858 - DNA, 20 bp, Artificial sequence
  SiRNA target sequence
tttcaataaaaaatataaat

SEQ ID NO: 1859 - DNA, 20 bp, Artificial sequence
  SiRNA target sequence
ttcaataaaaaatataaatg

SEQ ID NO: 1860 - DNA, 20 bp, Artificial sequence
  SiRNA target sequence
tcaataaaaaatataaatga

SEQ ID NO: 1861 - DNA, 20 bp, Artificial sequence
  SiRNA target sequence
caataaaaaatataaatgag

SEQ ID NO: 1862 - DNA, 20 bp, Artificial sequence
  SiRNA target sequence
aataaaaaatataaatgaga

SEQ ID NO: 1863 - DNA, 20 bp, Artificial sequence
  SiRNA target sequence
ataaaaaatataaatgagat

SEQ ID NO: 1864 - DNA, 20 bp, Artificial sequence
  SiRNA target sequence
taaaaaatataaatgagatt

SEQ ID NO: 1865 - DNA, 20 bp, Artificial sequence
  SiRNA target sequence
aaaaaatataaatgagattt

SEQ ID NO: 1866 - DNA, 20 bp, Artificial sequence
  SiRNA target sequence
aaaaatataaatgagattta

SEQ ID NO: 1867 - DNA, 20 bp, Artificial sequence
  SiRNA target sequence
aaaatataaatgagatttat

SEQ ID NO: 1868 - DNA, 20 bp, Artificial sequence
  SiRNA target sequence
aaatataaatgagatttatg

SEQ ID NO: 1869 - DNA, 20 bp, Artificial sequence
  SiRNA target sequence
aatataaatgagatttatga

SEQ ID NO: 1870 - DNA, 20 bp, Artificial sequence
  SiRNA target sequence
atataaatgagatttatgat

SEQ ID NO: 1871 - DNA, 20 bp, Artificial sequence
  SiRNA target sequence
tataaatgagatttatgatg

SEQ ID NO: 1872 - DNA, 20 bp, Artificial sequence
  SiRNA target sequence
ataaatgagatttatgatgc

SEQ ID NO: 1873 - DNA, 20 bp, Artificial sequence
  SiRNA target sequence
taaatgagatttatgatgca

SEQ ID NO: 1874 - DNA, 20 bp, Artificial sequence
  SiRNA target sequence
aaatgagatttatgatgcat

SEQ ID NO: 1875 - DNA, 20 bp, Artificial sequence
  SiRNA target sequence
aatgagatttatgatgcatt

SEQ ID NO: 1876 - DNA, 20 bp, Artificial sequence
  SiRNA target sequence
atgagatttatgatgcattt

SEQ ID NO: 1877 - DNA, 20 bp, Artificial sequence
  SiRNA target sequence
tgagatttatgatgcatttg

SEQ ID NO: 1878 - DNA, 20 bp, Artificial sequence
  SiRNA target sequence
gagatttatgatgcatttgg

SEQ ID NO: 1879 - DNA, 20 bp, Artificial sequence
  SiRNA target sequence
agatttatgatgcatttgga

SEQ ID NO: 1880 - DNA, 20 bp, Artificial sequence
  SiRNA target sequence
gatttatgatgcatttggag

SEQ ID NO: 1881 - DNA, 20 bp, Artificial sequence
  SiRNA target sequence
atttatgatgcatttggagg

SEQ ID NO: 1882 - DNA, 20 bp, Artificial sequence
  SiRNA target sequence
tttatgatgcatttggaggt

SEQ ID NO: 1883 - DNA, 20 bp, Artificial sequence
  SiRNA target sequence
ttatgatgcatttggaggta

SEQ ID NO: 1884 - DNA, 20 bp, Artificial sequence
  SiRNA target sequence
tatgatgcatttggaggtaa

SEQ ID NO: 1885 - DNA, 20 bp, Artificial sequence
  SiRNA target sequence
atgatgcatttggaggtaaa

SEQ ID NO: 1886 - DNA, 20 bp, Artificial sequence
  SiRNA target sequence
tgatgcatttggaggtaaat

SEQ ID NO: 1887 - DNA, 20 bp, Artificial sequence
  SiRNA target sequence
gatgcatttggaggtaaatc

SEQ ID NO: 1888 - DNA, 20 bp, Artificial sequence
  SiRNA target sequence
atgcatttggaggtaaatct

SEQ ID NO: 1889 - DNA, 20 bp, Artificial sequence
  SiRNA target sequence
tgcatttggaggtaaatcta

SEQ ID NO: 1890 - DNA, 20 bp, Artificial sequence
  SiRNA target sequence
gcatttggaggtaaatctaa

SEQ ID NO: 1891 - DNA, 20 bp, Artificial sequence
  SiRNA target sequence
catttggaggtaaatctaag

SEQ ID NO: 1892 - DNA, 20 bp, Artificial sequence
  SiRNA target sequence
atttggaggtaaatctaaga

SEQ ID NO: 1893 - DNA, 20 bp, Artificial sequence
  SiRNA target sequence
tttggaggtaaatctaagaa

SEQ ID NO: 1894 - DNA, 20 bp, Artificial sequence
  SiRNA target sequence
ttggaggtaaatctaagaag

SEQ ID NO: 1895 - DNA, 20 bp, Artificial sequence
  SiRNA target sequence
tggaggtaaatctaagaagt

SEQ ID NO: 1896 - DNA, 20 bp, Artificial sequence
  SiRNA target sequence
ggaggtaaatctaagaagtt

SEQ ID NO: 1897 - DNA, 20 bp, Artificial sequence
  SiRNA target sequence
gaggtaaatctaagaagttt

SEQ ID NO: 1898 - DNA, 20 bp, Artificial sequence
  SiRNA target sequence
aggtaaatctaagaagttta

SEQ ID NO: 1899 - DNA, 20 bp, Artificial sequence
  SiRNA target sequence
ggtaaatctaagaagtttaa

SEQ ID NO: 1900 - DNA, 20 bp, Artificial sequence
  SiRNA target sequence
gtaaatctaagaagtttaaa

SEQ ID NO: 1901 - DNA, 20 bp, Artificial sequence
  SiRNA target sequence
taaatctaagaagtttaaat

SEQ ID NO: 1902 - DNA, 20 bp, Artificial sequence
  SiRNA target sequence
aaatctaagaagtttaaatt

SEQ ID NO: 1903 - DNA, 20 bp, Artificial sequence
  SiRNA target sequence
aatctaagaagtttaaattt

SEQ ID NO: 1904 - DNA, 20 bp, Artificial sequence
  SiRNA target sequence
atctaagaagtttaaatttt

SEQ ID NO: 1905 - DNA, 20 bp, Artificial sequence
  SiRNA target sequence
tctaagaagtttaaattttc

SEQ ID NO: 1906 - DNA, 20 bp, Artificial sequence
  SiRNA target sequence
ctaagaagtttaaattttct

SEQ ID NO: 1907 - DNA, 20 bp, Artificial sequence
  SiRNA target sequence
taagaagtttaaattttcta

SEQ ID NO: 1908 - DNA, 20 bp, Artificial sequence
  SiRNA target sequence
aagaagtttaaattttctaa

SEQ ID NO: 1909 - DNA, 20 bp, Artificial sequence
  SiRNA target sequence
agaagtttaaattttctaat

SEQ ID NO: 1910 - DNA, 20 bp, Artificial sequence
  SiRNA target sequence
gaagtttaaattttctaatg

SEQ ID NO: 1911 - DNA, 20 bp, Artificial sequence
  SiRNA target sequence
aagtttaaattttctaatga

SEQ ID NO: 1912 - DNA, 20 bp, Artificial sequence
  SiRNA target sequence
agtttaaattttctaatgat

SEQ ID NO: 1913 - DNA, 20 bp, Artificial sequence
  SiRNA target sequence
gtttaaattttctaatgatg

SEQ ID NO: 1914 - DNA, 20 bp, Artificial sequence
  SiRNA target sequence
tttaaattttctaatgatga

SEQ ID NO: 1915 - DNA, 20 bp, Artificial sequence
  SiRNA target sequence
ttaaattttctaatgatgaa

SEQ ID NO: 1916 - DNA, 20 bp, Artificial sequence
  SiRNA target sequence
taaattttctaatgatgaaa

SEQ ID NO: 1917 - DNA, 20 bp, Artificial sequence
  SiRNA target sequence
aaattttctaatgatgaaaa

SEQ ID NO: 1918 - DNA, 20 bp, Artificial sequence
  SiRNA target sequence
aattttctaatgatgaaaag

SEQ ID NO: 1919 - DNA, 20 bp, Artificial sequence
  SiRNA target sequence
attttctaatgatgaaaagg

SEQ ID NO: 1920 - DNA, 20 bp, Artificial sequence
  SiRNA target sequence
ttttctaatgatgaaaagga

SEQ ID NO: 1921 - DNA, 20 bp, Artificial sequence
  SiRNA target sequence
tttctaatgatgaaaaggaa

SEQ ID NO: 1922 - DNA, 20 bp, Artificial sequence
  SiRNA target sequence
ttctaatgatgaaaaggaag

SEQ ID NO: 1923 - DNA, 20 bp, Artificial sequence
  SiRNA target sequence
tctaatgatgaaaaggaagt

SEQ ID NO: 1924 - DNA, 20 bp, Artificial sequence
  SiRNA target sequence
ctaatgatgaaaaggaagtg

SEQ ID NO: 1925 - DNA, 20 bp, Artificial sequence
  SiRNA target sequence
taatgatgaaaaggaagtgt

SEQ ID NO: 1926 - DNA, 20 bp, Artificial sequence
  SiRNA target sequence
aatgatgaaaaggaagtgtt

SEQ ID NO: 1927 - DNA, 20 bp, Artificial sequence
  SiRNA target sequence
atgatgaaaaggaagtgtta

SEQ ID NO: 1928 - DNA, 20 bp, Artificial sequence
  SiRNA target sequence
tgatgaaaaggaagtgttaa

SEQ ID NO: 1929 - DNA, 20 bp, Artificial sequence
  SiRNA target sequence
gatgaaaaggaagtgttaaa

SEQ ID NO: 1930 - DNA, 20 bp, Artificial sequence
  SiRNA target sequence
atgaaaaggaagtgttaaat

SEQ ID NO: 1931 - DNA, 20 bp, Artificial sequence
  SiRNA target sequence
tgaaaaggaagtgttaaatc

SEQ ID NO: 1932 - DNA, 20 bp, Artificial sequence
  SiRNA target sequence
gaaaaggaagtgttaaatct

SEQ ID NO: 1933 - DNA, 20 bp, Artificial sequence
  SiRNA target sequence
aaaaggaagtgttaaatctt

SEQ ID NO: 1934 - DNA, 20 bp, Artificial sequence
  SiRNA target sequence
aaaggaagtgttaaatcttc

SEQ ID NO: 1935 - DNA, 20 bp, Artificial sequence
  SiRNA target sequence
aaggaagtgttaaatcttct

SEQ ID NO: 1936 - DNA, 20 bp, Artificial sequence
  SiRNA target sequence
aggaagtgttaaatcttctt

SEQ ID NO: 1937 - DNA, 20 bp, Artificial sequence
  SiRNA target sequence
ggaagtgttaaatcttctta

SEQ ID NO: 1938 - DNA, 20 bp, Artificial sequence
  SiRNA target sequence
gaagtgttaaatcttcttaa

SEQ ID NO: 1939 - DNA, 20 bp, Artificial sequence
  SiRNA target sequence
aagtgttaaatcttcttaat

SEQ ID NO: 1940 - DNA, 20 bp, Artificial sequence
  SiRNA target sequence
agtgttaaatcttcttaatg

SEQ ID NO: 1941 - DNA, 20 bp, Artificial sequence
  SiRNA target sequence
gtgttaaatcttcttaatgc

SEQ ID NO: 1942 - DNA, 20 bp, Artificial sequence
  SiRNA target sequence
tgttaaatcttcttaatgcc

SEQ ID NO: 1943 - DNA, 20 bp, Artificial sequence
  SiRNA target sequence
gttaaatcttcttaatgcca

SEQ ID NO: 1944 - DNA, 20 bp, Artificial sequence
  SiRNA target sequence
ttaaatcttcttaatgccat

SEQ ID NO: 1945 - DNA, 20 bp, Artificial sequence
  SiRNA target sequence
taaatcttcttaatgccatt

SEQ ID NO: 1946 - DNA, 20 bp, Artificial sequence
  SiRNA target sequence
aaatcttcttaatgccatta

SEQ ID NO: 1947 - DNA, 20 bp, Artificial sequence
  SiRNA target sequence
aatcttcttaatgccattat

SEQ ID NO: 1948 - DNA, 20 bp, Artificial sequence
  SiRNA target sequence
atcttcttaatgccattatt

SEQ ID NO: 1949 - DNA, 20 bp, Artificial sequence
  SiRNA target sequence
tcttcttaatgccattattt

SEQ ID NO: 1950 - DNA, 20 bp, Artificial sequence
  SiRNA target sequence
cttcttaatgccattatttt

SEQ ID NO: 1951 - DNA, 20 bp, Artificial sequence
  SiRNA target sequence
ttcttaatgccattatttta

SEQ ID NO: 1952 - DNA, 20 bp, Artificial sequence
  SiRNA target sequence
tcttaatgccattattttac

SEQ ID NO: 1953 - DNA, 20 bp, Artificial sequence
  SiRNA target sequence
cttaatgccattattttaca

SEQ ID NO: 1954 - DNA, 20 bp, Artificial sequence
  SiRNA target sequence
ttaatgccattattttacac

SEQ ID NO: 1955 - DNA, 20 bp, Artificial sequence
  SiRNA target sequence
taatgccattattttacacc

SEQ ID NO: 1956 - DNA, 20 bp, Artificial sequence
  SiRNA target sequence
aatgccattattttacacct

SEQ ID NO: 1957 - DNA, 20 bp, Artificial sequence
  SiRNA target sequence
atgccattattttacaccta

SEQ ID NO: 1958 - DNA, 20 bp, Artificial sequence
  SiRNA target sequence
tgccattattttacacctaa

SEQ ID NO: 1959 - DNA, 20 bp, Artificial sequence
  SiRNA target sequence
gccattattttacacctaaa

SEQ ID NO: 1960 - DNA, 20 bp, Artificial sequence
  SiRNA target sequence
ccattattttacacctaaaa

SEQ ID NO: 1961 - DNA, 20 bp, Artificial sequence
  SiRNA target sequence
cattattttacacctaaaag

SEQ ID NO: 1962 - DNA, 20 bp, Artificial sequence
  SiRNA target sequence
attattttacacctaaaagg

SEQ ID NO: 1963 - DNA, 20 bp, Artificial sequence
  SiRNA target sequence
ttattttacacctaaaagga

SEQ ID NO: 1964 - DNA, 20 bp, Artificial sequence
  SiRNA target sequence
tattttacacctaaaaggaa

SEQ ID NO: 1965 - DNA, 20 bp, Artificial sequence
  SiRNA target sequence
attttacacctaaaaggaaa

SEQ ID NO: 1966 - DNA, 20 bp, Artificial sequence
  SiRNA target sequence
ttttacacctaaaaggaaaa

SEQ ID NO: 1967 - DNA, 20 bp, Artificial sequence
  SiRNA target sequence
tttacacctaaaaggaaaaa

SEQ ID NO: 1968 - DNA, 20 bp, Artificial sequence
  SiRNA target sequence
ttacacctaaaaggaaaaaa

SEQ ID NO: 1969 - DNA, 20 bp, Artificial sequence
  SiRNA target sequence
tacacctaaaaggaaaaaaa

SEQ ID NO: 1970 - DNA, 20 bp, Artificial sequence
  SiRNA target sequence
acacctaaaaggaaaaaaag

SEQ ID NO: 1971 - DNA, 20 bp, Artificial sequence
  SiRNA target sequence
cacctaaaaggaaaaaaaga

SEQ ID NO: 1972 - DNA, 20 bp, Artificial sequence
  SiRNA target sequence
acctaaaaggaaaaaaagaa

SEQ ID NO: 1973 - DNA, 20 bp, Artificial sequence
  SiRNA target sequence
cctaaaaggaaaaaaagaac

SEQ ID NO: 1974 - DNA, 20 bp, Artificial sequence
  SiRNA target sequence
ctaaaaggaaaaaaagaaca

SEQ ID NO: 1975 - DNA, 20 bp, Artificial sequence
  SiRNA target sequence
taaaaggaaaaaaagaacag

SEQ ID NO: 1976 - DNA, 20 bp, Artificial sequence
  SiRNA target sequence
aaaaggaaaaaaagaacagg

SEQ ID NO: 1977 - DNA, 20 bp, Artificial sequence
  SiRNA target sequence
aaaggaaaaaaagaacaggc

SEQ ID NO: 1978 - DNA, 20 bp, Artificial sequence
  SiRNA target sequence
aaggaaaaaaagaacaggca

SEQ ID NO: 1979 - DNA, 20 bp, Artificial sequence
  SiRNA target sequence
aggaaaaaaagaacaggcaa

SEQ ID NO: 1980 - DNA, 20 bp, Artificial sequence
  SiRNA target sequence
ggaaaaaaagaacaggcaat

SEQ ID NO: 1981 - DNA, 20 bp, Artificial sequence
  SiRNA target sequence
gaaaaaaagaacaggcaatt

SEQ ID NO: 1982 - DNA, 20 bp, Artificial sequence
  SiRNA target sequence
aaaaaaagaacaggcaattc

SEQ ID NO: 1983 - DNA, 20 bp, Artificial sequence
  SiRNA target sequence
aaaaaagaacaggcaattct

SEQ ID NO: 1984 - DNA, 20 bp, Artificial sequence
  SiRNA target sequence
aaaaagaacaggcaattctt

SEQ ID NO: 1985 - DNA, 20 bp, Artificial sequence
  SiRNA target sequence
aaaagaacaggcaattcttt

SEQ ID NO: 1986 - DNA, 20 bp, Artificial sequence
  SiRNA target sequence
aaagaacaggcaattctttt

SEQ ID NO: 1987 - DNA, 20 bp, Artificial sequence
  SiRNA target sequence
aagaacaggcaattctttta

SEQ ID NO: 1988 - DNA, 20 bp, Artificial sequence
  SiRNA target sequence
agaacaggcaattcttttat

SEQ ID NO: 1989 - DNA, 20 bp, Artificial sequence
  SiRNA target sequence
gaacaggcaattcttttatt

SEQ ID NO: 1990 - DNA, 20 bp, Artificial sequence
  SiRNA target sequence
aacaggcaattcttttatta

SEQ ID NO: 1991 - DNA, 20 bp, Artificial sequence
  SiRNA target sequence
acaggcaattcttttattag

SEQ ID NO: 1992 - DNA, 20 bp, Artificial sequence
  SiRNA target sequence
caggcaattcttttattaga

SEQ ID NO: 1993 - DNA, 20 bp, Artificial sequence
  SiRNA target sequence
aggcaattcttttattagaa

SEQ ID NO: 1994 - DNA, 20 bp, Artificial sequence
  SiRNA target sequence
ggcaattcttttattagaaa

SEQ ID NO: 1995 - DNA, 20 bp, Artificial sequence
  SiRNA target sequence
gcaattcttttattagaaaa

SEQ ID NO: 1996 - DNA, 20 bp, Artificial sequence
  SiRNA target sequence
caattcttttattagaaaaa

SEQ ID NO: 1997 - DNA, 20 bp, Artificial sequence
  SiRNA target sequence
aattcttttattagaaaaat

SEQ ID NO: 1998 - DNA, 20 bp, Artificial sequence
  SiRNA target sequence
attcttttattagaaaaatc

SEQ ID NO: 1999 - DNA, 20 bp, Artificial sequence
  SiRNA target sequence
ttcttttattagaaaaatct

SEQ ID NO: 2000 - DNA, 20 bp, Artificial sequence
  SiRNA target sequence
tcttttattagaaaaatcta

SEQ ID NO: 2001 - DNA, 20 bp, Artificial sequence
  SiRNA target sequence
cttttattagaaaaatctac

SEQ ID NO: 2002 - DNA, 20 bp, Artificial sequence
  SiRNA target sequence
ttttattagaaaaatctact

SEQ ID NO: 2003 - DNA, 20 bp, Artificial sequence
  SiRNA target sequence
tttattagaaaaatctactt

SEQ ID NO: 2004 - DNA, 20 bp, Artificial sequence
  SiRNA target sequence
ttattagaaaaatctactta

SEQ ID NO: 2005 - DNA, 20 bp, Artificial sequence
  SiRNA target sequence
tattagaaaaatctacttat

SEQ ID NO: 2006 - DNA, 20 bp, Artificial sequence
  SiRNA target sequence
attagaaaaatctacttata

SEQ ID NO: 2007 - DNA, 20 bp, Artificial sequence
  SiRNA target sequence
ttagaaaaatctacttataa

SEQ ID NO: 2008 - DNA, 20 bp, Artificial sequence
  SiRNA target sequence
tagaaaaatctacttataaa

SEQ ID NO: 2009 - DNA, 20 bp, Artificial sequence
  SiRNA target sequence
agaaaaatctacttataaat

SEQ ID NO: 2010 - DNA, 20 bp, Artificial sequence
  SiRNA target sequence
gaaaaatctacttataaata

SEQ ID NO: 2011 - DNA, 20 bp, Artificial sequence
  SiRNA target sequence
aaaaatctacttataaatac

SEQ ID NO: 2012 - DNA, 20 bp, Artificial sequence
  SiRNA target sequence
aaaatctacttataaataca

SEQ ID NO: 2013 - DNA, 20 bp, Artificial sequence
  SiRNA target sequence
aaatctacttataaatacag

SEQ ID NO: 2014 - DNA, 20 bp, Artificial sequence
  SiRNA target sequence
aatctacttataaatacagt

SEQ ID NO: 2015 - DNA, 20 bp, Artificial sequence
  SiRNA target sequence
atctacttataaatacagta

SEQ ID NO: 2016 - DNA, 20 bp, Artificial sequence
  SiRNA target sequence
tctacttataaatacagtat

SEQ ID NO: 2017 - DNA, 20 bp, Artificial sequence
  SiRNA target sequence
ctacttataaatacagtatc

SEQ ID NO: 2018 - DNA, 20 bp, Artificial sequence
  SiRNA target sequence
tacttataaatacagtatct

SEQ ID NO: 2019 - DNA, 20 bp, Artificial sequence
  SiRNA target sequence
acttataaatacagtatctt

SEQ ID NO: 2020 - DNA, 20 bp, Artificial sequence
  SiRNA target sequence
cttataaatacagtatcttg

SEQ ID NO: 2021 - DNA, 20 bp, Artificial sequence
  SiRNA target sequence
ttataaatacagtatcttgt

SEQ ID NO: 2022 - DNA, 20 bp, Artificial sequence
  SiRNA target sequence
tataaatacagtatcttgta

SEQ ID NO: 2023 - DNA, 20 bp, Artificial sequence
  SiRNA target sequence
ataaatacagtatcttgtat

SEQ ID NO: 2024 - DNA, 20 bp, Artificial sequence
  SiRNA target sequence
taaatacagtatcttgtata

SEQ ID NO: 2025 - DNA, 20 bp, Artificial sequence
  SiRNA target sequence
aaatacagtatcttgtatag

SEQ ID NO: 2026 - DNA, 20 bp, Artificial sequence
  SiRNA target sequence
aatacagtatcttgtataga

SEQ ID NO: 2027 - DNA, 20 bp, Artificial sequence
  SiRNA target sequence
atacagtatcttgtatagag

SEQ ID NO: 2028 - DNA, 20 bp, Artificial sequence
  SiRNA target sequence
tacagtatcttgtatagagc

SEQ ID NO: 2029 - DNA, 20 bp, Artificial sequence
  SiRNA target sequence
acagtatcttgtatagagca

SEQ ID NO: 2030 - DNA, 20 bp, Artificial sequence
  SiRNA target sequence
cagtatcttgtatagagcat

SEQ ID NO: 2031 - DNA, 20 bp, Artificial sequence
  SiRNA target sequence
agtatcttgtatagagcata

SEQ ID NO: 2032 - DNA, 20 bp, Artificial sequence
  SiRNA target sequence
gtatcttgtatagagcatat

SEQ ID NO: 2033 - DNA, 20 bp, Artificial sequence
  SiRNA target sequence
tatcttgtatagagcatatt

SEQ ID NO: 2034 - DNA, 20 bp, Artificial sequence
  SiRNA target sequence
atcttgtatagagcatattt

SEQ ID NO: 2035 - DNA, 20 bp, Artificial sequence
  SiRNA target sequence
tcttgtatagagcatatttt

SEQ ID NO: 2036 - DNA, 20 bp, Artificial sequence
  SiRNA target sequence
cttgtatagagcatattttc

SEQ ID NO: 2037 - DNA, 20 bp, Artificial sequence
  SiRNA target sequence
ttgtatagagcatattttct

SEQ ID NO: 2038 - DNA, 20 bp, Artificial sequence
  SiRNA target sequence
tgtatagagcatattttctt

SEQ ID NO: 2039 - DNA, 20 bp, Artificial sequence
  SiRNA target sequence
gtatagagcatattttctta

SEQ ID NO: 2040 - DNA, 20 bp, Artificial sequence
  SiRNA target sequence
tatagagcatattttcttac

SEQ ID NO: 2041 - DNA, 20 bp, Artificial sequence
  SiRNA target sequence
atagagcatattttcttaca

SEQ ID NO: 2042 - DNA, 20 bp, Artificial sequence
  SiRNA target sequence
tagagcatattttcttacat

SEQ ID NO: 2043 - DNA, 20 bp, Artificial sequence
  SiRNA target sequence
agagcatattttcttacatt

SEQ ID NO: 2044 - DNA, 20 bp, Artificial sequence
  SiRNA target sequence
gagcatattttcttacattg

SEQ ID NO: 2045 - DNA, 20 bp, Artificial sequence
  SiRNA target sequence
agcatattttcttacattga

SEQ ID NO: 2046 - DNA, 20 bp, Artificial sequence
  SiRNA target sequence
gcatattttcttacattgaa

SEQ ID NO: 2047 - DNA, 20 bp, Artificial sequence
  SiRNA target sequence
catattttcttacattgaag

SEQ ID NO: 2048 - DNA, 20 bp, Artificial sequence
  SiRNA target sequence
atattttcttacattgaaga

SEQ ID NO: 2049 - DNA, 20 bp, Artificial sequence
  SiRNA target sequence
tattttcttacattgaagaa

SEQ ID NO: 2050 - DNA, 20 bp, Artificial sequence
  SiRNA target sequence
attttcttacattgaagaat

SEQ ID NO: 2051 - DNA, 20 bp, Artificial sequence
  SiRNA target sequence
ttttcttacattgaagaatg

SEQ ID NO: 2052 - DNA, 20 bp, Artificial sequence
  SiRNA target sequence
tttcttacattgaagaatga

SEQ ID NO: 2053 - DNA, 20 bp, Artificial sequence
  SiRNA target sequence
ttcttacattgaagaatgaa

SEQ ID NO: 2054 - DNA, 20 bp, Artificial sequence
  SiRNA target sequence
tcttacattgaagaatgaat

SEQ ID NO: 2055 - DNA, 20 bp, Artificial sequence
  SiRNA target sequence
cttacattgaagaatgaata

SEQ ID NO: 2056 - DNA, 20 bp, Artificial sequence
  SiRNA target sequence
ttacattgaagaatgaatat

SEQ ID NO: 2057 - DNA, 20 bp, Artificial sequence
  SiRNA target sequence
tacattgaagaatgaatata

SEQ ID NO: 2058 - DNA, 20 bp, Artificial sequence
  SiRNA target sequence
acattgaagaatgaatatat

SEQ ID NO: 2059 - DNA, 20 bp, Artificial sequence
  SiRNA target sequence
cattgaagaatgaatatatt

SEQ ID NO: 2060 - DNA, 20 bp, Artificial sequence
  SiRNA target sequence
attgaagaatgaatatattt

SEQ ID NO: 2061 - DNA, 20 bp, Artificial sequence
  SiRNA target sequence
ttgaagaatgaatatatttc

SEQ ID NO: 2062 - DNA, 20 bp, Artificial sequence
  SiRNA target sequence
tgaagaatgaatatatttca

SEQ ID NO: 2063 - DNA, 20 bp, Artificial sequence
  SiRNA target sequence
gaagaatgaatatatttcat

SEQ ID NO: 2064 - DNA, 20 bp, Artificial sequence
  SiRNA target sequence
aagaatgaatatatttcatc

SEQ ID NO: 2065 - DNA, 20 bp, Artificial sequence
  SiRNA target sequence
agaatgaatatatttcatct

SEQ ID NO: 2066 - DNA, 20 bp, Artificial sequence
  SiRNA target sequence
gaatgaatatatttcatctt

SEQ ID NO: 2067 - DNA, 20 bp, Artificial sequence
  SiRNA target sequence
aatgaatatatttcatcttc

SEQ ID NO: 2068 - DNA, 20 bp, Artificial sequence
  SiRNA target sequence
atgaatatatttcatcttca

SEQ ID NO: 2069 - DNA, 20 bp, Artificial sequence
  SiRNA target sequence
tgaatatatttcatcttcat

SEQ ID NO: 2070 - DNA, 20 bp, Artificial sequence
  SiRNA target sequence
gaatatatttcatcttcatt

SEQ ID NO: 2071 - DNA, 20 bp, Artificial sequence
  SiRNA target sequence
aatatatttcatcttcattg

SEQ ID NO: 2072 - DNA, 20 bp, Artificial sequence
  SiRNA target sequence
atatatttcatcttcattgc

SEQ ID NO: 2073 - DNA, 20 bp, Artificial sequence
  SiRNA target sequence
tatatttcatcttcattgcc

SEQ ID NO: 2074 - DNA, 20 bp, Artificial sequence
  SiRNA target sequence
atatttcatcttcattgcct

SEQ ID NO: 2075 - DNA, 20 bp, Artificial sequence
  SiRNA target sequence
tatttcatcttcattgcctt

SEQ ID NO: 2076 - DNA, 20 bp, Artificial sequence
  SiRNA target sequence
atttcatcttcattgccttt

SEQ ID NO: 2077 - DNA, 20 bp, Artificial sequence
  SiRNA target sequence
tttcatcttcattgccttta

SEQ ID NO: 2078 - DNA, 20 bp, Artificial sequence
  SiRNA target sequence
ttcatcttcattgcctttag

SEQ ID NO: 2079 - DNA, 20 bp, Artificial sequence
  SiRNA target sequence
tcatcttcattgcctttaga

SEQ ID NO: 2080 - DNA, 20 bp, Artificial sequence
  SiRNA target sequence
catcttcattgcctttagat

SEQ ID NO: 2081 - DNA, 20 bp, Artificial sequence
  SiRNA target sequence
atcttcattgcctttagatg

SEQ ID NO: 2082 - DNA, 20 bp, Artificial sequence
  SiRNA target sequence
tcttcattgcctttagatga

SEQ ID NO: 2083 - DNA, 20 bp, Artificial sequence
  SiRNA target sequence
cttcattgcctttagatgac

SEQ ID NO: 2084 - DNA, 20 bp, Artificial sequence
  SiRNA target sequence
ttcattgcctttagatgacg

SEQ ID NO: 2085 - DNA, 20 bp, Artificial sequence
  SiRNA target sequence
tcattgcctttagatgacga

SEQ ID NO: 2086 - DNA, 20 bp, Artificial sequence
  SiRNA target sequence
cattgcctttagatgacgag

SEQ ID NO: 2087 - DNA, 20 bp, Artificial sequence
  SiRNA target sequence
attgcctttagatgacgaga

SEQ ID NO: 2088 - DNA, 20 bp, Artificial sequence
  SiRNA target sequence
ttgcctttagatgacgagat

SEQ ID NO: 2089 - DNA, 20 bp, Artificial sequence
  SiRNA target sequence
tgcctttagatgacgagatt

SEQ ID NO: 2090 - DNA, 20 bp, Artificial sequence
  SiRNA target sequence
gcctttagatgacgagatta

SEQ ID NO: 2091 - DNA, 20 bp, Artificial sequence
  SiRNA target sequence
cctttagatgacgagattac

SEQ ID NO: 2092 - DNA, 20 bp, Artificial sequence
  SiRNA target sequence
ctttagatgacgagattact

SEQ ID NO: 2093 - DNA, 20 bp, Artificial sequence
  SiRNA target sequence
tttagatgacgagattacta

SEQ ID NO: 2094 - DNA, 20 bp, Artificial sequence
  SiRNA target sequence
ttagatgacgagattactac

SEQ ID NO: 2095 - DNA, 20 bp, Artificial sequence
  SiRNA target sequence
tagatgacgagattactacg

SEQ ID NO: 2096 - DNA, 20 bp, Artificial sequence
  SiRNA target sequence
agatgacgagattactacgc

SEQ ID NO: 2097 - DNA, 20 bp, Artificial sequence
  SiRNA target sequence
gatgacgagattactacgct

SEQ ID NO: 2098 - DNA, 20 bp, Artificial sequence
  SiRNA target sequence
atgacgagattactacgctt

SEQ ID NO: 2099 - DNA, 20 bp, Artificial sequence
  SiRNA target sequence
tgacgagattactacgcttt

SEQ ID NO: 2100 - DNA, 20 bp, Artificial sequence
  SiRNA target sequence
gacgagattactacgcttta

SEQ ID NO: 2101 - DNA, 20 bp, Artificial sequence
  SiRNA target sequence
acgagattactacgctttac

SEQ ID NO: 2102 - DNA, 20 bp, Artificial sequence
  SiRNA target sequence
cgagattactacgctttact

SEQ ID NO: 2103 - DNA, 20 bp, Artificial sequence
  SiRNA target sequence
gagattactacgctttactt

SEQ ID NO: 2104 - DNA, 20 bp, Artificial sequence
  SiRNA target sequence
agattactacgctttacttg

SEQ ID NO: 2105 - DNA, 20 bp, Artificial sequence
  SiRNA target sequence
gattactacgctttacttgt

SEQ ID NO: 2106 - DNA, 20 bp, Artificial sequence
  SiRNA target sequence
attactacgctttacttgta

SEQ ID NO: 2107 - DNA, 20 bp, Artificial sequence
  SiRNA target sequence
ttactacgctttacttgtat

SEQ ID NO: 2108 - DNA, 20 bp, Artificial sequence
  SiRNA target sequence
tactacgctttacttgtatt

SEQ ID NO: 2109 - DNA, 20 bp, Artificial sequence
  SiRNA target sequence
actacgctttacttgtattc

SEQ ID NO: 2110 - DNA, 20 bp, Artificial sequence
  SiRNA target sequence
ctacgctttacttgtattct

SEQ ID NO: 2111 - DNA, 20 bp, Artificial sequence
  SiRNA target sequence
tacgctttacttgtattcta

SEQ ID NO: 2112 - DNA, 20 bp, Artificial sequence
  SiRNA target sequence
acgctttacttgtattctaa

SEQ ID NO: 2113 - DNA, 20 bp, Artificial sequence
  SiRNA target sequence
cgctttacttgtattctaag

SEQ ID NO: 2114 - DNA, 20 bp, Artificial sequence
  SiRNA target sequence
gctttacttgtattctaaga

SEQ ID NO: 2115 - DNA, 20 bp, Artificial sequence
  SiRNA target sequence
ctttacttgtattctaagat

SEQ ID NO: 2116 - DNA, 20 bp, Artificial sequence
  SiRNA target sequence
tttacttgtattctaagatt

SEQ ID NO: 2117 - DNA, 20 bp, Artificial sequence
  SiRNA target sequence
ttacttgtattctaagattt

SEQ ID NO: 2118 - DNA, 20 bp, Artificial sequence
  SiRNA target sequence
tacttgtattctaagatttt

SEQ ID NO: 2119 - DNA, 20 bp, Artificial sequence
  SiRNA target sequence
acttgtattctaagattttt

SEQ ID NO: 2120 - DNA, 20 bp, Artificial sequence
  SiRNA target sequence
cttgtattctaagattttta

SEQ ID NO: 2121 - DNA, 20 bp, Artificial sequence
  SiRNA target sequence
ttgtattctaagatttttaa

SEQ ID NO: 2122 - DNA, 20 bp, Artificial sequence
  SiRNA target sequence
tgtattctaagatttttaaa

SEQ ID NO: 2123 - DNA, 20 bp, Artificial sequence
  SiRNA target sequence
gtattctaagatttttaaag

SEQ ID NO: 2124 - DNA, 20 bp, Artificial sequence
  SiRNA target sequence
tattctaagatttttaaaga

SEQ ID NO: 2125 - DNA, 20 bp, Artificial sequence
  SiRNA target sequence
attctaagatttttaaagat

SEQ ID NO: 2126 - DNA, 20 bp, Artificial sequence
  SiRNA target sequence
ttctaagatttttaaagata

SEQ ID NO: 2127 - DNA, 20 bp, Artificial sequence
  SiRNA target sequence
tctaagatttttaaagataa

SEQ ID NO: 2128 - DNA, 20 bp, Artificial sequence
  SiRNA target sequence
ctaagatttttaaagataaa

SEQ ID NO: 2129 - DNA, 20 bp, Artificial sequence
  SiRNA target sequence
taagatttttaaagataaat

SEQ ID NO: 2130 - DNA, 20 bp, Artificial sequence
  SiRNA target sequence
aagatttttaaagataaatc

SEQ ID NO: 2131 - DNA, 20 bp, Artificial sequence
  SiRNA target sequence
agatttttaaagataaatct

SEQ ID NO: 2132 - DNA, 20 bp, Artificial sequence
  SiRNA target sequence
gatttttaaagataaatctg

SEQ ID NO: 2133 - DNA, 20 bp, Artificial sequence
  SiRNA target sequence
atttttaaagataaatctga

SEQ ID NO: 2134 - DNA, 20 bp, Artificial sequence
  SiRNA target sequence
tttttaaagataaatctgat

SEQ ID NO: 2135 - DNA, 20 bp, Artificial sequence
  SiRNA target sequence
ttttaaagataaatctgata

SEQ ID NO: 2136 - DNA, 20 bp, Artificial sequence
  SiRNA target sequence
tttaaagataaatctgatac

SEQ ID NO: 2137 - DNA, 20 bp, Artificial sequence
  SiRNA target sequence
ttaaagataaatctgatact

SEQ ID NO: 2138 - DNA, 20 bp, Artificial sequence
  SiRNA target sequence
taaagataaatctgatactt

SEQ ID NO: 2139 - DNA, 20 bp, Artificial sequence
  SiRNA target sequence
aaagataaatctgatactta

SEQ ID NO: 2140 - DNA, 20 bp, Artificial sequence
  SiRNA target sequence
aagataaatctgatacttac

SEQ ID NO: 2141 - DNA, 20 bp, Artificial sequence
  SiRNA target sequence
agataaatctgatacttacc

SEQ ID NO: 2142 - DNA, 20 bp, Artificial sequence
  SiRNA target sequence
gataaatctgatacttacct

SEQ ID NO: 2143 - DNA, 20 bp, Artificial sequence
  SiRNA target sequence
ataaatctgatacttacctt

SEQ ID NO: 2144 - DNA, 20 bp, Artificial sequence
  SiRNA target sequence
taaatctgatacttacctta

SEQ ID NO: 2145 - DNA, 20 bp, Artificial sequence
  SiRNA target sequence
aaatctgatacttaccttaa

SEQ ID NO: 2146 - DNA, 20 bp, Artificial sequence
  SiRNA target sequence
aatctgatacttaccttaaa

SEQ ID NO: 2147 - DNA, 20 bp, Artificial sequence
  SiRNA target sequence
atctgatacttaccttaaat

SEQ ID NO: 2148 - DNA, 20 bp, Artificial sequence
  SiRNA target sequence
tctgatacttaccttaaatc

SEQ ID NO: 2149 - DNA, 20 bp, Artificial sequence
  SiRNA target sequence
ctgatacttaccttaaatct

SEQ ID NO: 2150 - DNA, 20 bp, Artificial sequence
  SiRNA target sequence
tgatacttaccttaaatctg

SEQ ID NO: 2151 - DNA, 20 bp, Artificial sequence
  SiRNA target sequence
gatacttaccttaaatctgc

SEQ ID NO: 2152 - DNA, 20 bp, Artificial sequence
  SiRNA target sequence
atacttaccttaaatctgct

SEQ ID NO: 2153 - DNA, 20 bp, Artificial sequence
  SiRNA target sequence
tacttaccttaaatctgcta

SEQ ID NO: 2154 - DNA, 20 bp, Artificial sequence
  SiRNA target sequence
acttaccttaaatctgctat

SEQ ID NO: 2155 - DNA, 20 bp, Artificial sequence
  SiRNA target sequence
cttaccttaaatctgctata

SEQ ID NO: 2156 - DNA, 20 bp, Artificial sequence
  SiRNA target sequence
ttaccttaaatctgctatag

SEQ ID NO: 2157 - DNA, 20 bp, Artificial sequence
  SiRNA target sequence
taccttaaatctgctataga

SEQ ID NO: 2158 - DNA, 20 bp, Artificial sequence
  SiRNA target sequence
accttaaatctgctatagat

SEQ ID NO: 2159 - DNA, 20 bp, Artificial sequence
  SiRNA target sequence
ccttaaatctgctatagata

SEQ ID NO: 2160 - DNA, 20 bp, Artificial sequence
  SiRNA target sequence
cttaaatctgctatagataa

SEQ ID NO: 2161 - DNA, 20 bp, Artificial sequence
  SiRNA target sequence
ttaaatctgctatagataaa

SEQ ID NO: 2162 - DNA, 20 bp, Artificial sequence
  SiRNA target sequence
taaatctgctatagataaat

SEQ ID NO: 2163 - DNA, 20 bp, Artificial sequence
  SiRNA target sequence
aaatctgctatagataaatc

SEQ ID NO: 2164 - DNA, 20 bp, Artificial sequence
  SiRNA target sequence
aatctgctatagataaatca

SEQ ID NO: 2165 - DNA, 20 bp, Artificial sequence
  SiRNA target sequence
atctgctatagataaatcag

SEQ ID NO: 2166 - DNA, 20 bp, Artificial sequence
  SiRNA target sequence
tctgctatagataaatcagt

SEQ ID NO: 2167 - DNA, 20 bp, Artificial sequence
  SiRNA target sequence
ctgctatagataaatcagta

SEQ ID NO: 2168 - DNA, 20 bp, Artificial sequence
  SiRNA target sequence
tgctatagataaatcagtag

SEQ ID NO: 2169 - DNA, 20 bp, Artificial sequence
  SiRNA target sequence
gctatagataaatcagtaga

SEQ ID NO: 2170 - DNA, 20 bp, Artificial sequence
  SiRNA target sequence
ctatagataaatcagtagat

SEQ ID NO: 2171 - DNA, 20 bp, Artificial sequence
  SiRNA target sequence
tatagataaatcagtagatc

SEQ ID NO: 2172 - DNA, 20 bp, Artificial sequence
  SiRNA target sequence
atagataaatcagtagatct

SEQ ID NO: 2173 - DNA, 20 bp, Artificial sequence
  SiRNA target sequence
tagataaatcagtagatcta

SEQ ID NO: 2174 - DNA, 20 bp, Artificial sequence
  SiRNA target sequence
agataaatcagtagatctac

SEQ ID NO: 2175 - DNA, 20 bp, Artificial sequence
  SiRNA target sequence
gataaatcagtagatctacc

SEQ ID NO: 2176 - DNA, 20 bp, Artificial sequence
  SiRNA target sequence
ataaatcagtagatctacct

SEQ ID NO: 2177 - DNA, 20 bp, Artificial sequence
  SiRNA target sequence
taaatcagtagatctaccta

SEQ ID NO: 2178 - DNA, 20 bp, Artificial sequence
  SiRNA target sequence
aaatcagtagatctacctat

SEQ ID NO: 2179 - DNA, 20 bp, Artificial sequence
  SiRNA target sequence
aatcagtagatctacctatt

SEQ ID NO: 2180 - DNA, 20 bp, Artificial sequence
  SiRNA target sequence
atcagtagatctacctattg

SEQ ID NO: 2181 - DNA, 20 bp, Artificial sequence
  SiRNA target sequence
tcagtagatctacctattga

SEQ ID NO: 2182 - DNA, 20 bp, Artificial sequence
  SiRNA target sequence
cagtagatctacctattgaa

SEQ ID NO: 2183 - DNA, 20 bp, Artificial sequence
  SiRNA target sequence
agtagatctacctattgaac

SEQ ID NO: 2184 - DNA, 20 bp, Artificial sequence
  SiRNA target sequence
gtagatctacctattgaaca

SEQ ID NO: 2185 - DNA, 20 bp, Artificial sequence
  SiRNA target sequence
tagatctacctattgaacag

SEQ ID NO: 2186 - DNA, 20 bp, Artificial sequence
  SiRNA target sequence
agatctacctattgaacaga

SEQ ID NO: 2187 - DNA, 20 bp, Artificial sequence
  SiRNA target sequence
gatctacctattgaacagaa

SEQ ID NO: 2188 - DNA, 20 bp, Artificial sequence
  SiRNA target sequence
atctacctattgaacagaaa

SEQ ID NO: 2189 - DNA, 20 bp, Artificial sequence
  SiRNA target sequence
tctacctattgaacagaaag

SEQ ID NO: 2190 - DNA, 20 bp, Artificial sequence
  SiRNA target sequence
ctacctattgaacagaaaga

SEQ ID NO: 2191 - DNA, 20 bp, Artificial sequence
  SiRNA target sequence
tacctattgaacagaaagac

SEQ ID NO: 2192 - DNA, 20 bp, Artificial sequence
  SiRNA target sequence
acctattgaacagaaagact

SEQ ID NO: 2193 - DNA, 20 bp, Artificial sequence
  SiRNA target sequence
cctattgaacagaaagactt

SEQ ID NO: 2194 - DNA, 20 bp, Artificial sequence
  SiRNA target sequence
ctattgaacagaaagacttt

SEQ ID NO: 2195 - DNA, 20 bp, Artificial sequence
  SiRNA target sequence
tattgaacagaaagactttc

SEQ ID NO: 2196 - DNA, 20 bp, Artificial sequence
  SiRNA target sequence
attgaacagaaagactttct

SEQ ID NO: 2197 - DNA, 20 bp, Artificial sequence
  SiRNA target sequence
ttgaacagaaagactttctg

SEQ ID NO: 2198 - DNA, 20 bp, Artificial sequence
  SiRNA target sequence
tgaacagaaagactttctgt

SEQ ID NO: 2199 - DNA, 20 bp, Artificial sequence
  SiRNA target sequence
gaacagaaagactttctgta

SEQ ID NO: 2200 - DNA, 20 bp, Artificial sequence
  SiRNA target sequence
aacagaaagactttctgtac

SEQ ID NO: 2201 - DNA, 20 bp, Artificial sequence
  SiRNA target sequence
acagaaagactttctgtacg

SEQ ID NO: 2202 - DNA, 20 bp, Artificial sequence
  SiRNA target sequence
cagaaagactttctgtacgt

SEQ ID NO: 2203 - DNA, 20 bp, Artificial sequence
  SiRNA target sequence
agaaagactttctgtacgta

SEQ ID NO: 2204 - DNA, 20 bp, Artificial sequence
  SiRNA target sequence
gaaagactttctgtacgtag

SEQ ID NO: 2205 - DNA, 20 bp, Artificial sequence
  SiRNA target sequence
aaagactttctgtacgtaga

SEQ ID NO: 2206 - DNA, 20 bp, Artificial sequence
  SiRNA target sequence
aagactttctgtacgtagat

SEQ ID NO: 2207 - DNA, 20 bp, Artificial sequence
  SiRNA target sequence
agactttctgtacgtagatc

SEQ ID NO: 2208 - DNA, 20 bp, Artificial sequence
  SiRNA target sequence
gactttctgtacgtagatct

SEQ ID NO: 2209 - DNA, 20 bp, Artificial sequence
  SiRNA target sequence
actttctgtacgtagatctt

SEQ ID NO: 2210 - DNA, 20 bp, Artificial sequence
  SiRNA target sequence
ctttctgtacgtagatcttc

SEQ ID NO: 2211 - DNA, 20 bp, Artificial sequence
  SiRNA target sequence
tttctgtacgtagatcttct

SEQ ID NO: 2212 - DNA, 20 bp, Artificial sequence
  SiRNA target sequence
ttctgtacgtagatcttctt

SEQ ID NO: 2213 - DNA, 20 bp, Artificial sequence
  SiRNA target sequence
tctgtacgtagatcttcttg

SEQ ID NO: 2214 - DNA, 20 bp, Artificial sequence
  SiRNA target sequence
ctgtacgtagatcttcttgt

SEQ ID NO: 2215 - DNA, 20 bp, Artificial sequence
  SiRNA target sequence
tgtacgtagatcttcttgta

SEQ ID NO: 2216 - DNA, 20 bp, Artificial sequence
  SiRNA target sequence
gtacgtagatcttcttgtat

SEQ ID NO: 2217 - DNA, 20 bp, Artificial sequence
  SiRNA target sequence
tacgtagatcttcttgtatt

SEQ ID NO: 2218 - DNA, 20 bp, Artificial sequence
  SiRNA target sequence
acgtagatcttcttgtattt

SEQ ID NO: 2219 - DNA, 20 bp, Artificial sequence
  SiRNA target sequence
cgtagatcttcttgtatttt

SEQ ID NO: 2220 - DNA, 20 bp, Artificial sequence
  SiRNA target sequence
gtagatcttcttgtatttta

SEQ ID NO: 2221 - DNA, 20 bp, Artificial sequence
  SiRNA target sequence
tagatcttcttgtattttac

SEQ ID NO: 2222 - DNA, 20 bp, Artificial sequence
  SiRNA target sequence
agatcttcttgtattttaca

SEQ ID NO: 2223 - DNA, 20 bp, Artificial sequence
  SiRNA target sequence
gatcttcttgtattttacat

SEQ ID NO: 2224 - DNA, 20 bp, Artificial sequence
  SiRNA target sequence
atcttcttgtattttacatt

SEQ ID NO: 2225 - DNA, 20 bp, Artificial sequence
  SiRNA target sequence
tcttcttgtattttacattt

SEQ ID NO: 2226 - DNA, 20 bp, Artificial sequence
  SiRNA target sequence
cttcttgtattttacatttc

SEQ ID NO: 2227 - DNA, 20 bp, Artificial sequence
  SiRNA target sequence
ttcttgtattttacatttct

SEQ ID NO: 2228 - DNA, 20 bp, Artificial sequence
  SiRNA target sequence
tcttgtattttacatttcta

SEQ ID NO: 2229 - DNA, 20 bp, Artificial sequence
  SiRNA target sequence
cttgtattttacatttctaa

SEQ ID NO: 2230 - DNA, 20 bp, Artificial sequence
  SiRNA target sequence
ttgtattttacatttctaaa

SEQ ID NO: 2231 - DNA, 20 bp, Artificial sequence
  SiRNA target sequence
tgtattttacatttctaaaa

SEQ ID NO: 2232 - DNA, 20 bp, Artificial sequence
  SiRNA target sequence
gtattttacatttctaaaaa

SEQ ID NO: 2233 - DNA, 20 bp, Artificial sequence
  SiRNA target sequence
tattttacatttctaaaaag

SEQ ID NO: 2234 - DNA, 20 bp, Artificial sequence
  SiRNA target sequence
attttacatttctaaaaagg

SEQ ID NO: 2235 - DNA, 20 bp, Artificial sequence
  SiRNA target sequence
ttttacatttctaaaaagga

SEQ ID NO: 2236 - DNA, 20 bp, Artificial sequence
  SiRNA target sequence
tttacatttctaaaaaggat

SEQ ID NO: 2237 - DNA, 20 bp, Artificial sequence
  SiRNA target sequence
ttacatttctaaaaaggatg

SEQ ID NO: 2238 - DNA, 20 bp, Artificial sequence
  SiRNA target sequence
tacatttctaaaaaggatgt

SEQ ID NO: 2239 - DNA, 20 bp, Artificial sequence
  SiRNA target sequence
acatttctaaaaaggatgtt

SEQ ID NO: 2240 - DNA, 20 bp, Artificial sequence
  SiRNA target sequence
catttctaaaaaggatgttg

SEQ ID NO: 2241 - DNA, 20 bp, Artificial sequence
  SiRNA target sequence
atttctaaaaaggatgttga

SEQ ID NO: 2242 - DNA, 20 bp, Artificial sequence
  SiRNA target sequence
tttctaaaaaggatgttgaa

SEQ ID NO: 2243 - DNA, 20 bp, Artificial sequence
  SiRNA target sequence
ttctaaaaaggatgttgaaa

SEQ ID NO: 2244 - DNA, 20 bp, Artificial sequence
  SiRNA target sequence
tctaaaaaggatgttgaaaa

SEQ ID NO: 2245 - DNA, 20 bp, Artificial sequence
  SiRNA target sequence
ctaaaaaggatgttgaaaaa

SEQ ID NO: 2246 - DNA, 20 bp, Artificial sequence
  SiRNA target sequence
taaaaaggatgttgaaaaag

SEQ ID NO: 2247 - DNA, 20 bp, Artificial sequence
  SiRNA target sequence
aaaaaggatgttgaaaaagt

SEQ ID NO: 2248 - DNA, 20 bp, Artificial sequence
  SiRNA target sequence
aaaaggatgttgaaaaagtt

SEQ ID NO: 2249 - DNA, 20 bp, Artificial sequence
  SiRNA target sequence
aaaggatgttgaaaaagtta

SEQ ID NO: 2250 - DNA, 20 bp, Artificial sequence
  SiRNA target sequence
aaggatgttgaaaaagttaa

SEQ ID NO: 2251 - DNA, 20 bp, Artificial sequence
  SiRNA target sequence
aggatgttgaaaaagttaat

SEQ ID NO: 2252 - DNA, 20 bp, Artificial sequence
  SiRNA target sequence
ggatgttgaaaaagttaatg

SEQ ID NO: 2253 - DNA, 20 bp, Artificial sequence
  SiRNA target sequence
gatgttgaaaaagttaatga

SEQ ID NO: 2254 - DNA, 20 bp, Artificial sequence
  SiRNA target sequence
atgttgaaaaagttaatgaa

SEQ ID NO: 2255 - DNA, 20 bp, Artificial sequence
  SiRNA target sequence
tgttgaaaaagttaatgaaa

SEQ ID NO: 2256 - DNA, 20 bp, Artificial sequence
  SiRNA target sequence
gttgaaaaagttaatgaaac

SEQ ID NO: 2257 - DNA, 20 bp, Artificial sequence
  SiRNA target sequence
ttgaaaaagttaatgaaaca

SEQ ID NO: 2258 - DNA, 20 bp, Artificial sequence
  SiRNA target sequence
tgaaaaagttaatgaaacaa

SEQ ID NO: 2259 - DNA, 20 bp, Artificial sequence
  SiRNA target sequence
gaaaaagttaatgaaacaat

SEQ ID NO: 2260 - DNA, 20 bp, Artificial sequence
  SiRNA target sequence
aaaaagttaatgaaacaatt

SEQ ID NO: 2261 - DNA, 20 bp, Artificial sequence
  SiRNA target sequence
aaaagttaatgaaacaatta

SEQ ID NO: 2262 - DNA, 20 bp, Artificial sequence
  SiRNA target sequence
aaagttaatgaaacaattaa

SEQ ID NO: 2263 - DNA, 20 bp, Artificial sequence
  SiRNA target sequence
aagttaatgaaacaattaat

SEQ ID NO: 2264 - DNA, 20 bp, Artificial sequence
  SiRNA target sequence
agttaatgaaacaattaata

SEQ ID NO: 2265 - DNA, 20 bp, Artificial sequence
  SiRNA target sequence
gttaatgaaacaattaataa

SEQ ID NO: 2266 - DNA, 20 bp, Artificial sequence
  SiRNA target sequence
ttaatgaaacaattaataat

SEQ ID NO: 2267 - DNA, 20 bp, Artificial sequence
  SiRNA target sequence
taatgaaacaattaataatt

SEQ ID NO: 2268 - DNA, 20 bp, Artificial sequence
  SiRNA target sequence
aatgaaacaattaataattt

SEQ ID NO: 2269 - DNA, 20 bp, Artificial sequence
  SiRNA target sequence
atgaaacaattaataattta

SEQ ID NO: 2270 - DNA, 20 bp, Artificial sequence
  SiRNA target sequence
tgaaacaattaataatttaa

SEQ ID NO: 2271 - DNA, 20 bp, Artificial sequence
  SiRNA target sequence
gaaacaattaataatttaaa

SEQ ID NO: 2272 - DNA, 20 bp, Artificial sequence
  SiRNA target sequence
aaacaattaataatttaaaa

SEQ ID NO: 2273 - DNA, 20 bp, Artificial sequence
  SiRNA target sequence
aacaattaataatttaaaag

SEQ ID NO: 2274 - DNA, 20 bp, Artificial sequence
  SiRNA target sequence
acaattaataatttaaaaga

SEQ ID NO: 2275 - DNA, 20 bp, Artificial sequence
  SiRNA target sequence
caattaataatttaaaagag

SEQ ID NO: 2276 - DNA, 20 bp, Artificial sequence
  SiRNA target sequence
aattaataatttaaaagaga

SEQ ID NO: 2277 - DNA, 20 bp, Artificial sequence
  SiRNA target sequence
attaataatttaaaagagac

SEQ ID NO: 2278 - DNA, 20 bp, Artificial sequence
  SiRNA target sequence
ttaataatttaaaagagact

SEQ ID NO: 2279 - DNA, 20 bp, Artificial sequence
  SiRNA target sequence
taataatttaaaagagactc

SEQ ID NO: 2280 - DNA, 20 bp, Artificial sequence
  SiRNA target sequence
aataatttaaaagagactct

SEQ ID NO: 2281 - DNA, 20 bp, Artificial sequence
  SiRNA target sequence
ataatttaaaagagactctt

SEQ ID NO: 2282 - DNA, 20 bp, Artificial sequence
  SiRNA target sequence
taatttaaaagagactctta

SEQ ID NO: 2283 - DNA, 20 bp, Artificial sequence
  SiRNA target sequence
aatttaaaagagactcttac

SEQ ID NO: 2284 - DNA, 20 bp, Artificial sequence
  SiRNA target sequence
atttaaaagagactcttacc

SEQ ID NO: 2285 - DNA, 20 bp, Artificial sequence
  SiRNA target sequence
tttaaaagagactcttaccc

SEQ ID NO: 2286 - DNA, 20 bp, Artificial sequence
  SiRNA target sequence
ttaaaagagactcttacccc

SEQ ID NO: 2287 - DNA, 20 bp, Artificial sequence
  SiRNA target sequence
taaaagagactcttaccccc

SEQ ID NO: 2288 - DNA, 20 bp, Artificial sequence
  SiRNA target sequence
aaaagagactcttaccccca

SEQ ID NO: 2289 - DNA, 20 bp, Artificial sequence
  SiRNA target sequence
aaagagactcttacccccac

SEQ ID NO: 2290 - DNA, 20 bp, Artificial sequence
  SiRNA target sequence
aagagactcttacccccact

SEQ ID NO: 2291 - DNA, 20 bp, Artificial sequence
  SiRNA target sequence
agagactcttacccccactt

SEQ ID NO: 2292 - DNA, 20 bp, Artificial sequence
  SiRNA target sequence
gagactcttacccccacttt

SEQ ID NO: 2293 - DNA, 20 bp, Artificial sequence
  SiRNA target sequence
agactcttacccccacttta

SEQ ID NO: 2294 - DNA, 20 bp, Artificial sequence
  SiRNA target sequence
gactcttacccccactttat

SEQ ID NO: 2295 - DNA, 20 bp, Artificial sequence
  SiRNA target sequence
actcttacccccactttatt

SEQ ID NO: 2296 - DNA, 20 bp, Artificial sequence
  SiRNA target sequence
ctcttacccccactttattg

SEQ ID NO: 2297 - DNA, 20 bp, Artificial sequence
  SiRNA target sequence
tcttacccccactttattgg

SEQ ID NO: 2298 - DNA, 20 bp, Artificial sequence
  SiRNA target sequence
cttacccccactttattgga

SEQ ID NO: 2299 - DNA, 20 bp, Artificial sequence
  SiRNA target sequence
ttacccccactttattggaa

SEQ ID NO: 2300 - DNA, 20 bp, Artificial sequence
  SiRNA target sequence
tacccccactttattggaac

SEQ ID NO: 2301 - DNA, 20 bp, Artificial sequence
  SiRNA target sequence
acccccactttattggaact

SEQ ID NO: 2302 - DNA, 20 bp, Artificial sequence
  SiRNA target sequence
cccccactttattggaactt

SEQ ID NO: 2303 - DNA, 20 bp, Artificial sequence
  SiRNA target sequence
ccccactttattggaactta

SEQ ID NO: 2304 - DNA, 20 bp, Artificial sequence
  SiRNA target sequence
cccactttattggaacttat

SEQ ID NO: 2305 - DNA, 20 bp, Artificial sequence
  SiRNA target sequence
ccactttattggaacttatt

SEQ ID NO: 2306 - DNA, 20 bp, Artificial sequence
  SiRNA target sequence
cactttattggaacttattg

SEQ ID NO: 2307 - DNA, 20 bp, Artificial sequence
  SiRNA target sequence
actttattggaacttattgg

SEQ ID NO: 2308 - DNA, 20 bp, Artificial sequence
  SiRNA target sequence
ctttattggaacttattgga

SEQ ID NO: 2309 - DNA, 20 bp, Artificial sequence
  SiRNA target sequence
tttattggaacttattggag

SEQ ID NO: 2310 - DNA, 20 bp, Artificial sequence
  SiRNA target sequence
ttattggaacttattggaga

SEQ ID NO: 2311 - DNA, 20 bp, Artificial sequence
  SiRNA target sequence
tattggaacttattggagaa

SEQ ID NO: 2312 - DNA, 20 bp, Artificial sequence
  SiRNA target sequence
attggaacttattggagaat

SEQ ID NO: 2313 - DNA, 20 bp, Artificial sequence
  SiRNA target sequence
ttggaacttattggagaata

SEQ ID NO: 2314 - DNA, 20 bp, Artificial sequence
  SiRNA target sequence
tggaacttattggagaatat

SEQ ID NO: 2315 - DNA, 20 bp, Artificial sequence
  SiRNA target sequence
ggaacttattggagaatatt

SEQ ID NO: 2316 - DNA, 20 bp, Artificial sequence
  SiRNA target sequence
gaacttattggagaatatta

SEQ ID NO: 2317 - DNA, 20 bp, Artificial sequence
  SiRNA target sequence
aacttattggagaatattat

SEQ ID NO: 2318 - DNA, 20 bp, Artificial sequence
  SiRNA target sequence
acttattggagaatattatt

SEQ ID NO: 2319 - DNA, 20 bp, Artificial sequence
  SiRNA target sequence
cttattggagaatattattt

SEQ ID NO: 2320 - DNA, 20 bp, Artificial sequence
  SiRNA target sequence
ttattggagaatattattta

SEQ ID NO: 2321 - DNA, 20 bp, Artificial sequence
  SiRNA target sequence
tattggagaatattatttaa

SEQ ID NO: 2322 - DNA, 20 bp, Artificial sequence
  SiRNA target sequence
attggagaatattatttaaa

SEQ ID NO: 2323 - DNA, 20 bp, Artificial sequence
  SiRNA target sequence
ttggagaatattatttaaaa

SEQ ID NO: 2324 - DNA, 20 bp, Artificial sequence
  SiRNA target sequence
tggagaatattatttaaaaa

SEQ ID NO: 2325 - DNA, 20 bp, Artificial sequence
  SiRNA target sequence
ggagaatattatttaaaaag

SEQ ID NO: 2326 - DNA, 20 bp, Artificial sequence
  SiRNA target sequence
gagaatattatttaaaaagt

SEQ ID NO: 2327 - DNA, 20 bp, Artificial sequence
  SiRNA target sequence
agaatattatttaaaaagtg

SEQ ID NO: 2328 - DNA, 20 bp, Artificial sequence
  SiRNA target sequence
gaatattatttaaaaagtgg

SEQ ID NO: 2329 - DNA, 20 bp, Artificial sequence
  SiRNA target sequence
aatattatttaaaaagtgga

SEQ ID NO: 2330 - DNA, 20 bp, Artificial sequence
  SiRNA target sequence
atattatttaaaaagtggaa

SEQ ID NO: 2331 - DNA, 20 bp, Artificial sequence
  SiRNA target sequence
tattatttaaaaagtggaaa

SEQ ID NO: 2332 - DNA, 20 bp, Artificial sequence
  SiRNA target sequence
attatttaaaaagtggaaat

SEQ ID NO: 2333 - DNA, 20 bp, Artificial sequence
  SiRNA target sequence
ttatttaaaaagtggaaatc

SEQ ID NO: 2334 - DNA, 20 bp, Artificial sequence
  SiRNA target sequence
tatttaaaaagtggaaatca

SEQ ID NO: 2335 - DNA, 20 bp, Artificial sequence
  SiRNA target sequence
atttaaaaagtggaaatcac

SEQ ID NO: 2336 - DNA, 20 bp, Artificial sequence
  SiRNA target sequence
tttaaaaagtggaaatcact

SEQ ID NO: 2337 - DNA, 20 bp, Artificial sequence
  SiRNA target sequence
ttaaaaagtggaaatcactc

SEQ ID NO: 2338 - DNA, 20 bp, Artificial sequence
  SiRNA target sequence
taaaaagtggaaatcactct

SEQ ID NO: 2339 - DNA, 20 bp, Artificial sequence
  SiRNA target sequence
aaaaagtggaaatcactcta

SEQ ID NO: 2340 - DNA, 20 bp, Artificial sequence
  SiRNA target sequence
aaaagtggaaatcactctaa

SEQ ID NO: 2341 - DNA, 20 bp, Artificial sequence
  SiRNA target sequence
aaagtggaaatcactctaaa

SEQ ID NO: 2342 - DNA, 20 bp, Artificial sequence
  SiRNA target sequence
aagtggaaatcactctaaaa

SEQ ID NO: 2343 - DNA, 20 bp, Artificial sequence
  SiRNA target sequence
agtggaaatcactctaaaat

SEQ ID NO: 2344 - DNA, 20 bp, Artificial sequence
  SiRNA target sequence
gtggaaatcactctaaaatg

SEQ ID NO: 2345 - DNA, 20 bp, Artificial sequence
  SiRNA target sequence
tggaaatcactctaaaatgt

SEQ ID NO: 2346 - DNA, 20 bp, Artificial sequence
  SiRNA target sequence
ggaaatcactctaaaatgtt

SEQ ID NO: 2347 - DNA, 20 bp, Artificial sequence
  SiRNA target sequence
gaaatcactctaaaatgtta

SEQ ID NO: 2348 - DNA, 20 bp, Artificial sequence
  SiRNA target sequence
aaatcactctaaaatgttag

SEQ ID NO: 2349 - DNA, 20 bp, Artificial sequence
  SiRNA target sequence
aatcactctaaaatgttaga

SEQ ID NO: 2350 - DNA, 20 bp, Artificial sequence
  SiRNA target sequence
atcactctaaaatgttagat

SEQ ID NO: 2351 - DNA, 20 bp, Artificial sequence
  SiRNA target sequence
tcactctaaaatgttagatc

SEQ ID NO: 2352 - DNA, 20 bp, Artificial sequence
  SiRNA target sequence
cactctaaaatgttagatct

SEQ ID NO: 2353 - DNA, 20 bp, Artificial sequence
  SiRNA target sequence
actctaaaatgttagatcta

SEQ ID NO: 2354 - DNA, 20 bp, Artificial sequence
  SiRNA target sequence
ctctaaaatgttagatctat

SEQ ID NO: 2355 - DNA, 20 bp, Artificial sequence
  SiRNA target sequence
tctaaaatgttagatctatt

SEQ ID NO: 2356 - DNA, 20 bp, Artificial sequence
  SiRNA target sequence
ctaaaatgttagatctatta

SEQ ID NO: 2357 - DNA, 20 bp, Artificial sequence
  SiRNA target sequence
taaaatgttagatctattat

SEQ ID NO: 2358 - DNA, 20 bp, Artificial sequence
  SiRNA target sequence
aaaatgttagatctattatc

SEQ ID NO: 2359 - DNA, 20 bp, Artificial sequence
  SiRNA target sequence
aaatgttagatctattatct

SEQ ID NO: 2360 - DNA, 20 bp, Artificial sequence
  SiRNA target sequence
aatgttagatctattatcta

SEQ ID NO: 2361 - DNA, 20 bp, Artificial sequence
  SiRNA target sequence
atgttagatctattatctag

SEQ ID NO: 2362 - DNA, 20 bp, Artificial sequence
  SiRNA target sequence
tgttagatctattatctagt

SEQ ID NO: 2363 - DNA, 20 bp, Artificial sequence
  SiRNA target sequence
gttagatctattatctagtc

SEQ ID NO: 2364 - DNA, 20 bp, Artificial sequence
  SiRNA target sequence
ttagatctattatctagtca

SEQ ID NO: 2365 - DNA, 20 bp, Artificial sequence
  SiRNA target sequence
tagatctattatctagtcat

SEQ ID NO: 2366 - DNA, 20 bp, Artificial sequence
  SiRNA target sequence
agatctattatctagtcatc

SEQ ID NO: 2367 - DNA, 20 bp, Artificial sequence
  SiRNA target sequence
gatctattatctagtcatcc

SEQ ID NO: 2368 - DNA, 20 bp, Artificial sequence
  SiRNA target sequence
atctattatctagtcatcca

SEQ ID NO: 2369 - DNA, 20 bp, Artificial sequence
  SiRNA target sequence
tctattatctagtcatccag

SEQ ID NO: 2370 - DNA, 20 bp, Artificial sequence
  SiRNA target sequence
ctattatctagtcatccaga

SEQ ID NO: 2371 - DNA, 20 bp, Artificial sequence
  SiRNA target sequence
tattatctagtcatccagat

SEQ ID NO: 2372 - DNA, 20 bp, Artificial sequence
  SiRNA target sequence
attatctagtcatccagata

SEQ ID NO: 2373 - DNA, 20 bp, Artificial sequence
  SiRNA target sequence
ttatctagtcatccagatac

SEQ ID NO: 2374 - DNA, 20 bp, Artificial sequence
  SiRNA target sequence
tatctagtcatccagatact

SEQ ID NO: 2375 - DNA, 20 bp, Artificial sequence
  SiRNA target sequence
atctagtcatccagatactc

SEQ ID NO: 2376 - DNA, 20 bp, Artificial sequence
  SiRNA target sequence
tctagtcatccagatactcc

SEQ ID NO: 2377 - DNA, 20 bp, Artificial sequence
  SiRNA target sequence
ctagtcatccagatactcct

SEQ ID NO: 2378 - DNA, 20 bp, Artificial sequence
  SiRNA target sequence
tagtcatccagatactcctg

SEQ ID NO: 2379 - DNA, 20 bp, Artificial sequence
  SiRNA target sequence
agtcatccagatactcctgg

SEQ ID NO: 2380 - DNA, 20 bp, Artificial sequence
  SiRNA target sequence
gtcatccagatactcctggt

SEQ ID NO: 2381 - DNA, 20 bp, Artificial sequence
  SiRNA target sequence
tcatccagatactcctggta

SEQ ID NO: 2382 - DNA, 20 bp, Artificial sequence
  SiRNA target sequence
catccagatactcctggtaa

SEQ ID NO: 2383 - DNA, 20 bp, Artificial sequence
  SiRNA target sequence
atccagatactcctggtaaa

SEQ ID NO: 2384 - DNA, 20 bp, Artificial sequence
  SiRNA target sequence
tccagatactcctggtaaat

SEQ ID NO: 2385 - DNA, 20 bp, Artificial sequence
  SiRNA target sequence
ccagatactcctggtaaatt

SEQ ID NO: 2386 - DNA, 20 bp, Artificial sequence
  SiRNA target sequence
cagatactcctggtaaatta

SEQ ID NO: 2387 - DNA, 20 bp, Artificial sequence
  SiRNA target sequence
agatactcctggtaaattac

SEQ ID NO: 2388 - DNA, 20 bp, Artificial sequence
  SiRNA target sequence
gatactcctggtaaattact

SEQ ID NO: 2389 - DNA, 20 bp, Artificial sequence
  SiRNA target sequence
atactcctggtaaattactt

SEQ ID NO: 2390 - DNA, 20 bp, Artificial sequence
  SiRNA target sequence
tactcctggtaaattacttt

SEQ ID NO: 2391 - DNA, 20 bp, Artificial sequence
  SiRNA target sequence
actcctggtaaattactttt

SEQ ID NO: 2392 - DNA, 20 bp, Artificial sequence
  SiRNA target sequence
ctcctggtaaattactttta

SEQ ID NO: 2393 - DNA, 20 bp, Artificial sequence
  SiRNA target sequence
tcctggtaaattacttttaa

SEQ ID NO: 2394 - DNA, 20 bp, Artificial sequence
  SiRNA target sequence
cctggtaaattacttttaac

SEQ ID NO: 2395 - DNA, 20 bp, Artificial sequence
  SiRNA target sequence
ctggtaaattacttttaacg

SEQ ID NO: 2396 - DNA, 20 bp, Artificial sequence
  SiRNA target sequence
tggtaaattacttttaacgg

SEQ ID NO: 2397 - DNA, 20 bp, Artificial sequence
  SiRNA target sequence
ggtaaattacttttaacggc

SEQ ID NO: 2398 - DNA, 20 bp, Artificial sequence
  SiRNA target sequence
gtaaattacttttaacggca

SEQ ID NO: 2399 - DNA, 20 bp, Artificial sequence
  SiRNA target sequence
taaattacttttaacggcac

SEQ ID NO: 2400 - DNA, 20 bp, Artificial sequence
  SiRNA target sequence
aaattacttttaacggcact

SEQ ID NO: 2401 - DNA, 20 bp, Artificial sequence
  SiRNA target sequence
aattacttttaacggcactt

SEQ ID NO: 2402 - DNA, 20 bp, Artificial sequence
  SiRNA target sequence
attacttttaacggcacttt

SEQ ID NO: 2403 - DNA, 20 bp, Artificial sequence
  SiRNA target sequence
ttacttttaacggcacttta

SEQ ID NO: 2404 - DNA, 20 bp, Artificial sequence
  SiRNA target sequence
tacttttaacggcactttat

SEQ ID NO: 2405 - DNA, 20 bp, Artificial sequence
  SiRNA target sequence
acttttaacggcactttatg

SEQ ID NO: 2406 - DNA, 20 bp, Artificial sequence
  SiRNA target sequence
cttttaacggcactttatgc

SEQ ID NO: 2407 - DNA, 20 bp, Artificial sequence
  SiRNA target sequence
ttttaacggcactttatgca

SEQ ID NO: 2408 - DNA, 20 bp, Artificial sequence
  SiRNA target sequence
tttaacggcactttatgcaa

SEQ ID NO: 2409 - DNA, 20 bp, Artificial sequence
  SiRNA target sequence
ttaacggcactttatgcaat

SEQ ID NO: 2410 - DNA, 20 bp, Artificial sequence
  SiRNA target sequence
taacggcactttatgcaata

SEQ ID NO: 2411 - DNA, 20 bp, Artificial sequence
  SiRNA target sequence
aacggcactttatgcaataa

SEQ ID NO: 2412 - DNA, 20 bp, Artificial sequence
  SiRNA target sequence
acggcactttatgcaataag

SEQ ID NO: 2413 - DNA, 20 bp, Artificial sequence
  SiRNA target sequence
cggcactttatgcaataagt

SEQ ID NO: 2414 - DNA, 20 bp, Artificial sequence
  SiRNA target sequence
ggcactttatgcaataagta

SEQ ID NO: 2415 - DNA, 20 bp, Artificial sequence
  SiRNA target sequence
gcactttatgcaataagtat

SEQ ID NO: 2416 - DNA, 20 bp, Artificial sequence
  SiRNA target sequence
cactttatgcaataagtatt

SEQ ID NO: 2417 - DNA, 20 bp, Artificial sequence
  SiRNA target sequence
actttatgcaataagtattg

SEQ ID NO: 2418 - DNA, 20 bp, Artificial sequence
  SiRNA target sequence
ctttatgcaataagtattga

SEQ ID NO: 2419 - DNA, 20 bp, Artificial sequence
  SiRNA target sequence
tttatgcaataagtattgat

SEQ ID NO: 2420 - DNA, 20 bp, Artificial sequence
  SiRNA target sequence
ttatgcaataagtattgata

SEQ ID NO: 2421 - DNA, 20 bp, Artificial sequence
  SiRNA target sequence
tatgcaataagtattgataa

SEQ ID NO: 2422 - DNA, 20 bp, Artificial sequence
  SiRNA target sequence
atgcaataagtattgataag

SEQ ID NO: 2423 - DNA, 20 bp, Artificial sequence
  SiRNA target sequence
tgcaataagtattgataaga

SEQ ID NO: 2424 - DNA, 20 bp, Artificial sequence
  SiRNA target sequence
gcaataagtattgataagaa

SEQ ID NO: 2425 - DNA, 20 bp, Artificial sequence
  SiRNA target sequence
caataagtattgataagaaa

SEQ ID NO: 2426 - DNA, 20 bp, Artificial sequence
  SiRNA target sequence
aataagtattgataagaaaa

SEQ ID NO: 2427 - DNA, 20 bp, Artificial sequence
  SiRNA target sequence
ataagtattgataagaaaaa

SEQ ID NO: 2428 - DNA, 20 bp, Artificial sequence
  SiRNA target sequence
taagtattgataagaaaaag

SEQ ID NO: 2429 - DNA, 20 bp, Artificial sequence
  SiRNA target sequence
aagtattgataagaaaaagg

SEQ ID NO: 2430 - DNA, 20 bp, Artificial sequence
  SiRNA target sequence
agtattgataagaaaaagga

SEQ ID NO: 2431 - DNA, 20 bp, Artificial sequence
  SiRNA target sequence
gtattgataagaaaaaggat

SEQ ID NO: 2432 - DNA, 20 bp, Artificial sequence
  SiRNA target sequence
tattgataagaaaaaggatg

SEQ ID NO: 2433 - DNA, 20 bp, Artificial sequence
  SiRNA target sequence
attgataagaaaaaggatgc

SEQ ID NO: 2434 - DNA, 20 bp, Artificial sequence
  SiRNA target sequence
ttgataagaaaaaggatgct

SEQ ID NO: 2435 - DNA, 20 bp, Artificial sequence
  SiRNA target sequence
tgataagaaaaaggatgcta

SEQ ID NO: 2436 - DNA, 20 bp, Artificial sequence
  SiRNA target sequence
gataagaaaaaggatgctat

SEQ ID NO: 2437 - DNA, 20 bp, Artificial sequence
  SiRNA target sequence
ataagaaaaaggatgctata

SEQ ID NO: 2438 - DNA, 20 bp, Artificial sequence
  SiRNA target sequence
taagaaaaaggatgctatag

SEQ ID NO: 2439 - DNA, 20 bp, Artificial sequence
  SiRNA target sequence
aagaaaaaggatgctataga

SEQ ID NO: 2440 - DNA, 20 bp, Artificial sequence
  SiRNA target sequence
agaaaaaggatgctatagaa

SEQ ID NO: 2441 - DNA, 20 bp, Artificial sequence
  SiRNA target sequence
gaaaaaggatgctatagaaa

SEQ ID NO: 2442 - DNA, 20 bp, Artificial sequence
  SiRNA target sequence
aaaaaggatgctatagaaat

SEQ ID NO: 2443 - DNA, 20 bp, Artificial sequence
  SiRNA target sequence
aaaaggatgctatagaaatt

SEQ ID NO: 2444 - DNA, 20 bp, Artificial sequence
  SiRNA target sequence
aaaggatgctatagaaattt

SEQ ID NO: 2445 - DNA, 20 bp, Artificial sequence
  SiRNA target sequence
aaggatgctatagaaatttt

SEQ ID NO: 2446 - DNA, 20 bp, Artificial sequence
  SiRNA target sequence
aggatgctatagaaatttta

SEQ ID NO: 2447 - DNA, 20 bp, Artificial sequence
  SiRNA target sequence
ggatgctatagaaattttat

SEQ ID NO: 2448 - DNA, 20 bp, Artificial sequence
  SiRNA target sequence
gatgctatagaaattttata

SEQ ID NO: 2449 - DNA, 20 bp, Artificial sequence
  SiRNA target sequence
atgctatagaaattttatat

SEQ ID NO: 2450 - DNA, 20 bp, Artificial sequence
  SiRNA target sequence
tgctatagaaattttatata

SEQ ID NO: 2451 - DNA, 20 bp, Artificial sequence
  SiRNA target sequence
gctatagaaattttatatag

SEQ ID NO: 2452 - DNA, 20 bp, Artificial sequence
  SiRNA target sequence
ctatagaaattttatataga

SEQ ID NO: 2453 - DNA, 20 bp, Artificial sequence
  SiRNA target sequence
tatagaaattttatatagaa

SEQ ID NO: 2454 - DNA, 20 bp, Artificial sequence
  SiRNA target sequence
atagaaattttatatagaag

SEQ ID NO: 2455 - DNA, 20 bp, Artificial sequence
  SiRNA target sequence
tagaaattttatatagaagt

SEQ ID NO: 2456 - DNA, 20 bp, Artificial sequence
  SiRNA target sequence
agaaattttatatagaagta

SEQ ID NO: 2457 - DNA, 20 bp, Artificial sequence
  SiRNA target sequence
gaaattttatatagaagtat

SEQ ID NO: 2458 - DNA, 20 bp, Artificial sequence
  SiRNA target sequence
aaattttatatagaagtata

SEQ ID NO: 2459 - DNA, 20 bp, Artificial sequence
  SiRNA target sequence
aattttatatagaagtatat

SEQ ID NO: 2460 - DNA, 20 bp, Artificial sequence
  SiRNA target sequence
attttatatagaagtatatc

SEQ ID NO: 2461 - DNA, 20 bp, Artificial sequence
  SiRNA target sequence
ttttatatagaagtatatca

SEQ ID NO: 2462 - DNA, 20 bp, Artificial sequence
  SiRNA target sequence
tttatatagaagtatatcag

SEQ ID NO: 2463 - DNA, 20 bp, Artificial sequence
  SiRNA target sequence
ttatatagaagtatatcaga

SEQ ID NO: 2464 - DNA, 20 bp, Artificial sequence
  SiRNA target sequence
tatatagaagtatatcagaa

SEQ ID NO: 2465 - DNA, 20 bp, Artificial sequence
  SiRNA target sequence
atatagaagtatatcagaat

SEQ ID NO: 2466 - DNA, 20 bp, Artificial sequence
  SiRNA target sequence
tatagaagtatatcagaata

SEQ ID NO: 2467 - DNA, 20 bp, Artificial sequence
  SiRNA target sequence
atagaagtatatcagaatat

SEQ ID NO: 2468 - DNA, 20 bp, Artificial sequence
  SiRNA target sequence
tagaagtatatcagaatatt

SEQ ID NO: 2469 - DNA, 20 bp, Artificial sequence
  SiRNA target sequence
agaagtatatcagaatattc

SEQ ID NO: 2470 - DNA, 20 bp, Artificial sequence
  SiRNA target sequence
gaagtatatcagaatattca

SEQ ID NO: 2471 - DNA, 20 bp, Artificial sequence
  SiRNA target sequence
aagtatatcagaatattcat

SEQ ID NO: 2472 - DNA, 20 bp, Artificial sequence
  SiRNA target sequence
agtatatcagaatattcatc

SEQ ID NO: 2473 - DNA, 20 bp, Artificial sequence
  SiRNA target sequence
gtatatcagaatattcatct

SEQ ID NO: 2474 - DNA, 20 bp, Artificial sequence
  SiRNA target sequence
tatatcagaatattcatctt

SEQ ID NO: 2475 - DNA, 20 bp, Artificial sequence
  SiRNA target sequence
atatcagaatattcatctta

SEQ ID NO: 2476 - DNA, 20 bp, Artificial sequence
  SiRNA target sequence
tatcagaatattcatcttat

SEQ ID NO: 2477 - DNA, 20 bp, Artificial sequence
  SiRNA target sequence
atcagaatattcatcttatt

SEQ ID NO: 2478 - DNA, 20 bp, Artificial sequence
  SiRNA target sequence
tcagaatattcatcttattt

SEQ ID NO: 2479 - DNA, 20 bp, Artificial sequence
  SiRNA target sequence
cagaatattcatcttatttt

SEQ ID NO: 2480 - DNA, 20 bp, Artificial sequence
  SiRNA target sequence
agaatattcatcttatttta

SEQ ID NO: 2481 - DNA, 20 bp, Artificial sequence
  SiRNA target sequence
gaatattcatcttattttaa

SEQ ID NO: 2482 - DNA, 20 bp, Artificial sequence
  SiRNA target sequence
aatattcatcttattttaaa

SEQ ID NO: 2483 - DNA, 20 bp, Artificial sequence
  SiRNA target sequence
atattcatcttattttaaat

SEQ ID NO: 2484 - DNA, 20 bp, Artificial sequence
  SiRNA target sequence
tattcatcttattttaaatc

SEQ ID NO: 2485 - DNA, 20 bp, Artificial sequence
  SiRNA target sequence
attcatcttattttaaatct

SEQ ID NO: 2486 - DNA, 20 bp, Artificial sequence
  SiRNA target sequence
ttcatcttattttaaatctt

SEQ ID NO: 2487 - DNA, 20 bp, Artificial sequence
  SiRNA target sequence
tcatcttattttaaatctta

SEQ ID NO: 2488 - DNA, 20 bp, Artificial sequence
  SiRNA target sequence
catcttattttaaatcttat

SEQ ID NO: 2489 - DNA, 20 bp, Artificial sequence
  SiRNA target sequence
atcttattttaaatcttatt

SEQ ID NO: 2490 - DNA, 20 bp, Artificial sequence
  SiRNA target sequence
tcttattttaaatcttattt

SEQ ID NO: 2491 - DNA, 20 bp, Artificial sequence
  SiRNA target sequence
cttattttaaatcttatttg

SEQ ID NO: 2492 - DNA, 20 bp, Artificial sequence
  SiRNA target sequence
ttattttaaatcttatttgt

SEQ ID NO: 2493 - DNA, 20 bp, Artificial sequence
  SiRNA target sequence
tattttaaatcttatttgta

SEQ ID NO: 2494 - DNA, 20 bp, Artificial sequence
  SiRNA target sequence
attttaaatcttatttgtat

SEQ ID NO: 2495 - DNA, 20 bp, Artificial sequence
  SiRNA target sequence
ttttaaatcttatttgtatt

SEQ ID NO: 2496 - DNA, 20 bp, Artificial sequence
  SiRNA target sequence
tttaaatcttatttgtattt

SEQ ID NO: 2497 - DNA, 20 bp, Artificial sequence
  SiRNA target sequence
ttaaatcttatttgtattta

SEQ ID NO: 2498 - DNA, 20 bp, Artificial sequence
  SiRNA target sequence
taaatcttatttgtatttag

SEQ ID NO: 2499 - DNA, 20 bp, Artificial sequence
  SiRNA target sequence
aaatcttatttgtatttagg

SEQ ID NO: 2500 - DNA, 20 bp, Artificial sequence
  SiRNA target sequence
aatcttatttgtatttagga

SEQ ID NO: 2501 - DNA, 20 bp, Artificial sequence
  SiRNA target sequence
atcttatttgtatttaggaa

SEQ ID NO: 2502 - DNA, 20 bp, Artificial sequence
  SiRNA target sequence
tcttatttgtatttaggaaa

SEQ ID NO: 2503 - DNA, 20 bp, Artificial sequence
  SiRNA target sequence
cttatttgtatttaggaaat

SEQ ID NO: 2504 - DNA, 20 bp, Artificial sequence
  SiRNA target sequence
ttatttgtatttaggaaata

SEQ ID NO: 2505 - DNA, 20 bp, Artificial sequence
  SiRNA target sequence
tatttgtatttaggaaatat

SEQ ID NO: 2506 - DNA, 20 bp, Artificial sequence
  SiRNA target sequence
atttgtatttaggaaatatt

SEQ ID NO: 2507 - DNA, 20 bp, Artificial sequence
  SiRNA target sequence
tttgtatttaggaaatattt

SEQ ID NO: 2508 - DNA, 20 bp, Artificial sequence
  SiRNA target sequence
ttgtatttaggaaatatttt

SEQ ID NO: 2509 - DNA, 20 bp, Artificial sequence
  SiRNA target sequence
tgtatttaggaaatatttta

SEQ ID NO: 2510 - DNA, 20 bp, Artificial sequence
  SiRNA target sequence
gtatttaggaaatattttaa

SEQ ID NO: 2511 - DNA, 20 bp, Artificial sequence
  SiRNA target sequence
tatttaggaaatattttaat

SEQ ID NO: 2512 - DNA, 20 bp, Artificial sequence
  SiRNA target sequence
atttaggaaatattttaata

SEQ ID NO: 2513 - DNA, 20 bp, Artificial sequence
  SiRNA target sequence
tttaggaaatattttaataa

SEQ ID NO: 2514 - DNA, 20 bp, Artificial sequence
  SiRNA target sequence
ttaggaaatattttaataaa

SEQ ID NO: 2515 - DNA, 20 bp, Artificial sequence
  SiRNA target sequence
taggaaatattttaataaat

SEQ ID NO: 2516 - DNA, 20 bp, Artificial sequence
  SiRNA target sequence
aggaaatattttaataaatg

SEQ ID NO: 2517 - DNA, 20 bp, Artificial sequence
  SiRNA target sequence
ggaaatattttaataaatga

SEQ ID NO: 2518 - DNA, 20 bp, Artificial sequence
  SiRNA target sequence
gaaatattttaataaatgat

SEQ ID NO: 2519 - DNA, 20 bp, Artificial sequence
  SiRNA target sequence
aaatattttaataaatgatg

SEQ ID NO: 2520 - DNA, 20 bp, Artificial sequence
  SiRNA target sequence
aatattttaataaatgatga

SEQ ID NO: 2521 - DNA, 20 bp, Artificial sequence
  SiRNA target sequence
atattttaataaatgatgac

SEQ ID NO: 2522 - DNA, 20 bp, Artificial sequence
  SiRNA target sequence
tattttaataaatgatgact

SEQ ID NO: 2523 - DNA, 20 bp, Artificial sequence
  SiRNA target sequence
attttaataaatgatgactt

SEQ ID NO: 2524 - DNA, 20 bp, Artificial sequence
  SiRNA target sequence
ttttaataaatgatgactta

SEQ ID NO: 2525 - DNA, 20 bp, Artificial sequence
  SiRNA target sequence
tttaataaatgatgacttaa

SEQ ID NO: 2526 - DNA, 20 bp, Artificial sequence
  SiRNA target sequence
ttaataaatgatgacttaaa

SEQ ID NO: 2527 - DNA, 20 bp, Artificial sequence
  SiRNA target sequence
taataaatgatgacttaaat

SEQ ID NO: 2528 - DNA, 20 bp, Artificial sequence
  SiRNA target sequence
aataaatgatgacttaaatg

SEQ ID NO: 2529 - DNA, 20 bp, Artificial sequence
  SiRNA target sequence
ataaatgatgacttaaatga

SEQ ID NO: 2530 - DNA, 20 bp, Artificial sequence
  SiRNA target sequence
taaatgatgacttaaatgaa

SEQ ID NO: 2531 - DNA, 20 bp, Artificial sequence
  SiRNA target sequence
aaatgatgacttaaatgaat

SEQ ID NO: 2532 - DNA, 20 bp, Artificial sequence
  SiRNA target sequence
aatgatgacttaaatgaatg

SEQ ID NO: 2533 - DNA, 20 bp, Artificial sequence
  SiRNA target sequence
atgatgacttaaatgaatgc

SEQ ID NO: 2534 - DNA, 20 bp, Artificial sequence
  SiRNA target sequence
tgatgacttaaatgaatgca

SEQ ID NO: 2535 - DNA, 20 bp, Artificial sequence
  SiRNA target sequence
gatgacttaaatgaatgcag

SEQ ID NO: 2536 - DNA, 20 bp, Artificial sequence
  SiRNA target sequence
atgacttaaatgaatgcagg

SEQ ID NO: 2537 - DNA, 20 bp, Artificial sequence
  SiRNA target sequence
tgacttaaatgaatgcagga

SEQ ID NO: 2538 - DNA, 20 bp, Artificial sequence
  SiRNA target sequence
gacttaaatgaatgcaggaa

SEQ ID NO: 2539 - DNA, 20 bp, Artificial sequence
  SiRNA target sequence
acttaaatgaatgcaggaaa

SEQ ID NO: 2540 - DNA, 20 bp, Artificial sequence
  SiRNA target sequence
cttaaatgaatgcaggaaat

SEQ ID NO: 2541 - DNA, 20 bp, Artificial sequence
  SiRNA target sequence
ttaaatgaatgcaggaaatt

SEQ ID NO: 2542 - DNA, 20 bp, Artificial sequence
  SiRNA target sequence
taaatgaatgcaggaaattg

SEQ ID NO: 2543 - DNA, 20 bp, Artificial sequence
  SiRNA target sequence
aaatgaatgcaggaaattgt

SEQ ID NO: 2544 - DNA, 20 bp, Artificial sequence
  SiRNA target sequence
aatgaatgcaggaaattgtt

SEQ ID NO: 2545 - DNA, 20 bp, Artificial sequence
  SiRNA target sequence
atgaatgcaggaaattgttt

SEQ ID NO: 2546 - DNA, 20 bp, Artificial sequence
  SiRNA target sequence
tgaatgcaggaaattgttta

SEQ ID NO: 2547 - DNA, 20 bp, Artificial sequence
  SiRNA target sequence
gaatgcaggaaattgtttaa

SEQ ID NO: 2548 - DNA, 20 bp, Artificial sequence
  SiRNA target sequence
aatgcaggaaattgtttaat

SEQ ID NO: 2549 - DNA, 20 bp, Artificial sequence
  SiRNA target sequence
atgcaggaaattgtttaata

SEQ ID NO: 2550 - DNA, 20 bp, Artificial sequence
  SiRNA target sequence
tgcaggaaattgtttaatac

SEQ ID NO: 2551 - DNA, 20 bp, Artificial sequence
  SiRNA target sequence
gcaggaaattgtttaataca

SEQ ID NO: 2552 - DNA, 20 bp, Artificial sequence
  SiRNA target sequence
caggaaattgtttaatacat

SEQ ID NO: 2553 - DNA, 20 bp, Artificial sequence
  SiRNA target sequence
aggaaattgtttaatacatc

SEQ ID NO: 2554 - DNA, 20 bp, Artificial sequence
  SiRNA target sequence
ggaaattgtttaatacatca

SEQ ID NO: 2555 - DNA, 20 bp, Artificial sequence
  SiRNA target sequence
gaaattgtttaatacatcac

SEQ ID NO: 2556 - DNA, 20 bp, Artificial sequence
  SiRNA target sequence
aaattgtttaatacatcact

SEQ ID NO: 2557 - DNA, 20 bp, Artificial sequence
  SiRNA target sequence
aattgtttaatacatcactt

SEQ ID NO: 2558 - DNA, 20 bp, Artificial sequence
  SiRNA target sequence
attgtttaatacatcacttc

SEQ ID NO: 2559 - DNA, 20 bp, Artificial sequence
  SiRNA target sequence
ttgtttaatacatcacttca

SEQ ID NO: 2560 - DNA, 20 bp, Artificial sequence
  SiRNA target sequence
tgtttaatacatcacttcaa

SEQ ID NO: 2561 - DNA, 20 bp, Artificial sequence
  SiRNA target sequence
gtttaatacatcacttcaat

SEQ ID NO: 2562 - DNA, 20 bp, Artificial sequence
  SiRNA target sequence
tttaatacatcacttcaata

SEQ ID NO: 2563 - DNA, 20 bp, Artificial sequence
  SiRNA target sequence
ttaatacatcacttcaatat

SEQ ID NO: 2564 - DNA, 20 bp, Artificial sequence
  SiRNA target sequence
taatacatcacttcaatatt

SEQ ID NO: 2565 - DNA, 20 bp, Artificial sequence
  SiRNA target sequence
aatacatcacttcaatattg

SEQ ID NO: 2566 - DNA, 20 bp, Artificial sequence
  SiRNA target sequence
atacatcacttcaatattgt

SEQ ID NO: 2567 - DNA, 20 bp, Artificial sequence
  SiRNA target sequence
tacatcacttcaatattgtt

SEQ ID NO: 2568 - DNA, 20 bp, Artificial sequence
  SiRNA target sequence
acatcacttcaatattgttg

SEQ ID NO: 2569 - DNA, 20 bp, Artificial sequence
  SiRNA target sequence
catcacttcaatattgttgt

SEQ ID NO: 2570 - DNA, 20 bp, Artificial sequence
  SiRNA target sequence
atcacttcaatattgttgta

SEQ ID NO: 2571 - DNA, 20 bp, Artificial sequence
  SiRNA target sequence
tcacttcaatattgttgtaa

SEQ ID NO: 2572 - DNA, 20 bp, Artificial sequence
  SiRNA target sequence
cacttcaatattgttgtaat

SEQ ID NO: 2573 - DNA, 20 bp, Artificial sequence
  SiRNA target sequence
acttcaatattgttgtaatt

SEQ ID NO: 2574 - DNA, 20 bp, Artificial sequence
  SiRNA target sequence
cttcaatattgttgtaattc

SEQ ID NO: 2575 - DNA, 20 bp, Artificial sequence
  SiRNA target sequence
ttcaatattgttgtaattct

SEQ ID NO: 2576 - DNA, 20 bp, Artificial sequence
  SiRNA target sequence
tcaatattgttgtaattctg

SEQ ID NO: 2577 - DNA, 20 bp, Artificial sequence
  SiRNA target sequence
caatattgttgtaattctga

SEQ ID NO: 2578 - DNA, 20 bp, Artificial sequence
  SiRNA target sequence
aatattgttgtaattctgat

SEQ ID NO: 2579 - DNA, 20 bp, Artificial sequence
  SiRNA target sequence
atattgttgtaattctgatg

SEQ ID NO: 2580 - DNA, 20 bp, Artificial sequence
  SiRNA target sequence
tattgttgtaattctgatga

SEQ ID NO: 2581 - DNA, 20 bp, Artificial sequence
  SiRNA target sequence
attgttgtaattctgatgag

SEQ ID NO: 2582 - DNA, 20 bp, Artificial sequence
  SiRNA target sequence
ttgttgtaattctgatgagg

SEQ ID NO: 2583 - DNA, 20 bp, Artificial sequence
  SiRNA target sequence
tgttgtaattctgatgaggt

SEQ ID NO: 2584 - DNA, 20 bp, Artificial sequence
  SiRNA target sequence
gttgtaattctgatgaggtt

SEQ ID NO: 2585 - DNA, 20 bp, Artificial sequence
  SiRNA target sequence
ttgtaattctgatgaggttt

SEQ ID NO: 2586 - DNA, 20 bp, Artificial sequence
  SiRNA target sequence
tgtaattctgatgaggtttt

SEQ ID NO: 2587 - DNA, 20 bp, Artificial sequence
  SiRNA target sequence
gtaattctgatgaggttttt

SEQ ID NO: 2588 - DNA, 20 bp, Artificial sequence
  SiRNA target sequence
taattctgatgaggttttta

SEQ ID NO: 2589 - DNA, 20 bp, Artificial sequence
  SiRNA target sequence
aattctgatgaggtttttat

SEQ ID NO: 2590 - DNA, 20 bp, Artificial sequence
  SiRNA target sequence
attctgatgaggtttttatt

SEQ ID NO: 2591 - DNA, 20 bp, Artificial sequence
  SiRNA target sequence
ttctgatgaggtttttattg

SEQ ID NO: 2592 - DNA, 20 bp, Artificial sequence
  SiRNA target sequence
tctgatgaggtttttattgt

SEQ ID NO: 2593 - DNA, 20 bp, Artificial sequence
  SiRNA target sequence
ctgatgaggtttttattgtt

SEQ ID NO: 2594 - DNA, 20 bp, Artificial sequence
  SiRNA target sequence
tgatgaggtttttattgtta

SEQ ID NO: 2595 - DNA, 20 bp, Artificial sequence
  SiRNA target sequence
gatgaggtttttattgttaa

SEQ ID NO: 2596 - DNA, 20 bp, Artificial sequence
  SiRNA target sequence
atgaggtttttattgttaag

SEQ ID NO: 2597 - DNA, 20 bp, Artificial sequence
  SiRNA target sequence
tgaggtttttattgttaagc

SEQ ID NO: 2598 - DNA, 20 bp, Artificial sequence
  SiRNA target sequence
gaggtttttattgttaagca

SEQ ID NO: 2599 - DNA, 20 bp, Artificial sequence
  SiRNA target sequence
aggtttttattgttaagcag

SEQ ID NO: 2600 - DNA, 20 bp, Artificial sequence
  SiRNA target sequence
ggtttttattgttaagcagt

SEQ ID NO: 2601 - DNA, 20 bp, Artificial sequence
  SiRNA target sequence
gtttttattgttaagcagtc

SEQ ID NO: 2602 - DNA, 20 bp, Artificial sequence
  SiRNA target sequence
tttttattgttaagcagtca

SEQ ID NO: 2603 - DNA, 20 bp, Artificial sequence
  SiRNA target sequence
ttttattgttaagcagtcac

SEQ ID NO: 2604 - DNA, 20 bp, Artificial sequence
  SiRNA target sequence
tttattgttaagcagtcact

SEQ ID NO: 2605 - DNA, 20 bp, Artificial sequence
  SiRNA target sequence
ttattgttaagcagtcactt

SEQ ID NO: 2606 - DNA, 20 bp, Artificial sequence
  SiRNA target sequence
tattgttaagcagtcactta

SEQ ID NO: 2607 - DNA, 20 bp, Artificial sequence
  SiRNA target sequence
attgttaagcagtcacttat

SEQ ID NO: 2608 - DNA, 20 bp, Artificial sequence
  SiRNA target sequence
ttgttaagcagtcacttatt

SEQ ID NO: 2609 - DNA, 20 bp, Artificial sequence
  SiRNA target sequence
tgttaagcagtcacttattt

SEQ ID NO: 2610 - DNA, 20 bp, Artificial sequence
  SiRNA target sequence
gttaagcagtcacttatttt

SEQ ID NO: 2611 - DNA, 20 bp, Artificial sequence
  SiRNA target sequence
ttaagcagtcacttatttta

SEQ ID NO: 2612 - DNA, 20 bp, Artificial sequence
  SiRNA target sequence
taagcagtcacttattttaa

SEQ ID NO: 2613 - DNA, 20 bp, Artificial sequence
  SiRNA target sequence
aagcagtcacttattttaat

SEQ ID NO: 2614 - DNA, 20 bp, Artificial sequence
  SiRNA target sequence
agcagtcacttattttaata

SEQ ID NO: 2615 - DNA, 20 bp, Artificial sequence
  SiRNA target sequence
gcagtcacttattttaatag

SEQ ID NO: 2616 - DNA, 20 bp, Artificial sequence
  SiRNA target sequence
cagtcacttattttaataga

SEQ ID NO: 2617 - DNA, 20 bp, Artificial sequence
  SiRNA target sequence
agtcacttattttaatagaa

SEQ ID NO: 2618 - DNA, 20 bp, Artificial sequence
  SiRNA target sequence
gtcacttattttaatagaag

SEQ ID NO: 2619 - DNA, 20 bp, Artificial sequence
  SiRNA target sequence
tcacttattttaatagaagt

SEQ ID NO: 2620 - DNA, 20 bp, Artificial sequence
  SiRNA target sequence
cacttattttaatagaagta

SEQ ID NO: 2621 - DNA, 20 bp, Artificial sequence
  SiRNA target sequence
acttattttaatagaagtac

SEQ ID NO: 2622 - DNA, 20 bp, Artificial sequence
  SiRNA target sequence
cttattttaatagaagtaca

SEQ ID NO: 2623 - DNA, 20 bp, Artificial sequence
  SiRNA target sequence
ttattttaatagaagtacat

SEQ ID NO: 2624 - DNA, 20 bp, Artificial sequence
  SiRNA target sequence
tattttaatagaagtacatg

SEQ ID NO: 2625 - DNA, 20 bp, Artificial sequence
  SiRNA target sequence
attttaatagaagtacatga

SEQ ID NO: 2626 - DNA, 20 bp, Artificial sequence
  SiRNA target sequence
ttttaatagaagtacatgaa

SEQ ID NO: 2627 - DNA, 20 bp, Artificial sequence
  SiRNA target sequence
tttaatagaagtacatgaat

SEQ ID NO: 2628 - DNA, 20 bp, Artificial sequence
  SiRNA target sequence
ttaatagaagtacatgaata

SEQ ID NO: 2629 - DNA, 20 bp, Artificial sequence
  SiRNA target sequence
taatagaagtacatgaatac

SEQ ID NO: 2630 - DNA, 20 bp, Artificial sequence
  SiRNA target sequence
aatagaagtacatgaataca

SEQ ID NO: 2631 - DNA, 20 bp, Artificial sequence
  SiRNA target sequence
atagaagtacatgaatacat

SEQ ID NO: 2632 - DNA, 20 bp, Artificial sequence
  SiRNA target sequence
tagaagtacatgaatacatc

SEQ ID NO: 2633 - DNA, 20 bp, Artificial sequence
  SiRNA target sequence
agaagtacatgaatacatca

SEQ ID NO: 2634 - DNA, 20 bp, Artificial sequence
  SiRNA target sequence
gaagtacatgaatacatcaa

SEQ ID NO: 2635 - DNA, 20 bp, Artificial sequence
  SiRNA target sequence
aagtacatgaatacatcaaa

SEQ ID NO: 2636 - DNA, 20 bp, Artificial sequence
  SiRNA target sequence
agtacatgaatacatcaaag

SEQ ID NO: 2637 - DNA, 20 bp, Artificial sequence
  SiRNA target sequence
gtacatgaatacatcaaaga

SEQ ID NO: 2638 - DNA, 20 bp, Artificial sequence
  SiRNA target sequence
tacatgaatacatcaaagaa

SEQ ID NO: 2639 - DNA, 20 bp, Artificial sequence
  SiRNA target sequence
acatgaatacatcaaagaaa

SEQ ID NO: 2640 - DNA, 20 bp, Artificial sequence
  SiRNA target sequence
catgaatacatcaaagaaaa

SEQ ID NO: 2641 - DNA, 20 bp, Artificial sequence
  SiRNA target sequence
atgaatacatcaaagaaaat

SEQ ID NO: 2642 - DNA, 20 bp, Artificial sequence
  SiRNA target sequence
tgaatacatcaaagaaaata

SEQ ID NO: 2643 - DNA, 20 bp, Artificial sequence
  SiRNA target sequence
gaatacatcaaagaaaataa

SEQ ID NO: 2644 - DNA, 20 bp, Artificial sequence
  SiRNA target sequence
aatacatcaaagaaaataaa

SEQ ID NO: 2645 - DNA, 20 bp, Artificial sequence
  SiRNA target sequence
atacatcaaagaaaataaaa

SEQ ID NO: 2646 - DNA, 20 bp, Artificial sequence
  SiRNA target sequence
tacatcaaagaaaataaaat

SEQ ID NO: 2647 - DNA, 20 bp, Artificial sequence
  SiRNA target sequence
acatcaaagaaaataaaata

SEQ ID NO: 2648 - DNA, 20 bp, Artificial sequence
  SiRNA target sequence
catcaaagaaaataaaatat

SEQ ID NO: 2649 - DNA, 20 bp, Artificial sequence
  SiRNA target sequence
atcaaagaaaataaaatata

SEQ ID NO: 2650 - DNA, 20 bp, Artificial sequence
  SiRNA target sequence
tcaaagaaaataaaatataa

SEQ ID NO: 2651 - DNA, 21 bp, Artificial sequence
  SiRNA target sequence
atgaaacgaaaaacagaaata

SEQ ID NO: 2652 - DNA, 21 bp, Artificial sequence
  SiRNA target sequence
tgaaacgaaaaacagaaatat

SEQ ID NO: 2653 - DNA, 21 bp, Artificial sequence
  SiRNA target sequence
gaaacgaaaaacagaaatatt

SEQ ID NO: 2654 - DNA, 21 bp, Artificial sequence
  SiRNA target sequence
aaacgaaaaacagaaatattt

SEQ ID NO: 2655 - DNA, 21 bp, Artificial sequence
  SiRNA target sequence
aacgaaaaacagaaatattta

SEQ ID NO: 2656 - DNA, 21 bp, Artificial sequence
  SiRNA target sequence
acgaaaaacagaaatatttat

SEQ ID NO: 2657 - DNA, 21 bp, Artificial sequence
  SiRNA target sequence
cgaaaaacagaaatatttatt

SEQ ID NO: 2658 - DNA, 21 bp, Artificial sequence
  SiRNA target sequence
gaaaaacagaaatatttattg

SEQ ID NO: 2659 - DNA, 21 bp, Artificial sequence
  SiRNA target sequence
aaaaacagaaatatttattgc

SEQ ID NO: 2660 - DNA, 21 bp, Artificial sequence
  SiRNA target sequence
aaaacagaaatatttattgct

SEQ ID NO: 2661 - DNA, 21 bp, Artificial sequence
  SiRNA target sequence
aaacagaaatatttattgcta

SEQ ID NO: 2662 - DNA, 21 bp, Artificial sequence
  SiRNA target sequence
aacagaaatatttattgctat

SEQ ID NO: 2663 - DNA, 21 bp, Artificial sequence
  SiRNA target sequence
acagaaatatttattgctatt

SEQ ID NO: 2664 - DNA, 21 bp, Artificial sequence
  SiRNA target sequence
cagaaatatttattgctatta

SEQ ID NO: 2665 - DNA, 21 bp, Artificial sequence
  SiRNA target sequence
agaaatatttattgctattac

SEQ ID NO: 2666 - DNA, 21 bp, Artificial sequence
  SiRNA target sequence
gaaatatttattgctattaca

SEQ ID NO: 2667 - DNA, 21 bp, Artificial sequence
  SiRNA target sequence
aaatatttattgctattacag

SEQ ID NO: 2668 - DNA, 21 bp, Artificial sequence
  SiRNA target sequence
aatatttattgctattacagt

SEQ ID NO: 2669 - DNA, 21 bp, Artificial sequence
  SiRNA target sequence
atatttattgctattacagta

SEQ ID NO: 2670 - DNA, 21 bp, Artificial sequence
  SiRNA target sequence
tatttattgctattacagtag

SEQ ID NO: 2671 - DNA, 21 bp, Artificial sequence
  SiRNA target sequence
atttattgctattacagtagt

SEQ ID NO: 2672 - DNA, 21 bp, Artificial sequence
  SiRNA target sequence
tttattgctattacagtagtc

SEQ ID NO: 2673 - DNA, 21 bp, Artificial sequence
  SiRNA target sequence
ttattgctattacagtagtca

SEQ ID NO: 2674 - DNA, 21 bp, Artificial sequence
  SiRNA target sequence
tattgctattacagtagtcac

SEQ ID NO: 2675 - DNA, 21 bp, Artificial sequence
  SiRNA target sequence
attgctattacagtagtcact

SEQ ID NO: 2676 - DNA, 21 bp, Artificial sequence
  SiRNA target sequence
ttgctattacagtagtcactg

SEQ ID NO: 2677 - DNA, 21 bp, Artificial sequence
  SiRNA target sequence
tgctattacagtagtcactgc

SEQ ID NO: 2678 - DNA, 21 bp, Artificial sequence
  SiRNA target sequence
gctattacagtagtcactgca

SEQ ID NO: 2679 - DNA, 21 bp, Artificial sequence
  SiRNA target sequence
ctattacagtagtcactgcag

SEQ ID NO: 2680 - DNA, 21 bp, Artificial sequence
  SiRNA target sequence
tattacagtagtcactgcagt

SEQ ID NO: 2681 - DNA, 21 bp, Artificial sequence
  SiRNA target sequence
attacagtagtcactgcagtg

SEQ ID NO: 2682 - DNA, 21 bp, Artificial sequence
  SiRNA target sequence
ttacagtagtcactgcagtga

SEQ ID NO: 2683 - DNA, 21 bp, Artificial sequence
  SiRNA target sequence
tacagtagtcactgcagtgac

SEQ ID NO: 2684 - DNA, 21 bp, Artificial sequence
  SiRNA target sequence
acagtagtcactgcagtgaca

SEQ ID NO: 2685 - DNA, 21 bp, Artificial sequence
  SiRNA target sequence
cagtagtcactgcagtgacat

SEQ ID NO: 2686 - DNA, 21 bp, Artificial sequence
  SiRNA target sequence
agtagtcactgcagtgacatg

SEQ ID NO: 2687 - DNA, 21 bp, Artificial sequence
  SiRNA target sequence
gtagtcactgcagtgacatgt

SEQ ID NO: 2688 - DNA, 21 bp, Artificial sequence
  SiRNA target sequence
tagtcactgcagtgacatgtt

SEQ ID NO: 2689 - DNA, 21 bp, Artificial sequence
  SiRNA target sequence
agtcactgcagtgacatgtta

SEQ ID NO: 2690 - DNA, 21 bp, Artificial sequence
  SiRNA target sequence
gtcactgcagtgacatgttac

SEQ ID NO: 2691 - DNA, 21 bp, Artificial sequence
  SiRNA target sequence
tcactgcagtgacatgttact

SEQ ID NO: 2692 - DNA, 21 bp, Artificial sequence
  SiRNA target sequence
cactgcagtgacatgttactt

SEQ ID NO: 2693 - DNA, 21 bp, Artificial sequence
  SiRNA target sequence
actgcagtgacatgttactta

SEQ ID NO: 2694 - DNA, 21 bp, Artificial sequence
  SiRNA target sequence
ctgcagtgacatgttacttat

SEQ ID NO: 2695 - DNA, 21 bp, Artificial sequence
  SiRNA target sequence
tgcagtgacatgttacttatt

SEQ ID NO: 2696 - DNA, 21 bp, Artificial sequence
  SiRNA target sequence
gcagtgacatgttacttattt

SEQ ID NO: 2697 - DNA, 21 bp, Artificial sequence
  SiRNA target sequence
cagtgacatgttacttattta

SEQ ID NO: 2698 - DNA, 21 bp, Artificial sequence
  SiRNA target sequence
agtgacatgttacttatttaa

SEQ ID NO: 2699 - DNA, 21 bp, Artificial sequence
  SiRNA target sequence
gtgacatgttacttatttaaa

SEQ ID NO: 2700 - DNA, 21 bp, Artificial sequence
  SiRNA target sequence
tgacatgttacttatttaaaa

SEQ ID NO: 2701 - DNA, 21 bp, Artificial sequence
  SiRNA target sequence
gacatgttacttatttaaaaa

SEQ ID NO: 2702 - DNA, 21 bp, Artificial sequence
  SiRNA target sequence
acatgttacttatttaaaaaa

SEQ ID NO: 2703 - DNA, 21 bp, Artificial sequence
  SiRNA target sequence
catgttacttatttaaaaaaa

SEQ ID NO: 2704 - DNA, 21 bp, Artificial sequence
  SiRNA target sequence
atgttacttatttaaaaaaat

SEQ ID NO: 2705 - DNA, 21 bp, Artificial sequence
  SiRNA target sequence
tgttacttatttaaaaaaata

SEQ ID NO: 2706 - DNA, 21 bp, Artificial sequence
  SiRNA target sequence
gttacttatttaaaaaaataa

SEQ ID NO: 2707 - DNA, 21 bp, Artificial sequence
  SiRNA target sequence
ttacttatttaaaaaaataat

SEQ ID NO: 2708 - DNA, 21 bp, Artificial sequence
  SiRNA target sequence
tacttatttaaaaaaataata

SEQ ID NO: 2709 - DNA, 21 bp, Artificial sequence
  SiRNA target sequence
acttatttaaaaaaataataa

SEQ ID NO: 2710 - DNA, 21 bp, Artificial sequence
  SiRNA target sequence
cttatttaaaaaaataataaa

SEQ ID NO: 2711 - DNA, 21 bp, Artificial sequence
  SiRNA target sequence
ttatttaaaaaaataataaat

SEQ ID NO: 2712 - DNA, 21 bp, Artificial sequence
  SiRNA target sequence
tatttaaaaaaataataaata

SEQ ID NO: 2713 - DNA, 21 bp, Artificial sequence
  SiRNA target sequence
atttaaaaaaataataaatag

SEQ ID NO: 2714 - DNA, 21 bp, Artificial sequence
  SiRNA target sequence
tttaaaaaaataataaataga

SEQ ID NO: 2715 - DNA, 21 bp, Artificial sequence
  SiRNA target sequence
ttaaaaaaataataaatagac

SEQ ID NO: 2716 - DNA, 21 bp, Artificial sequence
  SiRNA target sequence
taaaaaaataataaatagaca

SEQ ID NO: 2717 - DNA, 21 bp, Artificial sequence
  SiRNA target sequence
aaaaaaataataaatagacaa

SEQ ID NO: 2718 - DNA, 21 bp, Artificial sequence
  SiRNA target sequence
aaaaaataataaatagacaaa

SEQ ID NO: 2719 - DNA, 21 bp, Artificial sequence
  SiRNA target sequence
aaaaataataaatagacaaaa

SEQ ID NO: 2720 - DNA, 21 bp, Artificial sequence
  SiRNA target sequence
aaaataataaatagacaaaag

SEQ ID NO: 2721 - DNA, 21 bp, Artificial sequence
  SiRNA target sequence
aaataataaatagacaaaagt

SEQ ID NO: 2722 - DNA, 21 bp, Artificial sequence
  SiRNA target sequence
aataataaatagacaaaagtc

SEQ ID NO: 2723 - DNA, 21 bp, Artificial sequence
  SiRNA target sequence
ataataaatagacaaaagtct

SEQ ID NO: 2724 - DNA, 21 bp, Artificial sequence
  SiRNA target sequence
taataaatagacaaaagtctg

SEQ ID NO: 2725 - DNA, 21 bp, Artificial sequence
  SiRNA target sequence
aataaatagacaaaagtctga

SEQ ID NO: 2726 - DNA, 21 bp, Artificial sequence
  SiRNA target sequence
ataaatagacaaaagtctgat

SEQ ID NO: 2727 - DNA, 21 bp, Artificial sequence
  SiRNA target sequence
taaatagacaaaagtctgatt

SEQ ID NO: 2728 - DNA, 21 bp, Artificial sequence
  SiRNA target sequence
aaatagacaaaagtctgatta

SEQ ID NO: 2729 - DNA, 21 bp, Artificial sequence
  SiRNA target sequence
aatagacaaaagtctgattat

SEQ ID NO: 2730 - DNA, 21 bp, Artificial sequence
  SiRNA target sequence
atagacaaaagtctgattata

SEQ ID NO: 2731 - DNA, 21 bp, Artificial sequence
  SiRNA target sequence
tagacaaaagtctgattatac

SEQ ID NO: 2732 - DNA, 21 bp, Artificial sequence
  SiRNA target sequence
agacaaaagtctgattataca

SEQ ID NO: 2733 - DNA, 21 bp, Artificial sequence
  SiRNA target sequence
gacaaaagtctgattatacat

SEQ ID NO: 2734 - DNA, 21 bp, Artificial sequence
  SiRNA target sequence
acaaaagtctgattatacatc

SEQ ID NO: 2735 - DNA, 21 bp, Artificial sequence
  SiRNA target sequence
caaaagtctgattatacatca

SEQ ID NO: 2736 - DNA, 21 bp, Artificial sequence
  SiRNA target sequence
aaaagtctgattatacatcaa

SEQ ID NO: 2737 - DNA, 21 bp, Artificial sequence
  SiRNA target sequence
aaagtctgattatacatcaat

SEQ ID NO: 2738 - DNA, 21 bp, Artificial sequence
  SiRNA target sequence
aagtctgattatacatcaata

SEQ ID NO: 2739 - DNA, 21 bp, Artificial sequence
  SiRNA target sequence
agtctgattatacatcaataa

SEQ ID NO: 2740 - DNA, 21 bp, Artificial sequence
  SiRNA target sequence
gtctgattatacatcaataaa

SEQ ID NO: 2741 - DNA, 21 bp, Artificial sequence
  SiRNA target sequence
tctgattatacatcaataaaa

SEQ ID NO: 2742 - DNA, 21 bp, Artificial sequence
  SiRNA target sequence
ctgattatacatcaataaaac

SEQ ID NO: 2743 - DNA, 21 bp, Artificial sequence
  SiRNA target sequence
tgattatacatcaataaaaca

SEQ ID NO: 2744 - DNA, 21 bp, Artificial sequence
  SiRNA target sequence
gattatacatcaataaaacag

SEQ ID NO: 2745 - DNA, 21 bp, Artificial sequence
  SiRNA target sequence
attatacatcaataaaacagg

SEQ ID NO: 2746 - DNA, 21 bp, Artificial sequence
  SiRNA target sequence
ttatacatcaataaaacagga

SEQ ID NO: 2747 - DNA, 21 bp, Artificial sequence
  SiRNA target sequence
tatacatcaataaaacaggaa

SEQ ID NO: 2748 - DNA, 21 bp, Artificial sequence
  SiRNA target sequence
atacatcaataaaacaggaag

SEQ ID NO: 2749 - DNA, 21 bp, Artificial sequence
  SiRNA target sequence
tacatcaataaaacaggaagc

SEQ ID NO: 2750 - DNA, 21 bp, Artificial sequence
  SiRNA target sequence
acatcaataaaacaggaagca

SEQ ID NO: 2751 - DNA, 21 bp, Artificial sequence
  SiRNA target sequence
catcaataaaacaggaagcag

SEQ ID NO: 2752 - DNA, 21 bp, Artificial sequence
  SiRNA target sequence
atcaataaaacaggaagcaga

SEQ ID NO: 2753 - DNA, 21 bp, Artificial sequence
  SiRNA target sequence
tcaataaaacaggaagcagat

SEQ ID NO: 2754 - DNA, 21 bp, Artificial sequence
  SiRNA target sequence
caataaaacaggaagcagata

SEQ ID NO: 2755 - DNA, 21 bp, Artificial sequence
  SiRNA target sequence
aataaaacaggaagcagataa

SEQ ID NO: 2756 - DNA, 21 bp, Artificial sequence
  SiRNA target sequence
ataaaacaggaagcagataaa

SEQ ID NO: 2757 - DNA, 21 bp, Artificial sequence
  SiRNA target sequence
taaaacaggaagcagataaat

SEQ ID NO: 2758 - DNA, 21 bp, Artificial sequence
  SiRNA target sequence
aaaacaggaagcagataaata

SEQ ID NO: 2759 - DNA, 21 bp, Artificial sequence
  SiRNA target sequence
aaacaggaagcagataaatat

SEQ ID NO: 2760 - DNA, 21 bp, Artificial sequence
  SiRNA target sequence
aacaggaagcagataaatatt

SEQ ID NO: 2761 - DNA, 21 bp, Artificial sequence
  SiRNA target sequence
acaggaagcagataaatattt

SEQ ID NO: 2762 - DNA, 21 bp, Artificial sequence
  SiRNA target sequence
caggaagcagataaatatttt

SEQ ID NO: 2763 - DNA, 21 bp, Artificial sequence
  SiRNA target sequence
aggaagcagataaatatttta

SEQ ID NO: 2764 - DNA, 21 bp, Artificial sequence
  SiRNA target sequence
ggaagcagataaatattttat

SEQ ID NO: 2765 - DNA, 21 bp, Artificial sequence
  SiRNA target sequence
gaagcagataaatattttata

SEQ ID NO: 2766 - DNA, 21 bp, Artificial sequence
  SiRNA target sequence
aagcagataaatattttatac

SEQ ID NO: 2767 - DNA, 21 bp, Artificial sequence
  SiRNA target sequence
agcagataaatattttataca

SEQ ID NO: 2768 - DNA, 21 bp, Artificial sequence
  SiRNA target sequence
gcagataaatattttatacaa

SEQ ID NO: 2769 - DNA, 21 bp, Artificial sequence
  SiRNA target sequence
cagataaatattttatacaag

SEQ ID NO: 2770 - DNA, 21 bp, Artificial sequence
  SiRNA target sequence
agataaatattttatacaaga

SEQ ID NO: 2771 - DNA, 21 bp, Artificial sequence
  SiRNA target sequence
gataaatattttatacaagaa

SEQ ID NO: 2772 - DNA, 21 bp, Artificial sequence
  SiRNA target sequence
ataaatattttatacaagaag

SEQ ID NO: 2773 - DNA, 21 bp, Artificial sequence
  SiRNA target sequence
taaatattttatacaagaaga

SEQ ID NO: 2774 - DNA, 21 bp, Artificial sequence
  SiRNA target sequence
aaatattttatacaagaagat

SEQ ID NO: 2775 - DNA, 21 bp, Artificial sequence
  SiRNA target sequence
aatattttatacaagaagatt

SEQ ID NO: 2776 - DNA, 21 bp, Artificial sequence
  SiRNA target sequence
atattttatacaagaagatta

SEQ ID NO: 2777 - DNA, 21 bp, Artificial sequence
  SiRNA target sequence
tattttatacaagaagattat

SEQ ID NO: 2778 - DNA, 21 bp, Artificial sequence
  SiRNA target sequence
attttatacaagaagattata

SEQ ID NO: 2779 - DNA, 21 bp, Artificial sequence
  SiRNA target sequence
ttttatacaagaagattataa

SEQ ID NO: 2780 - DNA, 21 bp, Artificial sequence
  SiRNA target sequence
tttatacaagaagattataaa

SEQ ID NO: 2781 - DNA, 21 bp, Artificial sequence
  SiRNA target sequence
ttatacaagaagattataaaa

SEQ ID NO: 2782 - DNA, 21 bp, Artificial sequence
  SiRNA target sequence
tatacaagaagattataaaaa

SEQ ID NO: 2783 - DNA, 21 bp, Artificial sequence
  SiRNA target sequence
atacaagaagattataaaaat

SEQ ID NO: 2784 - DNA, 21 bp, Artificial sequence
  SiRNA target sequence
tacaagaagattataaaaatg

SEQ ID NO: 2785 - DNA, 21 bp, Artificial sequence
  SiRNA target sequence
acaagaagattataaaaatgc

SEQ ID NO: 2786 - DNA, 21 bp, Artificial sequence
  SiRNA target sequence
caagaagattataaaaatgct

SEQ ID NO: 2787 - DNA, 21 bp, Artificial sequence
  SiRNA target sequence
aagaagattataaaaatgcta

SEQ ID NO: 2788 - DNA, 21 bp, Artificial sequence
  SiRNA target sequence
agaagattataaaaatgctat

SEQ ID NO: 2789 - DNA, 21 bp, Artificial sequence
  SiRNA target sequence
gaagattataaaaatgctatt

SEQ ID NO: 2790 - DNA, 21 bp, Artificial sequence
  SiRNA target sequence
aagattataaaaatgctattc

SEQ ID NO: 2791 - DNA, 21 bp, Artificial sequence
  SiRNA target sequence
agattataaaaatgctattct

SEQ ID NO: 2792 - DNA, 21 bp, Artificial sequence
  SiRNA target sequence
gattataaaaatgctattctg

SEQ ID NO: 2793 - DNA, 21 bp, Artificial sequence
  SiRNA target sequence
attataaaaatgctattctgt

SEQ ID NO: 2794 - DNA, 21 bp, Artificial sequence
  SiRNA target sequence
ttataaaaatgctattctgtt

SEQ ID NO: 2795 - DNA, 21 bp, Artificial sequence
  SiRNA target sequence
tataaaaatgctattctgttg

SEQ ID NO: 2796 - DNA, 21 bp, Artificial sequence
  SiRNA target sequence
ataaaaatgctattctgttgt

SEQ ID NO: 2797 - DNA, 21 bp, Artificial sequence
  SiRNA target sequence
taaaaatgctattctgttgta

SEQ ID NO: 2798 - DNA, 21 bp, Artificial sequence
  SiRNA target sequence
aaaaatgctattctgttgtac

SEQ ID NO: 2799 - DNA, 21 bp, Artificial sequence
  SiRNA target sequence
aaaatgctattctgttgtaca

SEQ ID NO: 2800 - DNA, 21 bp, Artificial sequence
  SiRNA target sequence
aaatgctattctgttgtacac

SEQ ID NO: 2801 - DNA, 21 bp, Artificial sequence
  SiRNA target sequence
aatgctattctgttgtacact

SEQ ID NO: 2802 - DNA, 21 bp, Artificial sequence
  SiRNA target sequence
atgctattctgttgtacacta

SEQ ID NO: 2803 - DNA, 21 bp, Artificial sequence
  SiRNA target sequence
tgctattctgttgtacactaa

SEQ ID NO: 2804 - DNA, 21 bp, Artificial sequence
  SiRNA target sequence
gctattctgttgtacactaaa

SEQ ID NO: 2805 - DNA, 21 bp, Artificial sequence
  SiRNA target sequence
ctattctgttgtacactaaat

SEQ ID NO: 2806 - DNA, 21 bp, Artificial sequence
  SiRNA target sequence
tattctgttgtacactaaatg

SEQ ID NO: 2807 - DNA, 21 bp, Artificial sequence
  SiRNA target sequence
attctgttgtacactaaatgt

SEQ ID NO: 2808 - DNA, 21 bp, Artificial sequence
  SiRNA target sequence
ttctgttgtacactaaatgta

SEQ ID NO: 2809 - DNA, 21 bp, Artificial sequence
  SiRNA target sequence
tctgttgtacactaaatgtaa

SEQ ID NO: 2810 - DNA, 21 bp, Artificial sequence
  SiRNA target sequence
ctgttgtacactaaatgtaaa

SEQ ID NO: 2811 - DNA, 21 bp, Artificial sequence
  SiRNA target sequence
tgttgtacactaaatgtaaat

SEQ ID NO: 2812 - DNA, 21 bp, Artificial sequence
  SiRNA target sequence
gttgtacactaaatgtaaata

SEQ ID NO: 2813 - DNA, 21 bp, Artificial sequence
  SiRNA target sequence
ttgtacactaaatgtaaatat

SEQ ID NO: 2814 - DNA, 21 bp, Artificial sequence
  SiRNA target sequence
tgtacactaaatgtaaatata

SEQ ID NO: 2815 - DNA, 21 bp, Artificial sequence
  SiRNA target sequence
gtacactaaatgtaaatatat

SEQ ID NO: 2816 - DNA, 21 bp, Artificial sequence
  SiRNA target sequence
tacactaaatgtaaatatatg

SEQ ID NO: 2817 - DNA, 21 bp, Artificial sequence
  SiRNA target sequence
acactaaatgtaaatatatga

SEQ ID NO: 2818 - DNA, 21 bp, Artificial sequence
  SiRNA target sequence
cactaaatgtaaatatatgaa

SEQ ID NO: 2819 - DNA, 21 bp, Artificial sequence
  SiRNA target sequence
actaaatgtaaatatatgaaa

SEQ ID NO: 2820 - DNA, 21 bp, Artificial sequence
  SiRNA target sequence
ctaaatgtaaatatatgaaaa

SEQ ID NO: 2821 - DNA, 21 bp, Artificial sequence
  SiRNA target sequence
taaatgtaaatatatgaaaag

SEQ ID NO: 2822 - DNA, 21 bp, Artificial sequence
  SiRNA target sequence
aaatgtaaatatatgaaaagt

SEQ ID NO: 2823 - DNA, 21 bp, Artificial sequence
  SiRNA target sequence
aatgtaaatatatgaaaagtg

SEQ ID NO: 2824 - DNA, 21 bp, Artificial sequence
  SiRNA target sequence
atgtaaatatatgaaaagtga

SEQ ID NO: 2825 - DNA, 21 bp, Artificial sequence
  SiRNA target sequence
tgtaaatatatgaaaagtgat

SEQ ID NO: 2826 - DNA, 21 bp, Artificial sequence
  SiRNA target sequence
gtaaatatatgaaaagtgatg

SEQ ID NO: 2827 - DNA, 21 bp, Artificial sequence
  SiRNA target sequence
taaatatatgaaaagtgatgc

SEQ ID NO: 2828 - DNA, 21 bp, Artificial sequence
  SiRNA target sequence
aaatatatgaaaagtgatgct

SEQ ID NO: 2829 - DNA, 21 bp, Artificial sequence
  SiRNA target sequence
aatatatgaaaagtgatgctg

SEQ ID NO: 2830 - DNA, 21 bp, Artificial sequence
  SiRNA target sequence
atatatgaaaagtgatgctga

SEQ ID NO: 2831 - DNA, 21 bp, Artificial sequence
  SiRNA target sequence
tatatgaaaagtgatgctgaa

SEQ ID NO: 2832 - DNA, 21 bp, Artificial sequence
  SiRNA target sequence
atatgaaaagtgatgctgaaa

SEQ ID NO: 2833 - DNA, 21 bp, Artificial sequence
  SiRNA target sequence
tatgaaaagtgatgctgaaat

SEQ ID NO: 2834 - DNA, 21 bp, Artificial sequence
  SiRNA target sequence
atgaaaagtgatgctgaaatt

SEQ ID NO: 2835 - DNA, 21 bp, Artificial sequence
  SiRNA target sequence
tgaaaagtgatgctgaaattc

SEQ ID NO: 2836 - DNA, 21 bp, Artificial sequence
  SiRNA target sequence
gaaaagtgatgctgaaattct

SEQ ID NO: 2837 - DNA, 21 bp, Artificial sequence
  SiRNA target sequence
aaaagtgatgctgaaattctt

SEQ ID NO: 2838 - DNA, 21 bp, Artificial sequence
  SiRNA target sequence
aaagtgatgctgaaattctta

SEQ ID NO: 2839 - DNA, 21 bp, Artificial sequence
  SiRNA target sequence
aagtgatgctgaaattcttac

SEQ ID NO: 2840 - DNA, 21 bp, Artificial sequence
  SiRNA target sequence
agtgatgctgaaattcttact

SEQ ID NO: 2841 - DNA, 21 bp, Artificial sequence
  SiRNA target sequence
gtgatgctgaaattcttacta

SEQ ID NO: 2842 - DNA, 21 bp, Artificial sequence
  SiRNA target sequence
tgatgctgaaattcttactaa

SEQ ID NO: 2843 - DNA, 21 bp, Artificial sequence
  SiRNA target sequence
gatgctgaaattcttactaaa

SEQ ID NO: 2844 - DNA, 21 bp, Artificial sequence
  SiRNA target sequence
atgctgaaattcttactaaaa

SEQ ID NO: 2845 - DNA, 21 bp, Artificial sequence
  SiRNA target sequence
tgctgaaattcttactaaaat

SEQ ID NO: 2846 - DNA, 21 bp, Artificial sequence
  SiRNA target sequence
gctgaaattcttactaaaatt

SEQ ID NO: 2847 - DNA, 21 bp, Artificial sequence
  SiRNA target sequence
ctgaaattcttactaaaatta

SEQ ID NO: 2848 - DNA, 21 bp, Artificial sequence
  SiRNA target sequence
tgaaattcttactaaaattag

SEQ ID NO: 2849 - DNA, 21 bp, Artificial sequence
  SiRNA target sequence
gaaattcttactaaaattagt

SEQ ID NO: 2850 - DNA, 21 bp, Artificial sequence
  SiRNA target sequence
aaattcttactaaaattagtc

SEQ ID NO: 2851 - DNA, 21 bp, Artificial sequence
  SiRNA target sequence
aattcttactaaaattagtct

SEQ ID NO: 2852 - DNA, 21 bp, Artificial sequence
  SiRNA target sequence
attcttactaaaattagtctc

SEQ ID NO: 2853 - DNA, 21 bp, Artificial sequence
  SiRNA target sequence
ttcttactaaaattagtctct

SEQ ID NO: 2854 - DNA, 21 bp, Artificial sequence
  SiRNA target sequence
tcttactaaaattagtctctg

SEQ ID NO: 2855 - DNA, 21 bp, Artificial sequence
  SiRNA target sequence
cttactaaaattagtctctgt

SEQ ID NO: 2856 - DNA, 21 bp, Artificial sequence
  SiRNA target sequence
ttactaaaattagtctctgta

SEQ ID NO: 2857 - DNA, 21 bp, Artificial sequence
  SiRNA target sequence
tactaaaattagtctctgtaa

SEQ ID NO: 2858 - DNA, 21 bp, Artificial sequence
  SiRNA target sequence
actaaaattagtctctgtaat

SEQ ID NO: 2859 - DNA, 21 bp, Artificial sequence
  SiRNA target sequence
ctaaaattagtctctgtaatt

SEQ ID NO: 2860 - DNA, 21 bp, Artificial sequence
  SiRNA target sequence
taaaattagtctctgtaatta

SEQ ID NO: 2861 - DNA, 21 bp, Artificial sequence
  SiRNA target sequence
aaaattagtctctgtaattat

SEQ ID NO: 2862 - DNA, 21 bp, Artificial sequence
  SiRNA target sequence
aaattagtctctgtaattatt

SEQ ID NO: 2863 - DNA, 21 bp, Artificial sequence
  SiRNA target sequence
aattagtctctgtaattattt

SEQ ID NO: 2864 - DNA, 21 bp, Artificial sequence
  SiRNA target sequence
attagtctctgtaattatttc

SEQ ID NO: 2865 - DNA, 21 bp, Artificial sequence
  SiRNA target sequence
ttagtctctgtaattatttct

SEQ ID NO: 2866 - DNA, 21 bp, Artificial sequence
  SiRNA target sequence
tagtctctgtaattatttctt

SEQ ID NO: 2867 - DNA, 21 bp, Artificial sequence
  SiRNA target sequence
agtctctgtaattatttctta

SEQ ID NO: 2868 - DNA, 21 bp, Artificial sequence
  SiRNA target sequence
gtctctgtaattatttcttaa

SEQ ID NO: 2869 - DNA, 21 bp, Artificial sequence
  SiRNA target sequence
tctctgtaattatttcttaaa

SEQ ID NO: 2870 - DNA, 21 bp, Artificial sequence
  SiRNA target sequence
ctctgtaattatttcttaaaa

SEQ ID NO: 2871 - DNA, 21 bp, Artificial sequence
  SiRNA target sequence
tctgtaattatttcttaaaaa

SEQ ID NO: 2872 - DNA, 21 bp, Artificial sequence
  SiRNA target sequence
ctgtaattatttcttaaaaaa

SEQ ID NO: 2873 - DNA, 21 bp, Artificial sequence
  SiRNA target sequence
tgtaattatttcttaaaaaat

SEQ ID NO: 2874 - DNA, 21 bp, Artificial sequence
  SiRNA target sequence
gtaattatttcttaaaaaatt

SEQ ID NO: 2875 - DNA, 21 bp, Artificial sequence
  SiRNA target sequence
taattatttcttaaaaaatta

SEQ ID NO: 2876 - DNA, 21 bp, Artificial sequence
  SiRNA target sequence
aattatttcttaaaaaattat

SEQ ID NO: 2877 - DNA, 21 bp, Artificial sequence
  SiRNA target sequence
attatttcttaaaaaattatc

SEQ ID NO: 2878 - DNA, 21 bp, Artificial sequence
  SiRNA target sequence
ttatttcttaaaaaattatca

SEQ ID NO: 2879 - DNA, 21 bp, Artificial sequence
  SiRNA target sequence
tatttcttaaaaaattatcaa

SEQ ID NO: 2880 - DNA, 21 bp, Artificial sequence
  SiRNA target sequence
atttcttaaaaaattatcaag

SEQ ID NO: 2881 - DNA, 21 bp, Artificial sequence
  SiRNA target sequence
tttcttaaaaaattatcaaga

SEQ ID NO: 2882 - DNA, 21 bp, Artificial sequence
  SiRNA target sequence
ttcttaaaaaattatcaagaa

SEQ ID NO: 2883 - DNA, 21 bp, Artificial sequence
  SiRNA target sequence
tcttaaaaaattatcaagaag

SEQ ID NO: 2884 - DNA, 21 bp, Artificial sequence
  SiRNA target sequence
cttaaaaaattatcaagaagt

SEQ ID NO: 2885 - DNA, 21 bp, Artificial sequence
  SiRNA target sequence
ttaaaaaattatcaagaagtt

SEQ ID NO: 2886 - DNA, 21 bp, Artificial sequence
  SiRNA target sequence
taaaaaattatcaagaagtta

SEQ ID NO: 2887 - DNA, 21 bp, Artificial sequence
  SiRNA target sequence
aaaaaattatcaagaagttat

SEQ ID NO: 2888 - DNA, 21 bp, Artificial sequence
  SiRNA target sequence
aaaaattatcaagaagttata

SEQ ID NO: 2889 - DNA, 21 bp, Artificial sequence
  SiRNA target sequence
aaaattatcaagaagttataa

SEQ ID NO: 2890 - DNA, 21 bp, Artificial sequence
  SiRNA target sequence
aaattatcaagaagttataaa

SEQ ID NO: 2891 - DNA, 21 bp, Artificial sequence
  SiRNA target sequence
aattatcaagaagttataaat

SEQ ID NO: 2892 - DNA, 21 bp, Artificial sequence
  SiRNA target sequence
attatcaagaagttataaata

SEQ ID NO: 2893 - DNA, 21 bp, Artificial sequence
  SiRNA target sequence
ttatcaagaagttataaataa

SEQ ID NO: 2894 - DNA, 21 bp, Artificial sequence
  SiRNA target sequence
tatcaagaagttataaataat

SEQ ID NO: 2895 - DNA, 21 bp, Artificial sequence
  SiRNA target sequence
atcaagaagttataaataatt

SEQ ID NO: 2896 - DNA, 21 bp, Artificial sequence
  SiRNA target sequence
tcaagaagttataaataattc

SEQ ID NO: 2897 - DNA, 21 bp, Artificial sequence
  SiRNA target sequence
caagaagttataaataattct

SEQ ID NO: 2898 - DNA, 21 bp, Artificial sequence
  SiRNA target sequence
aagaagttataaataattctt

SEQ ID NO: 2899 - DNA, 21 bp, Artificial sequence
  SiRNA target sequence
agaagttataaataattcttt

SEQ ID NO: 2900 - DNA, 21 bp, Artificial sequence
  SiRNA target sequence
gaagttataaataattcttta

SEQ ID NO: 2901 - DNA, 21 bp, Artificial sequence
  SiRNA target sequence
aagttataaataattctttat

SEQ ID NO: 2902 - DNA, 21 bp, Artificial sequence
  SiRNA target sequence
agttataaataattctttatt

SEQ ID NO: 2903 - DNA, 21 bp, Artificial sequence
  SiRNA target sequence
gttataaataattctttattt

SEQ ID NO: 2904 - DNA, 21 bp, Artificial sequence
  SiRNA target sequence
ttataaataattctttattta

SEQ ID NO: 2905 - DNA, 21 bp, Artificial sequence
  SiRNA target sequence
tataaataattctttatttaa

SEQ ID NO: 2906 - DNA, 21 bp, Artificial sequence
  SiRNA target sequence
ataaataattctttatttaag

SEQ ID NO: 2907 - DNA, 21 bp, Artificial sequence
  SiRNA target sequence
taaataattctttatttaaga

SEQ ID NO: 2908 - DNA, 21 bp, Artificial sequence
  SiRNA target sequence
aaataattctttatttaagac

SEQ ID NO: 2909 - DNA, 21 bp, Artificial sequence
  SiRNA target sequence
aataattctttatttaagaca

SEQ ID NO: 2910 - DNA, 21 bp, Artificial sequence
  SiRNA target sequence
ataattctttatttaagacaa

SEQ ID NO: 2911 - DNA, 21 bp, Artificial sequence
  SiRNA target sequence
taattctttatttaagacaaa

SEQ ID NO: 2912 - DNA, 21 bp, Artificial sequence
  SiRNA target sequence
aattctttatttaagacaaat

SEQ ID NO: 2913 - DNA, 21 bp, Artificial sequence
  SiRNA target sequence
attctttatttaagacaaata

SEQ ID NO: 2914 - DNA, 21 bp, Artificial sequence
  SiRNA target sequence
ttctttatttaagacaaataa

SEQ ID NO: 2915 - DNA, 21 bp, Artificial sequence
  SiRNA target sequence
tctttatttaagacaaataat

SEQ ID NO: 2916 - DNA, 21 bp, Artificial sequence
  SiRNA target sequence
ctttatttaagacaaataata

SEQ ID NO: 2917 - DNA, 21 bp, Artificial sequence
  SiRNA target sequence
tttatttaagacaaataataa

SEQ ID NO: 2918 - DNA, 21 bp, Artificial sequence
  SiRNA target sequence
ttatttaagacaaataataaa

SEQ ID NO: 2919 - DNA, 21 bp, Artificial sequence
  SiRNA target sequence
tatttaagacaaataataaag

SEQ ID NO: 2920 - DNA, 21 bp, Artificial sequence
  SiRNA target sequence
atttaagacaaataataaaga

SEQ ID NO: 2921 - DNA, 21 bp, Artificial sequence
  SiRNA target sequence
tttaagacaaataataaagat

SEQ ID NO: 2922 - DNA, 21 bp, Artificial sequence
  SiRNA target sequence
ttaagacaaataataaagatc

SEQ ID NO: 2923 - DNA, 21 bp, Artificial sequence
  SiRNA target sequence
taagacaaataataaagatct

SEQ ID NO: 2924 - DNA, 21 bp, Artificial sequence
  SiRNA target sequence
aagacaaataataaagatcta

SEQ ID NO: 2925 - DNA, 21 bp, Artificial sequence
  SiRNA target sequence
agacaaataataaagatctaa

SEQ ID NO: 2926 - DNA, 21 bp, Artificial sequence
  SiRNA target sequence
gacaaataataaagatctaat

SEQ ID NO: 2927 - DNA, 21 bp, Artificial sequence
  SiRNA target sequence
acaaataataaagatctaata

SEQ ID NO: 2928 - DNA, 21 bp, Artificial sequence
  SiRNA target sequence
caaataataaagatctaataa

SEQ ID NO: 2929 - DNA, 21 bp, Artificial sequence
  SiRNA target sequence
aaataataaagatctaataaa

SEQ ID NO: 2930 - DNA, 21 bp, Artificial sequence
  SiRNA target sequence
aataataaagatctaataaaa

SEQ ID NO: 2931 - DNA, 21 bp, Artificial sequence
  SiRNA target sequence
ataataaagatctaataaaaa

SEQ ID NO: 2932 - DNA, 21 bp, Artificial sequence
  SiRNA target sequence
taataaagatctaataaaaat

SEQ ID NO: 2933 - DNA, 21 bp, Artificial sequence
  SiRNA target sequence
aataaagatctaataaaaata

SEQ ID NO: 2934 - DNA, 21 bp, Artificial sequence
  SiRNA target sequence
ataaagatctaataaaaataa

SEQ ID NO: 2935 - DNA, 21 bp, Artificial sequence
  SiRNA target sequence
taaagatctaataaaaataag

SEQ ID NO: 2936 - DNA, 21 bp, Artificial sequence
  SiRNA target sequence
aaagatctaataaaaataaga

SEQ ID NO: 2937 - DNA, 21 bp, Artificial sequence
  SiRNA target sequence
aagatctaataaaaataagat

SEQ ID NO: 2938 - DNA, 21 bp, Artificial sequence
  SiRNA target sequence
agatctaataaaaataagatc

SEQ ID NO: 2939 - DNA, 21 bp, Artificial sequence
  SiRNA target sequence
gatctaataaaaataagatct

SEQ ID NO: 2940 - DNA, 21 bp, Artificial sequence
  SiRNA target sequence
atctaataaaaataagatctg

SEQ ID NO: 2941 - DNA, 21 bp, Artificial sequence
  SiRNA target sequence
tctaataaaaataagatctga

SEQ ID NO: 2942 - DNA, 21 bp, Artificial sequence
  SiRNA target sequence
ctaataaaaataagatctgaa

SEQ ID NO: 2943 - DNA, 21 bp, Artificial sequence
  SiRNA target sequence
taataaaaataagatctgaat

SEQ ID NO: 2944 - DNA, 21 bp, Artificial sequence
  SiRNA target sequence
aataaaaataagatctgaatg

SEQ ID NO: 2945 - DNA, 21 bp, Artificial sequence
  SiRNA target sequence
ataaaaataagatctgaatgt

SEQ ID NO: 2946 - DNA, 21 bp, Artificial sequence
  SiRNA target sequence
taaaaataagatctgaatgtt

SEQ ID NO: 2947 - DNA, 21 bp, Artificial sequence
  SiRNA target sequence
aaaaataagatctgaatgtta

SEQ ID NO: 2948 - DNA, 21 bp, Artificial sequence
  SiRNA target sequence
aaaataagatctgaatgttac

SEQ ID NO: 2949 - DNA, 21 bp, Artificial sequence
  SiRNA target sequence
aaataagatctgaatgttaca

SEQ ID NO: 2950 - DNA, 21 bp, Artificial sequence
  SiRNA target sequence
aataagatctgaatgttacaa

SEQ ID NO: 2951 - DNA, 21 bp, Artificial sequence
  SiRNA target sequence
ataagatctgaatgttacaag

SEQ ID NO: 2952 - DNA, 21 bp, Artificial sequence
  SiRNA target sequence
taagatctgaatgttacaagc

SEQ ID NO: 2953 - DNA, 21 bp, Artificial sequence
  SiRNA target sequence
aagatctgaatgttacaagca

SEQ ID NO: 2954 - DNA, 21 bp, Artificial sequence
  SiRNA target sequence
agatctgaatgttacaagcag

SEQ ID NO: 2955 - DNA, 21 bp, Artificial sequence
  SiRNA target sequence
gatctgaatgttacaagcaga

SEQ ID NO: 2956 - DNA, 21 bp, Artificial sequence
  SiRNA target sequence
atctgaatgttacaagcagat

SEQ ID NO: 2957 - DNA, 21 bp, Artificial sequence
  SiRNA target sequence
tctgaatgttacaagcagatg

SEQ ID NO: 2958 - DNA, 21 bp, Artificial sequence
  SiRNA target sequence
ctgaatgttacaagcagatgg

SEQ ID NO: 2959 - DNA, 21 bp, Artificial sequence
  SiRNA target sequence
tgaatgttacaagcagatggg

SEQ ID NO: 2960 - DNA, 21 bp, Artificial sequence
  SiRNA target sequence
gaatgttacaagcagatggga

SEQ ID NO: 2961 - DNA, 21 bp, Artificial sequence
  SiRNA target sequence
aatgttacaagcagatgggaa

SEQ ID NO: 2962 - DNA, 21 bp, Artificial sequence
  SiRNA target sequence
atgttacaagcagatgggaaa

SEQ ID NO: 2963 - DNA, 21 bp, Artificial sequence
  SiRNA target sequence
tgttacaagcagatgggaaat

SEQ ID NO: 2964 - DNA, 21 bp, Artificial sequence
  SiRNA target sequence
gttacaagcagatgggaaata

SEQ ID NO: 2965 - DNA, 21 bp, Artificial sequence
  SiRNA target sequence
ttacaagcagatgggaaataa

SEQ ID NO: 2966 - DNA, 21 bp, Artificial sequence
  SiRNA target sequence
tacaagcagatgggaaataaa

SEQ ID NO: 2967 - DNA, 21 bp, Artificial sequence
  SiRNA target sequence
acaagcagatgggaaataaaa

SEQ ID NO: 2968 - DNA, 21 bp, Artificial sequence
  SiRNA target sequence
caagcagatgggaaataaaaa

SEQ ID NO: 2969 - DNA, 21 bp, Artificial sequence
  SiRNA target sequence
aagcagatgggaaataaaaaa

SEQ ID NO: 2970 - DNA, 21 bp, Artificial sequence
  SiRNA target sequence
agcagatgggaaataaaaaaa

SEQ ID NO: 2971 - DNA, 21 bp, Artificial sequence
  SiRNA target sequence
gcagatgggaaataaaaaaaa

SEQ ID NO: 2972 - DNA, 21 bp, Artificial sequence
  SiRNA target sequence
cagatgggaaataaaaaaaaa

SEQ ID NO: 2973 - DNA, 21 bp, Artificial sequence
  SiRNA target sequence
agatgggaaataaaaaaaaat

SEQ ID NO: 2974 - DNA, 21 bp, Artificial sequence
  SiRNA target sequence
gatgggaaataaaaaaaaatt

SEQ ID NO: 2975 - DNA, 21 bp, Artificial sequence
  SiRNA target sequence
atgggaaataaaaaaaaattt

SEQ ID NO: 2976 - DNA, 21 bp, Artificial sequence
  SiRNA target sequence
tgggaaataaaaaaaaatttc

SEQ ID NO: 2977 - DNA, 21 bp, Artificial sequence
  SiRNA target sequence
gggaaataaaaaaaaatttct

SEQ ID NO: 2978 - DNA, 21 bp, Artificial sequence
  SiRNA target sequence
ggaaataaaaaaaaatttctt

SEQ ID NO: 2979 - DNA, 21 bp, Artificial sequence
  SiRNA target sequence
gaaataaaaaaaaatttctta

SEQ ID NO: 2980 - DNA, 21 bp, Artificial sequence
  SiRNA target sequence
aaataaaaaaaaatttcttaa

SEQ ID NO: 2981 - DNA, 21 bp, Artificial sequence
  SiRNA target sequence
aataaaaaaaaatttcttaag

SEQ ID NO: 2982 - DNA, 21 bp, Artificial sequence
  SiRNA target sequence
ataaaaaaaaatttcttaagg

SEQ ID NO: 2983 - DNA, 21 bp, Artificial sequence
  SiRNA target sequence
taaaaaaaaatttcttaagga

SEQ ID NO: 2984 - DNA, 21 bp, Artificial sequence
  SiRNA target sequence
aaaaaaaaatttcttaaggat

SEQ ID NO: 2985 - DNA, 21 bp, Artificial sequence
  SiRNA target sequence
aaaaaaaatttcttaaggatt

SEQ ID NO: 2986 - DNA, 21 bp, Artificial sequence
  SiRNA target sequence
aaaaaaatttcttaaggattt

SEQ ID NO: 2987 - DNA, 21 bp, Artificial sequence
  SiRNA target sequence
aaaaaatttcttaaggattta

SEQ ID NO: 2988 - DNA, 21 bp, Artificial sequence
  SiRNA target sequence
aaaaatttcttaaggatttag

SEQ ID NO: 2989 - DNA, 21 bp, Artificial sequence
  SiRNA target sequence
aaaatttcttaaggatttagc

SEQ ID NO: 2990 - DNA, 21 bp, Artificial sequence
  SiRNA target sequence
aaatttcttaaggatttagca

SEQ ID NO: 2991 - DNA, 21 bp, Artificial sequence
  SiRNA target sequence
aatttcttaaggatttagcac

SEQ ID NO: 2992 - DNA, 21 bp, Artificial sequence
  SiRNA target sequence
atttcttaaggatttagcact

SEQ ID NO: 2993 - DNA, 21 bp, Artificial sequence
  SiRNA target sequence
tttcttaaggatttagcactt

SEQ ID NO: 2994 - DNA, 21 bp, Artificial sequence
  SiRNA target sequence
ttcttaaggatttagcacttt

SEQ ID NO: 2995 - DNA, 21 bp, Artificial sequence
  SiRNA target sequence
tcttaaggatttagcacttta

SEQ ID NO: 2996 - DNA, 21 bp, Artificial sequence
  SiRNA target sequence
cttaaggatttagcactttat

SEQ ID NO: 2997 - DNA, 21 bp, Artificial sequence
  SiRNA target sequence
ttaaggatttagcactttatg

SEQ ID NO: 2998 - DNA, 21 bp, Artificial sequence
  SiRNA target sequence
taaggatttagcactttatga

SEQ ID NO: 2999 - DNA, 21 bp, Artificial sequence
  SiRNA target sequence
aaggatttagcactttatgaa

SEQ ID NO: 3000 - DNA, 21 bp, Artificial sequence
  SiRNA target sequence
aggatttagcactttatgaaa

SEQ ID NO: 3001 - DNA, 21 bp, Artificial sequence
  SiRNA target sequence
ggatttagcactttatgaaac

SEQ ID NO: 3002 - DNA, 21 bp, Artificial sequence
  SiRNA target sequence
gatttagcactttatgaaaca

SEQ ID NO: 3003 - DNA, 21 bp, Artificial sequence
  SiRNA target sequence
atttagcactttatgaaacat

SEQ ID NO: 3004 - DNA, 21 bp, Artificial sequence
  SiRNA target sequence
tttagcactttatgaaacatt

SEQ ID NO: 3005 - DNA, 21 bp, Artificial sequence
  SiRNA target sequence
ttagcactttatgaaacattt

SEQ ID NO: 3006 - DNA, 21 bp, Artificial sequence
  SiRNA target sequence
tagcactttatgaaacatttg

SEQ ID NO: 3007 - DNA, 21 bp, Artificial sequence
  SiRNA target sequence
agcactttatgaaacatttgc

SEQ ID NO: 3008 - DNA, 21 bp, Artificial sequence
  SiRNA target sequence
gcactttatgaaacatttgct

SEQ ID NO: 3009 - DNA, 21 bp, Artificial sequence
  SiRNA target sequence
cactttatgaaacatttgcta

SEQ ID NO: 3010 - DNA, 21 bp, Artificial sequence
  SiRNA target sequence
actttatgaaacatttgctaa

SEQ ID NO: 3011 - DNA, 21 bp, Artificial sequence
  SiRNA target sequence
ctttatgaaacatttgctaat

SEQ ID NO: 3012 - DNA, 21 bp, Artificial sequence
  SiRNA target sequence
tttatgaaacatttgctaata

SEQ ID NO: 3013 - DNA, 21 bp, Artificial sequence
  SiRNA target sequence
ttatgaaacatttgctaataa

SEQ ID NO: 3014 - DNA, 21 bp, Artificial sequence
  SiRNA target sequence
tatgaaacatttgctaataat

SEQ ID NO: 3015 - DNA, 21 bp, Artificial sequence
  SiRNA target sequence
atgaaacatttgctaataata

SEQ ID NO: 3016 - DNA, 21 bp, Artificial sequence
  SiRNA target sequence
tgaaacatttgctaataataa

SEQ ID NO: 3017 - DNA, 21 bp, Artificial sequence
  SiRNA target sequence
gaaacatttgctaataataaa

SEQ ID NO: 3018 - DNA, 21 bp, Artificial sequence
  SiRNA target sequence
aaacatttgctaataataaag

SEQ ID NO: 3019 - DNA, 21 bp, Artificial sequence
  SiRNA target sequence
aacatttgctaataataaaga

SEQ ID NO: 3020 - DNA, 21 bp, Artificial sequence
  SiRNA target sequence
acatttgctaataataaagaa

SEQ ID NO: 3021 - DNA, 21 bp, Artificial sequence
  SiRNA target sequence
catttgctaataataaagaag

SEQ ID NO: 3022 - DNA, 21 bp, Artificial sequence
  SiRNA target sequence
atttgctaataataaagaagt

SEQ ID NO: 3023 - DNA, 21 bp, Artificial sequence
  SiRNA target sequence
tttgctaataataaagaagtc

SEQ ID NO: 3024 - DNA, 21 bp, Artificial sequence
  SiRNA target sequence
ttgctaataataaagaagtcc

SEQ ID NO: 3025 - DNA, 21 bp, Artificial sequence
  SiRNA target sequence
tgctaataataaagaagtcca

SEQ ID NO: 3026 - DNA, 21 bp, Artificial sequence
  SiRNA target sequence
gctaataataaagaagtccaa

SEQ ID NO: 3027 - DNA, 21 bp, Artificial sequence
  SiRNA target sequence
ctaataataaagaagtccaag

SEQ ID NO: 3028 - DNA, 21 bp, Artificial sequence
  SiRNA target sequence
taataataaagaagtccaaga

SEQ ID NO: 3029 - DNA, 21 bp, Artificial sequence
  SiRNA target sequence
aataataaagaagtccaagat

SEQ ID NO: 3030 - DNA, 21 bp, Artificial sequence
  SiRNA target sequence
ataataaagaagtccaagatg

SEQ ID NO: 3031 - DNA, 21 bp, Artificial sequence
  SiRNA target sequence
taataaagaagtccaagatga

SEQ ID NO: 3032 - DNA, 21 bp, Artificial sequence
  SiRNA target sequence
aataaagaagtccaagatgaa

SEQ ID NO: 3033 - DNA, 21 bp, Artificial sequence
  SiRNA target sequence
ataaagaagtccaagatgaaa

SEQ ID NO: 3034 - DNA, 21 bp, Artificial sequence
  SiRNA target sequence
taaagaagtccaagatgaaat

SEQ ID NO: 3035 - DNA, 21 bp, Artificial sequence
  SiRNA target sequence
aaagaagtccaagatgaaatt

SEQ ID NO: 3036 - DNA, 21 bp, Artificial sequence
  SiRNA target sequence
aagaagtccaagatgaaatta

SEQ ID NO: 3037 - DNA, 21 bp, Artificial sequence
  SiRNA target sequence
agaagtccaagatgaaattat

SEQ ID NO: 3038 - DNA, 21 bp, Artificial sequence
  SiRNA target sequence
gaagtccaagatgaaattatg

SEQ ID NO: 3039 - DNA, 21 bp, Artificial sequence
  SiRNA target sequence
aagtccaagatgaaattatgc

SEQ ID NO: 3040 - DNA, 21 bp, Artificial sequence
  SiRNA target sequence
agtccaagatgaaattatgca

SEQ ID NO: 3041 - DNA, 21 bp, Artificial sequence
  SiRNA target sequence
gtccaagatgaaattatgcag

SEQ ID NO: 3042 - DNA, 21 bp, Artificial sequence
  SiRNA target sequence
tccaagatgaaattatgcaga

SEQ ID NO: 3043 - DNA, 21 bp, Artificial sequence
  SiRNA target sequence
ccaagatgaaattatgcagac

SEQ ID NO: 3044 - DNA, 21 bp, Artificial sequence
  SiRNA target sequence
caagatgaaattatgcagact

SEQ ID NO: 3045 - DNA, 21 bp, Artificial sequence
  SiRNA target sequence
aagatgaaattatgcagactg

SEQ ID NO: 3046 - DNA, 21 bp, Artificial sequence
  SiRNA target sequence
agatgaaattatgcagactgt

SEQ ID NO: 3047 - DNA, 21 bp, Artificial sequence
  SiRNA target sequence
gatgaaattatgcagactgtt

SEQ ID NO: 3048 - DNA, 21 bp, Artificial sequence
  SiRNA target sequence
atgaaattatgcagactgtta

SEQ ID NO: 3049 - DNA, 21 bp, Artificial sequence
  SiRNA target sequence
tgaaattatgcagactgttaa

SEQ ID NO: 3050 - DNA, 21 bp, Artificial sequence
  SiRNA target sequence
gaaattatgcagactgttaaa

SEQ ID NO: 3051 - DNA, 21 bp, Artificial sequence
  SiRNA target sequence
aaattatgcagactgttaaag

SEQ ID NO: 3052 - DNA, 21 bp, Artificial sequence
  SiRNA target sequence
aattatgcagactgttaaaga

SEQ ID NO: 3053 - DNA, 21 bp, Artificial sequence
  SiRNA target sequence
attatgcagactgttaaagaa

SEQ ID NO: 3054 - DNA, 21 bp, Artificial sequence
  SiRNA target sequence
ttatgcagactgttaaagaaa

SEQ ID NO: 3055 - DNA, 21 bp, Artificial sequence
  SiRNA target sequence
tatgcagactgttaaagaaat

SEQ ID NO: 3056 - DNA, 21 bp, Artificial sequence
  SiRNA target sequence
atgcagactgttaaagaaatt

SEQ ID NO: 3057 - DNA, 21 bp, Artificial sequence
  SiRNA target sequence
tgcagactgttaaagaaattt

SEQ ID NO: 3058 - DNA, 21 bp, Artificial sequence
  SiRNA target sequence
gcagactgttaaagaaatttg

SEQ ID NO: 3059 - DNA, 21 bp, Artificial sequence
  SiRNA target sequence
cagactgttaaagaaatttgt

SEQ ID NO: 3060 - DNA, 21 bp, Artificial sequence
  SiRNA target sequence
agactgttaaagaaatttgtg

SEQ ID NO: 3061 - DNA, 21 bp, Artificial sequence
  SiRNA target sequence
gactgttaaagaaatttgtga

SEQ ID NO: 3062 - DNA, 21 bp, Artificial sequence
  SiRNA target sequence
actgttaaagaaatttgtgaa

SEQ ID NO: 3063 - DNA, 21 bp, Artificial sequence
  SiRNA target sequence
ctgttaaagaaatttgtgaag

SEQ ID NO: 3064 - DNA, 21 bp, Artificial sequence
  SiRNA target sequence
tgttaaagaaatttgtgaaga

SEQ ID NO: 3065 - DNA, 21 bp, Artificial sequence
  SiRNA target sequence
gttaaagaaatttgtgaagaa

SEQ ID NO: 3066 - DNA, 21 bp, Artificial sequence
  SiRNA target sequence
ttaaagaaatttgtgaagaag

SEQ ID NO: 3067 - DNA, 21 bp, Artificial sequence
  SiRNA target sequence
taaagaaatttgtgaagaaga

SEQ ID NO: 3068 - DNA, 21 bp, Artificial sequence
  SiRNA target sequence
aaagaaatttgtgaagaagaa

SEQ ID NO: 3069 - DNA, 21 bp, Artificial sequence
  SiRNA target sequence
aagaaatttgtgaagaagaag

SEQ ID NO: 3070 - DNA, 21 bp, Artificial sequence
  SiRNA target sequence
agaaatttgtgaagaagaagt

SEQ ID NO: 3071 - DNA, 21 bp, Artificial sequence
  SiRNA target sequence
gaaatttgtgaagaagaagtg

SEQ ID NO: 3072 - DNA, 21 bp, Artificial sequence
  SiRNA target sequence
aaatttgtgaagaagaagtga

SEQ ID NO: 3073 - DNA, 21 bp, Artificial sequence
  SiRNA target sequence
aatttgtgaagaagaagtgaa

SEQ ID NO: 3074 - DNA, 21 bp, Artificial sequence
  SiRNA target sequence
atttgtgaagaagaagtgaat

SEQ ID NO: 3075 - DNA, 21 bp, Artificial sequence
  SiRNA target sequence
tttgtgaagaagaagtgaatg

SEQ ID NO: 3076 - DNA, 21 bp, Artificial sequence
  SiRNA target sequence
ttgtgaagaagaagtgaatga

SEQ ID NO: 3077 - DNA, 21 bp, Artificial sequence
  SiRNA target sequence
tgtgaagaagaagtgaatgag

SEQ ID NO: 3078 - DNA, 21 bp, Artificial sequence
  SiRNA target sequence
gtgaagaagaagtgaatgagt

SEQ ID NO: 3079 - DNA, 21 bp, Artificial sequence
  SiRNA target sequence
tgaagaagaagtgaatgagtt

SEQ ID NO: 3080 - DNA, 21 bp, Artificial sequence
  SiRNA target sequence
gaagaagaagtgaatgagttt

SEQ ID NO: 3081 - DNA, 21 bp, Artificial sequence
  SiRNA target sequence
aagaagaagtgaatgagttta

SEQ ID NO: 3082 - DNA, 21 bp, Artificial sequence
  SiRNA target sequence
agaagaagtgaatgagtttat

SEQ ID NO: 3083 - DNA, 21 bp, Artificial sequence
  SiRNA target sequence
gaagaagtgaatgagtttatt

SEQ ID NO: 3084 - DNA, 21 bp, Artificial sequence
  SiRNA target sequence
aagaagtgaatgagtttattg

SEQ ID NO: 3085 - DNA, 21 bp, Artificial sequence
  SiRNA target sequence
agaagtgaatgagtttattga

SEQ ID NO: 3086 - DNA, 21 bp, Artificial sequence
  SiRNA target sequence
gaagtgaatgagtttattgaa

SEQ ID NO: 3087 - DNA, 21 bp, Artificial sequence
  SiRNA target sequence
aagtgaatgagtttattgaac

SEQ ID NO: 3088 - DNA, 21 bp, Artificial sequence
  SiRNA target sequence
agtgaatgagtttattgaaca

SEQ ID NO: 3089 - DNA, 21 bp, Artificial sequence
  SiRNA target sequence
gtgaatgagtttattgaacaa

SEQ ID NO: 3090 - DNA, 21 bp, Artificial sequence
  SiRNA target sequence
tgaatgagtttattgaacaag

SEQ ID NO: 3091 - DNA, 21 bp, Artificial sequence
  SiRNA target sequence
gaatgagtttattgaacaaga

SEQ ID NO: 3092 - DNA, 21 bp, Artificial sequence
  SiRNA target sequence
aatgagtttattgaacaagaa

SEQ ID NO: 3093 - DNA, 21 bp, Artificial sequence
  SiRNA target sequence
atgagtttattgaacaagaag

SEQ ID NO: 3094 - DNA, 21 bp, Artificial sequence
  SiRNA target sequence
tgagtttattgaacaagaagg

SEQ ID NO: 3095 - DNA, 21 bp, Artificial sequence
  SiRNA target sequence
gagtttattgaacaagaaggt

SEQ ID NO: 3096 - DNA, 21 bp, Artificial sequence
  SiRNA target sequence
agtttattgaacaagaaggtt

SEQ ID NO: 3097 - DNA, 21 bp, Artificial sequence
  SiRNA target sequence
gtttattgaacaagaaggttt

SEQ ID NO: 3098 - DNA, 21 bp, Artificial sequence
  SiRNA target sequence
tttattgaacaagaaggttta

SEQ ID NO: 3099 - DNA, 21 bp, Artificial sequence
  SiRNA target sequence
ttattgaacaagaaggtttaa

SEQ ID NO: 3100 - DNA, 21 bp, Artificial sequence
  SiRNA target sequence
tattgaacaagaaggtttaaa

SEQ ID NO: 3101 - DNA, 21 bp, Artificial sequence
  SiRNA target sequence
attgaacaagaaggtttaaaa

SEQ ID NO: 3102 - DNA, 21 bp, Artificial sequence
  SiRNA target sequence
ttgaacaagaaggtttaaaaa

SEQ ID NO: 3103 - DNA, 21 bp, Artificial sequence
  SiRNA target sequence
tgaacaagaaggtttaaaaat

SEQ ID NO: 3104 - DNA, 21 bp, Artificial sequence
  SiRNA target sequence
gaacaagaaggtttaaaaatt

SEQ ID NO: 3105 - DNA, 21 bp, Artificial sequence
  SiRNA target sequence
aacaagaaggtttaaaaatta

SEQ ID NO: 3106 - DNA, 21 bp, Artificial sequence
  SiRNA target sequence
acaagaaggtttaaaaattaa

SEQ ID NO: 3107 - DNA, 21 bp, Artificial sequence
  SiRNA target sequence
caagaaggtttaaaaattaat

SEQ ID NO: 3108 - DNA, 21 bp, Artificial sequence
  SiRNA target sequence
aagaaggtttaaaaattaata

SEQ ID NO: 3109 - DNA, 21 bp, Artificial sequence
  SiRNA target sequence
agaaggtttaaaaattaataa

SEQ ID NO: 3110 - DNA, 21 bp, Artificial sequence
  SiRNA target sequence
gaaggtttaaaaattaataaa

SEQ ID NO: 3111 - DNA, 21 bp, Artificial sequence
  SiRNA target sequence
aaggtttaaaaattaataaag

SEQ ID NO: 3112 - DNA, 21 bp, Artificial sequence
  SiRNA target sequence
aggtttaaaaattaataaaga

SEQ ID NO: 3113 - DNA, 21 bp, Artificial sequence
  SiRNA target sequence
ggtttaaaaattaataaagaa

SEQ ID NO: 3114 - DNA, 21 bp, Artificial sequence
  SiRNA target sequence
gtttaaaaattaataaagaag

SEQ ID NO: 3115 - DNA, 21 bp, Artificial sequence
  SiRNA target sequence
tttaaaaattaataaagaaga

SEQ ID NO: 3116 - DNA, 21 bp, Artificial sequence
  SiRNA target sequence
ttaaaaattaataaagaagat

SEQ ID NO: 3117 - DNA, 21 bp, Artificial sequence
  SiRNA target sequence
taaaaattaataaagaagatg

SEQ ID NO: 3118 - DNA, 21 bp, Artificial sequence
  SiRNA target sequence
aaaaattaataaagaagatgt

SEQ ID NO: 3119 - DNA, 21 bp, Artificial sequence
  SiRNA target sequence
aaaattaataaagaagatgtg

SEQ ID NO: 3120 - DNA, 21 bp, Artificial sequence
  SiRNA target sequence
aaattaataaagaagatgtgc

SEQ ID NO: 3121 - DNA, 21 bp, Artificial sequence
  SiRNA target sequence
aattaataaagaagatgtgct

SEQ ID NO: 3122 - DNA, 21 bp, Artificial sequence
  SiRNA target sequence
attaataaagaagatgtgcta

SEQ ID NO: 3123 - DNA, 21 bp, Artificial sequence
  SiRNA target sequence
ttaataaagaagatgtgctaa

SEQ ID NO: 3124 - DNA, 21 bp, Artificial sequence
  SiRNA target sequence
taataaagaagatgtgctaag

SEQ ID NO: 3125 - DNA, 21 bp, Artificial sequence
  SiRNA target sequence
aataaagaagatgtgctaaga

SEQ ID NO: 3126 - DNA, 21 bp, Artificial sequence
  SiRNA target sequence
ataaagaagatgtgctaagag

SEQ ID NO: 3127 - DNA, 21 bp, Artificial sequence
  SiRNA target sequence
taaagaagatgtgctaagagg

SEQ ID NO: 3128 - DNA, 21 bp, Artificial sequence
  SiRNA target sequence
aaagaagatgtgctaagagga

SEQ ID NO: 3129 - DNA, 21 bp, Artificial sequence
  SiRNA target sequence
aagaagatgtgctaagaggac

SEQ ID NO: 3130 - DNA, 21 bp, Artificial sequence
  SiRNA target sequence
agaagatgtgctaagaggact

SEQ ID NO: 3131 - DNA, 21 bp, Artificial sequence
  SiRNA target sequence
gaagatgtgctaagaggactt

SEQ ID NO: 3132 - DNA, 21 bp, Artificial sequence
  SiRNA target sequence
aagatgtgctaagaggacttg

SEQ ID NO: 3133 - DNA, 21 bp, Artificial sequence
  SiRNA target sequence
agatgtgctaagaggacttgt

SEQ ID NO: 3134 - DNA, 21 bp, Artificial sequence
  SiRNA target sequence
gatgtgctaagaggacttgtt

SEQ ID NO: 3135 - DNA, 21 bp, Artificial sequence
  SiRNA target sequence
atgtgctaagaggacttgttt

SEQ ID NO: 3136 - DNA, 21 bp, Artificial sequence
  SiRNA target sequence
tgtgctaagaggacttgtttc

SEQ ID NO: 3137 - DNA, 21 bp, Artificial sequence
  SiRNA target sequence
gtgctaagaggacttgtttca

SEQ ID NO: 3138 - DNA, 21 bp, Artificial sequence
  SiRNA target sequence
tgctaagaggacttgtttcaa

SEQ ID NO: 3139 - DNA, 21 bp, Artificial sequence
  SiRNA target sequence
gctaagaggacttgtttcaat

SEQ ID NO: 3140 - DNA, 21 bp, Artificial sequence
  SiRNA target sequence
ctaagaggacttgtttcaata

SEQ ID NO: 3141 - DNA, 21 bp, Artificial sequence
  SiRNA target sequence
taagaggacttgtttcaataa

SEQ ID NO: 3142 - DNA, 21 bp, Artificial sequence
  SiRNA target sequence
aagaggacttgtttcaataaa

SEQ ID NO: 3143 - DNA, 21 bp, Artificial sequence
  SiRNA target sequence
agaggacttgtttcaataaaa

SEQ ID NO: 3144 - DNA, 21 bp, Artificial sequence
  SiRNA target sequence
gaggacttgtttcaataaaaa

SEQ ID NO: 3145 - DNA, 21 bp, Artificial sequence
  SiRNA target sequence
aggacttgtttcaataaaaaa

SEQ ID NO: 3146 - DNA, 21 bp, Artificial sequence
  SiRNA target sequence
ggacttgtttcaataaaaaat

SEQ ID NO: 3147 - DNA, 21 bp, Artificial sequence
  SiRNA target sequence
gacttgtttcaataaaaaata

SEQ ID NO: 3148 - DNA, 21 bp, Artificial sequence
  SiRNA target sequence
acttgtttcaataaaaaatat

SEQ ID NO: 3149 - DNA, 21 bp, Artificial sequence
  SiRNA target sequence
cttgtttcaataaaaaatata

SEQ ID NO: 3150 - DNA, 21 bp, Artificial sequence
  SiRNA target sequence
ttgtttcaataaaaaatataa

SEQ ID NO: 3151 - DNA, 21 bp, Artificial sequence
  SiRNA target sequence
tgtttcaataaaaaatataaa

SEQ ID NO: 3152 - DNA, 21 bp, Artificial sequence
  SiRNA target sequence
gtttcaataaaaaatataaat

SEQ ID NO: 3153 - DNA, 21 bp, Artificial sequence
  SiRNA target sequence
tttcaataaaaaatataaatg

SEQ ID NO: 3154 - DNA, 21 bp, Artificial sequence
  SiRNA target sequence
ttcaataaaaaatataaatga

SEQ ID NO: 3155 - DNA, 21 bp, Artificial sequence
  SiRNA target sequence
tcaataaaaaatataaatgag

SEQ ID NO: 3156 - DNA, 21 bp, Artificial sequence
  SiRNA target sequence
caataaaaaatataaatgaga

SEQ ID NO: 3157 - DNA, 21 bp, Artificial sequence
  SiRNA target sequence
aataaaaaatataaatgagat

SEQ ID NO: 3158 - DNA, 21 bp, Artificial sequence
  SiRNA target sequence
ataaaaaatataaatgagatt

SEQ ID NO: 3159 - DNA, 21 bp, Artificial sequence
  SiRNA target sequence
taaaaaatataaatgagattt

SEQ ID NO: 3160 - DNA, 21 bp, Artificial sequence
  SiRNA target sequence
aaaaaatataaatgagattta

SEQ ID NO: 3161 - DNA, 21 bp, Artificial sequence
  SiRNA target sequence
aaaaatataaatgagatttat

SEQ ID NO: 3162 - DNA, 21 bp, Artificial sequence
  SiRNA target sequence
aaaatataaatgagatttatg

SEQ ID NO: 3163 - DNA, 21 bp, Artificial sequence
  SiRNA target sequence
aaatataaatgagatttatga

SEQ ID NO: 3164 - DNA, 21 bp, Artificial sequence
  SiRNA target sequence
aatataaatgagatttatgat

SEQ ID NO: 3165 - DNA, 21 bp, Artificial sequence
  SiRNA target sequence
atataaatgagatttatgatg

SEQ ID NO: 3166 - DNA, 21 bp, Artificial sequence
  SiRNA target sequence
tataaatgagatttatgatgc

SEQ ID NO: 3167 - DNA, 21 bp, Artificial sequence
  SiRNA target sequence
ataaatgagatttatgatgca

SEQ ID NO: 3168 - DNA, 21 bp, Artificial sequence
  SiRNA target sequence
taaatgagatttatgatgcat

SEQ ID NO: 3169 - DNA, 21 bp, Artificial sequence
  SiRNA target sequence
aaatgagatttatgatgcatt

SEQ ID NO: 3170 - DNA, 21 bp, Artificial sequence
  SiRNA target sequence
aatgagatttatgatgcattt

SEQ ID NO: 3171 - DNA, 21 bp, Artificial sequence
  SiRNA target sequence
atgagatttatgatgcatttg

SEQ ID NO: 3172 - DNA, 21 bp, Artificial sequence
  SiRNA target sequence
tgagatttatgatgcatttgg

SEQ ID NO: 3173 - DNA, 21 bp, Artificial sequence
  SiRNA target sequence
gagatttatgatgcatttgga

SEQ ID NO: 3174 - DNA, 21 bp, Artificial sequence
  SiRNA target sequence
agatttatgatgcatttggag

SEQ ID NO: 3175 - DNA, 21 bp, Artificial sequence
  SiRNA target sequence
gatttatgatgcatttggagg

SEQ ID NO: 3176 - DNA, 21 bp, Artificial sequence
  SiRNA target sequence
atttatgatgcatttggaggt

SEQ ID NO: 3177 - DNA, 21 bp, Artificial sequence
  SiRNA target sequence
tttatgatgcatttggaggta

SEQ ID NO: 3178 - DNA, 21 bp, Artificial sequence
  SiRNA target sequence
ttatgatgcatttggaggtaa

SEQ ID NO: 3179 - DNA, 21 bp, Artificial sequence
  SiRNA target sequence
tatgatgcatttggaggtaaa

SEQ ID NO: 3180 - DNA, 21 bp, Artificial sequence
  SiRNA target sequence
atgatgcatttggaggtaaat

SEQ ID NO: 3181 - DNA, 21 bp, Artificial sequence
  SiRNA target sequence
tgatgcatttggaggtaaatc

SEQ ID NO: 3182 - DNA, 21 bp, Artificial sequence
  SiRNA target sequence
gatgcatttggaggtaaatct

SEQ ID NO: 3183 - DNA, 21 bp, Artificial sequence
  SiRNA target sequence
atgcatttggaggtaaatcta

SEQ ID NO: 3184 - DNA, 21 bp, Artificial sequence
  SiRNA target sequence
tgcatttggaggtaaatctaa

SEQ ID NO: 3185 - DNA, 21 bp, Artificial sequence
  SiRNA target sequence
gcatttggaggtaaatctaag

SEQ ID NO: 3186 - DNA, 21 bp, Artificial sequence
  SiRNA target sequence
catttggaggtaaatctaaga

SEQ ID NO: 3187 - DNA, 21 bp, Artificial sequence
  SiRNA target sequence
atttggaggtaaatctaagaa

SEQ ID NO: 3188 - DNA, 21 bp, Artificial sequence
  SiRNA target sequence
tttggaggtaaatctaagaag

SEQ ID NO: 3189 - DNA, 21 bp, Artificial sequence
  SiRNA target sequence
ttggaggtaaatctaagaagt

SEQ ID NO: 3190 - DNA, 21 bp, Artificial sequence
  SiRNA target sequence
tggaggtaaatctaagaagtt

SEQ ID NO: 3191 - DNA, 21 bp, Artificial sequence
  SiRNA target sequence
ggaggtaaatctaagaagttt

SEQ ID NO: 3192 - DNA, 21 bp, Artificial sequence
  SiRNA target sequence
gaggtaaatctaagaagttta

SEQ ID NO: 3193 - DNA, 21 bp, Artificial sequence
  SiRNA target sequence
aggtaaatctaagaagtttaa

SEQ ID NO: 3194 - DNA, 21 bp, Artificial sequence
  SiRNA target sequence
ggtaaatctaagaagtttaaa

SEQ ID NO: 3195 - DNA, 21 bp, Artificial sequence
  SiRNA target sequence
gtaaatctaagaagtttaaat

SEQ ID NO: 3196 - DNA, 21 bp, Artificial sequence
  SiRNA target sequence
taaatctaagaagtttaaatt

SEQ ID NO: 3197 - DNA, 21 bp, Artificial sequence
  SiRNA target sequence
aaatctaagaagtttaaattt

SEQ ID NO: 3198 - DNA, 21 bp, Artificial sequence
  SiRNA target sequence
aatctaagaagtttaaatttt

SEQ ID NO: 3199 - DNA, 21 bp, Artificial sequence
  SiRNA target sequence
atctaagaagtttaaattttc

SEQ ID NO: 3200 - DNA, 21 bp, Artificial sequence
  SiRNA target sequence
tctaagaagtttaaattttct

SEQ ID NO: 3201 - DNA, 21 bp, Artificial sequence
  SiRNA target sequence
ctaagaagtttaaattttcta

SEQ ID NO: 3202 - DNA, 21 bp, Artificial sequence
  SiRNA target sequence
taagaagtttaaattttctaa

SEQ ID NO: 3203 - DNA, 21 bp, Artificial sequence
  SiRNA target sequence
aagaagtttaaattttctaat

SEQ ID NO: 3204 - DNA, 21 bp, Artificial sequence
  SiRNA target sequence
agaagtttaaattttctaatg

SEQ ID NO: 3205 - DNA, 21 bp, Artificial sequence
  SiRNA target sequence
gaagtttaaattttctaatga

SEQ ID NO: 3206 - DNA, 21 bp, Artificial sequence
  SiRNA target sequence
aagtttaaattttctaatgat

SEQ ID NO: 3207 - DNA, 21 bp, Artificial sequence
  SiRNA target sequence
agtttaaattttctaatgatg

SEQ ID NO: 3208 - DNA, 21 bp, Artificial sequence
  SiRNA target sequence
gtttaaattttctaatgatga

SEQ ID NO: 3209 - DNA, 21 bp, Artificial sequence
  SiRNA target sequence
tttaaattttctaatgatgaa

SEQ ID NO: 3210 - DNA, 21 bp, Artificial sequence
  SiRNA target sequence
ttaaattttctaatgatgaaa

SEQ ID NO: 3211 - DNA, 21 bp, Artificial sequence
  SiRNA target sequence
taaattttctaatgatgaaaa

SEQ ID NO: 3212 - DNA, 21 bp, Artificial sequence
  SiRNA target sequence
aaattttctaatgatgaaaag

SEQ ID NO: 3213 - DNA, 21 bp, Artificial sequence
  SiRNA target sequence
aattttctaatgatgaaaagg

SEQ ID NO: 3214 - DNA, 21 bp, Artificial sequence
  SiRNA target sequence
attttctaatgatgaaaagga

SEQ ID NO: 3215 - DNA, 21 bp, Artificial sequence
  SiRNA target sequence
ttttctaatgatgaaaaggaa

SEQ ID NO: 3216 - DNA, 21 bp, Artificial sequence
  SiRNA target sequence
tttctaatgatgaaaaggaag

SEQ ID NO: 3217 - DNA, 21 bp, Artificial sequence
  SiRNA target sequence
ttctaatgatgaaaaggaagt

SEQ ID NO: 3218 - DNA, 21 bp, Artificial sequence
  SiRNA target sequence
tctaatgatgaaaaggaagtg

SEQ ID NO: 3219 - DNA, 21 bp, Artificial sequence
  SiRNA target sequence
ctaatgatgaaaaggaagtgt

SEQ ID NO: 3220 - DNA, 21 bp, Artificial sequence
  SiRNA target sequence
taatgatgaaaaggaagtgtt

SEQ ID NO: 3221 - DNA, 21 bp, Artificial sequence
  SiRNA target sequence
aatgatgaaaaggaagtgtta

SEQ ID NO: 3222 - DNA, 21 bp, Artificial sequence
  SiRNA target sequence
atgatgaaaaggaagtgttaa

SEQ ID NO: 3223 - DNA, 21 bp, Artificial sequence
  SiRNA target sequence
tgatgaaaaggaagtgttaaa

SEQ ID NO: 3224 - DNA, 21 bp, Artificial sequence
  SiRNA target sequence
gatgaaaaggaagtgttaaat

SEQ ID NO: 3225 - DNA, 21 bp, Artificial sequence
  SiRNA target sequence
atgaaaaggaagtgttaaatc

SEQ ID NO: 3226 - DNA, 21 bp, Artificial sequence
  SiRNA target sequence
tgaaaaggaagtgttaaatct

SEQ ID NO: 3227 - DNA, 21 bp, Artificial sequence
  SiRNA target sequence
gaaaaggaagtgttaaatctt

SEQ ID NO: 3228 - DNA, 21 bp, Artificial sequence
  SiRNA target sequence
aaaaggaagtgttaaatcttc

SEQ ID NO: 3229 - DNA, 21 bp, Artificial sequence
  SiRNA target sequence
aaaggaagtgttaaatcttct

SEQ ID NO: 3230 - DNA, 21 bp, Artificial sequence
  SiRNA target sequence
aaggaagtgttaaatcttctt

SEQ ID NO: 3231 - DNA, 21 bp, Artificial sequence
  SiRNA target sequence
aggaagtgttaaatcttctta

SEQ ID NO: 3232 - DNA, 21 bp, Artificial sequence
  SiRNA target sequence
ggaagtgttaaatcttcttaa

SEQ ID NO: 3233 - DNA, 21 bp, Artificial sequence
  SiRNA target sequence
gaagtgttaaatcttcttaat

SEQ ID NO: 3234 - DNA, 21 bp, Artificial sequence
  SiRNA target sequence
aagtgttaaatcttcttaatg

SEQ ID NO: 3235 - DNA, 21 bp, Artificial sequence
  SiRNA target sequence
agtgttaaatcttcttaatgc

SEQ ID NO: 3236 - DNA, 21 bp, Artificial sequence
  SiRNA target sequence
gtgttaaatcttcttaatgcc

SEQ ID NO: 3237 - DNA, 21 bp, Artificial sequence
  SiRNA target sequence
tgttaaatcttcttaatgcca

SEQ ID NO: 3238 - DNA, 21 bp, Artificial sequence
  SiRNA target sequence
gttaaatcttcttaatgccat

SEQ ID NO: 3239 - DNA, 21 bp, Artificial sequence
  SiRNA target sequence
ttaaatcttcttaatgccatt

SEQ ID NO: 3240 - DNA, 21 bp, Artificial sequence
  SiRNA target sequence
taaatcttcttaatgccatta

SEQ ID NO: 3241 - DNA, 21 bp, Artificial sequence
  SiRNA target sequence
aaatcttcttaatgccattat

SEQ ID NO: 3242 - DNA, 21 bp, Artificial sequence
  SiRNA target sequence
aatcttcttaatgccattatt

SEQ ID NO: 3243 - DNA, 21 bp, Artificial sequence
  SiRNA target sequence
atcttcttaatgccattattt

SEQ ID NO: 3244 - DNA, 21 bp, Artificial sequence
  SiRNA target sequence
tcttcttaatgccattatttt

SEQ ID NO: 3245 - DNA, 21 bp, Artificial sequence
  SiRNA target sequence
cttcttaatgccattatttta

SEQ ID NO: 3246 - DNA, 21 bp, Artificial sequence
  SiRNA target sequence
ttcttaatgccattattttac

SEQ ID NO: 3247 - DNA, 21 bp, Artificial sequence
  SiRNA target sequence
tcttaatgccattattttaca

SEQ ID NO: 3248 - DNA, 21 bp, Artificial sequence
  SiRNA target sequence
cttaatgccattattttacac

SEQ ID NO: 3249 - DNA, 21 bp, Artificial sequence
  SiRNA target sequence
ttaatgccattattttacacc

SEQ ID NO: 3250 - DNA, 21 bp, Artificial sequence
  SiRNA target sequence
taatgccattattttacacct

SEQ ID NO: 3251 - DNA, 21 bp, Artificial sequence
  SiRNA target sequence
aatgccattattttacaccta

SEQ ID NO: 3252 - DNA, 21 bp, Artificial sequence
  SiRNA target sequence
atgccattattttacacctaa

SEQ ID NO: 3253 - DNA, 21 bp, Artificial sequence
  SiRNA target sequence
tgccattattttacacctaaa

SEQ ID NO: 3254 - DNA, 21 bp, Artificial sequence
  SiRNA target sequence
gccattattttacacctaaaa

SEQ ID NO: 3255 - DNA, 21 bp, Artificial sequence
  SiRNA target sequence
ccattattttacacctaaaag

SEQ ID NO: 3256 - DNA, 21 bp, Artificial sequence
  SiRNA target sequence
cattattttacacctaaaagg

SEQ ID NO: 3257 - DNA, 21 bp, Artificial sequence
  SiRNA target sequence
attattttacacctaaaagga

SEQ ID NO: 3258 - DNA, 21 bp, Artificial sequence
  SiRNA target sequence
ttattttacacctaaaaggaa

SEQ ID NO: 3259 - DNA, 21 bp, Artificial sequence
  SiRNA target sequence
tattttacacctaaaaggaaa

SEQ ID NO: 3260 - DNA, 21 bp, Artificial sequence
  SiRNA target sequence
attttacacctaaaaggaaaa

SEQ ID NO: 3261 - DNA, 21 bp, Artificial sequence
  SiRNA target sequence
ttttacacctaaaaggaaaaa

SEQ ID NO: 3262 - DNA, 21 bp, Artificial sequence
  SiRNA target sequence
tttacacctaaaaggaaaaaa

SEQ ID NO: 3263 - DNA, 21 bp, Artificial sequence
  SiRNA target sequence
ttacacctaaaaggaaaaaaa

SEQ ID NO: 3264 - DNA, 21 bp, Artificial sequence
  SiRNA target sequence
tacacctaaaaggaaaaaaag

SEQ ID NO: 3265 - DNA, 21 bp, Artificial sequence
  SiRNA target sequence
acacctaaaaggaaaaaaaga

SEQ ID NO: 3266 - DNA, 21 bp, Artificial sequence
  SiRNA target sequence
cacctaaaaggaaaaaaagaa

SEQ ID NO: 3267 - DNA, 21 bp, Artificial sequence
  SiRNA target sequence
acctaaaaggaaaaaaagaac

SEQ ID NO: 3268 - DNA, 21 bp, Artificial sequence
  SiRNA target sequence
cctaaaaggaaaaaaagaaca

SEQ ID NO: 3269 - DNA, 21 bp, Artificial sequence
  SiRNA target sequence
ctaaaaggaaaaaaagaacag

SEQ ID NO: 3270 - DNA, 21 bp, Artificial sequence
  SiRNA target sequence
taaaaggaaaaaaagaacagg

SEQ ID NO: 3271 - DNA, 21 bp, Artificial sequence
  SiRNA target sequence
aaaaggaaaaaaagaacaggc

SEQ ID NO: 3272 - DNA, 21 bp, Artificial sequence
  SiRNA target sequence
aaaggaaaaaaagaacaggca

SEQ ID NO: 3273 - DNA, 21 bp, Artificial sequence
  SiRNA target sequence
aaggaaaaaaagaacaggcaa

SEQ ID NO: 3274 - DNA, 21 bp, Artificial sequence
  SiRNA target sequence
aggaaaaaaagaacaggcaat

SEQ ID NO: 3275 - DNA, 21 bp, Artificial sequence
  SiRNA target sequence
ggaaaaaaagaacaggcaatt

SEQ ID NO: 3276 - DNA, 21 bp, Artificial sequence
  SiRNA target sequence
gaaaaaaagaacaggcaattc

SEQ ID NO: 3277 - DNA, 21 bp, Artificial sequence
  SiRNA target sequence
aaaaaaagaacaggcaattct

SEQ ID NO: 3278 - DNA, 21 bp, Artificial sequence
  SiRNA target sequence
aaaaaagaacaggcaattctt

SEQ ID NO: 3279 - DNA, 21 bp, Artificial sequence
  SiRNA target sequence
aaaaagaacaggcaattcttt

SEQ ID NO: 3280 - DNA, 21 bp, Artificial sequence
  SiRNA target sequence
aaaagaacaggcaattctttt

SEQ ID NO: 3281 - DNA, 21 bp, Artificial sequence
  SiRNA target sequence
aaagaacaggcaattctttta

SEQ ID NO: 3282 - DNA, 21 bp, Artificial sequence
  SiRNA target sequence
aagaacaggcaattcttttat

SEQ ID NO: 3283 - DNA, 21 bp, Artificial sequence
  SiRNA target sequence
agaacaggcaattcttttatt

SEQ ID NO: 3284 - DNA, 21 bp, Artificial sequence
  SiRNA target sequence
gaacaggcaattcttttatta

SEQ ID NO: 3285 - DNA, 21 bp, Artificial sequence
  SiRNA target sequence
aacaggcaattcttttattag

SEQ ID NO: 3286 - DNA, 21 bp, Artificial sequence
  SiRNA target sequence
acaggcaattcttttattaga

SEQ ID NO: 3287 - DNA, 21 bp, Artificial sequence
  SiRNA target sequence
caggcaattcttttattagaa

SEQ ID NO: 3288 - DNA, 21 bp, Artificial sequence
  SiRNA target sequence
aggcaattcttttattagaaa

SEQ ID NO: 3289 - DNA, 21 bp, Artificial sequence
  SiRNA target sequence
ggcaattcttttattagaaaa

SEQ ID NO: 3290 - DNA, 21 bp, Artificial sequence
  SiRNA target sequence
gcaattcttttattagaaaaa

SEQ ID NO: 3291 - DNA, 21 bp, Artificial sequence
  SiRNA target sequence
caattcttttattagaaaaat

SEQ ID NO: 3292 - DNA, 21 bp, Artificial sequence
  SiRNA target sequence
aattcttttattagaaaaatc

SEQ ID NO: 3293 - DNA, 21 bp, Artificial sequence
  SiRNA target sequence
attcttttattagaaaaatct

SEQ ID NO: 3294 - DNA, 21 bp, Artificial sequence
  SiRNA target sequence
ttcttttattagaaaaatcta

SEQ ID NO: 3295 - DNA, 21 bp, Artificial sequence
  SiRNA target sequence
tcttttattagaaaaatctac

SEQ ID NO: 3296 - DNA, 21 bp, Artificial sequence
  SiRNA target sequence
cttttattagaaaaatctact

SEQ ID NO: 3297 - DNA, 21 bp, Artificial sequence
  SiRNA target sequence
ttttattagaaaaatctactt

SEQ ID NO: 3298 - DNA, 21 bp, Artificial sequence
  SiRNA target sequence
tttattagaaaaatctactta

SEQ ID NO: 3299 - DNA, 21 bp, Artificial sequence
  SiRNA target sequence
ttattagaaaaatctacttat

SEQ ID NO: 3300 - DNA, 21 bp, Artificial sequence
  SiRNA target sequence
tattagaaaaatctacttata

SEQ ID NO: 3301 - DNA, 21 bp, Artificial sequence
  SiRNA target sequence
attagaaaaatctacttataa

SEQ ID NO: 3302 - DNA, 21 bp, Artificial sequence
  SiRNA target sequence
ttagaaaaatctacttataaa

SEQ ID NO: 3303 - DNA, 21 bp, Artificial sequence
  SiRNA target sequence
tagaaaaatctacttataaat

SEQ ID NO: 3304 - DNA, 21 bp, Artificial sequence
  SiRNA target sequence
agaaaaatctacttataaata

SEQ ID NO: 3305 - DNA, 21 bp, Artificial sequence
  SiRNA target sequence
gaaaaatctacttataaatac

SEQ ID NO: 3306 - DNA, 21 bp, Artificial sequence
  SiRNA target sequence
aaaaatctacttataaataca

SEQ ID NO: 3307 - DNA, 21 bp, Artificial sequence
  SiRNA target sequence
aaaatctacttataaatacag

SEQ ID NO: 3308 - DNA, 21 bp, Artificial sequence
  SiRNA target sequence
aaatctacttataaatacagt

SEQ ID NO: 3309 - DNA, 21 bp, Artificial sequence
  SiRNA target sequence
aatctacttataaatacagta

SEQ ID NO: 3310 - DNA, 21 bp, Artificial sequence
  SiRNA target sequence
atctacttataaatacagtat

SEQ ID NO: 3311 - DNA, 21 bp, Artificial sequence
  SiRNA target sequence
tctacttataaatacagtatc

SEQ ID NO: 3312 - DNA, 21 bp, Artificial sequence
  SiRNA target sequence
ctacttataaatacagtatct

SEQ ID NO: 3313 - DNA, 21 bp, Artificial sequence
  SiRNA target sequence
tacttataaatacagtatctt

SEQ ID NO: 3314 - DNA, 21 bp, Artificial sequence
  SiRNA target sequence
acttataaatacagtatcttg

SEQ ID NO: 3315 - DNA, 21 bp, Artificial sequence
  SiRNA target sequence
cttataaatacagtatcttgt

SEQ ID NO: 3316 - DNA, 21 bp, Artificial sequence
  SiRNA target sequence
ttataaatacagtatcttgta

SEQ ID NO: 3317 - DNA, 21 bp, Artificial sequence
  SiRNA target sequence
tataaatacagtatcttgtat

SEQ ID NO: 3318 - DNA, 21 bp, Artificial sequence
  SiRNA target sequence
ataaatacagtatcttgtata

SEQ ID NO: 3319 - DNA, 21 bp, Artificial sequence
  SiRNA target sequence
taaatacagtatcttgtatag

SEQ ID NO: 3320 - DNA, 21 bp, Artificial sequence
  SiRNA target sequence
aaatacagtatcttgtataga

SEQ ID NO: 3321 - DNA, 21 bp, Artificial sequence
  SiRNA target sequence
aatacagtatcttgtatagag

SEQ ID NO: 3322 - DNA, 21 bp, Artificial sequence
  SiRNA target sequence
atacagtatcttgtatagagc

SEQ ID NO: 3323 - DNA, 21 bp, Artificial sequence
  SiRNA target sequence
tacagtatcttgtatagagca

SEQ ID NO: 3324 - DNA, 21 bp, Artificial sequence
  SiRNA target sequence
acagtatcttgtatagagcat

SEQ ID NO: 3325 - DNA, 21 bp, Artificial sequence
  SiRNA target sequence
cagtatcttgtatagagcata

SEQ ID NO: 3326 - DNA, 21 bp, Artificial sequence
  SiRNA target sequence
agtatcttgtatagagcatat

SEQ ID NO: 3327 - DNA, 21 bp, Artificial sequence
  SiRNA target sequence
gtatcttgtatagagcatatt

SEQ ID NO: 3328 - DNA, 21 bp, Artificial sequence
  SiRNA target sequence
tatcttgtatagagcatattt

SEQ ID NO: 3329 - DNA, 21 bp, Artificial sequence
  SiRNA target sequence
atcttgtatagagcatatttt

SEQ ID NO: 3330 - DNA, 21 bp, Artificial sequence
  SiRNA target sequence
tcttgtatagagcatattttc

SEQ ID NO: 3331 - DNA, 21 bp, Artificial sequence
  SiRNA target sequence
cttgtatagagcatattttct

SEQ ID NO: 3332 - DNA, 21 bp, Artificial sequence
  SiRNA target sequence
ttgtatagagcatattttctt

SEQ ID NO: 3333 - DNA, 21 bp, Artificial sequence
  SiRNA target sequence
tgtatagagcatattttctta

SEQ ID NO: 3334 - DNA, 21 bp, Artificial sequence
  SiRNA target sequence
gtatagagcatattttcttac

SEQ ID NO: 3335 - DNA, 21 bp, Artificial sequence
  SiRNA target sequence
tatagagcatattttcttaca

SEQ ID NO: 3336 - DNA, 21 bp, Artificial sequence
  SiRNA target sequence
atagagcatattttcttacat

SEQ ID NO: 3337 - DNA, 21 bp, Artificial sequence
  SiRNA target sequence
tagagcatattttcttacatt

SEQ ID NO: 3338 - DNA, 21 bp, Artificial sequence
  SiRNA target sequence
agagcatattttcttacattg

SEQ ID NO: 3339 - DNA, 21 bp, Artificial sequence
  SiRNA target sequence
gagcatattttcttacattga

SEQ ID NO: 3340 - DNA, 21 bp, Artificial sequence
  SiRNA target sequence
agcatattttcttacattgaa

SEQ ID NO: 3341 - DNA, 21 bp, Artificial sequence
  SiRNA target sequence
gcatattttcttacattgaag

SEQ ID NO: 3342 - DNA, 21 bp, Artificial sequence
  SiRNA target sequence
catattttcttacattgaaga

SEQ ID NO: 3343 - DNA, 21 bp, Artificial sequence
  SiRNA target sequence
atattttcttacattgaagaa

SEQ ID NO: 3344 - DNA, 21 bp, Artificial sequence
  SiRNA target sequence
tattttcttacattgaagaat

SEQ ID NO: 3345 - DNA, 21 bp, Artificial sequence
  SiRNA target sequence
attttcttacattgaagaatg

SEQ ID NO: 3346 - DNA, 21 bp, Artificial sequence
  SiRNA target sequence
ttttcttacattgaagaatga

SEQ ID NO: 3347 - DNA, 21 bp, Artificial sequence
  SiRNA target sequence
tttcttacattgaagaatgaa

SEQ ID NO: 3348 - DNA, 21 bp, Artificial sequence
  SiRNA target sequence
ttcttacattgaagaatgaat

SEQ ID NO: 3349 - DNA, 21 bp, Artificial sequence
  SiRNA target sequence
tcttacattgaagaatgaata

SEQ ID NO: 3350 - DNA, 21 bp, Artificial sequence
  SiRNA target sequence
cttacattgaagaatgaatat

SEQ ID NO: 3351 - DNA, 21 bp, Artificial sequence
  SiRNA target sequence
ttacattgaagaatgaatata

SEQ ID NO: 3352 - DNA, 21 bp, Artificial sequence
  SiRNA target sequence
tacattgaagaatgaatatat

SEQ ID NO: 3353 - DNA, 21 bp, Artificial sequence
  SiRNA target sequence
acattgaagaatgaatatatt

SEQ ID NO: 3354 - DNA, 21 bp, Artificial sequence
  SiRNA target sequence
cattgaagaatgaatatattt

SEQ ID NO: 3355 - DNA, 21 bp, Artificial sequence
  SiRNA target sequence
attgaagaatgaatatatttc

SEQ ID NO: 3356 - DNA, 21 bp, Artificial sequence
  SiRNA target sequence
ttgaagaatgaatatatttca

SEQ ID NO: 3357 - DNA, 21 bp, Artificial sequence
  SiRNA target sequence
tgaagaatgaatatatttcat

SEQ ID NO: 3358 - DNA, 21 bp, Artificial sequence
  SiRNA target sequence
gaagaatgaatatatttcatc

SEQ ID NO: 3359 - DNA, 21 bp, Artificial sequence
  SiRNA target sequence
aagaatgaatatatttcatct

SEQ ID NO: 3360 - DNA, 21 bp, Artificial sequence
  SiRNA target sequence
agaatgaatatatttcatctt

SEQ ID NO: 3361 - DNA, 21 bp, Artificial sequence
  SiRNA target sequence
gaatgaatatatttcatcttc

SEQ ID NO: 3362 - DNA, 21 bp, Artificial sequence
  SiRNA target sequence
aatgaatatatttcatcttca

SEQ ID NO: 3363 - DNA, 21 bp, Artificial sequence
  SiRNA target sequence
atgaatatatttcatcttcat

SEQ ID NO: 3364 - DNA, 21 bp, Artificial sequence
  SiRNA target sequence
tgaatatatttcatcttcatt

SEQ ID NO: 3365 - DNA, 21 bp, Artificial sequence
  SiRNA target sequence
gaatatatttcatcttcattg

SEQ ID NO: 3366 - DNA, 21 bp, Artificial sequence
  SiRNA target sequence
aatatatttcatcttcattgc

SEQ ID NO: 3367 - DNA, 21 bp, Artificial sequence
  SiRNA target sequence
atatatttcatcttcattgcc

SEQ ID NO: 3368 - DNA, 21 bp, Artificial sequence
  SiRNA target sequence
tatatttcatcttcattgcct

SEQ ID NO: 3369 - DNA, 21 bp, Artificial sequence
  SiRNA target sequence
atatttcatcttcattgcctt

SEQ ID NO: 3370 - DNA, 21 bp, Artificial sequence
  SiRNA target sequence
tatttcatcttcattgccttt

SEQ ID NO: 3371 - DNA, 21 bp, Artificial sequence
  SiRNA target sequence
atttcatcttcattgccttta

SEQ ID NO: 3372 - DNA, 21 bp, Artificial sequence
  SiRNA target sequence
tttcatcttcattgcctttag

SEQ ID NO: 3373 - DNA, 21 bp, Artificial sequence
  SiRNA target sequence
ttcatcttcattgcctttaga

SEQ ID NO: 3374 - DNA, 21 bp, Artificial sequence
  SiRNA target sequence
tcatcttcattgcctttagat

SEQ ID NO: 3375 - DNA, 21 bp, Artificial sequence
  SiRNA target sequence
catcttcattgcctttagatg

SEQ ID NO: 3376 - DNA, 21 bp, Artificial sequence
  SiRNA target sequence
atcttcattgcctttagatga

SEQ ID NO: 3377 - DNA, 21 bp, Artificial sequence
  SiRNA target sequence
tcttcattgcctttagatgac

SEQ ID NO: 3378 - DNA, 21 bp, Artificial sequence
  SiRNA target sequence
cttcattgcctttagatgacg

SEQ ID NO: 3379 - DNA, 21 bp, Artificial sequence
  SiRNA target sequence
ttcattgcctttagatgacga

SEQ ID NO: 3380 - DNA, 21 bp, Artificial sequence
  SiRNA target sequence
tcattgcctttagatgacgag

SEQ ID NO: 3381 - DNA, 21 bp, Artificial sequence
  SiRNA target sequence
cattgcctttagatgacgaga

SEQ ID NO: 3382 - DNA, 21 bp, Artificial sequence
  SiRNA target sequence
attgcctttagatgacgagat

SEQ ID NO: 3383 - DNA, 21 bp, Artificial sequence
  SiRNA target sequence
ttgcctttagatgacgagatt

SEQ ID NO: 3384 - DNA, 21 bp, Artificial sequence
  SiRNA target sequence
tgcctttagatgacgagatta

SEQ ID NO: 3385 - DNA, 21 bp, Artificial sequence
  SiRNA target sequence
gcctttagatgacgagattac

SEQ ID NO: 3386 - DNA, 21 bp, Artificial sequence
  SiRNA target sequence
cctttagatgacgagattact

SEQ ID NO: 3387 - DNA, 21 bp, Artificial sequence
  SiRNA target sequence
ctttagatgacgagattacta

SEQ ID NO: 3388 - DNA, 21 bp, Artificial sequence
  SiRNA target sequence
tttagatgacgagattactac

SEQ ID NO: 3389 - DNA, 21 bp, Artificial sequence
  SiRNA target sequence
ttagatgacgagattactacg

SEQ ID NO: 3390 - DNA, 21 bp, Artificial sequence
  SiRNA target sequence
tagatgacgagattactacgc

SEQ ID NO: 3391 - DNA, 21 bp, Artificial sequence
  SiRNA target sequence
agatgacgagattactacgct

SEQ ID NO: 3392 - DNA, 21 bp, Artificial sequence
  SiRNA target sequence
gatgacgagattactacgctt

SEQ ID NO: 3393 - DNA, 21 bp, Artificial sequence
  SiRNA target sequence
atgacgagattactacgcttt

SEQ ID NO: 3394 - DNA, 21 bp, Artificial sequence
  SiRNA target sequence
tgacgagattactacgcttta

SEQ ID NO: 3395 - DNA, 21 bp, Artificial sequence
  SiRNA target sequence
gacgagattactacgctttac

SEQ ID NO: 3396 - DNA, 21 bp, Artificial sequence
  SiRNA target sequence
acgagattactacgctttact

SEQ ID NO: 3397 - DNA, 21 bp, Artificial sequence
  SiRNA target sequence
cgagattactacgctttactt

SEQ ID NO: 3398 - DNA, 21 bp, Artificial sequence
  SiRNA target sequence
gagattactacgctttacttg

SEQ ID NO: 3399 - DNA, 21 bp, Artificial sequence
  SiRNA target sequence
agattactacgctttacttgt

SEQ ID NO: 3400 - DNA, 21 bp, Artificial sequence
  SiRNA target sequence
gattactacgctttacttgta

SEQ ID NO: 3401 - DNA, 21 bp, Artificial sequence
  SiRNA target sequence
attactacgctttacttgtat

SEQ ID NO: 3402 - DNA, 21 bp, Artificial sequence
  SiRNA target sequence
ttactacgctttacttgtatt

SEQ ID NO: 3403 - DNA, 21 bp, Artificial sequence
  SiRNA target sequence
tactacgctttacttgtattc

SEQ ID NO: 3404 - DNA, 21 bp, Artificial sequence
  SiRNA target sequence
actacgctttacttgtattct

SEQ ID NO: 3405 - DNA, 21 bp, Artificial sequence
  SiRNA target sequence
ctacgctttacttgtattcta

SEQ ID NO: 3406 - DNA, 21 bp, Artificial sequence
  SiRNA target sequence
tacgctttacttgtattctaa

SEQ ID NO: 3407 - DNA, 21 bp, Artificial sequence
  SiRNA target sequence
acgctttacttgtattctaag

SEQ ID NO: 3408 - DNA, 21 bp, Artificial sequence
  SiRNA target sequence
cgctttacttgtattctaaga

SEQ ID NO: 3409 - DNA, 21 bp, Artificial sequence
  SiRNA target sequence
gctttacttgtattctaagat

SEQ ID NO: 3410 - DNA, 21 bp, Artificial sequence
  SiRNA target sequence
ctttacttgtattctaagatt

SEQ ID NO: 3411 - DNA, 21 bp, Artificial sequence
  SiRNA target sequence
tttacttgtattctaagattt

SEQ ID NO: 3412 - DNA, 21 bp, Artificial sequence
  SiRNA target sequence
ttacttgtattctaagatttt

SEQ ID NO: 3413 - DNA, 21 bp, Artificial sequence
  SiRNA target sequence
tacttgtattctaagattttt

SEQ ID NO: 3414 - DNA, 21 bp, Artificial sequence
  SiRNA target sequence
acttgtattctaagattttta

SEQ ID NO: 3415 - DNA, 21 bp, Artificial sequence
  SiRNA target sequence
cttgtattctaagatttttaa

SEQ ID NO: 3416 - DNA, 21 bp, Artificial sequence
  SiRNA target sequence
ttgtattctaagatttttaaa

SEQ ID NO: 3417 - DNA, 21 bp, Artificial sequence
  SiRNA target sequence
tgtattctaagatttttaaag

SEQ ID NO: 3418 - DNA, 21 bp, Artificial sequence
  SiRNA target sequence
gtattctaagatttttaaaga

SEQ ID NO: 3419 - DNA, 21 bp, Artificial sequence
  SiRNA target sequence
tattctaagatttttaaagat

SEQ ID NO: 3420 - DNA, 21 bp, Artificial sequence
  SiRNA target sequence
attctaagatttttaaagata

SEQ ID NO: 3421 - DNA, 21 bp, Artificial sequence
  SiRNA target sequence
ttctaagatttttaaagataa

SEQ ID NO: 3422 - DNA, 21 bp, Artificial sequence
  SiRNA target sequence
tctaagatttttaaagataaa

SEQ ID NO: 3423 - DNA, 21 bp, Artificial sequence
  SiRNA target sequence
ctaagatttttaaagataaat

SEQ ID NO: 3424 - DNA, 21 bp, Artificial sequence
  SiRNA target sequence
taagatttttaaagataaatc

SEQ ID NO: 3425 - DNA, 21 bp, Artificial sequence
  SiRNA target sequence
aagatttttaaagataaatct

SEQ ID NO: 3426 - DNA, 21 bp, Artificial sequence
  SiRNA target sequence
agatttttaaagataaatctg

SEQ ID NO: 3427 - DNA, 21 bp, Artificial sequence
  SiRNA target sequence
gatttttaaagataaatctga

SEQ ID NO: 3428 - DNA, 21 bp, Artificial sequence
  SiRNA target sequence
atttttaaagataaatctgat

SEQ ID NO: 3429 - DNA, 21 bp, Artificial sequence
  SiRNA target sequence
tttttaaagataaatctgata

SEQ ID NO: 3430 - DNA, 21 bp, Artificial sequence
  SiRNA target sequence
ttttaaagataaatctgatac

SEQ ID NO: 3431 - DNA, 21 bp, Artificial sequence
  SiRNA target sequence
tttaaagataaatctgatact

SEQ ID NO: 3432 - DNA, 21 bp, Artificial sequence
  SiRNA target sequence
ttaaagataaatctgatactt

SEQ ID NO: 3433 - DNA, 21 bp, Artificial sequence
  SiRNA target sequence
taaagataaatctgatactta

SEQ ID NO: 3434 - DNA, 21 bp, Artificial sequence
  SiRNA target sequence
aaagataaatctgatacttac

SEQ ID NO: 3435 - DNA, 21 bp, Artificial sequence
  SiRNA target sequence
aagataaatctgatacttacc

SEQ ID NO: 3436 - DNA, 21 bp, Artificial sequence
  SiRNA target sequence
agataaatctgatacttacct

SEQ ID NO: 3437 - DNA, 21 bp, Artificial sequence
  SiRNA target sequence
gataaatctgatacttacctt

SEQ ID NO: 3438 - DNA, 21 bp, Artificial sequence
  SiRNA target sequence
ataaatctgatacttacctta

SEQ ID NO: 3439 - DNA, 21 bp, Artificial sequence
  SiRNA target sequence
taaatctgatacttaccttaa

SEQ ID NO: 3440 - DNA, 21 bp, Artificial sequence
  SiRNA target sequence
aaatctgatacttaccttaaa

SEQ ID NO: 3441 - DNA, 21 bp, Artificial sequence
  SiRNA target sequence
aatctgatacttaccttaaat

SEQ ID NO: 3442 - DNA, 21 bp, Artificial sequence
  SiRNA target sequence
atctgatacttaccttaaatc

SEQ ID NO: 3443 - DNA, 21 bp, Artificial sequence
  SiRNA target sequence
tctgatacttaccttaaatct

SEQ ID NO: 3444 - DNA, 21 bp, Artificial sequence
  SiRNA target sequence
ctgatacttaccttaaatctg

SEQ ID NO: 3445 - DNA, 21 bp, Artificial sequence
  SiRNA target sequence
tgatacttaccttaaatctgc

SEQ ID NO: 3446 - DNA, 21 bp, Artificial sequence
  SiRNA target sequence
gatacttaccttaaatctgct

SEQ ID NO: 3447 - DNA, 21 bp, Artificial sequence
  SiRNA target sequence
atacttaccttaaatctgcta

SEQ ID NO: 3448 - DNA, 21 bp, Artificial sequence
  SiRNA target sequence
tacttaccttaaatctgctat

SEQ ID NO: 3449 - DNA, 21 bp, Artificial sequence
  SiRNA target sequence
acttaccttaaatctgctata

SEQ ID NO: 3450 - DNA, 21 bp, Artificial sequence
  SiRNA target sequence
cttaccttaaatctgctatag

SEQ ID NO: 3451 - DNA, 21 bp, Artificial sequence
  SiRNA target sequence
ttaccttaaatctgctataga

SEQ ID NO: 3452 - DNA, 21 bp, Artificial sequence
  SiRNA target sequence
taccttaaatctgctatagat

SEQ ID NO: 3453 - DNA, 21 bp, Artificial sequence
  SiRNA target sequence
accttaaatctgctatagata

SEQ ID NO: 3454 - DNA, 21 bp, Artificial sequence
  SiRNA target sequence
ccttaaatctgctatagataa

SEQ ID NO: 3455 - DNA, 21 bp, Artificial sequence
  SiRNA target sequence
cttaaatctgctatagataaa

SEQ ID NO: 3456 - DNA, 21 bp, Artificial sequence
  SiRNA target sequence
ttaaatctgctatagataaat

SEQ ID NO: 3457 - DNA, 21 bp, Artificial sequence
  SiRNA target sequence
taaatctgctatagataaatc

SEQ ID NO: 3458 - DNA, 21 bp, Artificial sequence
  SiRNA target sequence
aaatctgctatagataaatca

SEQ ID NO: 3459 - DNA, 21 bp, Artificial sequence
  SiRNA target sequence
aatctgctatagataaatcag

SEQ ID NO: 3460 - DNA, 21 bp, Artificial sequence
  SiRNA target sequence
atctgctatagataaatcagt

SEQ ID NO: 3461 - DNA, 21 bp, Artificial sequence
  SiRNA target sequence
tctgctatagataaatcagta

SEQ ID NO: 3462 - DNA, 21 bp, Artificial sequence
  SiRNA target sequence
ctgctatagataaatcagtag

SEQ ID NO: 3463 - DNA, 21 bp, Artificial sequence
  SiRNA target sequence
tgctatagataaatcagtaga

SEQ ID NO: 3464 - DNA, 21 bp, Artificial sequence
  SiRNA target sequence
gctatagataaatcagtagat

SEQ ID NO: 3465 - DNA, 21 bp, Artificial sequence
  SiRNA target sequence
ctatagataaatcagtagatc

SEQ ID NO: 3466 - DNA, 21 bp, Artificial sequence
  SiRNA target sequence
tatagataaatcagtagatct

SEQ ID NO: 3467 - DNA, 21 bp, Artificial sequence
  SiRNA target sequence
atagataaatcagtagatcta

SEQ ID NO: 3468 - DNA, 21 bp, Artificial sequence
  SiRNA target sequence
tagataaatcagtagatctac

SEQ ID NO: 3469 - DNA, 21 bp, Artificial sequence
  SiRNA target sequence
agataaatcagtagatctacc

SEQ ID NO: 3470 - DNA, 21 bp, Artificial sequence
  SiRNA target sequence
gataaatcagtagatctacct

SEQ ID NO: 3471 - DNA, 21 bp, Artificial sequence
  SiRNA target sequence
ataaatcagtagatctaccta

SEQ ID NO: 3472 - DNA, 21 bp, Artificial sequence
  SiRNA target sequence
taaatcagtagatctacctat

SEQ ID NO: 3473 - DNA, 21 bp, Artificial sequence
  SiRNA target sequence
aaatcagtagatctacctatt

SEQ ID NO: 3474 - DNA, 21 bp, Artificial sequence
  SiRNA target sequence
aatcagtagatctacctattg

SEQ ID NO: 3475 - DNA, 21 bp, Artificial sequence
  SiRNA target sequence
atcagtagatctacctattga

SEQ ID NO: 3476 - DNA, 21 bp, Artificial sequence
  SiRNA target sequence
tcagtagatctacctattgaa

SEQ ID NO: 3477 - DNA, 21 bp, Artificial sequence
  SiRNA target sequence
cagtagatctacctattgaac

SEQ ID NO: 3478 - DNA, 21 bp, Artificial sequence
  SiRNA target sequence
agtagatctacctattgaaca

SEQ ID NO: 3479 - DNA, 21 bp, Artificial sequence
  SiRNA target sequence
gtagatctacctattgaacag

SEQ ID NO: 3480 - DNA, 21 bp, Artificial sequence
  SiRNA target sequence
tagatctacctattgaacaga

SEQ ID NO: 3481 - DNA, 21 bp, Artificial sequence
  SiRNA target sequence
agatctacctattgaacagaa

SEQ ID NO: 3482 - DNA, 21 bp, Artificial sequence
  SiRNA target sequence
gatctacctattgaacagaaa

SEQ ID NO: 3483 - DNA, 21 bp, Artificial sequence
  SiRNA target sequence
atctacctattgaacagaaag

SEQ ID NO: 3484 - DNA, 21 bp, Artificial sequence
  SiRNA target sequence
tctacctattgaacagaaaga

SEQ ID NO: 3485 - DNA, 21 bp, Artificial sequence
  SiRNA target sequence
ctacctattgaacagaaagac

SEQ ID NO: 3486 - DNA, 21 bp, Artificial sequence
  SiRNA target sequence
tacctattgaacagaaagact

SEQ ID NO: 3487 - DNA, 21 bp, Artificial sequence
  SiRNA target sequence
acctattgaacagaaagactt

SEQ ID NO: 3488 - DNA, 21 bp, Artificial sequence
  SiRNA target sequence
cctattgaacagaaagacttt

SEQ ID NO: 3489 - DNA, 21 bp, Artificial sequence
  SiRNA target sequence
ctattgaacagaaagactttc

SEQ ID NO: 3490 - DNA, 21 bp, Artificial sequence
  SiRNA target sequence
tattgaacagaaagactttct

SEQ ID NO: 3491 - DNA, 21 bp, Artificial sequence
  SiRNA target sequence
attgaacagaaagactttctg

SEQ ID NO: 3492 - DNA, 21 bp, Artificial sequence
  SiRNA target sequence
ttgaacagaaagactttctgt

SEQ ID NO: 3493 - DNA, 21 bp, Artificial sequence
  SiRNA target sequence
tgaacagaaagactttctgta

SEQ ID NO: 3494 - DNA, 21 bp, Artificial sequence
  SiRNA target sequence
gaacagaaagactttctgtac

SEQ ID NO: 3495 - DNA, 21 bp, Artificial sequence
  SiRNA target sequence
aacagaaagactttctgtacg

SEQ ID NO: 3496 - DNA, 21 bp, Artificial sequence
  SiRNA target sequence
acagaaagactttctgtacgt

SEQ ID NO: 3497 - DNA, 21 bp, Artificial sequence
  SiRNA target sequence
cagaaagactttctgtacgta

SEQ ID NO: 3498 - DNA, 21 bp, Artificial sequence
  SiRNA target sequence
agaaagactttctgtacgtag

SEQ ID NO: 3499 - DNA, 21 bp, Artificial sequence
  SiRNA target sequence
gaaagactttctgtacgtaga

SEQ ID NO: 3500 - DNA, 21 bp, Artificial sequence
  SiRNA target sequence
aaagactttctgtacgtagat

SEQ ID NO: 3501 - DNA, 21 bp, Artificial sequence
  SiRNA target sequence
aagactttctgtacgtagatc

SEQ ID NO: 3502 - DNA, 21 bp, Artificial sequence
  SiRNA target sequence
agactttctgtacgtagatct

SEQ ID NO: 3503 - DNA, 21 bp, Artificial sequence
  SiRNA target sequence
gactttctgtacgtagatctt

SEQ ID NO: 3504 - DNA, 21 bp, Artificial sequence
  SiRNA target sequence
actttctgtacgtagatcttc

SEQ ID NO: 3505 - DNA, 21 bp, Artificial sequence
  SiRNA target sequence
ctttctgtacgtagatcttct

SEQ ID NO: 3506 - DNA, 21 bp, Artificial sequence
  SiRNA target sequence
tttctgtacgtagatcttctt

SEQ ID NO: 3507 - DNA, 21 bp, Artificial sequence
  SiRNA target sequence
ttctgtacgtagatcttcttg

SEQ ID NO: 3508 - DNA, 21 bp, Artificial sequence
  SiRNA target sequence
tctgtacgtagatcttcttgt

SEQ ID NO: 3509 - DNA, 21 bp, Artificial sequence
  SiRNA target sequence
ctgtacgtagatcttcttgta

SEQ ID NO: 3510 - DNA, 21 bp, Artificial sequence
  SiRNA target sequence
tgtacgtagatcttcttgtat

SEQ ID NO: 3511 - DNA, 21 bp, Artificial sequence
  SiRNA target sequence
gtacgtagatcttcttgtatt

SEQ ID NO: 3512 - DNA, 21 bp, Artificial sequence
  SiRNA target sequence
tacgtagatcttcttgtattt

SEQ ID NO: 3513 - DNA, 21 bp, Artificial sequence
  SiRNA target sequence
acgtagatcttcttgtatttt

SEQ ID NO: 3514 - DNA, 21 bp, Artificial sequence
  SiRNA target sequence
cgtagatcttcttgtatttta

SEQ ID NO: 3515 - DNA, 21 bp, Artificial sequence
  SiRNA target sequence
gtagatcttcttgtattttac

SEQ ID NO: 3516 - DNA, 21 bp, Artificial sequence
  SiRNA target sequence
tagatcttcttgtattttaca

SEQ ID NO: 3517 - DNA, 21 bp, Artificial sequence
  SiRNA target sequence
agatcttcttgtattttacat

SEQ ID NO: 3518 - DNA, 21 bp, Artificial sequence
  SiRNA target sequence
gatcttcttgtattttacatt

SEQ ID NO: 3519 - DNA, 21 bp, Artificial sequence
  SiRNA target sequence
atcttcttgtattttacattt

SEQ ID NO: 3520 - DNA, 21 bp, Artificial sequence
  SiRNA target sequence
tcttcttgtattttacatttc

SEQ ID NO: 3521 - DNA, 21 bp, Artificial sequence
  SiRNA target sequence
cttcttgtattttacatttct

SEQ ID NO: 3522 - DNA, 21 bp, Artificial sequence
  SiRNA target sequence
ttcttgtattttacatttcta

SEQ ID NO: 3523 - DNA, 21 bp, Artificial sequence
  SiRNA target sequence
tcttgtattttacatttctaa

SEQ ID NO: 3524 - DNA, 21 bp, Artificial sequence
  SiRNA target sequence
cttgtattttacatttctaaa

SEQ ID NO: 3525 - DNA, 21 bp, Artificial sequence
  SiRNA target sequence
ttgtattttacatttctaaaa

SEQ ID NO: 3526 - DNA, 21 bp, Artificial sequence
  SiRNA target sequence
tgtattttacatttctaaaaa

SEQ ID NO: 3527 - DNA, 21 bp, Artificial sequence
  SiRNA target sequence
gtattttacatttctaaaaag

SEQ ID NO: 3528 - DNA, 21 bp, Artificial sequence
  SiRNA target sequence
tattttacatttctaaaaagg

SEQ ID NO: 3529 - DNA, 21 bp, Artificial sequence
  SiRNA target sequence
attttacatttctaaaaagga

SEQ ID NO: 3530 - DNA, 21 bp, Artificial sequence
  SiRNA target sequence
ttttacatttctaaaaaggat

SEQ ID NO: 3531 - DNA, 21 bp, Artificial sequence
  SiRNA target sequence
tttacatttctaaaaaggatg

SEQ ID NO: 3532 - DNA, 21 bp, Artificial sequence
  SiRNA target sequence
ttacatttctaaaaaggatgt

SEQ ID NO: 3533 - DNA, 21 bp, Artificial sequence
  SiRNA target sequence
tacatttctaaaaaggatgtt

SEQ ID NO: 3534 - DNA, 21 bp, Artificial sequence
  SiRNA target sequence
acatttctaaaaaggatgttg

SEQ ID NO: 3535 - DNA, 21 bp, Artificial sequence
  SiRNA target sequence
catttctaaaaaggatgttga

SEQ ID NO: 3536 - DNA, 21 bp, Artificial sequence
  SiRNA target sequence
atttctaaaaaggatgttgaa

SEQ ID NO: 3537 - DNA, 21 bp, Artificial sequence
  SiRNA target sequence
tttctaaaaaggatgttgaaa

SEQ ID NO: 3538 - DNA, 21 bp, Artificial sequence
  SiRNA target sequence
ttctaaaaaggatgttgaaaa

SEQ ID NO: 3539 - DNA, 21 bp, Artificial sequence
  SiRNA target sequence
tctaaaaaggatgttgaaaaa

SEQ ID NO: 3540 - DNA, 21 bp, Artificial sequence
  SiRNA target sequence
ctaaaaaggatgttgaaaaag

SEQ ID NO: 3541 - DNA, 21 bp, Artificial sequence
  SiRNA target sequence
taaaaaggatgttgaaaaagt

SEQ ID NO: 3542 - DNA, 21 bp, Artificial sequence
  SiRNA target sequence
aaaaaggatgttgaaaaagtt

SEQ ID NO: 3543 - DNA, 21 bp, Artificial sequence
  SiRNA target sequence
aaaaggatgttgaaaaagtta

SEQ ID NO: 3544 - DNA, 21 bp, Artificial sequence
  SiRNA target sequence
aaaggatgttgaaaaagttaa

SEQ ID NO: 3545 - DNA, 21 bp, Artificial sequence
  SiRNA target sequence
aaggatgttgaaaaagttaat

SEQ ID NO: 3546 - DNA, 21 bp, Artificial sequence
  SiRNA target sequence
aggatgttgaaaaagttaatg

SEQ ID NO: 3547 - DNA, 21 bp, Artificial sequence
  SiRNA target sequence
ggatgttgaaaaagttaatga

SEQ ID NO: 3548 - DNA, 21 bp, Artificial sequence
  SiRNA target sequence
gatgttgaaaaagttaatgaa

SEQ ID NO: 3549 - DNA, 21 bp, Artificial sequence
  SiRNA target sequence
atgttgaaaaagttaatgaaa

SEQ ID NO: 3550 - DNA, 21 bp, Artificial sequence
  SiRNA target sequence
tgttgaaaaagttaatgaaac

SEQ ID NO: 3551 - DNA, 21 bp, Artificial sequence
  SiRNA target sequence
gttgaaaaagttaatgaaaca

SEQ ID NO: 3552 - DNA, 21 bp, Artificial sequence
  SiRNA target sequence
ttgaaaaagttaatgaaacaa

SEQ ID NO: 3553 - DNA, 21 bp, Artificial sequence
  SiRNA target sequence
tgaaaaagttaatgaaacaat

SEQ ID NO: 3554 - DNA, 21 bp, Artificial sequence
  SiRNA target sequence
gaaaaagttaatgaaacaatt

SEQ ID NO: 3555 - DNA, 21 bp, Artificial sequence
  SiRNA target sequence
aaaaagttaatgaaacaatta

SEQ ID NO: 3556 - DNA, 21 bp, Artificial sequence
  SiRNA target sequence
aaaagttaatgaaacaattaa

SEQ ID NO: 3557 - DNA, 21 bp, Artificial sequence
  SiRNA target sequence
aaagttaatgaaacaattaat

SEQ ID NO: 3558 - DNA, 21 bp, Artificial sequence
  SiRNA target sequence
aagttaatgaaacaattaata

SEQ ID NO: 3559 - DNA, 21 bp, Artificial sequence
  SiRNA target sequence
agttaatgaaacaattaataa

SEQ ID NO: 3560 - DNA, 21 bp, Artificial sequence
  SiRNA target sequence
gttaatgaaacaattaataat

SEQ ID NO: 3561 - DNA, 21 bp, Artificial sequence
  SiRNA target sequence
ttaatgaaacaattaataatt

SEQ ID NO: 3562 - DNA, 21 bp, Artificial sequence
  SiRNA target sequence
taatgaaacaattaataattt

SEQ ID NO: 3563 - DNA, 21 bp, Artificial sequence
  SiRNA target sequence
aatgaaacaattaataattta

SEQ ID NO: 3564 - DNA, 21 bp, Artificial sequence
  SiRNA target sequence
atgaaacaattaataatttaa

SEQ ID NO: 3565 - DNA, 21 bp, Artificial sequence
  SiRNA target sequence
tgaaacaattaataatttaaa

SEQ ID NO: 3566 - DNA, 21 bp, Artificial sequence
  SiRNA target sequence
gaaacaattaataatttaaaa

SEQ ID NO: 3567 - DNA, 21 bp, Artificial sequence
  SiRNA target sequence
aaacaattaataatttaaaag

SEQ ID NO: 3568 - DNA, 21 bp, Artificial sequence
  SiRNA target sequence
aacaattaataatttaaaaga

SEQ ID NO: 3569 - DNA, 21 bp, Artificial sequence
  SiRNA target sequence
acaattaataatttaaaagag

SEQ ID NO: 3570 - DNA, 21 bp, Artificial sequence
  SiRNA target sequence
caattaataatttaaaagaga

SEQ ID NO: 3571 - DNA, 21 bp, Artificial sequence
  SiRNA target sequence
aattaataatttaaaagagac

SEQ ID NO: 3572 - DNA, 21 bp, Artificial sequence
  SiRNA target sequence
attaataatttaaaagagact

SEQ ID NO: 3573 - DNA, 21 bp, Artificial sequence
  SiRNA target sequence
ttaataatttaaaagagactc

SEQ ID NO: 3574 - DNA, 21 bp, Artificial sequence
  SiRNA target sequence
taataatttaaaagagactct

SEQ ID NO: 3575 - DNA, 21 bp, Artificial sequence
  SiRNA target sequence
aataatttaaaagagactctt

SEQ ID NO: 3576 - DNA, 21 bp, Artificial sequence
  SiRNA target sequence
ataatttaaaagagactctta

SEQ ID NO: 3577 - DNA, 21 bp, Artificial sequence
  SiRNA target sequence
taatttaaaagagactcttac

SEQ ID NO: 3578 - DNA, 21 bp, Artificial sequence
  SiRNA target sequence
aatttaaaagagactcttacc

SEQ ID NO: 3579 - DNA, 21 bp, Artificial sequence
  SiRNA target sequence
atttaaaagagactcttaccc

SEQ ID NO: 3580 - DNA, 21 bp, Artificial sequence
  SiRNA target sequence
tttaaaagagactcttacccc

SEQ ID NO: 3581 - DNA, 21 bp, Artificial sequence
  SiRNA target sequence
ttaaaagagactcttaccccc

SEQ ID NO: 3582 - DNA, 21 bp, Artificial sequence
  SiRNA target sequence
taaaagagactcttaccccca

SEQ ID NO: 3583 - DNA, 21 bp, Artificial sequence
  SiRNA target sequence
aaaagagactcttacccccac

SEQ ID NO: 3584 - DNA, 21 bp, Artificial sequence
  SiRNA target sequence
aaagagactcttacccccact

SEQ ID NO: 3585 - DNA, 21 bp, Artificial sequence
  SiRNA target sequence
aagagactcttacccccactt

SEQ ID NO: 3586 - DNA, 21 bp, Artificial sequence
  SiRNA target sequence
agagactcttacccccacttt

SEQ ID NO: 3587 - DNA, 21 bp, Artificial sequence
  SiRNA target sequence
gagactcttacccccacttta

SEQ ID NO: 3588 - DNA, 21 bp, Artificial sequence
  SiRNA target sequence
agactcttacccccactttat

SEQ ID NO: 3589 - DNA, 21 bp, Artificial sequence
  SiRNA target sequence
gactcttacccccactttatt

SEQ ID NO: 3590 - DNA, 21 bp, Artificial sequence
  SiRNA target sequence
actcttacccccactttattg

SEQ ID NO: 3591 - DNA, 21 bp, Artificial sequence
  SiRNA target sequence
ctcttacccccactttattgg

SEQ ID NO: 3592 - DNA, 21 bp, Artificial sequence
  SiRNA target sequence
tcttacccccactttattgga

SEQ ID NO: 3593 - DNA, 21 bp, Artificial sequence
  SiRNA target sequence
cttacccccactttattggaa

SEQ ID NO: 3594 - DNA, 21 bp, Artificial sequence
  SiRNA target sequence
ttacccccactttattggaac

SEQ ID NO: 3595 - DNA, 21 bp, Artificial sequence
  SiRNA target sequence
tacccccactttattggaact

SEQ ID NO: 3596 - DNA, 21 bp, Artificial sequence
  SiRNA target sequence
acccccactttattggaactt

SEQ ID NO: 3597 - DNA, 21 bp, Artificial sequence
  SiRNA target sequence
cccccactttattggaactta

SEQ ID NO: 3598 - DNA, 21 bp, Artificial sequence
  SiRNA target sequence
ccccactttattggaacttat

SEQ ID NO: 3599 - DNA, 21 bp, Artificial sequence
  SiRNA target sequence
cccactttattggaacttatt

SEQ ID NO: 3600 - DNA, 21 bp, Artificial sequence
  SiRNA target sequence
ccactttattggaacttattg

SEQ ID NO: 3601 - DNA, 21 bp, Artificial sequence
  SiRNA target sequence
cactttattggaacttattgg

SEQ ID NO: 3602 - DNA, 21 bp, Artificial sequence
  SiRNA target sequence
actttattggaacttattgga

SEQ ID NO: 3603 - DNA, 21 bp, Artificial sequence
  SiRNA target sequence
ctttattggaacttattggag

SEQ ID NO: 3604 - DNA, 21 bp, Artificial sequence
  SiRNA target sequence
tttattggaacttattggaga

SEQ ID NO: 3605 - DNA, 21 bp, Artificial sequence
  SiRNA target sequence
ttattggaacttattggagaa

SEQ ID NO: 3606 - DNA, 21 bp, Artificial sequence
  SiRNA target sequence
tattggaacttattggagaat

SEQ ID NO: 3607 - DNA, 21 bp, Artificial sequence
  SiRNA target sequence
attggaacttattggagaata

SEQ ID NO: 3608 - DNA, 21 bp, Artificial sequence
  SiRNA target sequence
ttggaacttattggagaatat

SEQ ID NO: 3609 - DNA, 21 bp, Artificial sequence
  SiRNA target sequence
tggaacttattggagaatatt

SEQ ID NO: 3610 - DNA, 21 bp, Artificial sequence
  SiRNA target sequence
ggaacttattggagaatatta

SEQ ID NO: 3611 - DNA, 21 bp, Artificial sequence
  SiRNA target sequence
gaacttattggagaatattat

SEQ ID NO: 3612 - DNA, 21 bp, Artificial sequence
  SiRNA target sequence
aacttattggagaatattatt

SEQ ID NO: 3613 - DNA, 21 bp, Artificial sequence
  SiRNA target sequence
acttattggagaatattattt

SEQ ID NO: 3614 - DNA, 21 bp, Artificial sequence
  SiRNA target sequence
cttattggagaatattattta

SEQ ID NO: 3615 - DNA, 21 bp, Artificial sequence
  SiRNA target sequence
ttattggagaatattatttaa

SEQ ID NO: 3616 - DNA, 21 bp, Artificial sequence
  SiRNA target sequence
tattggagaatattatttaaa

SEQ ID NO: 3617 - DNA, 21 bp, Artificial sequence
  SiRNA target sequence
attggagaatattatttaaaa

SEQ ID NO: 3618 - DNA, 21 bp, Artificial sequence
  SiRNA target sequence
ttggagaatattatttaaaaa

SEQ ID NO: 3619 - DNA, 21 bp, Artificial sequence
  SiRNA target sequence
tggagaatattatttaaaaag

SEQ ID NO: 3620 - DNA, 21 bp, Artificial sequence
  SiRNA target sequence
ggagaatattatttaaaaagt

SEQ ID NO: 3621 - DNA, 21 bp, Artificial sequence
  SiRNA target sequence
gagaatattatttaaaaagtg

SEQ ID NO: 3622 - DNA, 21 bp, Artificial sequence
  SiRNA target sequence
agaatattatttaaaaagtgg

SEQ ID NO: 3623 - DNA, 21 bp, Artificial sequence
  SiRNA target sequence
gaatattatttaaaaagtgga

SEQ ID NO: 3624 - DNA, 21 bp, Artificial sequence
  SiRNA target sequence
aatattatttaaaaagtggaa

SEQ ID NO: 3625 - DNA, 21 bp, Artificial sequence
  SiRNA target sequence
atattatttaaaaagtggaaa

SEQ ID NO: 3626 - DNA, 21 bp, Artificial sequence
  SiRNA target sequence
tattatttaaaaagtggaaat

SEQ ID NO: 3627 - DNA, 21 bp, Artificial sequence
  SiRNA target sequence
attatttaaaaagtggaaatc

SEQ ID NO: 3628 - DNA, 21 bp, Artificial sequence
  SiRNA target sequence
ttatttaaaaagtggaaatca

SEQ ID NO: 3629 - DNA, 21 bp, Artificial sequence
  SiRNA target sequence
tatttaaaaagtggaaatcac

SEQ ID NO: 3630 - DNA, 21 bp, Artificial sequence
  SiRNA target sequence
atttaaaaagtggaaatcact

SEQ ID NO: 3631 - DNA, 21 bp, Artificial sequence
  SiRNA target sequence
tttaaaaagtggaaatcactc

SEQ ID NO: 3632 - DNA, 21 bp, Artificial sequence
  SiRNA target sequence
ttaaaaagtggaaatcactct

SEQ ID NO: 3633 - DNA, 21 bp, Artificial sequence
  SiRNA target sequence
taaaaagtggaaatcactcta

SEQ ID NO: 3634 - DNA, 21 bp, Artificial sequence
  SiRNA target sequence
aaaaagtggaaatcactctaa

SEQ ID NO: 3635 - DNA, 21 bp, Artificial sequence
  SiRNA target sequence
aaaagtggaaatcactctaaa

SEQ ID NO: 3636 - DNA, 21 bp, Artificial sequence
  SiRNA target sequence
aaagtggaaatcactctaaaa

SEQ ID NO: 3637 - DNA, 21 bp, Artificial sequence
  SiRNA target sequence
aagtggaaatcactctaaaat

SEQ ID NO: 3638 - DNA, 21 bp, Artificial sequence
  SiRNA target sequence
agtggaaatcactctaaaatg

SEQ ID NO: 3639 - DNA, 21 bp, Artificial sequence
  SiRNA target sequence
gtggaaatcactctaaaatgt

SEQ ID NO: 3640 - DNA, 21 bp, Artificial sequence
  SiRNA target sequence
tggaaatcactctaaaatgtt

SEQ ID NO: 3641 - DNA, 21 bp, Artificial sequence
  SiRNA target sequence
ggaaatcactctaaaatgtta

SEQ ID NO: 3642 - DNA, 21 bp, Artificial sequence
  SiRNA target sequence
gaaatcactctaaaatgttag

SEQ ID NO: 3643 - DNA, 21 bp, Artificial sequence
  SiRNA target sequence
aaatcactctaaaatgttaga

SEQ ID NO: 3644 - DNA, 21 bp, Artificial sequence
  SiRNA target sequence
aatcactctaaaatgttagat

SEQ ID NO: 3645 - DNA, 21 bp, Artificial sequence
  SiRNA target sequence
atcactctaaaatgttagatc

SEQ ID NO: 3646 - DNA, 21 bp, Artificial sequence
  SiRNA target sequence
tcactctaaaatgttagatct

SEQ ID NO: 3647 - DNA, 21 bp, Artificial sequence
  SiRNA target sequence
cactctaaaatgttagatcta

SEQ ID NO: 3648 - DNA, 21 bp, Artificial sequence
  SiRNA target sequence
actctaaaatgttagatctat

SEQ ID NO: 3649 - DNA, 21 bp, Artificial sequence
  SiRNA target sequence
ctctaaaatgttagatctatt

SEQ ID NO: 3650 - DNA, 21 bp, Artificial sequence
  SiRNA target sequence
tctaaaatgttagatctatta

SEQ ID NO: 3651 - DNA, 21 bp, Artificial sequence
  SiRNA target sequence
ctaaaatgttagatctattat

SEQ ID NO: 3652 - DNA, 21 bp, Artificial sequence
  SiRNA target sequence
taaaatgttagatctattatc

SEQ ID NO: 3653 - DNA, 21 bp, Artificial sequence
  SiRNA target sequence
aaaatgttagatctattatct

SEQ ID NO: 3654 - DNA, 21 bp, Artificial sequence
  SiRNA target sequence
aaatgttagatctattatcta

SEQ ID NO: 3655 - DNA, 21 bp, Artificial sequence
  SiRNA target sequence
aatgttagatctattatctag

SEQ ID NO: 3656 - DNA, 21 bp, Artificial sequence
  SiRNA target sequence
atgttagatctattatctagt

SEQ ID NO: 3657 - DNA, 21 bp, Artificial sequence
  SiRNA target sequence
tgttagatctattatctagtc

SEQ ID NO: 3658 - DNA, 21 bp, Artificial sequence
  SiRNA target sequence
gttagatctattatctagtca

SEQ ID NO: 3659 - DNA, 21 bp, Artificial sequence
  SiRNA target sequence
ttagatctattatctagtcat

SEQ ID NO: 3660 - DNA, 21 bp, Artificial sequence
  SiRNA target sequence
tagatctattatctagtcatc

SEQ ID NO: 3661 - DNA, 21 bp, Artificial sequence
  SiRNA target sequence
agatctattatctagtcatcc

SEQ ID NO: 3662 - DNA, 21 bp, Artificial sequence
  SiRNA target sequence
gatctattatctagtcatcca

SEQ ID NO: 3663 - DNA, 21 bp, Artificial sequence
  SiRNA target sequence
atctattatctagtcatccag

SEQ ID NO: 3664 - DNA, 21 bp, Artificial sequence
  SiRNA target sequence
tctattatctagtcatccaga

SEQ ID NO: 3665 - DNA, 21 bp, Artificial sequence
  SiRNA target sequence
ctattatctagtcatccagat

SEQ ID NO: 3666 - DNA, 21 bp, Artificial sequence
  SiRNA target sequence
tattatctagtcatccagata

SEQ ID NO: 3667 - DNA, 21 bp, Artificial sequence
  SiRNA target sequence
attatctagtcatccagatac

SEQ ID NO: 3668 - DNA, 21 bp, Artificial sequence
  SiRNA target sequence
ttatctagtcatccagatact

SEQ ID NO: 3669 - DNA, 21 bp, Artificial sequence
  SiRNA target sequence
tatctagtcatccagatactc

SEQ ID NO: 3670 - DNA, 21 bp, Artificial sequence
  SiRNA target sequence
atctagtcatccagatactcc

SEQ ID NO: 3671 - DNA, 21 bp, Artificial sequence
  SiRNA target sequence
tctagtcatccagatactcct

SEQ ID NO: 3672 - DNA, 21 bp, Artificial sequence
  SiRNA target sequence
ctagtcatccagatactcctg

SEQ ID NO: 3673 - DNA, 21 bp, Artificial sequence
  SiRNA target sequence
tagtcatccagatactcctgg

SEQ ID NO: 3674 - DNA, 21 bp, Artificial sequence
  SiRNA target sequence
agtcatccagatactcctggt

SEQ ID NO: 3675 - DNA, 21 bp, Artificial sequence
  SiRNA target sequence
gtcatccagatactcctggta

SEQ ID NO: 3676 - DNA, 21 bp, Artificial sequence
  SiRNA target sequence
tcatccagatactcctggtaa

SEQ ID NO: 3677 - DNA, 21 bp, Artificial sequence
  SiRNA target sequence
catccagatactcctggtaaa

SEQ ID NO: 3678 - DNA, 21 bp, Artificial sequence
  SiRNA target sequence
atccagatactcctggtaaat

SEQ ID NO: 3679 - DNA, 21 bp, Artificial sequence
  SiRNA target sequence
tccagatactcctggtaaatt

SEQ ID NO: 3680 - DNA, 21 bp, Artificial sequence
  SiRNA target sequence
ccagatactcctggtaaatta

SEQ ID NO: 3681 - DNA, 21 bp, Artificial sequence
  SiRNA target sequence
cagatactcctggtaaattac

SEQ ID NO: 3682 - DNA, 21 bp, Artificial sequence
  SiRNA target sequence
agatactcctggtaaattact

SEQ ID NO: 3683 - DNA, 21 bp, Artificial sequence
  SiRNA target sequence
gatactcctggtaaattactt

SEQ ID NO: 3684 - DNA, 21 bp, Artificial sequence
  SiRNA target sequence
atactcctggtaaattacttt

SEQ ID NO: 3685 - DNA, 21 bp, Artificial sequence
  SiRNA target sequence
tactcctggtaaattactttt

SEQ ID NO: 3686 - DNA, 21 bp, Artificial sequence
  SiRNA target sequence
actcctggtaaattactttta

SEQ ID NO: 3687 - DNA, 21 bp, Artificial sequence
  SiRNA target sequence
ctcctggtaaattacttttaa

SEQ ID NO: 3688 - DNA, 21 bp, Artificial sequence
  SiRNA target sequence
tcctggtaaattacttttaac

SEQ ID NO: 3689 - DNA, 21 bp, Artificial sequence
  SiRNA target sequence
cctggtaaattacttttaacg

SEQ ID NO: 3690 - DNA, 21 bp, Artificial sequence
  SiRNA target sequence
ctggtaaattacttttaacgg

SEQ ID NO: 3691 - DNA, 21 bp, Artificial sequence
  SiRNA target sequence
tggtaaattacttttaacggc

SEQ ID NO: 3692 - DNA, 21 bp, Artificial sequence
  SiRNA target sequence
ggtaaattacttttaacggca

SEQ ID NO: 3693 - DNA, 21 bp, Artificial sequence
  SiRNA target sequence
gtaaattacttttaacggcac

SEQ ID NO: 3694 - DNA, 21 bp, Artificial sequence
  SiRNA target sequence
taaattacttttaacggcact

SEQ ID NO: 3695 - DNA, 21 bp, Artificial sequence
  SiRNA target sequence
aaattacttttaacggcactt

SEQ ID NO: 3696 - DNA, 21 bp, Artificial sequence
  SiRNA target sequence
aattacttttaacggcacttt

SEQ ID NO: 3697 - DNA, 21 bp, Artificial sequence
  SiRNA target sequence
attacttttaacggcacttta

SEQ ID NO: 3698 - DNA, 21 bp, Artificial sequence
  SiRNA target sequence
ttacttttaacggcactttat

SEQ ID NO: 3699 - DNA, 21 bp, Artificial sequence
  SiRNA target sequence
tacttttaacggcactttatg

SEQ ID NO: 3700 - DNA, 21 bp, Artificial sequence
  SiRNA target sequence
acttttaacggcactttatgc

SEQ ID NO: 3701 - DNA, 21 bp, Artificial sequence
  SiRNA target sequence
cttttaacggcactttatgca

SEQ ID NO: 3702 - DNA, 21 bp, Artificial sequence
  SiRNA target sequence
ttttaacggcactttatgcaa

SEQ ID NO: 3703 - DNA, 21 bp, Artificial sequence
  SiRNA target sequence
tttaacggcactttatgcaat

SEQ ID NO: 3704 - DNA, 21 bp, Artificial sequence
  SiRNA target sequence
ttaacggcactttatgcaata

SEQ ID NO: 3705 - DNA, 21 bp, Artificial sequence
  SiRNA target sequence
taacggcactttatgcaataa

SEQ ID NO: 3706 - DNA, 21 bp, Artificial sequence
  SiRNA target sequence
aacggcactttatgcaataag

SEQ ID NO: 3707 - DNA, 21 bp, Artificial sequence
  SiRNA target sequence
acggcactttatgcaataagt

SEQ ID NO: 3708 - DNA, 21 bp, Artificial sequence
  SiRNA target sequence
cggcactttatgcaataagta

SEQ ID NO: 3709 - DNA, 21 bp, Artificial sequence
  SiRNA target sequence
ggcactttatgcaataagtat

SEQ ID NO: 3710 - DNA, 21 bp, Artificial sequence
  SiRNA target sequence
gcactttatgcaataagtatt

SEQ ID NO: 3711 - DNA, 21 bp, Artificial sequence
  SiRNA target sequence
cactttatgcaataagtattg

SEQ ID NO: 3712 - DNA, 21 bp, Artificial sequence
  SiRNA target sequence
actttatgcaataagtattga

SEQ ID NO: 3713 - DNA, 21 bp, Artificial sequence
  SiRNA target sequence
ctttatgcaataagtattgat

SEQ ID NO: 3714 - DNA, 21 bp, Artificial sequence
  SiRNA target sequence
tttatgcaataagtattgata

SEQ ID NO: 3715 - DNA, 21 bp, Artificial sequence
  SiRNA target sequence
ttatgcaataagtattgataa

SEQ ID NO: 3716 - DNA, 21 bp, Artificial sequence
  SiRNA target sequence
tatgcaataagtattgataag

SEQ ID NO: 3717 - DNA, 21 bp, Artificial sequence
  SiRNA target sequence
atgcaataagtattgataaga

SEQ ID NO: 3718 - DNA, 21 bp, Artificial sequence
  SiRNA target sequence
tgcaataagtattgataagaa

SEQ ID NO: 3719 - DNA, 21 bp, Artificial sequence
  SiRNA target sequence
gcaataagtattgataagaaa

SEQ ID NO: 3720 - DNA, 21 bp, Artificial sequence
  SiRNA target sequence
caataagtattgataagaaaa

SEQ ID NO: 3721 - DNA, 21 bp, Artificial sequence
  SiRNA target sequence
aataagtattgataagaaaaa

SEQ ID NO: 3722 - DNA, 21 bp, Artificial sequence
  SiRNA target sequence
ataagtattgataagaaaaag

SEQ ID NO: 3723 - DNA, 21 bp, Artificial sequence
  SiRNA target sequence
taagtattgataagaaaaagg

SEQ ID NO: 3724 - DNA, 21 bp, Artificial sequence
  SiRNA target sequence
aagtattgataagaaaaagga

SEQ ID NO: 3725 - DNA, 21 bp, Artificial sequence
  SiRNA target sequence
agtattgataagaaaaaggat

SEQ ID NO: 3726 - DNA, 21 bp, Artificial sequence
  SiRNA target sequence
gtattgataagaaaaaggatg

SEQ ID NO: 3727 - DNA, 21 bp, Artificial sequence
  SiRNA target sequence
tattgataagaaaaaggatgc

SEQ ID NO: 3728 - DNA, 21 bp, Artificial sequence
  SiRNA target sequence
attgataagaaaaaggatgct

SEQ ID NO: 3729 - DNA, 21 bp, Artificial sequence
  SiRNA target sequence
ttgataagaaaaaggatgcta

SEQ ID NO: 3730 - DNA, 21 bp, Artificial sequence
  SiRNA target sequence
tgataagaaaaaggatgctat

SEQ ID NO: 3731 - DNA, 21 bp, Artificial sequence
  SiRNA target sequence
gataagaaaaaggatgctata

SEQ ID NO: 3732 - DNA, 21 bp, Artificial sequence
  SiRNA target sequence
ataagaaaaaggatgctatag

SEQ ID NO: 3733 - DNA, 21 bp, Artificial sequence
  SiRNA target sequence
taagaaaaaggatgctataga

SEQ ID NO: 3734 - DNA, 21 bp, Artificial sequence
  SiRNA target sequence
aagaaaaaggatgctatagaa

SEQ ID NO: 3735 - DNA, 21 bp, Artificial sequence
  SiRNA target sequence
agaaaaaggatgctatagaaa

SEQ ID NO: 3736 - DNA, 21 bp, Artificial sequence
  SiRNA target sequence
gaaaaaggatgctatagaaat

SEQ ID NO: 3737 - DNA, 21 bp, Artificial sequence
  SiRNA target sequence
aaaaaggatgctatagaaatt

SEQ ID NO: 3738 - DNA, 21 bp, Artificial sequence
  SiRNA target sequence
aaaaggatgctatagaaattt

SEQ ID NO: 3739 - DNA, 21 bp, Artificial sequence
  SiRNA target sequence
aaaggatgctatagaaatttt

SEQ ID NO: 3740 - DNA, 21 bp, Artificial sequence
  SiRNA target sequence
aaggatgctatagaaatttta

SEQ ID NO: 3741 - DNA, 21 bp, Artificial sequence
  SiRNA target sequence
aggatgctatagaaattttat

SEQ ID NO: 3742 - DNA, 21 bp, Artificial sequence
  SiRNA target sequence
ggatgctatagaaattttata

SEQ ID NO: 3743 - DNA, 21 bp, Artificial sequence
  SiRNA target sequence
gatgctatagaaattttatat

SEQ ID NO: 3744 - DNA, 21 bp, Artificial sequence
  SiRNA target sequence
atgctatagaaattttatata

SEQ ID NO: 3745 - DNA, 21 bp, Artificial sequence
  SiRNA target sequence
tgctatagaaattttatatag

SEQ ID NO: 3746 - DNA, 21 bp, Artificial sequence
  SiRNA target sequence
gctatagaaattttatataga

SEQ ID NO: 3747 - DNA, 21 bp, Artificial sequence
  SiRNA target sequence
ctatagaaattttatatagaa

SEQ ID NO: 3748 - DNA, 21 bp, Artificial sequence
  SiRNA target sequence
tatagaaattttatatagaag

SEQ ID NO: 3749 - DNA, 21 bp, Artificial sequence
  SiRNA target sequence
atagaaattttatatagaagt

SEQ ID NO: 3750 - DNA, 21 bp, Artificial sequence
  SiRNA target sequence
tagaaattttatatagaagta

SEQ ID NO: 3751 - DNA, 21 bp, Artificial sequence
  SiRNA target sequence
agaaattttatatagaagtat

SEQ ID NO: 3752 - DNA, 21 bp, Artificial sequence
  SiRNA target sequence
gaaattttatatagaagtata

SEQ ID NO: 3753 - DNA, 21 bp, Artificial sequence
  SiRNA target sequence
aaattttatatagaagtatat

SEQ ID NO: 3754 - DNA, 21 bp, Artificial sequence
  SiRNA target sequence
aattttatatagaagtatatc

SEQ ID NO: 3755 - DNA, 21 bp, Artificial sequence
  SiRNA target sequence
attttatatagaagtatatca

SEQ ID NO: 3756 - DNA, 21 bp, Artificial sequence
  SiRNA target sequence
ttttatatagaagtatatcag

SEQ ID NO: 3757 - DNA, 21 bp, Artificial sequence
  SiRNA target sequence
tttatatagaagtatatcaga

SEQ ID NO: 3758 - DNA, 21 bp, Artificial sequence
  SiRNA target sequence
ttatatagaagtatatcagaa

SEQ ID NO: 3759 - DNA, 21 bp, Artificial sequence
  SiRNA target sequence
tatatagaagtatatcagaat

SEQ ID NO: 3760 - DNA, 21 bp, Artificial sequence
  SiRNA target sequence
atatagaagtatatcagaata

SEQ ID NO: 3761 - DNA, 21 bp, Artificial sequence
  SiRNA target sequence
tatagaagtatatcagaatat

SEQ ID NO: 3762 - DNA, 21 bp, Artificial sequence
  SiRNA target sequence
atagaagtatatcagaatatt

SEQ ID NO: 3763 - DNA, 21 bp, Artificial sequence
  SiRNA target sequence
tagaagtatatcagaatattc

SEQ ID NO: 3764 - DNA, 21 bp, Artificial sequence
  SiRNA target sequence
agaagtatatcagaatattca

SEQ ID NO: 3765 - DNA, 21 bp, Artificial sequence
  SiRNA target sequence
gaagtatatcagaatattcat

SEQ ID NO: 3766 - DNA, 21 bp, Artificial sequence
  SiRNA target sequence
aagtatatcagaatattcatc

SEQ ID NO: 3767 - DNA, 21 bp, Artificial sequence
  SiRNA target sequence
agtatatcagaatattcatct

SEQ ID NO: 3768 - DNA, 21 bp, Artificial sequence
  SiRNA target sequence
gtatatcagaatattcatctt

SEQ ID NO: 3769 - DNA, 21 bp, Artificial sequence
  SiRNA target sequence
tatatcagaatattcatctta

SEQ ID NO: 3770 - DNA, 21 bp, Artificial sequence
  SiRNA target sequence
atatcagaatattcatcttat

SEQ ID NO: 3771 - DNA, 21 bp, Artificial sequence
  SiRNA target sequence
tatcagaatattcatcttatt

SEQ ID NO: 3772 - DNA, 21 bp, Artificial sequence
  SiRNA target sequence
atcagaatattcatcttattt

SEQ ID NO: 3773 - DNA, 21 bp, Artificial sequence
  SiRNA target sequence
tcagaatattcatcttatttt

SEQ ID NO: 3774 - DNA, 21 bp, Artificial sequence
  SiRNA target sequence
cagaatattcatcttatttta

SEQ ID NO: 3775 - DNA, 21 bp, Artificial sequence
  SiRNA target sequence
agaatattcatcttattttaa

SEQ ID NO: 3776 - DNA, 21 bp, Artificial sequence
  SiRNA target sequence
gaatattcatcttattttaaa

SEQ ID NO: 3777 - DNA, 21 bp, Artificial sequence
  SiRNA target sequence
aatattcatcttattttaaat

SEQ ID NO: 3778 - DNA, 21 bp, Artificial sequence
  SiRNA target sequence
atattcatcttattttaaatc

SEQ ID NO: 3779 - DNA, 21 bp, Artificial sequence
  SiRNA target sequence
tattcatcttattttaaatct

SEQ ID NO: 3780 - DNA, 21 bp, Artificial sequence
  SiRNA target sequence
attcatcttattttaaatctt

SEQ ID NO: 3781 - DNA, 21 bp, Artificial sequence
  SiRNA target sequence
ttcatcttattttaaatctta

SEQ ID NO: 3782 - DNA, 21 bp, Artificial sequence
  SiRNA target sequence
tcatcttattttaaatcttat

SEQ ID NO: 3783 - DNA, 21 bp, Artificial sequence
  SiRNA target sequence
catcttattttaaatcttatt

SEQ ID NO: 3784 - DNA, 21 bp, Artificial sequence
  SiRNA target sequence
atcttattttaaatcttattt

SEQ ID NO: 3785 - DNA, 21 bp, Artificial sequence
  SiRNA target sequence
tcttattttaaatcttatttg

SEQ ID NO: 3786 - DNA, 21 bp, Artificial sequence
  SiRNA target sequence
cttattttaaatcttatttgt

SEQ ID NO: 3787 - DNA, 21 bp, Artificial sequence
  SiRNA target sequence
ttattttaaatcttatttgta

SEQ ID NO: 3788 - DNA, 21 bp, Artificial sequence
  SiRNA target sequence
tattttaaatcttatttgtat

SEQ ID NO: 3789 - DNA, 21 bp, Artificial sequence
  SiRNA target sequence
attttaaatcttatttgtatt

SEQ ID NO: 3790 - DNA, 21 bp, Artificial sequence
  SiRNA target sequence
ttttaaatcttatttgtattt

SEQ ID NO: 3791 - DNA, 21 bp, Artificial sequence
  SiRNA target sequence
tttaaatcttatttgtattta

SEQ ID NO: 3792 - DNA, 21 bp, Artificial sequence
  SiRNA target sequence
ttaaatcttatttgtatttag

SEQ ID NO: 3793 - DNA, 21 bp, Artificial sequence
  SiRNA target sequence
taaatcttatttgtatttagg

SEQ ID NO: 3794 - DNA, 21 bp, Artificial sequence
  SiRNA target sequence
aaatcttatttgtatttagga

SEQ ID NO: 3795 - DNA, 21 bp, Artificial sequence
  SiRNA target sequence
aatcttatttgtatttaggaa

SEQ ID NO: 3796 - DNA, 21 bp, Artificial sequence
  SiRNA target sequence
atcttatttgtatttaggaaa

SEQ ID NO: 3797 - DNA, 21 bp, Artificial sequence
  SiRNA target sequence
tcttatttgtatttaggaaat

SEQ ID NO: 3798 - DNA, 21 bp, Artificial sequence
  SiRNA target sequence
cttatttgtatttaggaaata

SEQ ID NO: 3799 - DNA, 21 bp, Artificial sequence
  SiRNA target sequence
ttatttgtatttaggaaatat

SEQ ID NO: 3800 - DNA, 21 bp, Artificial sequence
  SiRNA target sequence
tatttgtatttaggaaatatt

SEQ ID NO: 3801 - DNA, 21 bp, Artificial sequence
  SiRNA target sequence
atttgtatttaggaaatattt

SEQ ID NO: 3802 - DNA, 21 bp, Artificial sequence
  SiRNA target sequence
tttgtatttaggaaatatttt

SEQ ID NO: 3803 - DNA, 21 bp, Artificial sequence
  SiRNA target sequence
ttgtatttaggaaatatttta

SEQ ID NO: 3804 - DNA, 21 bp, Artificial sequence
  SiRNA target sequence
tgtatttaggaaatattttaa

SEQ ID NO: 3805 - DNA, 21 bp, Artificial sequence
  SiRNA target sequence
gtatttaggaaatattttaat

SEQ ID NO: 3806 - DNA, 21 bp, Artificial sequence
  SiRNA target sequence
tatttaggaaatattttaata

SEQ ID NO: 3807 - DNA, 21 bp, Artificial sequence
  SiRNA target sequence
atttaggaaatattttaataa

SEQ ID NO: 3808 - DNA, 21 bp, Artificial sequence
  SiRNA target sequence
tttaggaaatattttaataaa

SEQ ID NO: 3809 - DNA, 21 bp, Artificial sequence
  SiRNA target sequence
ttaggaaatattttaataaat

SEQ ID NO: 3810 - DNA, 21 bp, Artificial sequence
  SiRNA target sequence
taggaaatattttaataaatg

SEQ ID NO: 3811 - DNA, 21 bp, Artificial sequence
  SiRNA target sequence
aggaaatattttaataaatga

SEQ ID NO: 3812 - DNA, 21 bp, Artificial sequence
  SiRNA target sequence
ggaaatattttaataaatgat

SEQ ID NO: 3813 - DNA, 21 bp, Artificial sequence
  SiRNA target sequence
gaaatattttaataaatgatg

SEQ ID NO: 3814 - DNA, 21 bp, Artificial sequence
  SiRNA target sequence
aaatattttaataaatgatga

SEQ ID NO: 3815 - DNA, 21 bp, Artificial sequence
  SiRNA target sequence
aatattttaataaatgatgac

SEQ ID NO: 3816 - DNA, 21 bp, Artificial sequence
  SiRNA target sequence
atattttaataaatgatgact

SEQ ID NO: 3817 - DNA, 21 bp, Artificial sequence
  SiRNA target sequence
tattttaataaatgatgactt

SEQ ID NO: 3818 - DNA, 21 bp, Artificial sequence
  SiRNA target sequence
attttaataaatgatgactta

SEQ ID NO: 3819 - DNA, 21 bp, Artificial sequence
  SiRNA target sequence
ttttaataaatgatgacttaa

SEQ ID NO: 3820 - DNA, 21 bp, Artificial sequence
  SiRNA target sequence
tttaataaatgatgacttaaa

SEQ ID NO: 3821 - DNA, 21 bp, Artificial sequence
  SiRNA target sequence
ttaataaatgatgacttaaat

SEQ ID NO: 3822 - DNA, 21 bp, Artificial sequence
  SiRNA target sequence
taataaatgatgacttaaatg

SEQ ID NO: 3823 - DNA, 21 bp, Artificial sequence
  SiRNA target sequence
aataaatgatgacttaaatga

SEQ ID NO: 3824 - DNA, 21 bp, Artificial sequence
  SiRNA target sequence
ataaatgatgacttaaatgaa

SEQ ID NO: 3825 - DNA, 21 bp, Artificial sequence
  SiRNA target sequence
taaatgatgacttaaatgaat

SEQ ID NO: 3826 - DNA, 21 bp, Artificial sequence
  SiRNA target sequence
aaatgatgacttaaatgaatg

SEQ ID NO: 3827 - DNA, 21 bp, Artificial sequence
  SiRNA target sequence
aatgatgacttaaatgaatgc

SEQ ID NO: 3828 - DNA, 21 bp, Artificial sequence
  SiRNA target sequence
atgatgacttaaatgaatgca

SEQ ID NO: 3829 - DNA, 21 bp, Artificial sequence
  SiRNA target sequence
tgatgacttaaatgaatgcag

SEQ ID NO: 3830 - DNA, 21 bp, Artificial sequence
  SiRNA target sequence
gatgacttaaatgaatgcagg

SEQ ID NO: 3831 - DNA, 21 bp, Artificial sequence
  SiRNA target sequence
atgacttaaatgaatgcagga

SEQ ID NO: 3832 - DNA, 21 bp, Artificial sequence
  SiRNA target sequence
tgacttaaatgaatgcaggaa

SEQ ID NO: 3833 - DNA, 21 bp, Artificial sequence
  SiRNA target sequence
gacttaaatgaatgcaggaaa

SEQ ID NO: 3834 - DNA, 21 bp, Artificial sequence
  SiRNA target sequence
acttaaatgaatgcaggaaat

SEQ ID NO: 3835 - DNA, 21 bp, Artificial sequence
  SiRNA target sequence
cttaaatgaatgcaggaaatt

SEQ ID NO: 3836 - DNA, 21 bp, Artificial sequence
  SiRNA target sequence
ttaaatgaatgcaggaaattg

SEQ ID NO: 3837 - DNA, 21 bp, Artificial sequence
  SiRNA target sequence
taaatgaatgcaggaaattgt

SEQ ID NO: 3838 - DNA, 21 bp, Artificial sequence
  SiRNA target sequence
aaatgaatgcaggaaattgtt

SEQ ID NO: 3839 - DNA, 21 bp, Artificial sequence
  SiRNA target sequence
aatgaatgcaggaaattgttt

SEQ ID NO: 3840 - DNA, 21 bp, Artificial sequence
  SiRNA target sequence
atgaatgcaggaaattgttta

SEQ ID NO: 3841 - DNA, 21 bp, Artificial sequence
  SiRNA target sequence
tgaatgcaggaaattgtttaa

SEQ ID NO: 3842 - DNA, 21 bp, Artificial sequence
  SiRNA target sequence
gaatgcaggaaattgtttaat

SEQ ID NO: 3843 - DNA, 21 bp, Artificial sequence
  SiRNA target sequence
aatgcaggaaattgtttaata

SEQ ID NO: 3844 - DNA, 21 bp, Artificial sequence
  SiRNA target sequence
atgcaggaaattgtttaatac

SEQ ID NO: 3845 - DNA, 21 bp, Artificial sequence
  SiRNA target sequence
tgcaggaaattgtttaataca

SEQ ID NO: 3846 - DNA, 21 bp, Artificial sequence
  SiRNA target sequence
gcaggaaattgtttaatacat

SEQ ID NO: 3847 - DNA, 21 bp, Artificial sequence
  SiRNA target sequence
caggaaattgtttaatacatc

SEQ ID NO: 3848 - DNA, 21 bp, Artificial sequence
  SiRNA target sequence
aggaaattgtttaatacatca

SEQ ID NO: 3849 - DNA, 21 bp, Artificial sequence
  SiRNA target sequence
ggaaattgtttaatacatcac

SEQ ID NO: 3850 - DNA, 21 bp, Artificial sequence
  SiRNA target sequence
gaaattgtttaatacatcact

SEQ ID NO: 3851 - DNA, 21 bp, Artificial sequence
  SiRNA target sequence
aaattgtttaatacatcactt

SEQ ID NO: 3852 - DNA, 21 bp, Artificial sequence
  SiRNA target sequence
aattgtttaatacatcacttc

SEQ ID NO: 3853 - DNA, 21 bp, Artificial sequence
  SiRNA target sequence
attgtttaatacatcacttca

SEQ ID NO: 3854 - DNA, 21 bp, Artificial sequence
  SiRNA target sequence
ttgtttaatacatcacttcaa

SEQ ID NO: 3855 - DNA, 21 bp, Artificial sequence
  SiRNA target sequence
tgtttaatacatcacttcaat

SEQ ID NO: 3856 - DNA, 21 bp, Artificial sequence
  SiRNA target sequence
gtttaatacatcacttcaata

SEQ ID NO: 3857 - DNA, 21 bp, Artificial sequence
  SiRNA target sequence
tttaatacatcacttcaatat

SEQ ID NO: 3858 - DNA, 21 bp, Artificial sequence
  SiRNA target sequence
ttaatacatcacttcaatatt

SEQ ID NO: 3859 - DNA, 21 bp, Artificial sequence
  SiRNA target sequence
taatacatcacttcaatattg

SEQ ID NO: 3860 - DNA, 21 bp, Artificial sequence
  SiRNA target sequence
aatacatcacttcaatattgt

SEQ ID NO: 3861 - DNA, 21 bp, Artificial sequence
  SiRNA target sequence
atacatcacttcaatattgtt

SEQ ID NO: 3862 - DNA, 21 bp, Artificial sequence
  SiRNA target sequence
tacatcacttcaatattgttg

SEQ ID NO: 3863 - DNA, 21 bp, Artificial sequence
  SiRNA target sequence
acatcacttcaatattgttgt

SEQ ID NO: 3864 - DNA, 21 bp, Artificial sequence
  SiRNA target sequence
catcacttcaatattgttgta

SEQ ID NO: 3865 - DNA, 21 bp, Artificial sequence
  SiRNA target sequence
atcacttcaatattgttgtaa

SEQ ID NO: 3866 - DNA, 21 bp, Artificial sequence
  SiRNA target sequence
tcacttcaatattgttgtaat

SEQ ID NO: 3867 - DNA, 21 bp, Artificial sequence
  SiRNA target sequence
cacttcaatattgttgtaatt

SEQ ID NO: 3868 - DNA, 21 bp, Artificial sequence
  SiRNA target sequence
acttcaatattgttgtaattc

SEQ ID NO: 3869 - DNA, 21 bp, Artificial sequence
  SiRNA target sequence
cttcaatattgttgtaattct

SEQ ID NO: 3870 - DNA, 21 bp, Artificial sequence
  SiRNA target sequence
ttcaatattgttgtaattctg

SEQ ID NO: 3871 - DNA, 21 bp, Artificial sequence
  SiRNA target sequence
tcaatattgttgtaattctga

SEQ ID NO: 3872 - DNA, 21 bp, Artificial sequence
  SiRNA target sequence
caatattgttgtaattctgat

SEQ ID NO: 3873 - DNA, 21 bp, Artificial sequence
  SiRNA target sequence
aatattgttgtaattctgatg

SEQ ID NO: 3874 - DNA, 21 bp, Artificial sequence
  SiRNA target sequence
atattgttgtaattctgatga

SEQ ID NO: 3875 - DNA, 21 bp, Artificial sequence
  SiRNA target sequence
tattgttgtaattctgatgag

SEQ ID NO: 3876 - DNA, 21 bp, Artificial sequence
  SiRNA target sequence
attgttgtaattctgatgagg

SEQ ID NO: 3877 - DNA, 21 bp, Artificial sequence
  SiRNA target sequence
ttgttgtaattctgatgaggt

SEQ ID NO: 3878 - DNA, 21 bp, Artificial sequence
  SiRNA target sequence
tgttgtaattctgatgaggtt

SEQ ID NO: 3879 - DNA, 21 bp, Artificial sequence
  SiRNA target sequence
gttgtaattctgatgaggttt

SEQ ID NO: 3880 - DNA, 21 bp, Artificial sequence
  SiRNA target sequence
ttgtaattctgatgaggtttt

SEQ ID NO: 3881 - DNA, 21 bp, Artificial sequence
  SiRNA target sequence
tgtaattctgatgaggttttt

SEQ ID NO: 3882 - DNA, 21 bp, Artificial sequence
  SiRNA target sequence
gtaattctgatgaggttttta

SEQ ID NO: 3883 - DNA, 21 bp, Artificial sequence
  SiRNA target sequence
taattctgatgaggtttttat

SEQ ID NO: 3884 - DNA, 21 bp, Artificial sequence
  SiRNA target sequence
aattctgatgaggtttttatt

SEQ ID NO: 3885 - DNA, 21 bp, Artificial sequence
  SiRNA target sequence
attctgatgaggtttttattg

SEQ ID NO: 3886 - DNA, 21 bp, Artificial sequence
  SiRNA target sequence
ttctgatgaggtttttattgt

SEQ ID NO: 3887 - DNA, 21 bp, Artificial sequence
  SiRNA target sequence
tctgatgaggtttttattgtt

SEQ ID NO: 3888 - DNA, 21 bp, Artificial sequence
  SiRNA target sequence
ctgatgaggtttttattgtta

SEQ ID NO: 3889 - DNA, 21 bp, Artificial sequence
  SiRNA target sequence
tgatgaggtttttattgttaa

SEQ ID NO: 3890 - DNA, 21 bp, Artificial sequence
  SiRNA target sequence
gatgaggtttttattgttaag

SEQ ID NO: 3891 - DNA, 21 bp, Artificial sequence
  SiRNA target sequence
atgaggtttttattgttaagc

SEQ ID NO: 3892 - DNA, 21 bp, Artificial sequence
  SiRNA target sequence
tgaggtttttattgttaagca

SEQ ID NO: 3893 - DNA, 21 bp, Artificial sequence
  SiRNA target sequence
gaggtttttattgttaagcag

SEQ ID NO: 3894 - DNA, 21 bp, Artificial sequence
  SiRNA target sequence
aggtttttattgttaagcagt

SEQ ID NO: 3895 - DNA, 21 bp, Artificial sequence
  SiRNA target sequence
ggtttttattgttaagcagtc

SEQ ID NO: 3896 - DNA, 21 bp, Artificial sequence
  SiRNA target sequence
gtttttattgttaagcagtca

SEQ ID NO: 3897 - DNA, 21 bp, Artificial sequence
  SiRNA target sequence
tttttattgttaagcagtcac

SEQ ID NO: 3898 - DNA, 21 bp, Artificial sequence
  SiRNA target sequence
ttttattgttaagcagtcact

SEQ ID NO: 3899 - DNA, 21 bp, Artificial sequence
  SiRNA target sequence
tttattgttaagcagtcactt

SEQ ID NO: 3900 - DNA, 21 bp, Artificial sequence
  SiRNA target sequence
ttattgttaagcagtcactta

SEQ ID NO: 3901 - DNA, 21 bp, Artificial sequence
  SiRNA target sequence
tattgttaagcagtcacttat

SEQ ID NO: 3902 - DNA, 21 bp, Artificial sequence
  SiRNA target sequence
attgttaagcagtcacttatt

SEQ ID NO: 3903 - DNA, 21 bp, Artificial sequence
  SiRNA target sequence
ttgttaagcagtcacttattt

SEQ ID NO: 3904 - DNA, 21 bp, Artificial sequence
  SiRNA target sequence
tgttaagcagtcacttatttt

SEQ ID NO: 3905 - DNA, 21 bp, Artificial sequence
  SiRNA target sequence
gttaagcagtcacttatttta

SEQ ID NO: 3906 - DNA, 21 bp, Artificial sequence
  SiRNA target sequence
ttaagcagtcacttattttaa

SEQ ID NO: 3907 - DNA, 21 bp, Artificial sequence
  SiRNA target sequence
taagcagtcacttattttaat

SEQ ID NO: 3908 - DNA, 21 bp, Artificial sequence
  SiRNA target sequence
aagcagtcacttattttaata

SEQ ID NO: 3909 - DNA, 21 bp, Artificial sequence
  SiRNA target sequence
agcagtcacttattttaatag

SEQ ID NO: 3910 - DNA, 21 bp, Artificial sequence
  SiRNA target sequence
gcagtcacttattttaataga

SEQ ID NO: 3911 - DNA, 21 bp, Artificial sequence
  SiRNA target sequence
cagtcacttattttaatagaa

SEQ ID NO: 3912 - DNA, 21 bp, Artificial sequence
  SiRNA target sequence
agtcacttattttaatagaag

SEQ ID NO: 3913 - DNA, 21 bp, Artificial sequence
  SiRNA target sequence
gtcacttattttaatagaagt

SEQ ID NO: 3914 - DNA, 21 bp, Artificial sequence
  SiRNA target sequence
tcacttattttaatagaagta

SEQ ID NO: 3915 - DNA, 21 bp, Artificial sequence
  SiRNA target sequence
cacttattttaatagaagtac

SEQ ID NO: 3916 - DNA, 21 bp, Artificial sequence
  SiRNA target sequence
acttattttaatagaagtaca

SEQ ID NO: 3917 - DNA, 21 bp, Artificial sequence
  SiRNA target sequence
cttattttaatagaagtacat

SEQ ID NO: 3918 - DNA, 21 bp, Artificial sequence
  SiRNA target sequence
ttattttaatagaagtacatg

SEQ ID NO: 3919 - DNA, 21 bp, Artificial sequence
  SiRNA target sequence
tattttaatagaagtacatga

SEQ ID NO: 3920 - DNA, 21 bp, Artificial sequence
  SiRNA target sequence
attttaatagaagtacatgaa

SEQ ID NO: 3921 - DNA, 21 bp, Artificial sequence
  SiRNA target sequence
ttttaatagaagtacatgaat

SEQ ID NO: 3922 - DNA, 21 bp, Artificial sequence
  SiRNA target sequence
tttaatagaagtacatgaata

SEQ ID NO: 3923 - DNA, 21 bp, Artificial sequence
  SiRNA target sequence
ttaatagaagtacatgaatac

SEQ ID NO: 3924 - DNA, 21 bp, Artificial sequence
  SiRNA target sequence
taatagaagtacatgaataca

SEQ ID NO: 3925 - DNA, 21 bp, Artificial sequence
  SiRNA target sequence
aatagaagtacatgaatacat

SEQ ID NO: 3926 - DNA, 21 bp, Artificial sequence
  SiRNA target sequence
atagaagtacatgaatacatc

SEQ ID NO: 3927 - DNA, 21 bp, Artificial sequence
  SiRNA target sequence
tagaagtacatgaatacatca

SEQ ID NO: 3928 - DNA, 21 bp, Artificial sequence
  SiRNA target sequence
agaagtacatgaatacatcaa

SEQ ID NO: 3929 - DNA, 21 bp, Artificial sequence
  SiRNA target sequence
gaagtacatgaatacatcaaa

SEQ ID NO: 3930 - DNA, 21 bp, Artificial sequence
  SiRNA target sequence
aagtacatgaatacatcaaag

SEQ ID NO: 3931 - DNA, 21 bp, Artificial sequence
  SiRNA target sequence
agtacatgaatacatcaaaga

SEQ ID NO: 3932 - DNA, 21 bp, Artificial sequence
  SiRNA target sequence
gtacatgaatacatcaaagaa

SEQ ID NO: 3933 - DNA, 21 bp, Artificial sequence
  SiRNA target sequence
tacatgaatacatcaaagaaa

SEQ ID NO: 3934 - DNA, 21 bp, Artificial sequence
  SiRNA target sequence
acatgaatacatcaaagaaaa

SEQ ID NO: 3935 - DNA, 21 bp, Artificial sequence
  SiRNA target sequence
catgaatacatcaaagaaaat

SEQ ID NO: 3936 - DNA, 21 bp, Artificial sequence
  SiRNA target sequence
atgaatacatcaaagaaaata

SEQ ID NO: 3937 - DNA, 21 bp, Artificial sequence
  SiRNA target sequence
tgaatacatcaaagaaaataa

SEQ ID NO: 3938 - DNA, 21 bp, Artificial sequence
  SiRNA target sequence
gaatacatcaaagaaaataaa

SEQ ID NO: 3939 - DNA, 21 bp, Artificial sequence
  SiRNA target sequence
aatacatcaaagaaaataaaa

SEQ ID NO: 3940 - DNA, 21 bp, Artificial sequence
  SiRNA target sequence
atacatcaaagaaaataaaat

SEQ ID NO: 3941 - DNA, 21 bp, Artificial sequence
  SiRNA target sequence
tacatcaaagaaaataaaata

SEQ ID NO: 3942 - DNA, 21 bp, Artificial sequence
  SiRNA target sequence
acatcaaagaaaataaaatat

SEQ ID NO: 3943 - DNA, 21 bp, Artificial sequence
  SiRNA target sequence
catcaaagaaaataaaatata

SEQ ID NO: 3944 - DNA, 21 bp, Artificial sequence
  SiRNA target sequence
atcaaagaaaataaaatataa

SEQ ID NO: 3945 - DNA, 22 bp, Artificial sequence
  SiRNA target sequence
atgaaacgaaaaacagaaatat

SEQ ID NO: 3946 - DNA, 22 bp, Artificial sequence
  SiRNA target sequence
tgaaacgaaaaacagaaatatt

SEQ ID NO: 3947 - DNA, 22 bp, Artificial sequence
  SiRNA target sequence
gaaacgaaaaacagaaatattt

SEQ ID NO: 3948 - DNA, 22 bp, Artificial sequence
  SiRNA target sequence
aaacgaaaaacagaaatattta

SEQ ID NO: 3949 - DNA, 22 bp, Artificial sequence
  SiRNA target sequence
aacgaaaaacagaaatatttat

SEQ ID NO: 3950 - DNA, 22 bp, Artificial sequence
  SiRNA target sequence
acgaaaaacagaaatatttatt

SEQ ID NO: 3951 - DNA, 22 bp, Artificial sequence
  SiRNA target sequence
cgaaaaacagaaatatttattg

SEQ ID NO: 3952 - DNA, 22 bp, Artificial sequence
  SiRNA target sequence
gaaaaacagaaatatttattgc

SEQ ID NO: 3953 - DNA, 22 bp, Artificial sequence
  SiRNA target sequence
aaaaacagaaatatttattgct

SEQ ID NO: 3954 - DNA, 22 bp, Artificial sequence
  SiRNA target sequence
aaaacagaaatatttattgcta

SEQ ID NO: 3955 - DNA, 22 bp, Artificial sequence
  SiRNA target sequence
aaacagaaatatttattgctat

SEQ ID NO: 3956 - DNA, 22 bp, Artificial sequence
  SiRNA target sequence
aacagaaatatttattgctatt

SEQ ID NO: 3957 - DNA, 22 bp, Artificial sequence
  SiRNA target sequence
acagaaatatttattgctatta

SEQ ID NO: 3958 - DNA, 22 bp, Artificial sequence
  SiRNA target sequence
cagaaatatttattgctattac

SEQ ID NO: 3959 - DNA, 22 bp, Artificial sequence
  SiRNA target sequence
agaaatatttattgctattaca

SEQ ID NO: 3960 - DNA, 22 bp, Artificial sequence
  SiRNA target sequence
gaaatatttattgctattacag

SEQ ID NO: 3961 - DNA, 22 bp, Artificial sequence
  SiRNA target sequence
aaatatttattgctattacagt

SEQ ID NO: 3962 - DNA, 22 bp, Artificial sequence
  SiRNA target sequence
aatatttattgctattacagta

SEQ ID NO: 3963 - DNA, 22 bp, Artificial sequence
  SiRNA target sequence
atatttattgctattacagtag

SEQ ID NO: 3964 - DNA, 22 bp, Artificial sequence
  SiRNA target sequence
tatttattgctattacagtagt

SEQ ID NO: 3965 - DNA, 22 bp, Artificial sequence
  SiRNA target sequence
atttattgctattacagtagtc

SEQ ID NO: 3966 - DNA, 22 bp, Artificial sequence
  SiRNA target sequence
tttattgctattacagtagtca

SEQ ID NO: 3967 - DNA, 22 bp, Artificial sequence
  SiRNA target sequence
ttattgctattacagtagtcac

SEQ ID NO: 3968 - DNA, 22 bp, Artificial sequence
  SiRNA target sequence
tattgctattacagtagtcact

SEQ ID NO: 3969 - DNA, 22 bp, Artificial sequence
  SiRNA target sequence
attgctattacagtagtcactg

SEQ ID NO: 3970 - DNA, 22 bp, Artificial sequence
  SiRNA target sequence
ttgctattacagtagtcactgc

SEQ ID NO: 3971 - DNA, 22 bp, Artificial sequence
  SiRNA target sequence
tgctattacagtagtcactgca

SEQ ID NO: 3972 - DNA, 22 bp, Artificial sequence
  SiRNA target sequence
gctattacagtagtcactgcag

SEQ ID NO: 3973 - DNA, 22 bp, Artificial sequence
  SiRNA target sequence
ctattacagtagtcactgcagt

SEQ ID NO: 3974 - DNA, 22 bp, Artificial sequence
  SiRNA target sequence
tattacagtagtcactgcagtg

SEQ ID NO: 3975 - DNA, 22 bp, Artificial sequence
  SiRNA target sequence
attacagtagtcactgcagtga

SEQ ID NO: 3976 - DNA, 22 bp, Artificial sequence
  SiRNA target sequence
ttacagtagtcactgcagtgac

SEQ ID NO: 3977 - DNA, 22 bp, Artificial sequence
  SiRNA target sequence
tacagtagtcactgcagtgaca

SEQ ID NO: 3978 - DNA, 22 bp, Artificial sequence
  SiRNA target sequence
acagtagtcactgcagtgacat

SEQ ID NO: 3979 - DNA, 22 bp, Artificial sequence
  SiRNA target sequence
cagtagtcactgcagtgacatg

SEQ ID NO: 3980 - DNA, 22 bp, Artificial sequence
  SiRNA target sequence
agtagtcactgcagtgacatgt

SEQ ID NO: 3981 - DNA, 22 bp, Artificial sequence
  SiRNA target sequence
gtagtcactgcagtgacatgtt

SEQ ID NO: 3982 - DNA, 22 bp, Artificial sequence
  SiRNA target sequence
tagtcactgcagtgacatgtta

SEQ ID NO: 3983 - DNA, 22 bp, Artificial sequence
  SiRNA target sequence
agtcactgcagtgacatgttac

SEQ ID NO: 3984 - DNA, 22 bp, Artificial sequence
  SiRNA target sequence
gtcactgcagtgacatgttact

SEQ ID NO: 3985 - DNA, 22 bp, Artificial sequence
  SiRNA target sequence
tcactgcagtgacatgttactt

SEQ ID NO: 3986 - DNA, 22 bp, Artificial sequence
  SiRNA target sequence
cactgcagtgacatgttactta

SEQ ID NO: 3987 - DNA, 22 bp, Artificial sequence
  SiRNA target sequence
actgcagtgacatgttacttat

SEQ ID NO: 3988 - DNA, 22 bp, Artificial sequence
  SiRNA target sequence
ctgcagtgacatgttacttatt

SEQ ID NO: 3989 - DNA, 22 bp, Artificial sequence
  SiRNA target sequence
tgcagtgacatgttacttattt

SEQ ID NO: 3990 - DNA, 22 bp, Artificial sequence
  SiRNA target sequence
gcagtgacatgttacttattta

SEQ ID NO: 3991 - DNA, 22 bp, Artificial sequence
  SiRNA target sequence
cagtgacatgttacttatttaa

SEQ ID NO: 3992 - DNA, 22 bp, Artificial sequence
  SiRNA target sequence
agtgacatgttacttatttaaa

SEQ ID NO: 3993 - DNA, 22 bp, Artificial sequence
  SiRNA target sequence
gtgacatgttacttatttaaaa

SEQ ID NO: 3994 - DNA, 22 bp, Artificial sequence
  SiRNA target sequence
tgacatgttacttatttaaaaa

SEQ ID NO: 3995 - DNA, 22 bp, Artificial sequence
  SiRNA target sequence
gacatgttacttatttaaaaaa

SEQ ID NO: 3996 - DNA, 22 bp, Artificial sequence
  SiRNA target sequence
acatgttacttatttaaaaaaa

SEQ ID NO: 3997 - DNA, 22 bp, Artificial sequence
  SiRNA target sequence
catgttacttatttaaaaaaat

SEQ ID NO: 3998 - DNA, 22 bp, Artificial sequence
  SiRNA target sequence
atgttacttatttaaaaaaata

SEQ ID NO: 3999 - DNA, 22 bp, Artificial sequence
  SiRNA target sequence
tgttacttatttaaaaaaataa

SEQ ID NO: 4000 - DNA, 22 bp, Artificial sequence
  SiRNA target sequence
gttacttatttaaaaaaataat

SEQ ID NO: 4001 - DNA, 22 bp, Artificial sequence
  SiRNA target sequence
ttacttatttaaaaaaataata

SEQ ID NO: 4002 - DNA, 22 bp, Artificial sequence
  SiRNA target sequence
tacttatttaaaaaaataataa

SEQ ID NO: 4003 - DNA, 22 bp, Artificial sequence
  SiRNA target sequence
acttatttaaaaaaataataaa

SEQ ID NO: 4004 - DNA, 22 bp, Artificial sequence
  SiRNA target sequence
cttatttaaaaaaataataaat

SEQ ID NO: 4005 - DNA, 22 bp, Artificial sequence
  SiRNA target sequence
ttatttaaaaaaataataaata

SEQ ID NO: 4006 - DNA, 22 bp, Artificial sequence
  SiRNA target sequence
tatttaaaaaaataataaatag

SEQ ID NO: 4007 - DNA, 22 bp, Artificial sequence
  SiRNA target sequence
atttaaaaaaataataaataga

SEQ ID NO: 4008 - DNA, 22 bp, Artificial sequence
  SiRNA target sequence
tttaaaaaaataataaatagac

SEQ ID NO: 4009 - DNA, 22 bp, Artificial sequence
  SiRNA target sequence
ttaaaaaaataataaatagaca

SEQ ID NO: 4010 - DNA, 22 bp, Artificial sequence
  SiRNA target sequence
taaaaaaataataaatagacaa

SEQ ID NO: 4011 - DNA, 22 bp, Artificial sequence
  SiRNA target sequence
aaaaaaataataaatagacaaa

SEQ ID NO: 4012 - DNA, 22 bp, Artificial sequence
  SiRNA target sequence
aaaaaataataaatagacaaaa

SEQ ID NO: 4013 - DNA, 22 bp, Artificial sequence
  SiRNA target sequence
aaaaataataaatagacaaaag

SEQ ID NO: 4014 - DNA, 22 bp, Artificial sequence
  SiRNA target sequence
aaaataataaatagacaaaagt

SEQ ID NO: 4015 - DNA, 22 bp, Artificial sequence
  SiRNA target sequence
aaataataaatagacaaaagtc

SEQ ID NO: 4016 - DNA, 22 bp, Artificial sequence
  SiRNA target sequence
aataataaatagacaaaagtct

SEQ ID NO: 4017 - DNA, 22 bp, Artificial sequence
  SiRNA target sequence
ataataaatagacaaaagtctg

SEQ ID NO: 4018 - DNA, 22 bp, Artificial sequence
  SiRNA target sequence
taataaatagacaaaagtctga

SEQ ID NO: 4019 - DNA, 22 bp, Artificial sequence
  SiRNA target sequence
aataaatagacaaaagtctgat

SEQ ID NO: 4020 - DNA, 22 bp, Artificial sequence
  SiRNA target sequence
ataaatagacaaaagtctgatt

SEQ ID NO: 4021 - DNA, 22 bp, Artificial sequence
  SiRNA target sequence
taaatagacaaaagtctgatta

SEQ ID NO: 4022 - DNA, 22 bp, Artificial sequence
  SiRNA target sequence
aaatagacaaaagtctgattat

SEQ ID NO: 4023 - DNA, 22 bp, Artificial sequence
  SiRNA target sequence
aatagacaaaagtctgattata

SEQ ID NO: 4024 - DNA, 22 bp, Artificial sequence
  SiRNA target sequence
atagacaaaagtctgattatac

SEQ ID NO: 4025 - DNA, 22 bp, Artificial sequence
  SiRNA target sequence
tagacaaaagtctgattataca

SEQ ID NO: 4026 - DNA, 22 bp, Artificial sequence
  SiRNA target sequence
agacaaaagtctgattatacat

SEQ ID NO: 4027 - DNA, 22 bp, Artificial sequence
  SiRNA target sequence
gacaaaagtctgattatacatc

SEQ ID NO: 4028 - DNA, 22 bp, Artificial sequence
  SiRNA target sequence
acaaaagtctgattatacatca

SEQ ID NO: 4029 - DNA, 22 bp, Artificial sequence
  SiRNA target sequence
caaaagtctgattatacatcaa

SEQ ID NO: 4030 - DNA, 22 bp, Artificial sequence
  SiRNA target sequence
aaaagtctgattatacatcaat

SEQ ID NO: 4031 - DNA, 22 bp, Artificial sequence
  SiRNA target sequence
aaagtctgattatacatcaata

SEQ ID NO: 4032 - DNA, 22 bp, Artificial sequence
  SiRNA target sequence
aagtctgattatacatcaataa

SEQ ID NO: 4033 - DNA, 22 bp, Artificial sequence
  SiRNA target sequence
agtctgattatacatcaataaa

SEQ ID NO: 4034 - DNA, 22 bp, Artificial sequence
  SiRNA target sequence
gtctgattatacatcaataaaa

SEQ ID NO: 4035 - DNA, 22 bp, Artificial sequence
  SiRNA target sequence
tctgattatacatcaataaaac

SEQ ID NO: 4036 - DNA, 22 bp, Artificial sequence
  SiRNA target sequence
ctgattatacatcaataaaaca

SEQ ID NO: 4037 - DNA, 22 bp, Artificial sequence
  SiRNA target sequence
tgattatacatcaataaaacag

SEQ ID NO: 4038 - DNA, 22 bp, Artificial sequence
  SiRNA target sequence
gattatacatcaataaaacagg

SEQ ID NO: 4039 - DNA, 22 bp, Artificial sequence
  SiRNA target sequence
attatacatcaataaaacagga

SEQ ID NO: 4040 - DNA, 22 bp, Artificial sequence
  SiRNA target sequence
ttatacatcaataaaacaggaa

SEQ ID NO: 4041 - DNA, 22 bp, Artificial sequence
  SiRNA target sequence
tatacatcaataaaacaggaag

SEQ ID NO: 4042 - DNA, 22 bp, Artificial sequence
  SiRNA target sequence
atacatcaataaaacaggaagc

SEQ ID NO: 4043 - DNA, 22 bp, Artificial sequence
  SiRNA target sequence
tacatcaataaaacaggaagca

SEQ ID NO: 4044 - DNA, 22 bp, Artificial sequence
  SiRNA target sequence
acatcaataaaacaggaagcag

SEQ ID NO: 4045 - DNA, 22 bp, Artificial sequence
  SiRNA target sequence
catcaataaaacaggaagcaga

SEQ ID NO: 4046 - DNA, 22 bp, Artificial sequence
  SiRNA target sequence
atcaataaaacaggaagcagat

SEQ ID NO: 4047 - DNA, 22 bp, Artificial sequence
  SiRNA target sequence
tcaataaaacaggaagcagata

SEQ ID NO: 4048 - DNA, 22 bp, Artificial sequence
  SiRNA target sequence
caataaaacaggaagcagataa

SEQ ID NO: 4049 - DNA, 22 bp, Artificial sequence
  SiRNA target sequence
aataaaacaggaagcagataaa

SEQ ID NO: 4050 - DNA, 22 bp, Artificial sequence
  SiRNA target sequence
ataaaacaggaagcagataaat

SEQ ID NO: 4051 - DNA, 22 bp, Artificial sequence
  SiRNA target sequence
taaaacaggaagcagataaata

SEQ ID NO: 4052 - DNA, 22 bp, Artificial sequence
  SiRNA target sequence
aaaacaggaagcagataaatat

SEQ ID NO: 4053 - DNA, 22 bp, Artificial sequence
  SiRNA target sequence
aaacaggaagcagataaatatt

SEQ ID NO: 4054 - DNA, 22 bp, Artificial sequence
  SiRNA target sequence
aacaggaagcagataaatattt

SEQ ID NO: 4055 - DNA, 22 bp, Artificial sequence
  SiRNA target sequence
acaggaagcagataaatatttt

SEQ ID NO: 4056 - DNA, 22 bp, Artificial sequence
  SiRNA target sequence
caggaagcagataaatatttta

SEQ ID NO: 4057 - DNA, 22 bp, Artificial sequence
  SiRNA target sequence
aggaagcagataaatattttat

SEQ ID NO: 4058 - DNA, 22 bp, Artificial sequence
  SiRNA target sequence
ggaagcagataaatattttata

SEQ ID NO: 4059 - DNA, 22 bp, Artificial sequence
  SiRNA target sequence
gaagcagataaatattttatac

SEQ ID NO: 4060 - DNA, 22 bp, Artificial sequence
  SiRNA target sequence
aagcagataaatattttataca

SEQ ID NO: 4061 - DNA, 22 bp, Artificial sequence
  SiRNA target sequence
agcagataaatattttatacaa

SEQ ID NO: 4062 - DNA, 22 bp, Artificial sequence
  SiRNA target sequence
gcagataaatattttatacaag

SEQ ID NO: 4063 - DNA, 22 bp, Artificial sequence
  SiRNA target sequence
cagataaatattttatacaaga

SEQ ID NO: 4064 - DNA, 22 bp, Artificial sequence
  SiRNA target sequence
agataaatattttatacaagaa

SEQ ID NO: 4065 - DNA, 22 bp, Artificial sequence
  SiRNA target sequence
gataaatattttatacaagaag

SEQ ID NO: 4066 - DNA, 22 bp, Artificial sequence
  SiRNA target sequence
ataaatattttatacaagaaga

SEQ ID NO: 4067 - DNA, 22 bp, Artificial sequence
  SiRNA target sequence
taaatattttatacaagaagat

SEQ ID NO: 4068 - DNA, 22 bp, Artificial sequence
  SiRNA target sequence
aaatattttatacaagaagatt

SEQ ID NO: 4069 - DNA, 22 bp, Artificial sequence
  SiRNA target sequence
aatattttatacaagaagatta

SEQ ID NO: 4070 - DNA, 22 bp, Artificial sequence
  SiRNA target sequence
atattttatacaagaagattat

SEQ ID NO: 4071 - DNA, 22 bp, Artificial sequence
  SiRNA target sequence
tattttatacaagaagattata

SEQ ID NO: 4072 - DNA, 22 bp, Artificial sequence
  SiRNA target sequence
attttatacaagaagattataa

SEQ ID NO: 4073 - DNA, 22 bp, Artificial sequence
  SiRNA target sequence
ttttatacaagaagattataaa

SEQ ID NO: 4074 - DNA, 22 bp, Artificial sequence
  SiRNA target sequence
tttatacaagaagattataaaa

SEQ ID NO: 4075 - DNA, 22 bp, Artificial sequence
  SiRNA target sequence
ttatacaagaagattataaaaa

SEQ ID NO: 4076 - DNA, 22 bp, Artificial sequence
  SiRNA target sequence
tatacaagaagattataaaaat

SEQ ID NO: 4077 - DNA, 22 bp, Artificial sequence
  SiRNA target sequence
atacaagaagattataaaaatg

SEQ ID NO: 4078 - DNA, 22 bp, Artificial sequence
  SiRNA target sequence
tacaagaagattataaaaatgc

SEQ ID NO: 4079 - DNA, 22 bp, Artificial sequence
  SiRNA target sequence
acaagaagattataaaaatgct

SEQ ID NO: 4080 - DNA, 22 bp, Artificial sequence
  SiRNA target sequence
caagaagattataaaaatgcta

SEQ ID NO: 4081 - DNA, 22 bp, Artificial sequence
  SiRNA target sequence
aagaagattataaaaatgctat

SEQ ID NO: 4082 - DNA, 22 bp, Artificial sequence
  SiRNA target sequence
agaagattataaaaatgctatt

SEQ ID NO: 4083 - DNA, 22 bp, Artificial sequence
  SiRNA target sequence
gaagattataaaaatgctattc

SEQ ID NO: 4084 - DNA, 22 bp, Artificial sequence
  SiRNA target sequence
aagattataaaaatgctattct

SEQ ID NO: 4085 - DNA, 22 bp, Artificial sequence
  SiRNA target sequence
agattataaaaatgctattctg

SEQ ID NO: 4086 - DNA, 22 bp, Artificial sequence
  SiRNA target sequence
gattataaaaatgctattctgt

SEQ ID NO: 4087 - DNA, 22 bp, Artificial sequence
  SiRNA target sequence
attataaaaatgctattctgtt

SEQ ID NO: 4088 - DNA, 22 bp, Artificial sequence
  SiRNA target sequence
ttataaaaatgctattctgttg

SEQ ID NO: 4089 - DNA, 22 bp, Artificial sequence
  SiRNA target sequence
tataaaaatgctattctgttgt

SEQ ID NO: 4090 - DNA, 22 bp, Artificial sequence
  SiRNA target sequence
ataaaaatgctattctgttgta

SEQ ID NO: 4091 - DNA, 22 bp, Artificial sequence
  SiRNA target sequence
taaaaatgctattctgttgtac

SEQ ID NO: 4092 - DNA, 22 bp, Artificial sequence
  SiRNA target sequence
aaaaatgctattctgttgtaca

SEQ ID NO: 4093 - DNA, 22 bp, Artificial sequence
  SiRNA target sequence
aaaatgctattctgttgtacac

SEQ ID NO: 4094 - DNA, 22 bp, Artificial sequence
  SiRNA target sequence
aaatgctattctgttgtacact

SEQ ID NO: 4095 - DNA, 22 bp, Artificial sequence
  SiRNA target sequence
aatgctattctgttgtacacta

SEQ ID NO: 4096 - DNA, 22 bp, Artificial sequence
  SiRNA target sequence
atgctattctgttgtacactaa

SEQ ID NO: 4097 - DNA, 22 bp, Artificial sequence
  SiRNA target sequence
tgctattctgttgtacactaaa

SEQ ID NO: 4098 - DNA, 22 bp, Artificial sequence
  SiRNA target sequence
gctattctgttgtacactaaat

SEQ ID NO: 4099 - DNA, 22 bp, Artificial sequence
  SiRNA target sequence
ctattctgttgtacactaaatg

SEQ ID NO: 4100 - DNA, 22 bp, Artificial sequence
  SiRNA target sequence
tattctgttgtacactaaatgt

SEQ ID NO: 4101 - DNA, 22 bp, Artificial sequence
  SiRNA target sequence
attctgttgtacactaaatgta

SEQ ID NO: 4102 - DNA, 22 bp, Artificial sequence
  SiRNA target sequence
ttctgttgtacactaaatgtaa

SEQ ID NO: 4103 - DNA, 22 bp, Artificial sequence
  SiRNA target sequence
tctgttgtacactaaatgtaaa

SEQ ID NO: 4104 - DNA, 22 bp, Artificial sequence
  SiRNA target sequence
ctgttgtacactaaatgtaaat

SEQ ID NO: 4105 - DNA, 22 bp, Artificial sequence
  SiRNA target sequence
tgttgtacactaaatgtaaata

SEQ ID NO: 4106 - DNA, 22 bp, Artificial sequence
  SiRNA target sequence
gttgtacactaaatgtaaatat

SEQ ID NO: 4107 - DNA, 22 bp, Artificial sequence
  SiRNA target sequence
ttgtacactaaatgtaaatata

SEQ ID NO: 4108 - DNA, 22 bp, Artificial sequence
  SiRNA target sequence
tgtacactaaatgtaaatatat

SEQ ID NO: 4109 - DNA, 22 bp, Artificial sequence
  SiRNA target sequence
gtacactaaatgtaaatatatg

SEQ ID NO: 4110 - DNA, 22 bp, Artificial sequence
  SiRNA target sequence
tacactaaatgtaaatatatga

SEQ ID NO: 4111 - DNA, 22 bp, Artificial sequence
  SiRNA target sequence
acactaaatgtaaatatatgaa

SEQ ID NO: 4112 - DNA, 22 bp, Artificial sequence
  SiRNA target sequence
cactaaatgtaaatatatgaaa

SEQ ID NO: 4113 - DNA, 22 bp, Artificial sequence
  SiRNA target sequence
actaaatgtaaatatatgaaaa

SEQ ID NO: 4114 - DNA, 22 bp, Artificial sequence
  SiRNA target sequence
ctaaatgtaaatatatgaaaag

SEQ ID NO: 4115 - DNA, 22 bp, Artificial sequence
  SiRNA target sequence
taaatgtaaatatatgaaaagt

SEQ ID NO: 4116 - DNA, 22 bp, Artificial sequence
  SiRNA target sequence
aaatgtaaatatatgaaaagtg

SEQ ID NO: 4117 - DNA, 22 bp, Artificial sequence
  SiRNA target sequence
aatgtaaatatatgaaaagtga

SEQ ID NO: 4118 - DNA, 22 bp, Artificial sequence
  SiRNA target sequence
atgtaaatatatgaaaagtgat

SEQ ID NO: 4119 - DNA, 22 bp, Artificial sequence
  SiRNA target sequence
tgtaaatatatgaaaagtgatg

SEQ ID NO: 4120 - DNA, 22 bp, Artificial sequence
  SiRNA target sequence
gtaaatatatgaaaagtgatgc

SEQ ID NO: 4121 - DNA, 22 bp, Artificial sequence
  SiRNA target sequence
taaatatatgaaaagtgatgct

SEQ ID NO: 4122 - DNA, 22 bp, Artificial sequence
  SiRNA target sequence
aaatatatgaaaagtgatgctg

SEQ ID NO: 4123 - DNA, 22 bp, Artificial sequence
  SiRNA target sequence
aatatatgaaaagtgatgctga

SEQ ID NO: 4124 - DNA, 22 bp, Artificial sequence
  SiRNA target sequence
atatatgaaaagtgatgctgaa

SEQ ID NO: 4125 - DNA, 22 bp, Artificial sequence
  SiRNA target sequence
tatatgaaaagtgatgctgaaa

SEQ ID NO: 4126 - DNA, 22 bp, Artificial sequence
  SiRNA target sequence
atatgaaaagtgatgctgaaat

SEQ ID NO: 4127 - DNA, 22 bp, Artificial sequence
  SiRNA target sequence
tatgaaaagtgatgctgaaatt

SEQ ID NO: 4128 - DNA, 22 bp, Artificial sequence
  SiRNA target sequence
atgaaaagtgatgctgaaattc

SEQ ID NO: 4129 - DNA, 22 bp, Artificial sequence
  SiRNA target sequence
tgaaaagtgatgctgaaattct

SEQ ID NO: 4130 - DNA, 22 bp, Artificial sequence
  SiRNA target sequence
gaaaagtgatgctgaaattctt

SEQ ID NO: 4131 - DNA, 22 bp, Artificial sequence
  SiRNA target sequence
aaaagtgatgctgaaattctta

SEQ ID NO: 4132 - DNA, 22 bp, Artificial sequence
  SiRNA target sequence
aaagtgatgctgaaattcttac

SEQ ID NO: 4133 - DNA, 22 bp, Artificial sequence
  SiRNA target sequence
aagtgatgctgaaattcttact

SEQ ID NO: 4134 - DNA, 22 bp, Artificial sequence
  SiRNA target sequence
agtgatgctgaaattcttacta

SEQ ID NO: 4135 - DNA, 22 bp, Artificial sequence
  SiRNA target sequence
gtgatgctgaaattcttactaa

SEQ ID NO: 4136 - DNA, 22 bp, Artificial sequence
  SiRNA target sequence
tgatgctgaaattcttactaaa

SEQ ID NO: 4137 - DNA, 22 bp, Artificial sequence
  SiRNA target sequence
gatgctgaaattcttactaaaa

SEQ ID NO: 4138 - DNA, 22 bp, Artificial sequence
  SiRNA target sequence
atgctgaaattcttactaaaat

SEQ ID NO: 4139 - DNA, 22 bp, Artificial sequence
  SiRNA target sequence
tgctgaaattcttactaaaatt

SEQ ID NO: 4140 - DNA, 22 bp, Artificial sequence
  SiRNA target sequence
gctgaaattcttactaaaatta

SEQ ID NO: 4141 - DNA, 22 bp, Artificial sequence
  SiRNA target sequence
ctgaaattcttactaaaattag

SEQ ID NO: 4142 - DNA, 22 bp, Artificial sequence
  SiRNA target sequence
tgaaattcttactaaaattagt

SEQ ID NO: 4143 - DNA, 22 bp, Artificial sequence
  SiRNA target sequence
gaaattcttactaaaattagtc

SEQ ID NO: 4144 - DNA, 22 bp, Artificial sequence
  SiRNA target sequence
aaattcttactaaaattagtct

SEQ ID NO: 4145 - DNA, 22 bp, Artificial sequence
  SiRNA target sequence
aattcttactaaaattagtctc

SEQ ID NO: 4146 - DNA, 22 bp, Artificial sequence
  SiRNA target sequence
attcttactaaaattagtctct

SEQ ID NO: 4147 - DNA, 22 bp, Artificial sequence
  SiRNA target sequence
ttcttactaaaattagtctctg

SEQ ID NO: 4148 - DNA, 22 bp, Artificial sequence
  SiRNA target sequence
tcttactaaaattagtctctgt

SEQ ID NO: 4149 - DNA, 22 bp, Artificial sequence
  SiRNA target sequence
cttactaaaattagtctctgta

SEQ ID NO: 4150 - DNA, 22 bp, Artificial sequence
  SiRNA target sequence
ttactaaaattagtctctgtaa

SEQ ID NO: 4151 - DNA, 22 bp, Artificial sequence
  SiRNA target sequence
tactaaaattagtctctgtaat

SEQ ID NO: 4152 - DNA, 22 bp, Artificial sequence
  SiRNA target sequence
actaaaattagtctctgtaatt

SEQ ID NO: 4153 - DNA, 22 bp, Artificial sequence
  SiRNA target sequence
ctaaaattagtctctgtaatta

SEQ ID NO: 4154 - DNA, 22 bp, Artificial sequence
  SiRNA target sequence
taaaattagtctctgtaattat

SEQ ID NO: 4155 - DNA, 22 bp, Artificial sequence
  SiRNA target sequence
aaaattagtctctgtaattatt

SEQ ID NO: 4156 - DNA, 22 bp, Artificial sequence
  SiRNA target sequence
aaattagtctctgtaattattt

SEQ ID NO: 4157 - DNA, 22 bp, Artificial sequence
  SiRNA target sequence
aattagtctctgtaattatttc

SEQ ID NO: 4158 - DNA, 22 bp, Artificial sequence
  SiRNA target sequence
attagtctctgtaattatttct

SEQ ID NO: 4159 - DNA, 22 bp, Artificial sequence
  SiRNA target sequence
ttagtctctgtaattatttctt

SEQ ID NO: 4160 - DNA, 22 bp, Artificial sequence
  SiRNA target sequence
tagtctctgtaattatttctta

SEQ ID NO: 4161 - DNA, 22 bp, Artificial sequence
  SiRNA target sequence
agtctctgtaattatttcttaa

SEQ ID NO: 4162 - DNA, 22 bp, Artificial sequence
  SiRNA target sequence
gtctctgtaattatttcttaaa

SEQ ID NO: 4163 - DNA, 22 bp, Artificial sequence
  SiRNA target sequence
tctctgtaattatttcttaaaa

SEQ ID NO: 4164 - DNA, 22 bp, Artificial sequence
  SiRNA target sequence
ctctgtaattatttcttaaaaa

SEQ ID NO: 4165 - DNA, 22 bp, Artificial sequence
  SiRNA target sequence
tctgtaattatttcttaaaaaa

SEQ ID NO: 4166 - DNA, 22 bp, Artificial sequence
  SiRNA target sequence
ctgtaattatttcttaaaaaat

SEQ ID NO: 4167 - DNA, 22 bp, Artificial sequence
  SiRNA target sequence
tgtaattatttcttaaaaaatt

SEQ ID NO: 4168 - DNA, 22 bp, Artificial sequence
  SiRNA target sequence
gtaattatttcttaaaaaatta

SEQ ID NO: 4169 - DNA, 22 bp, Artificial sequence
  SiRNA target sequence
taattatttcttaaaaaattat

SEQ ID NO: 4170 - DNA, 22 bp, Artificial sequence
  SiRNA target sequence
aattatttcttaaaaaattatc

SEQ ID NO: 4171 - DNA, 22 bp, Artificial sequence
  SiRNA target sequence
attatttcttaaaaaattatca

SEQ ID NO: 4172 - DNA, 22 bp, Artificial sequence
  SiRNA target sequence
ttatttcttaaaaaattatcaa

SEQ ID NO: 4173 - DNA, 22 bp, Artificial sequence
  SiRNA target sequence
tatttcttaaaaaattatcaag

SEQ ID NO: 4174 - DNA, 22 bp, Artificial sequence
  SiRNA target sequence
atttcttaaaaaattatcaaga

SEQ ID NO: 4175 - DNA, 22 bp, Artificial sequence
  SiRNA target sequence
tttcttaaaaaattatcaagaa

SEQ ID NO: 4176 - DNA, 22 bp, Artificial sequence
  SiRNA target sequence
ttcttaaaaaattatcaagaag

SEQ ID NO: 4177 - DNA, 22 bp, Artificial sequence
  SiRNA target sequence
tcttaaaaaattatcaagaagt

SEQ ID NO: 4178 - DNA, 22 bp, Artificial sequence
  SiRNA target sequence
cttaaaaaattatcaagaagtt

SEQ ID NO: 4179 - DNA, 22 bp, Artificial sequence
  SiRNA target sequence
ttaaaaaattatcaagaagtta

SEQ ID NO: 4180 - DNA, 22 bp, Artificial sequence
  SiRNA target sequence
taaaaaattatcaagaagttat

SEQ ID NO: 4181 - DNA, 22 bp, Artificial sequence
  SiRNA target sequence
aaaaaattatcaagaagttata

SEQ ID NO: 4182 - DNA, 22 bp, Artificial sequence
  SiRNA target sequence
aaaaattatcaagaagttataa

SEQ ID NO: 4183 - DNA, 22 bp, Artificial sequence
  SiRNA target sequence
aaaattatcaagaagttataaa

SEQ ID NO: 4184 - DNA, 22 bp, Artificial sequence
  SiRNA target sequence
aaattatcaagaagttataaat

SEQ ID NO: 4185 - DNA, 22 bp, Artificial sequence
  SiRNA target sequence
aattatcaagaagttataaata

SEQ ID NO: 4186 - DNA, 22 bp, Artificial sequence
  SiRNA target sequence
attatcaagaagttataaataa

SEQ ID NO: 4187 - DNA, 22 bp, Artificial sequence
  SiRNA target sequence
ttatcaagaagttataaataat

SEQ ID NO: 4188 - DNA, 22 bp, Artificial sequence
  SiRNA target sequence
tatcaagaagttataaataatt

SEQ ID NO: 4189 - DNA, 22 bp, Artificial sequence
  SiRNA target sequence
atcaagaagttataaataattc

SEQ ID NO: 4190 - DNA, 22 bp, Artificial sequence
  SiRNA target sequence
tcaagaagttataaataattct

SEQ ID NO: 4191 - DNA, 22 bp, Artificial sequence
  SiRNA target sequence
caagaagttataaataattctt

SEQ ID NO: 4192 - DNA, 22 bp, Artificial sequence
  SiRNA target sequence
aagaagttataaataattcttt

SEQ ID NO: 4193 - DNA, 22 bp, Artificial sequence
  SiRNA target sequence
agaagttataaataattcttta

SEQ ID NO: 4194 - DNA, 22 bp, Artificial sequence
  SiRNA target sequence
gaagttataaataattctttat

SEQ ID NO: 4195 - DNA, 22 bp, Artificial sequence
  SiRNA target sequence
aagttataaataattctttatt

SEQ ID NO: 4196 - DNA, 22 bp, Artificial sequence
  SiRNA target sequence
agttataaataattctttattt

SEQ ID NO: 4197 - DNA, 22 bp, Artificial sequence
  SiRNA target sequence
gttataaataattctttattta

SEQ ID NO: 4198 - DNA, 22 bp, Artificial sequence
  SiRNA target sequence
ttataaataattctttatttaa

SEQ ID NO: 4199 - DNA, 22 bp, Artificial sequence
  SiRNA target sequence
tataaataattctttatttaag

SEQ ID NO: 4200 - DNA, 22 bp, Artificial sequence
  SiRNA target sequence
ataaataattctttatttaaga

SEQ ID NO: 4201 - DNA, 22 bp, Artificial sequence
  SiRNA target sequence
taaataattctttatttaagac

SEQ ID NO: 4202 - DNA, 22 bp, Artificial sequence
  SiRNA target sequence
aaataattctttatttaagaca

SEQ ID NO: 4203 - DNA, 22 bp, Artificial sequence
  SiRNA target sequence
aataattctttatttaagacaa

SEQ ID NO: 4204 - DNA, 22 bp, Artificial sequence
  SiRNA target sequence
ataattctttatttaagacaaa

SEQ ID NO: 4205 - DNA, 22 bp, Artificial sequence
  SiRNA target sequence
taattctttatttaagacaaat

SEQ ID NO: 4206 - DNA, 22 bp, Artificial sequence
  SiRNA target sequence
aattctttatttaagacaaata

SEQ ID NO: 4207 - DNA, 22 bp, Artificial sequence
  SiRNA target sequence
attctttatttaagacaaataa

SEQ ID NO: 4208 - DNA, 22 bp, Artificial sequence
  SiRNA target sequence
ttctttatttaagacaaataat

SEQ ID NO: 4209 - DNA, 22 bp, Artificial sequence
  SiRNA target sequence
tctttatttaagacaaataata

SEQ ID NO: 4210 - DNA, 22 bp, Artificial sequence
  SiRNA target sequence
ctttatttaagacaaataataa

SEQ ID NO: 4211 - DNA, 22 bp, Artificial sequence
  SiRNA target sequence
tttatttaagacaaataataaa

SEQ ID NO: 4212 - DNA, 22 bp, Artificial sequence
  SiRNA target sequence
ttatttaagacaaataataaag

SEQ ID NO: 4213 - DNA, 22 bp, Artificial sequence
  SiRNA target sequence
tatttaagacaaataataaaga

SEQ ID NO: 4214 - DNA, 22 bp, Artificial sequence
  SiRNA target sequence
atttaagacaaataataaagat

SEQ ID NO: 4215 - DNA, 22 bp, Artificial sequence
  SiRNA target sequence
tttaagacaaataataaagatc

SEQ ID NO: 4216 - DNA, 22 bp, Artificial sequence
  SiRNA target sequence
ttaagacaaataataaagatct

SEQ ID NO: 4217 - DNA, 22 bp, Artificial sequence
  SiRNA target sequence
taagacaaataataaagatcta

SEQ ID NO: 4218 - DNA, 22 bp, Artificial sequence
  SiRNA target sequence
aagacaaataataaagatctaa

SEQ ID NO: 4219 - DNA, 22 bp, Artificial sequence
  SiRNA target sequence
agacaaataataaagatctaat

SEQ ID NO: 4220 - DNA, 22 bp, Artificial sequence
  SiRNA target sequence
gacaaataataaagatctaata

SEQ ID NO: 4221 - DNA, 22 bp, Artificial sequence
  SiRNA target sequence
acaaataataaagatctaataa

SEQ ID NO: 4222 - DNA, 22 bp, Artificial sequence
  SiRNA target sequence
caaataataaagatctaataaa

SEQ ID NO: 4223 - DNA, 22 bp, Artificial sequence
  SiRNA target sequence
aaataataaagatctaataaaa

SEQ ID NO: 4224 - DNA, 22 bp, Artificial sequence
  SiRNA target sequence
aataataaagatctaataaaaa

SEQ ID NO: 4225 - DNA, 22 bp, Artificial sequence
  SiRNA target sequence
ataataaagatctaataaaaat

SEQ ID NO: 4226 - DNA, 22 bp, Artificial sequence
  SiRNA target sequence
taataaagatctaataaaaata

SEQ ID NO: 4227 - DNA, 22 bp, Artificial sequence
  SiRNA target sequence
aataaagatctaataaaaataa

SEQ ID NO: 4228 - DNA, 22 bp, Artificial sequence
  SiRNA target sequence
ataaagatctaataaaaataag

SEQ ID NO: 4229 - DNA, 22 bp, Artificial sequence
  SiRNA target sequence
taaagatctaataaaaataaga

SEQ ID NO: 4230 - DNA, 22 bp, Artificial sequence
  SiRNA target sequence
aaagatctaataaaaataagat

SEQ ID NO: 4231 - DNA, 22 bp, Artificial sequence
  SiRNA target sequence
aagatctaataaaaataagatc

SEQ ID NO: 4232 - DNA, 22 bp, Artificial sequence
  SiRNA target sequence
agatctaataaaaataagatct

SEQ ID NO: 4233 - DNA, 22 bp, Artificial sequence
  SiRNA target sequence
gatctaataaaaataagatctg

SEQ ID NO: 4234 - DNA, 22 bp, Artificial sequence
  SiRNA target sequence
atctaataaaaataagatctga

SEQ ID NO: 4235 - DNA, 22 bp, Artificial sequence
  SiRNA target sequence
tctaataaaaataagatctgaa

SEQ ID NO: 4236 - DNA, 22 bp, Artificial sequence
  SiRNA target sequence
ctaataaaaataagatctgaat

SEQ ID NO: 4237 - DNA, 22 bp, Artificial sequence
  SiRNA target sequence
taataaaaataagatctgaatg

SEQ ID NO: 4238 - DNA, 22 bp, Artificial sequence
  SiRNA target sequence
aataaaaataagatctgaatgt

SEQ ID NO: 4239 - DNA, 22 bp, Artificial sequence
  SiRNA target sequence
ataaaaataagatctgaatgtt

SEQ ID NO: 4240 - DNA, 22 bp, Artificial sequence
  SiRNA target sequence
taaaaataagatctgaatgtta

SEQ ID NO: 4241 - DNA, 22 bp, Artificial sequence
  SiRNA target sequence
aaaaataagatctgaatgttac

SEQ ID NO: 4242 - DNA, 22 bp, Artificial sequence
  SiRNA target sequence
aaaataagatctgaatgttaca

SEQ ID NO: 4243 - DNA, 22 bp, Artificial sequence
  SiRNA target sequence
aaataagatctgaatgttacaa

SEQ ID NO: 4244 - DNA, 22 bp, Artificial sequence
  SiRNA target sequence
aataagatctgaatgttacaag

SEQ ID NO: 4245 - DNA, 22 bp, Artificial sequence
  SiRNA target sequence
ataagatctgaatgttacaagc

SEQ ID NO: 4246 - DNA, 22 bp, Artificial sequence
  SiRNA target sequence
taagatctgaatgttacaagca

SEQ ID NO: 4247 - DNA, 22 bp, Artificial sequence
  SiRNA target sequence
aagatctgaatgttacaagcag

SEQ ID NO: 4248 - DNA, 22 bp, Artificial sequence
  SiRNA target sequence
agatctgaatgttacaagcaga

SEQ ID NO: 4249 - DNA, 22 bp, Artificial sequence
  SiRNA target sequence
gatctgaatgttacaagcagat

SEQ ID NO: 4250 - DNA, 22 bp, Artificial sequence
  SiRNA target sequence
atctgaatgttacaagcagatg

SEQ ID NO: 4251 - DNA, 22 bp, Artificial sequence
  SiRNA target sequence
tctgaatgttacaagcagatgg

SEQ ID NO: 4252 - DNA, 22 bp, Artificial sequence
  SiRNA target sequence
ctgaatgttacaagcagatggg

SEQ ID NO: 4253 - DNA, 22 bp, Artificial sequence
  SiRNA target sequence
tgaatgttacaagcagatggga

SEQ ID NO: 4254 - DNA, 22 bp, Artificial sequence
  SiRNA target sequence
gaatgttacaagcagatgggaa

SEQ ID NO: 4255 - DNA, 22 bp, Artificial sequence
  SiRNA target sequence
aatgttacaagcagatgggaaa

SEQ ID NO: 4256 - DNA, 22 bp, Artificial sequence
  SiRNA target sequence
atgttacaagcagatgggaaat

SEQ ID NO: 4257 - DNA, 22 bp, Artificial sequence
  SiRNA target sequence
tgttacaagcagatgggaaata

SEQ ID NO: 4258 - DNA, 22 bp, Artificial sequence
  SiRNA target sequence
gttacaagcagatgggaaataa

SEQ ID NO: 4259 - DNA, 22 bp, Artificial sequence
  SiRNA target sequence
ttacaagcagatgggaaataaa

SEQ ID NO: 4260 - DNA, 22 bp, Artificial sequence
  SiRNA target sequence
tacaagcagatgggaaataaaa

SEQ ID NO: 4261 - DNA, 22 bp, Artificial sequence
  SiRNA target sequence
acaagcagatgggaaataaaaa

SEQ ID NO: 4262 - DNA, 22 bp, Artificial sequence
  SiRNA target sequence
caagcagatgggaaataaaaaa

SEQ ID NO: 4263 - DNA, 22 bp, Artificial sequence
  SiRNA target sequence
aagcagatgggaaataaaaaaa

SEQ ID NO: 4264 - DNA, 22 bp, Artificial sequence
  SiRNA target sequence
agcagatgggaaataaaaaaaa

SEQ ID NO: 4265 - DNA, 22 bp, Artificial sequence
  SiRNA target sequence
gcagatgggaaataaaaaaaaa

SEQ ID NO: 4266 - DNA, 22 bp, Artificial sequence
  SiRNA target sequence
cagatgggaaataaaaaaaaat

SEQ ID NO: 4267 - DNA, 22 bp, Artificial sequence
  SiRNA target sequence
agatgggaaataaaaaaaaatt

SEQ ID NO: 4268 - DNA, 22 bp, Artificial sequence
  SiRNA target sequence
gatgggaaataaaaaaaaattt

SEQ ID NO: 4269 - DNA, 22 bp, Artificial sequence
  SiRNA target sequence
atgggaaataaaaaaaaatttc

SEQ ID NO: 4270 - DNA, 22 bp, Artificial sequence
  SiRNA target sequence
tgggaaataaaaaaaaatttct

SEQ ID NO: 4271 - DNA, 22 bp, Artificial sequence
  SiRNA target sequence
gggaaataaaaaaaaatttctt

SEQ ID NO: 4272 - DNA, 22 bp, Artificial sequence
  SiRNA target sequence
ggaaataaaaaaaaatttctta

SEQ ID NO: 4273 - DNA, 22 bp, Artificial sequence
  SiRNA target sequence
gaaataaaaaaaaatttcttaa

SEQ ID NO: 4274 - DNA, 22 bp, Artificial sequence
  SiRNA target sequence
aaataaaaaaaaatttcttaag

SEQ ID NO: 4275 - DNA, 22 bp, Artificial sequence
  SiRNA target sequence
aataaaaaaaaatttcttaagg

SEQ ID NO: 4276 - DNA, 22 bp, Artificial sequence
  SiRNA target sequence
ataaaaaaaaatttcttaagga

SEQ ID NO: 4277 - DNA, 22 bp, Artificial sequence
  SiRNA target sequence
taaaaaaaaatttcttaaggat

SEQ ID NO: 4278 - DNA, 22 bp, Artificial sequence
  SiRNA target sequence
aaaaaaaaatttcttaaggatt

SEQ ID NO: 4279 - DNA, 22 bp, Artificial sequence
  SiRNA target sequence
aaaaaaaatttcttaaggattt

SEQ ID NO: 4280 - DNA, 22 bp, Artificial sequence
  SiRNA target sequence
aaaaaaatttcttaaggattta

SEQ ID NO: 4281 - DNA, 22 bp, Artificial sequence
  SiRNA target sequence
aaaaaatttcttaaggatttag

SEQ ID NO: 4282 - DNA, 22 bp, Artificial sequence
  SiRNA target sequence
aaaaatttcttaaggatttagc

SEQ ID NO: 4283 - DNA, 22 bp, Artificial sequence
  SiRNA target sequence
aaaatttcttaaggatttagca

SEQ ID NO: 4284 - DNA, 22 bp, Artificial sequence
  SiRNA target sequence
aaatttcttaaggatttagcac

SEQ ID NO: 4285 - DNA, 22 bp, Artificial sequence
  SiRNA target sequence
aatttcttaaggatttagcact

SEQ ID NO: 4286 - DNA, 22 bp, Artificial sequence
  SiRNA target sequence
atttcttaaggatttagcactt

SEQ ID NO: 4287 - DNA, 22 bp, Artificial sequence
  SiRNA target sequence
tttcttaaggatttagcacttt

SEQ ID NO: 4288 - DNA, 22 bp, Artificial sequence
  SiRNA target sequence
ttcttaaggatttagcacttta

SEQ ID NO: 4289 - DNA, 22 bp, Artificial sequence
  SiRNA target sequence
tcttaaggatttagcactttat

SEQ ID NO: 4290 - DNA, 22 bp, Artificial sequence
  SiRNA target sequence
cttaaggatttagcactttatg

SEQ ID NO: 4291 - DNA, 22 bp, Artificial sequence
  SiRNA target sequence
ttaaggatttagcactttatga

SEQ ID NO: 4292 - DNA, 22 bp, Artificial sequence
  SiRNA target sequence
taaggatttagcactttatgaa

SEQ ID NO: 4293 - DNA, 22 bp, Artificial sequence
  SiRNA target sequence
aaggatttagcactttatgaaa

SEQ ID NO: 4294 - DNA, 22 bp, Artificial sequence
  SiRNA target sequence
aggatttagcactttatgaaac

SEQ ID NO: 4295 - DNA, 22 bp, Artificial sequence
  SiRNA target sequence
ggatttagcactttatgaaaca

SEQ ID NO: 4296 - DNA, 22 bp, Artificial sequence
  SiRNA target sequence
gatttagcactttatgaaacat

SEQ ID NO: 4297 - DNA, 22 bp, Artificial sequence
  SiRNA target sequence
atttagcactttatgaaacatt

SEQ ID NO: 4298 - DNA, 22 bp, Artificial sequence
  SiRNA target sequence
tttagcactttatgaaacattt

SEQ ID NO: 4299 - DNA, 22 bp, Artificial sequence
  SiRNA target sequence
ttagcactttatgaaacatttg

SEQ ID NO: 4300 - DNA, 22 bp, Artificial sequence
  SiRNA target sequence
tagcactttatgaaacatttgc

SEQ ID NO: 4301 - DNA, 22 bp, Artificial sequence
  SiRNA target sequence
agcactttatgaaacatttgct

SEQ ID NO: 4302 - DNA, 22 bp, Artificial sequence
  SiRNA target sequence
gcactttatgaaacatttgcta

SEQ ID NO: 4303 - DNA, 22 bp, Artificial sequence
  SiRNA target sequence
cactttatgaaacatttgctaa

SEQ ID NO: 4304 - DNA, 22 bp, Artificial sequence
  SiRNA target sequence
actttatgaaacatttgctaat

SEQ ID NO: 4305 - DNA, 22 bp, Artificial sequence
  SiRNA target sequence
ctttatgaaacatttgctaata

SEQ ID NO: 4306 - DNA, 22 bp, Artificial sequence
  SiRNA target sequence
tttatgaaacatttgctaataa

SEQ ID NO: 4307 - DNA, 22 bp, Artificial sequence
  SiRNA target sequence
ttatgaaacatttgctaataat

SEQ ID NO: 4308 - DNA, 22 bp, Artificial sequence
  SiRNA target sequence
tatgaaacatttgctaataata

SEQ ID NO: 4309 - DNA, 22 bp, Artificial sequence
  SiRNA target sequence
atgaaacatttgctaataataa

SEQ ID NO: 4310 - DNA, 22 bp, Artificial sequence
  SiRNA target sequence
tgaaacatttgctaataataaa

SEQ ID NO: 4311 - DNA, 22 bp, Artificial sequence
  SiRNA target sequence
gaaacatttgctaataataaag

SEQ ID NO: 4312 - DNA, 22 bp, Artificial sequence
  SiRNA target sequence
aaacatttgctaataataaaga

SEQ ID NO: 4313 - DNA, 22 bp, Artificial sequence
  SiRNA target sequence
aacatttgctaataataaagaa

SEQ ID NO: 4314 - DNA, 22 bp, Artificial sequence
  SiRNA target sequence
acatttgctaataataaagaag

SEQ ID NO: 4315 - DNA, 22 bp, Artificial sequence
  SiRNA target sequence
catttgctaataataaagaagt

SEQ ID NO: 4316 - DNA, 22 bp, Artificial sequence
  SiRNA target sequence
atttgctaataataaagaagtc

SEQ ID NO: 4317 - DNA, 22 bp, Artificial sequence
  SiRNA target sequence
tttgctaataataaagaagtcc

SEQ ID NO: 4318 - DNA, 22 bp, Artificial sequence
  SiRNA target sequence
ttgctaataataaagaagtcca

SEQ ID NO: 4319 - DNA, 22 bp, Artificial sequence
  SiRNA target sequence
tgctaataataaagaagtccaa

SEQ ID NO: 4320 - DNA, 22 bp, Artificial sequence
  SiRNA target sequence
gctaataataaagaagtccaag

SEQ ID NO: 4321 - DNA, 22 bp, Artificial sequence
  SiRNA target sequence
ctaataataaagaagtccaaga

SEQ ID NO: 4322 - DNA, 22 bp, Artificial sequence
  SiRNA target sequence
taataataaagaagtccaagat

SEQ ID NO: 4323 - DNA, 22 bp, Artificial sequence
  SiRNA target sequence
aataataaagaagtccaagatg

SEQ ID NO: 4324 - DNA, 22 bp, Artificial sequence
  SiRNA target sequence
ataataaagaagtccaagatga

SEQ ID NO: 4325 - DNA, 22 bp, Artificial sequence
  SiRNA target sequence
taataaagaagtccaagatgaa

SEQ ID NO: 4326 - DNA, 22 bp, Artificial sequence
  SiRNA target sequence
aataaagaagtccaagatgaaa

SEQ ID NO: 4327 - DNA, 22 bp, Artificial sequence
  SiRNA target sequence
ataaagaagtccaagatgaaat

SEQ ID NO: 4328 - DNA, 22 bp, Artificial sequence
  SiRNA target sequence
taaagaagtccaagatgaaatt

SEQ ID NO: 4329 - DNA, 22 bp, Artificial sequence
  SiRNA target sequence
aaagaagtccaagatgaaatta

SEQ ID NO: 4330 - DNA, 22 bp, Artificial sequence
  SiRNA target sequence
aagaagtccaagatgaaattat

SEQ ID NO: 4331 - DNA, 22 bp, Artificial sequence
  SiRNA target sequence
agaagtccaagatgaaattatg

SEQ ID NO: 4332 - DNA, 22 bp, Artificial sequence
  SiRNA target sequence
gaagtccaagatgaaattatgc

SEQ ID NO: 4333 - DNA, 22 bp, Artificial sequence
  SiRNA target sequence
aagtccaagatgaaattatgca

SEQ ID NO: 4334 - DNA, 22 bp, Artificial sequence
  SiRNA target sequence
agtccaagatgaaattatgcag

SEQ ID NO: 4335 - DNA, 22 bp, Artificial sequence
  SiRNA target sequence
gtccaagatgaaattatgcaga

SEQ ID NO: 4336 - DNA, 22 bp, Artificial sequence
  SiRNA target sequence
tccaagatgaaattatgcagac

SEQ ID NO: 4337 - DNA, 22 bp, Artificial sequence
  SiRNA target sequence
ccaagatgaaattatgcagact

SEQ ID NO: 4338 - DNA, 22 bp, Artificial sequence
  SiRNA target sequence
caagatgaaattatgcagactg

SEQ ID NO: 4339 - DNA, 22 bp, Artificial sequence
  SiRNA target sequence
aagatgaaattatgcagactgt

SEQ ID NO: 4340 - DNA, 22 bp, Artificial sequence
  SiRNA target sequence
agatgaaattatgcagactgtt

SEQ ID NO: 4341 - DNA, 22 bp, Artificial sequence
  SiRNA target sequence
gatgaaattatgcagactgtta

SEQ ID NO: 4342 - DNA, 22 bp, Artificial sequence
  SiRNA target sequence
atgaaattatgcagactgttaa

SEQ ID NO: 4343 - DNA, 22 bp, Artificial sequence
  SiRNA target sequence
tgaaattatgcagactgttaaa

SEQ ID NO: 4344 - DNA, 22 bp, Artificial sequence
  SiRNA target sequence
gaaattatgcagactgttaaag

SEQ ID NO: 4345 - DNA, 22 bp, Artificial sequence
  SiRNA target sequence
aaattatgcagactgttaaaga

SEQ ID NO: 4346 - DNA, 22 bp, Artificial sequence
  SiRNA target sequence
aattatgcagactgttaaagaa

SEQ ID NO: 4347 - DNA, 22 bp, Artificial sequence
  SiRNA target sequence
attatgcagactgttaaagaaa

SEQ ID NO: 4348 - DNA, 22 bp, Artificial sequence
  SiRNA target sequence
ttatgcagactgttaaagaaat

SEQ ID NO: 4349 - DNA, 22 bp, Artificial sequence
  SiRNA target sequence
tatgcagactgttaaagaaatt

SEQ ID NO: 4350 - DNA, 22 bp, Artificial sequence
  SiRNA target sequence
atgcagactgttaaagaaattt

SEQ ID NO: 4351 - DNA, 22 bp, Artificial sequence
  SiRNA target sequence
tgcagactgttaaagaaatttg

SEQ ID NO: 4352 - DNA, 22 bp, Artificial sequence
  SiRNA target sequence
gcagactgttaaagaaatttgt

SEQ ID NO: 4353 - DNA, 22 bp, Artificial sequence
  SiRNA target sequence
cagactgttaaagaaatttgtg

SEQ ID NO: 4354 - DNA, 22 bp, Artificial sequence
  SiRNA target sequence
agactgttaaagaaatttgtga

SEQ ID NO: 4355 - DNA, 22 bp, Artificial sequence
  SiRNA target sequence
gactgttaaagaaatttgtgaa

SEQ ID NO: 4356 - DNA, 22 bp, Artificial sequence
  SiRNA target sequence
actgttaaagaaatttgtgaag

SEQ ID NO: 4357 - DNA, 22 bp, Artificial sequence
  SiRNA target sequence
ctgttaaagaaatttgtgaaga

SEQ ID NO: 4358 - DNA, 22 bp, Artificial sequence
  SiRNA target sequence
tgttaaagaaatttgtgaagaa

SEQ ID NO: 4359 - DNA, 22 bp, Artificial sequence
  SiRNA target sequence
gttaaagaaatttgtgaagaag

SEQ ID NO: 4360 - DNA, 22 bp, Artificial sequence
  SiRNA target sequence
ttaaagaaatttgtgaagaaga

SEQ ID NO: 4361 - DNA, 22 bp, Artificial sequence
  SiRNA target sequence
taaagaaatttgtgaagaagaa

SEQ ID NO: 4362 - DNA, 22 bp, Artificial sequence
  SiRNA target sequence
aaagaaatttgtgaagaagaag

SEQ ID NO: 4363 - DNA, 22 bp, Artificial sequence
  SiRNA target sequence
aagaaatttgtgaagaagaagt

SEQ ID NO: 4364 - DNA, 22 bp, Artificial sequence
  SiRNA target sequence
agaaatttgtgaagaagaagtg

SEQ ID NO: 4365 - DNA, 22 bp, Artificial sequence
  SiRNA target sequence
gaaatttgtgaagaagaagtga

SEQ ID NO: 4366 - DNA, 22 bp, Artificial sequence
  SiRNA target sequence
aaatttgtgaagaagaagtgaa

SEQ ID NO: 4367 - DNA, 22 bp, Artificial sequence
  SiRNA target sequence
aatttgtgaagaagaagtgaat

SEQ ID NO: 4368 - DNA, 22 bp, Artificial sequence
  SiRNA target sequence
atttgtgaagaagaagtgaatg

SEQ ID NO: 4369 - DNA, 22 bp, Artificial sequence
  SiRNA target sequence
tttgtgaagaagaagtgaatga

SEQ ID NO: 4370 - DNA, 22 bp, Artificial sequence
  SiRNA target sequence
ttgtgaagaagaagtgaatgag

SEQ ID NO: 4371 - DNA, 22 bp, Artificial sequence
  SiRNA target sequence
tgtgaagaagaagtgaatgagt

SEQ ID NO: 4372 - DNA, 22 bp, Artificial sequence
  SiRNA target sequence
gtgaagaagaagtgaatgagtt

SEQ ID NO: 4373 - DNA, 22 bp, Artificial sequence
  SiRNA target sequence
tgaagaagaagtgaatgagttt

SEQ ID NO: 4374 - DNA, 22 bp, Artificial sequence
  SiRNA target sequence
gaagaagaagtgaatgagttta

SEQ ID NO: 4375 - DNA, 22 bp, Artificial sequence
  SiRNA target sequence
aagaagaagtgaatgagtttat

SEQ ID NO: 4376 - DNA, 22 bp, Artificial sequence
  SiRNA target sequence
agaagaagtgaatgagtttatt

SEQ ID NO: 4377 - DNA, 22 bp, Artificial sequence
  SiRNA target sequence
gaagaagtgaatgagtttattg

SEQ ID NO: 4378 - DNA, 22 bp, Artificial sequence
  SiRNA target sequence
aagaagtgaatgagtttattga

SEQ ID NO: 4379 - DNA, 22 bp, Artificial sequence
  SiRNA target sequence
agaagtgaatgagtttattgaa

SEQ ID NO: 4380 - DNA, 22 bp, Artificial sequence
  SiRNA target sequence
gaagtgaatgagtttattgaac

SEQ ID NO: 4381 - DNA, 22 bp, Artificial sequence
  SiRNA target sequence
aagtgaatgagtttattgaaca

SEQ ID NO: 4382 - DNA, 22 bp, Artificial sequence
  SiRNA target sequence
agtgaatgagtttattgaacaa

SEQ ID NO: 4383 - DNA, 22 bp, Artificial sequence
  SiRNA target sequence
gtgaatgagtttattgaacaag

SEQ ID NO: 4384 - DNA, 22 bp, Artificial sequence
  SiRNA target sequence
tgaatgagtttattgaacaaga

SEQ ID NO: 4385 - DNA, 22 bp, Artificial sequence
  SiRNA target sequence
gaatgagtttattgaacaagaa

SEQ ID NO: 4386 - DNA, 22 bp, Artificial sequence
  SiRNA target sequence
aatgagtttattgaacaagaag

SEQ ID NO: 4387 - DNA, 22 bp, Artificial sequence
  SiRNA target sequence
atgagtttattgaacaagaagg

SEQ ID NO: 4388 - DNA, 22 bp, Artificial sequence
  SiRNA target sequence
tgagtttattgaacaagaaggt

SEQ ID NO: 4389 - DNA, 22 bp, Artificial sequence
  SiRNA target sequence
gagtttattgaacaagaaggtt

SEQ ID NO: 4390 - DNA, 22 bp, Artificial sequence
  SiRNA target sequence
agtttattgaacaagaaggttt

SEQ ID NO: 4391 - DNA, 22 bp, Artificial sequence
  SiRNA target sequence
gtttattgaacaagaaggttta

SEQ ID NO: 4392 - DNA, 22 bp, Artificial sequence
  SiRNA target sequence
tttattgaacaagaaggtttaa

SEQ ID NO: 4393 - DNA, 22 bp, Artificial sequence
  SiRNA target sequence
ttattgaacaagaaggtttaaa

SEQ ID NO: 4394 - DNA, 22 bp, Artificial sequence
  SiRNA target sequence
tattgaacaagaaggtttaaaa

SEQ ID NO: 4395 - DNA, 22 bp, Artificial sequence
  SiRNA target sequence
attgaacaagaaggtttaaaaa

SEQ ID NO: 4396 - DNA, 22 bp, Artificial sequence
  SiRNA target sequence
ttgaacaagaaggtttaaaaat

SEQ ID NO: 4397 - DNA, 22 bp, Artificial sequence
  SiRNA target sequence
tgaacaagaaggtttaaaaatt

SEQ ID NO: 4398 - DNA, 22 bp, Artificial sequence
  SiRNA target sequence
gaacaagaaggtttaaaaatta

SEQ ID NO: 4399 - DNA, 22 bp, Artificial sequence
  SiRNA target sequence
aacaagaaggtttaaaaattaa

SEQ ID NO: 4400 - DNA, 22 bp, Artificial sequence
  SiRNA target sequence
acaagaaggtttaaaaattaat

SEQ ID NO: 4401 - DNA, 22 bp, Artificial sequence
  SiRNA target sequence
caagaaggtttaaaaattaata

SEQ ID NO: 4402 - DNA, 22 bp, Artificial sequence
  SiRNA target sequence
aagaaggtttaaaaattaataa

SEQ ID NO: 4403 - DNA, 22 bp, Artificial sequence
  SiRNA target sequence
agaaggtttaaaaattaataaa

SEQ ID NO: 4404 - DNA, 22 bp, Artificial sequence
  SiRNA target sequence
gaaggtttaaaaattaataaag

SEQ ID NO: 4405 - DNA, 22 bp, Artificial sequence
  SiRNA target sequence
aaggtttaaaaattaataaaga

SEQ ID NO: 4406 - DNA, 22 bp, Artificial sequence
  SiRNA target sequence
aggtttaaaaattaataaagaa

SEQ ID NO: 4407 - DNA, 22 bp, Artificial sequence
  SiRNA target sequence
ggtttaaaaattaataaagaag

SEQ ID NO: 4408 - DNA, 22 bp, Artificial sequence
  SiRNA target sequence
gtttaaaaattaataaagaaga

SEQ ID NO: 4409 - DNA, 22 bp, Artificial sequence
  SiRNA target sequence
tttaaaaattaataaagaagat

SEQ ID NO: 4410 - DNA, 22 bp, Artificial sequence
  SiRNA target sequence
ttaaaaattaataaagaagatg

SEQ ID NO: 4411 - DNA, 22 bp, Artificial sequence
  SiRNA target sequence
taaaaattaataaagaagatgt

SEQ ID NO: 4412 - DNA, 22 bp, Artificial sequence
  SiRNA target sequence
aaaaattaataaagaagatgtg

SEQ ID NO: 4413 - DNA, 22 bp, Artificial sequence
  SiRNA target sequence
aaaattaataaagaagatgtgc

SEQ ID NO: 4414 - DNA, 22 bp, Artificial sequence
  SiRNA target sequence
aaattaataaagaagatgtgct

SEQ ID NO: 4415 - DNA, 22 bp, Artificial sequence
  SiRNA target sequence
aattaataaagaagatgtgcta

SEQ ID NO: 4416 - DNA, 22 bp, Artificial sequence
  SiRNA target sequence
attaataaagaagatgtgctaa

SEQ ID NO: 4417 - DNA, 22 bp, Artificial sequence
  SiRNA target sequence
ttaataaagaagatgtgctaag

SEQ ID NO: 4418 - DNA, 22 bp, Artificial sequence
  SiRNA target sequence
taataaagaagatgtgctaaga

SEQ ID NO: 4419 - DNA, 22 bp, Artificial sequence
  SiRNA target sequence
aataaagaagatgtgctaagag

SEQ ID NO: 4420 - DNA, 22 bp, Artificial sequence
  SiRNA target sequence
ataaagaagatgtgctaagagg

SEQ ID NO: 4421 - DNA, 22 bp, Artificial sequence
  SiRNA target sequence
taaagaagatgtgctaagagga

SEQ ID NO: 4422 - DNA, 22 bp, Artificial sequence
  SiRNA target sequence
aaagaagatgtgctaagaggac

SEQ ID NO: 4423 - DNA, 22 bp, Artificial sequence
  SiRNA target sequence
aagaagatgtgctaagaggact

SEQ ID NO: 4424 - DNA, 22 bp, Artificial sequence
  SiRNA target sequence
agaagatgtgctaagaggactt

SEQ ID NO: 4425 - DNA, 22 bp, Artificial sequence
  SiRNA target sequence
gaagatgtgctaagaggacttg

SEQ ID NO: 4426 - DNA, 22 bp, Artificial sequence
  SiRNA target sequence
aagatgtgctaagaggacttgt

SEQ ID NO: 4427 - DNA, 22 bp, Artificial sequence
  SiRNA target sequence
agatgtgctaagaggacttgtt

SEQ ID NO: 4428 - DNA, 22 bp, Artificial sequence
  SiRNA target sequence
gatgtgctaagaggacttgttt

SEQ ID NO: 4429 - DNA, 22 bp, Artificial sequence
  SiRNA target sequence
atgtgctaagaggacttgtttc

SEQ ID NO: 4430 - DNA, 22 bp, Artificial sequence
  SiRNA target sequence
tgtgctaagaggacttgtttca

SEQ ID NO: 4431 - DNA, 22 bp, Artificial sequence
  SiRNA target sequence
gtgctaagaggacttgtttcaa

SEQ ID NO: 4432 - DNA, 22 bp, Artificial sequence
  SiRNA target sequence
tgctaagaggacttgtttcaat

SEQ ID NO: 4433 - DNA, 22 bp, Artificial sequence
  SiRNA target sequence
gctaagaggacttgtttcaata

SEQ ID NO: 4434 - DNA, 22 bp, Artificial sequence
  SiRNA target sequence
ctaagaggacttgtttcaataa

SEQ ID NO: 4435 - DNA, 22 bp, Artificial sequence
  SiRNA target sequence
taagaggacttgtttcaataaa

SEQ ID NO: 4436 - DNA, 22 bp, Artificial sequence
  SiRNA target sequence
aagaggacttgtttcaataaaa

SEQ ID NO: 4437 - DNA, 22 bp, Artificial sequence
  SiRNA target sequence
agaggacttgtttcaataaaaa

SEQ ID NO: 4438 - DNA, 22 bp, Artificial sequence
  SiRNA target sequence
gaggacttgtttcaataaaaaa

SEQ ID NO: 4439 - DNA, 22 bp, Artificial sequence
  SiRNA target sequence
aggacttgtttcaataaaaaat

SEQ ID NO: 4440 - DNA, 22 bp, Artificial sequence
  SiRNA target sequence
ggacttgtttcaataaaaaata

SEQ ID NO: 4441 - DNA, 22 bp, Artificial sequence
  SiRNA target sequence
gacttgtttcaataaaaaatat

SEQ ID NO: 4442 - DNA, 22 bp, Artificial sequence
  SiRNA target sequence
acttgtttcaataaaaaatata

SEQ ID NO: 4443 - DNA, 22 bp, Artificial sequence
  SiRNA target sequence
cttgtttcaataaaaaatataa

SEQ ID NO: 4444 - DNA, 22 bp, Artificial sequence
  SiRNA target sequence
ttgtttcaataaaaaatataaa

SEQ ID NO: 4445 - DNA, 22 bp, Artificial sequence
  SiRNA target sequence
tgtttcaataaaaaatataaat

SEQ ID NO: 4446 - DNA, 22 bp, Artificial sequence
  SiRNA target sequence
gtttcaataaaaaatataaatg

SEQ ID NO: 4447 - DNA, 22 bp, Artificial sequence
  SiRNA target sequence
tttcaataaaaaatataaatga

SEQ ID NO: 4448 - DNA, 22 bp, Artificial sequence
  SiRNA target sequence
ttcaataaaaaatataaatgag

SEQ ID NO: 4449 - DNA, 22 bp, Artificial sequence
  SiRNA target sequence
tcaataaaaaatataaatgaga

SEQ ID NO: 4450 - DNA, 22 bp, Artificial sequence
  SiRNA target sequence
caataaaaaatataaatgagat

SEQ ID NO: 4451 - DNA, 22 bp, Artificial sequence
  SiRNA target sequence
aataaaaaatataaatgagatt

SEQ ID NO: 4452 - DNA, 22 bp, Artificial sequence
  SiRNA target sequence
ataaaaaatataaatgagattt

SEQ ID NO: 4453 - DNA, 22 bp, Artificial sequence
  SiRNA target sequence
taaaaaatataaatgagattta

SEQ ID NO: 4454 - DNA, 22 bp, Artificial sequence
  SiRNA target sequence
aaaaaatataaatgagatttat

SEQ ID NO: 4455 - DNA, 22 bp, Artificial sequence
  SiRNA target sequence
aaaaatataaatgagatttatg

SEQ ID NO: 4456 - DNA, 22 bp, Artificial sequence
  SiRNA target sequence
aaaatataaatgagatttatga

SEQ ID NO: 4457 - DNA, 22 bp, Artificial sequence
  SiRNA target sequence
aaatataaatgagatttatgat

SEQ ID NO: 4458 - DNA, 22 bp, Artificial sequence
  SiRNA target sequence
aatataaatgagatttatgatg

SEQ ID NO: 4459 - DNA, 22 bp, Artificial sequence
  SiRNA target sequence
atataaatgagatttatgatgc

SEQ ID NO: 4460 - DNA, 22 bp, Artificial sequence
  SiRNA target sequence
tataaatgagatttatgatgca

SEQ ID NO: 4461 - DNA, 22 bp, Artificial sequence
  SiRNA target sequence
ataaatgagatttatgatgcat

SEQ ID NO: 4462 - DNA, 22 bp, Artificial sequence
  SiRNA target sequence
taaatgagatttatgatgcatt

SEQ ID NO: 4463 - DNA, 22 bp, Artificial sequence
  SiRNA target sequence
aaatgagatttatgatgcattt

SEQ ID NO: 4464 - DNA, 22 bp, Artificial sequence
  SiRNA target sequence
aatgagatttatgatgcatttg

SEQ ID NO: 4465 - DNA, 22 bp, Artificial sequence
  SiRNA target sequence
atgagatttatgatgcatttgg

SEQ ID NO: 4466 - DNA, 22 bp, Artificial sequence
  SiRNA target sequence
tgagatttatgatgcatttgga

SEQ ID NO: 4467 - DNA, 22 bp, Artificial sequence
  SiRNA target sequence
gagatttatgatgcatttggag

SEQ ID NO: 4468 - DNA, 22 bp, Artificial sequence
  SiRNA target sequence
agatttatgatgcatttggagg

SEQ ID NO: 4469 - DNA, 22 bp, Artificial sequence
  SiRNA target sequence
gatttatgatgcatttggaggt

SEQ ID NO: 4470 - DNA, 22 bp, Artificial sequence
  SiRNA target sequence
atttatgatgcatttggaggta

SEQ ID NO: 4471 - DNA, 22 bp, Artificial sequence
  SiRNA target sequence
tttatgatgcatttggaggtaa

SEQ ID NO: 4472 - DNA, 22 bp, Artificial sequence
  SiRNA target sequence
ttatgatgcatttggaggtaaa

SEQ ID NO: 4473 - DNA, 22 bp, Artificial sequence
  SiRNA target sequence
tatgatgcatttggaggtaaat

SEQ ID NO: 4474 - DNA, 22 bp, Artificial sequence
  SiRNA target sequence
atgatgcatttggaggtaaatc

SEQ ID NO: 4475 - DNA, 22 bp, Artificial sequence
  SiRNA target sequence
tgatgcatttggaggtaaatct

SEQ ID NO: 4476 - DNA, 22 bp, Artificial sequence
  SiRNA target sequence
gatgcatttggaggtaaatcta

SEQ ID NO: 4477 - DNA, 22 bp, Artificial sequence
  SiRNA target sequence
atgcatttggaggtaaatctaa

SEQ ID NO: 4478 - DNA, 22 bp, Artificial sequence
  SiRNA target sequence
tgcatttggaggtaaatctaag

SEQ ID NO: 4479 - DNA, 22 bp, Artificial sequence
  SiRNA target sequence
gcatttggaggtaaatctaaga

SEQ ID NO: 4480 - DNA, 22 bp, Artificial sequence
  SiRNA target sequence
catttggaggtaaatctaagaa

SEQ ID NO: 4481 - DNA, 22 bp, Artificial sequence
  SiRNA target sequence
atttggaggtaaatctaagaag

SEQ ID NO: 4482 - DNA, 22 bp, Artificial sequence
  SiRNA target sequence
tttggaggtaaatctaagaagt

SEQ ID NO: 4483 - DNA, 22 bp, Artificial sequence
  SiRNA target sequence
ttggaggtaaatctaagaagtt

SEQ ID NO: 4484 - DNA, 22 bp, Artificial sequence
  SiRNA target sequence
tggaggtaaatctaagaagttt

SEQ ID NO: 4485 - DNA, 22 bp, Artificial sequence
  SiRNA target sequence
ggaggtaaatctaagaagttta

SEQ ID NO: 4486 - DNA, 22 bp, Artificial sequence
  SiRNA target sequence
gaggtaaatctaagaagtttaa

SEQ ID NO: 4487 - DNA, 22 bp, Artificial sequence
  SiRNA target sequence
aggtaaatctaagaagtttaaa

SEQ ID NO: 4488 - DNA, 22 bp, Artificial sequence
  SiRNA target sequence
ggtaaatctaagaagtttaaat

SEQ ID NO: 4489 - DNA, 22 bp, Artificial sequence
  SiRNA target sequence
gtaaatctaagaagtttaaatt

SEQ ID NO: 4490 - DNA, 22 bp, Artificial sequence
  SiRNA target sequence
taaatctaagaagtttaaattt

SEQ ID NO: 4491 - DNA, 22 bp, Artificial sequence
  SiRNA target sequence
aaatctaagaagtttaaatttt

SEQ ID NO: 4492 - DNA, 22 bp, Artificial sequence
  SiRNA target sequence
aatctaagaagtttaaattttc

SEQ ID NO: 4493 - DNA, 22 bp, Artificial sequence
  SiRNA target sequence
atctaagaagtttaaattttct

SEQ ID NO: 4494 - DNA, 22 bp, Artificial sequence
  SiRNA target sequence
tctaagaagtttaaattttcta

SEQ ID NO: 4495 - DNA, 22 bp, Artificial sequence
  SiRNA target sequence
ctaagaagtttaaattttctaa

SEQ ID NO: 4496 - DNA, 22 bp, Artificial sequence
  SiRNA target sequence
taagaagtttaaattttctaat

SEQ ID NO: 4497 - DNA, 22 bp, Artificial sequence
  SiRNA target sequence
aagaagtttaaattttctaatg

SEQ ID NO: 4498 - DNA, 22 bp, Artificial sequence
  SiRNA target sequence
agaagtttaaattttctaatga

SEQ ID NO: 4499 - DNA, 22 bp, Artificial sequence
  SiRNA target sequence
gaagtttaaattttctaatgat

SEQ ID NO: 4500 - DNA, 22 bp, Artificial sequence
  SiRNA target sequence
aagtttaaattttctaatgatg

SEQ ID NO: 4501 - DNA, 22 bp, Artificial sequence
  SiRNA target sequence
agtttaaattttctaatgatga

SEQ ID NO: 4502 - DNA, 22 bp, Artificial sequence
  SiRNA target sequence
gtttaaattttctaatgatgaa

SEQ ID NO: 4503 - DNA, 22 bp, Artificial sequence
  SiRNA target sequence
tttaaattttctaatgatgaaa

SEQ ID NO: 4504 - DNA, 22 bp, Artificial sequence
  SiRNA target sequence
ttaaattttctaatgatgaaaa

SEQ ID NO: 4505 - DNA, 22 bp, Artificial sequence
  SiRNA target sequence
taaattttctaatgatgaaaag

SEQ ID NO: 4506 - DNA, 22 bp, Artificial sequence
  SiRNA target sequence
aaattttctaatgatgaaaagg

SEQ ID NO: 4507 - DNA, 22 bp, Artificial sequence
  SiRNA target sequence
aattttctaatgatgaaaagga

SEQ ID NO: 4508 - DNA, 22 bp, Artificial sequence
  SiRNA target sequence
attttctaatgatgaaaaggaa

SEQ ID NO: 4509 - DNA, 22 bp, Artificial sequence
  SiRNA target sequence
ttttctaatgatgaaaaggaag

SEQ ID NO: 4510 - DNA, 22 bp, Artificial sequence
  SiRNA target sequence
tttctaatgatgaaaaggaagt

SEQ ID NO: 4511 - DNA, 22 bp, Artificial sequence
  SiRNA target sequence
ttctaatgatgaaaaggaagtg

SEQ ID NO: 4512 - DNA, 22 bp, Artificial sequence
  SiRNA target sequence
tctaatgatgaaaaggaagtgt

SEQ ID NO: 4513 - DNA, 22 bp, Artificial sequence
  SiRNA target sequence
ctaatgatgaaaaggaagtgtt

SEQ ID NO: 4514 - DNA, 22 bp, Artificial sequence
  SiRNA target sequence
taatgatgaaaaggaagtgtta

SEQ ID NO: 4515 - DNA, 22 bp, Artificial sequence
  SiRNA target sequence
aatgatgaaaaggaagtgttaa

SEQ ID NO: 4516 - DNA, 22 bp, Artificial sequence
  SiRNA target sequence
atgatgaaaaggaagtgttaaa

SEQ ID NO: 4517 - DNA, 22 bp, Artificial sequence
  SiRNA target sequence
tgatgaaaaggaagtgttaaat

SEQ ID NO: 4518 - DNA, 22 bp, Artificial sequence
  SiRNA target sequence
gatgaaaaggaagtgttaaatc

SEQ ID NO: 4519 - DNA, 22 bp, Artificial sequence
  SiRNA target sequence
atgaaaaggaagtgttaaatct

SEQ ID NO: 4520 - DNA, 22 bp, Artificial sequence
  SiRNA target sequence
tgaaaaggaagtgttaaatctt

SEQ ID NO: 4521 - DNA, 22 bp, Artificial sequence
  SiRNA target sequence
gaaaaggaagtgttaaatcttc

SEQ ID NO: 4522 - DNA, 22 bp, Artificial sequence
  SiRNA target sequence
aaaaggaagtgttaaatcttct

SEQ ID NO: 4523 - DNA, 22 bp, Artificial sequence
  SiRNA target sequence
aaaggaagtgttaaatcttctt

SEQ ID NO: 4524 - DNA, 22 bp, Artificial sequence
  SiRNA target sequence
aaggaagtgttaaatcttctta

SEQ ID NO: 4525 - DNA, 22 bp, Artificial sequence
  SiRNA target sequence
aggaagtgttaaatcttcttaa

SEQ ID NO: 4526 - DNA, 22 bp, Artificial sequence
  SiRNA target sequence
ggaagtgttaaatcttcttaat

SEQ ID NO: 4527 - DNA, 22 bp, Artificial sequence
  SiRNA target sequence
gaagtgttaaatcttcttaatg

SEQ ID NO: 4528 - DNA, 22 bp, Artificial sequence
  SiRNA target sequence
aagtgttaaatcttcttaatgc

SEQ ID NO: 4529 - DNA, 22 bp, Artificial sequence
  SiRNA target sequence
agtgttaaatcttcttaatgcc

SEQ ID NO: 4530 - DNA, 22 bp, Artificial sequence
  SiRNA target sequence
gtgttaaatcttcttaatgcca

SEQ ID NO: 4531 - DNA, 22 bp, Artificial sequence
  SiRNA target sequence
tgttaaatcttcttaatgccat

SEQ ID NO: 4532 - DNA, 22 bp, Artificial sequence
  SiRNA target sequence
gttaaatcttcttaatgccatt

SEQ ID NO: 4533 - DNA, 22 bp, Artificial sequence
  SiRNA target sequence
ttaaatcttcttaatgccatta

SEQ ID NO: 4534 - DNA, 22 bp, Artificial sequence
  SiRNA target sequence
taaatcttcttaatgccattat

SEQ ID NO: 4535 - DNA, 22 bp, Artificial sequence
  SiRNA target sequence
aaatcttcttaatgccattatt

SEQ ID NO: 4536 - DNA, 22 bp, Artificial sequence
  SiRNA target sequence
aatcttcttaatgccattattt

SEQ ID NO: 4537 - DNA, 22 bp, Artificial sequence
  SiRNA target sequence
atcttcttaatgccattatttt

SEQ ID NO: 4538 - DNA, 22 bp, Artificial sequence
  SiRNA target sequence
tcttcttaatgccattatttta

SEQ ID NO: 4539 - DNA, 22 bp, Artificial sequence
  SiRNA target sequence
cttcttaatgccattattttac

SEQ ID NO: 4540 - DNA, 22 bp, Artificial sequence
  SiRNA target sequence
ttcttaatgccattattttaca

SEQ ID NO: 4541 - DNA, 22 bp, Artificial sequence
  SiRNA target sequence
tcttaatgccattattttacac

SEQ ID NO: 4542 - DNA, 22 bp, Artificial sequence
  SiRNA target sequence
cttaatgccattattttacacc

SEQ ID NO: 4543 - DNA, 22 bp, Artificial sequence
  SiRNA target sequence
ttaatgccattattttacacct

SEQ ID NO: 4544 - DNA, 22 bp, Artificial sequence
  SiRNA target sequence
taatgccattattttacaccta

SEQ ID NO: 4545 - DNA, 22 bp, Artificial sequence
  SiRNA target sequence
aatgccattattttacacctaa

SEQ ID NO: 4546 - DNA, 22 bp, Artificial sequence
  SiRNA target sequence
atgccattattttacacctaaa

SEQ ID NO: 4547 - DNA, 22 bp, Artificial sequence
  SiRNA target sequence
tgccattattttacacctaaaa

SEQ ID NO: 4548 - DNA, 22 bp, Artificial sequence
  SiRNA target sequence
gccattattttacacctaaaag

SEQ ID NO: 4549 - DNA, 22 bp, Artificial sequence
  SiRNA target sequence
ccattattttacacctaaaagg

SEQ ID NO: 4550 - DNA, 22 bp, Artificial sequence
  SiRNA target sequence
cattattttacacctaaaagga

SEQ ID NO: 4551 - DNA, 22 bp, Artificial sequence
  SiRNA target sequence
attattttacacctaaaaggaa

SEQ ID NO: 4552 - DNA, 22 bp, Artificial sequence
  SiRNA target sequence
ttattttacacctaaaaggaaa

SEQ ID NO: 4553 - DNA, 22 bp, Artificial sequence
  SiRNA target sequence
tattttacacctaaaaggaaaa

SEQ ID NO: 4554 - DNA, 22 bp, Artificial sequence
  SiRNA target sequence
attttacacctaaaaggaaaaa

SEQ ID NO: 4555 - DNA, 22 bp, Artificial sequence
  SiRNA target sequence
ttttacacctaaaaggaaaaaa

SEQ ID NO: 4556 - DNA, 22 bp, Artificial sequence
  SiRNA target sequence
tttacacctaaaaggaaaaaaa

SEQ ID NO: 4557 - DNA, 22 bp, Artificial sequence
  SiRNA target sequence
ttacacctaaaaggaaaaaaag

SEQ ID NO: 4558 - DNA, 22 bp, Artificial sequence
  SiRNA target sequence
tacacctaaaaggaaaaaaaga

SEQ ID NO: 4559 - DNA, 22 bp, Artificial sequence
  SiRNA target sequence
acacctaaaaggaaaaaaagaa

SEQ ID NO: 4560 - DNA, 22 bp, Artificial sequence
  SiRNA target sequence
cacctaaaaggaaaaaaagaac

SEQ ID NO: 4561 - DNA, 22 bp, Artificial sequence
  SiRNA target sequence
acctaaaaggaaaaaaagaaca

SEQ ID NO: 4562 - DNA, 22 bp, Artificial sequence
  SiRNA target sequence
cctaaaaggaaaaaaagaacag

SEQ ID NO: 4563 - DNA, 22 bp, Artificial sequence
  SiRNA target sequence
ctaaaaggaaaaaaagaacagg

SEQ ID NO: 4564 - DNA, 22 bp, Artificial sequence
  SiRNA target sequence
taaaaggaaaaaaagaacaggc

SEQ ID NO: 4565 - DNA, 22 bp, Artificial sequence
  SiRNA target sequence
aaaaggaaaaaaagaacaggca

SEQ ID NO: 4566 - DNA, 22 bp, Artificial sequence
  SiRNA target sequence
aaaggaaaaaaagaacaggcaa

SEQ ID NO: 4567 - DNA, 22 bp, Artificial sequence
  SiRNA target sequence
aaggaaaaaaagaacaggcaat

SEQ ID NO: 4568 - DNA, 22 bp, Artificial sequence
  SiRNA target sequence
aggaaaaaaagaacaggcaatt

SEQ ID NO: 4569 - DNA, 22 bp, Artificial sequence
  SiRNA target sequence
ggaaaaaaagaacaggcaattc

SEQ ID NO: 4570 - DNA, 22 bp, Artificial sequence
  SiRNA target sequence
gaaaaaaagaacaggcaattct

SEQ ID NO: 4571 - DNA, 22 bp, Artificial sequence
  SiRNA target sequence
aaaaaaagaacaggcaattctt

SEQ ID NO: 4572 - DNA, 22 bp, Artificial sequence
  SiRNA target sequence
aaaaaagaacaggcaattcttt

SEQ ID NO: 4573 - DNA, 22 bp, Artificial sequence
  SiRNA target sequence
aaaaagaacaggcaattctttt

SEQ ID NO: 4574 - DNA, 22 bp, Artificial sequence
  SiRNA target sequence
aaaagaacaggcaattctttta

SEQ ID NO: 4575 - DNA, 22 bp, Artificial sequence
  SiRNA target sequence
aaagaacaggcaattcttttat

SEQ ID NO: 4576 - DNA, 22 bp, Artificial sequence
  SiRNA target sequence
aagaacaggcaattcttttatt

SEQ ID NO: 4577 - DNA, 22 bp, Artificial sequence
  SiRNA target sequence
agaacaggcaattcttttatta

SEQ ID NO: 4578 - DNA, 22 bp, Artificial sequence
  SiRNA target sequence
gaacaggcaattcttttattag

SEQ ID NO: 4579 - DNA, 22 bp, Artificial sequence
  SiRNA target sequence
aacaggcaattcttttattaga

SEQ ID NO: 4580 - DNA, 22 bp, Artificial sequence
  SiRNA target sequence
acaggcaattcttttattagaa

SEQ ID NO: 4581 - DNA, 22 bp, Artificial sequence
  SiRNA target sequence
caggcaattcttttattagaaa

SEQ ID NO: 4582 - DNA, 22 bp, Artificial sequence
  SiRNA target sequence
aggcaattcttttattagaaaa

SEQ ID NO: 4583 - DNA, 22 bp, Artificial sequence
  SiRNA target sequence
ggcaattcttttattagaaaaa

SEQ ID NO: 4584 - DNA, 22 bp, Artificial sequence
  SiRNA target sequence
gcaattcttttattagaaaaat

SEQ ID NO: 4585 - DNA, 22 bp, Artificial sequence
  SiRNA target sequence
caattcttttattagaaaaatc

SEQ ID NO: 4586 - DNA, 22 bp, Artificial sequence
  SiRNA target sequence
aattcttttattagaaaaatct

SEQ ID NO: 4587 - DNA, 22 bp, Artificial sequence
  SiRNA target sequence
attcttttattagaaaaatcta

SEQ ID NO: 4588 - DNA, 22 bp, Artificial sequence
  SiRNA target sequence
ttcttttattagaaaaatctac

SEQ ID NO: 4589 - DNA, 22 bp, Artificial sequence
  SiRNA target sequence
tcttttattagaaaaatctact

SEQ ID NO: 4590 - DNA, 22 bp, Artificial sequence
  SiRNA target sequence
cttttattagaaaaatctactt

SEQ ID NO: 4591 - DNA, 22 bp, Artificial sequence
  SiRNA target sequence
ttttattagaaaaatctactta

SEQ ID NO: 4592 - DNA, 22 bp, Artificial sequence
  SiRNA target sequence
tttattagaaaaatctacttat

SEQ ID NO: 4593 - DNA, 22 bp, Artificial sequence
  SiRNA target sequence
ttattagaaaaatctacttata

SEQ ID NO: 4594 - DNA, 22 bp, Artificial sequence
  SiRNA target sequence
tattagaaaaatctacttataa

SEQ ID NO: 4595 - DNA, 22 bp, Artificial sequence
  SiRNA target sequence
attagaaaaatctacttataaa

SEQ ID NO: 4596 - DNA, 22 bp, Artificial sequence
  SiRNA target sequence
ttagaaaaatctacttataaat

SEQ ID NO: 4597 - DNA, 22 bp, Artificial sequence
  SiRNA target sequence
tagaaaaatctacttataaata

SEQ ID NO: 4598 - DNA, 22 bp, Artificial sequence
  SiRNA target sequence
agaaaaatctacttataaatac

SEQ ID NO: 4599 - DNA, 22 bp, Artificial sequence
  SiRNA target sequence
gaaaaatctacttataaataca

SEQ ID NO: 4600 - DNA, 22 bp, Artificial sequence
  SiRNA target sequence
aaaaatctacttataaatacag

SEQ ID NO: 4601 - DNA, 22 bp, Artificial sequence
  SiRNA target sequence
aaaatctacttataaatacagt

SEQ ID NO: 4602 - DNA, 22 bp, Artificial sequence
  SiRNA target sequence
aaatctacttataaatacagta

SEQ ID NO: 4603 - DNA, 22 bp, Artificial sequence
  SiRNA target sequence
aatctacttataaatacagtat

SEQ ID NO: 4604 - DNA, 22 bp, Artificial sequence
  SiRNA target sequence
atctacttataaatacagtatc

SEQ ID NO: 4605 - DNA, 22 bp, Artificial sequence
  SiRNA target sequence
tctacttataaatacagtatct

SEQ ID NO: 4606 - DNA, 22 bp, Artificial sequence
  SiRNA target sequence
ctacttataaatacagtatctt

SEQ ID NO: 4607 - DNA, 22 bp, Artificial sequence
  SiRNA target sequence
tacttataaatacagtatcttg

SEQ ID NO: 4608 - DNA, 22 bp, Artificial sequence
  SiRNA target sequence
acttataaatacagtatcttgt

SEQ ID NO: 4609 - DNA, 22 bp, Artificial sequence
  SiRNA target sequence
cttataaatacagtatcttgta

SEQ ID NO: 4610 - DNA, 22 bp, Artificial sequence
  SiRNA target sequence
ttataaatacagtatcttgtat

SEQ ID NO: 4611 - DNA, 22 bp, Artificial sequence
  SiRNA target sequence
tataaatacagtatcttgtata

SEQ ID NO: 4612 - DNA, 22 bp, Artificial sequence
  SiRNA target sequence
ataaatacagtatcttgtatag

SEQ ID NO: 4613 - DNA, 22 bp, Artificial sequence
  SiRNA target sequence
taaatacagtatcttgtataga

SEQ ID NO: 4614 - DNA, 22 bp, Artificial sequence
  SiRNA target sequence
aaatacagtatcttgtatagag

SEQ ID NO: 4615 - DNA, 22 bp, Artificial sequence
  SiRNA target sequence
aatacagtatcttgtatagagc

SEQ ID NO: 4616 - DNA, 22 bp, Artificial sequence
  SiRNA target sequence
atacagtatcttgtatagagca

SEQ ID NO: 4617 - DNA, 22 bp, Artificial sequence
  SiRNA target sequence
tacagtatcttgtatagagcat

SEQ ID NO: 4618 - DNA, 22 bp, Artificial sequence
  SiRNA target sequence
acagtatcttgtatagagcata

SEQ ID NO: 4619 - DNA, 22 bp, Artificial sequence
  SiRNA target sequence
cagtatcttgtatagagcatat

SEQ ID NO: 4620 - DNA, 22 bp, Artificial sequence
  SiRNA target sequence
agtatcttgtatagagcatatt

SEQ ID NO: 4621 - DNA, 22 bp, Artificial sequence
  SiRNA target sequence
gtatcttgtatagagcatattt

SEQ ID NO: 4622 - DNA, 22 bp, Artificial sequence
  SiRNA target sequence
tatcttgtatagagcatatttt

SEQ ID NO: 4623 - DNA, 22 bp, Artificial sequence
  SiRNA target sequence
atcttgtatagagcatattttc

SEQ ID NO: 4624 - DNA, 22 bp, Artificial sequence
  SiRNA target sequence
tcttgtatagagcatattttct

SEQ ID NO: 4625 - DNA, 22 bp, Artificial sequence
  SiRNA target sequence
cttgtatagagcatattttctt

SEQ ID NO: 4626 - DNA, 22 bp, Artificial sequence
  SiRNA target sequence
ttgtatagagcatattttctta

SEQ ID NO: 4627 - DNA, 22 bp, Artificial sequence
  SiRNA target sequence
tgtatagagcatattttcttac

SEQ ID NO: 4628 - DNA, 22 bp, Artificial sequence
  SiRNA target sequence
gtatagagcatattttcttaca

SEQ ID NO: 4629 - DNA, 22 bp, Artificial sequence
  SiRNA target sequence
tatagagcatattttcttacat

SEQ ID NO: 4630 - DNA, 22 bp, Artificial sequence
  SiRNA target sequence
atagagcatattttcttacatt

SEQ ID NO: 4631 - DNA, 22 bp, Artificial sequence
  SiRNA target sequence
tagagcatattttcttacattg

SEQ ID NO: 4632 - DNA, 22 bp, Artificial sequence
  SiRNA target sequence
agagcatattttcttacattga

SEQ ID NO: 4633 - DNA, 22 bp, Artificial sequence
  SiRNA target sequence
gagcatattttcttacattgaa

SEQ ID NO: 4634 - DNA, 22 bp, Artificial sequence
  SiRNA target sequence
agcatattttcttacattgaag

SEQ ID NO: 4635 - DNA, 22 bp, Artificial sequence
  SiRNA target sequence
gcatattttcttacattgaaga

SEQ ID NO: 4636 - DNA, 22 bp, Artificial sequence
  SiRNA target sequence
catattttcttacattgaagaa

SEQ ID NO: 4637 - DNA, 22 bp, Artificial sequence
  SiRNA target sequence
atattttcttacattgaagaat

SEQ ID NO: 4638 - DNA, 22 bp, Artificial sequence
  SiRNA target sequence
tattttcttacattgaagaatg

SEQ ID NO: 4639 - DNA, 22 bp, Artificial sequence
  SiRNA target sequence
attttcttacattgaagaatga

SEQ ID NO: 4640 - DNA, 22 bp, Artificial sequence
  SiRNA target sequence
ttttcttacattgaagaatgaa

SEQ ID NO: 4641 - DNA, 22 bp, Artificial sequence
  SiRNA target sequence
tttcttacattgaagaatgaat

SEQ ID NO: 4642 - DNA, 22 bp, Artificial sequence
  SiRNA target sequence
ttcttacattgaagaatgaata

SEQ ID NO: 4643 - DNA, 22 bp, Artificial sequence
  SiRNA target sequence
tcttacattgaagaatgaatat

SEQ ID NO: 4644 - DNA, 22 bp, Artificial sequence
  SiRNA target sequence
cttacattgaagaatgaatata

SEQ ID NO: 4645 - DNA, 22 bp, Artificial sequence
  SiRNA target sequence
ttacattgaagaatgaatatat

SEQ ID NO: 4646 - DNA, 22 bp, Artificial sequence
  SiRNA target sequence
tacattgaagaatgaatatatt

SEQ ID NO: 4647 - DNA, 22 bp, Artificial sequence
  SiRNA target sequence
acattgaagaatgaatatattt

SEQ ID NO: 4648 - DNA, 22 bp, Artificial sequence
  SiRNA target sequence
cattgaagaatgaatatatttc

SEQ ID NO: 4649 - DNA, 22 bp, Artificial sequence
  SiRNA target sequence
attgaagaatgaatatatttca

SEQ ID NO: 4650 - DNA, 22 bp, Artificial sequence
  SiRNA target sequence
ttgaagaatgaatatatttcat

SEQ ID NO: 4651 - DNA, 22 bp, Artificial sequence
  SiRNA target sequence
tgaagaatgaatatatttcatc

SEQ ID NO: 4652 - DNA, 22 bp, Artificial sequence
  SiRNA target sequence
gaagaatgaatatatttcatct

SEQ ID NO: 4653 - DNA, 22 bp, Artificial sequence
  SiRNA target sequence
aagaatgaatatatttcatctt

SEQ ID NO: 4654 - DNA, 22 bp, Artificial sequence
  SiRNA target sequence
agaatgaatatatttcatcttc

SEQ ID NO: 4655 - DNA, 22 bp, Artificial sequence
  SiRNA target sequence
gaatgaatatatttcatcttca

SEQ ID NO: 4656 - DNA, 22 bp, Artificial sequence
  SiRNA target sequence
aatgaatatatttcatcttcat

SEQ ID NO: 4657 - DNA, 22 bp, Artificial sequence
  SiRNA target sequence
atgaatatatttcatcttcatt

SEQ ID NO: 4658 - DNA, 22 bp, Artificial sequence
  SiRNA target sequence
tgaatatatttcatcttcattg

SEQ ID NO: 4659 - DNA, 22 bp, Artificial sequence
  SiRNA target sequence
gaatatatttcatcttcattgc

SEQ ID NO: 4660 - DNA, 22 bp, Artificial sequence
  SiRNA target sequence
aatatatttcatcttcattgcc

SEQ ID NO: 4661 - DNA, 22 bp, Artificial sequence
  SiRNA target sequence
atatatttcatcttcattgcct

SEQ ID NO: 4662 - DNA, 22 bp, Artificial sequence
  SiRNA target sequence
tatatttcatcttcattgcctt

SEQ ID NO: 4663 - DNA, 22 bp, Artificial sequence
  SiRNA target sequence
atatttcatcttcattgccttt

SEQ ID NO: 4664 - DNA, 22 bp, Artificial sequence
  SiRNA target sequence
tatttcatcttcattgccttta

SEQ ID NO: 4665 - DNA, 22 bp, Artificial sequence
  SiRNA target sequence
atttcatcttcattgcctttag

SEQ ID NO: 4666 - DNA, 22 bp, Artificial sequence
  SiRNA target sequence
tttcatcttcattgcctttaga

SEQ ID NO: 4667 - DNA, 22 bp, Artificial sequence
  SiRNA target sequence
ttcatcttcattgcctttagat

SEQ ID NO: 4668 - DNA, 22 bp, Artificial sequence
  SiRNA target sequence
tcatcttcattgcctttagatg

SEQ ID NO: 4669 - DNA, 22 bp, Artificial sequence
  SiRNA target sequence
catcttcattgcctttagatga

SEQ ID NO: 4670 - DNA, 22 bp, Artificial sequence
  SiRNA target sequence
atcttcattgcctttagatgac

SEQ ID NO: 4671 - DNA, 22 bp, Artificial sequence
  SiRNA target sequence
tcttcattgcctttagatgacg

SEQ ID NO: 4672 - DNA, 22 bp, Artificial sequence
  SiRNA target sequence
cttcattgcctttagatgacga

SEQ ID NO: 4673 - DNA, 22 bp, Artificial sequence
  SiRNA target sequence
ttcattgcctttagatgacgag

SEQ ID NO: 4674 - DNA, 22 bp, Artificial sequence
  SiRNA target sequence
tcattgcctttagatgacgaga

SEQ ID NO: 4675 - DNA, 22 bp, Artificial sequence
  SiRNA target sequence
cattgcctttagatgacgagat

SEQ ID NO: 4676 - DNA, 22 bp, Artificial sequence
  SiRNA target sequence
attgcctttagatgacgagatt

SEQ ID NO: 4677 - DNA, 22 bp, Artificial sequence
  SiRNA target sequence
ttgcctttagatgacgagatta

SEQ ID NO: 4678 - DNA, 22 bp, Artificial sequence
  SiRNA target sequence
tgcctttagatgacgagattac

SEQ ID NO: 4679 - DNA, 22 bp, Artificial sequence
  SiRNA target sequence
gcctttagatgacgagattact

SEQ ID NO: 4680 - DNA, 22 bp, Artificial sequence
  SiRNA target sequence
cctttagatgacgagattacta

SEQ ID NO: 4681 - DNA, 22 bp, Artificial sequence
  SiRNA target sequence
ctttagatgacgagattactac

SEQ ID NO: 4682 - DNA, 22 bp, Artificial sequence
  SiRNA target sequence
tttagatgacgagattactacg

SEQ ID NO: 4683 - DNA, 22 bp, Artificial sequence
  SiRNA target sequence
ttagatgacgagattactacgc

SEQ ID NO: 4684 - DNA, 22 bp, Artificial sequence
  SiRNA target sequence
tagatgacgagattactacgct

SEQ ID NO: 4685 - DNA, 22 bp, Artificial sequence
  SiRNA target sequence
agatgacgagattactacgctt

SEQ ID NO: 4686 - DNA, 22 bp, Artificial sequence
  SiRNA target sequence
gatgacgagattactacgcttt

SEQ ID NO: 4687 - DNA, 22 bp, Artificial sequence
  SiRNA target sequence
atgacgagattactacgcttta

SEQ ID NO: 4688 - DNA, 22 bp, Artificial sequence
  SiRNA target sequence
tgacgagattactacgctttac

SEQ ID NO: 4689 - DNA, 22 bp, Artificial sequence
  SiRNA target sequence
gacgagattactacgctttact

SEQ ID NO: 4690 - DNA, 22 bp, Artificial sequence
  SiRNA target sequence
acgagattactacgctttactt

SEQ ID NO: 4691 - DNA, 22 bp, Artificial sequence
  SiRNA target sequence
cgagattactacgctttacttg

SEQ ID NO: 4692 - DNA, 22 bp, Artificial sequence
  SiRNA target sequence
gagattactacgctttacttgt

SEQ ID NO: 4693 - DNA, 22 bp, Artificial sequence
  SiRNA target sequence
agattactacgctttacttgta

SEQ ID NO: 4694 - DNA, 22 bp, Artificial sequence
  SiRNA target sequence
gattactacgctttacttgtat

SEQ ID NO: 4695 - DNA, 22 bp, Artificial sequence
  SiRNA target sequence
attactacgctttacttgtatt

SEQ ID NO: 4696 - DNA, 22 bp, Artificial sequence
  SiRNA target sequence
ttactacgctttacttgtattc

SEQ ID NO: 4697 - DNA, 22 bp, Artificial sequence
  SiRNA target sequence
tactacgctttacttgtattct

SEQ ID NO: 4698 - DNA, 22 bp, Artificial sequence
  SiRNA target sequence
actacgctttacttgtattcta

SEQ ID NO: 4699 - DNA, 22 bp, Artificial sequence
  SiRNA target sequence
ctacgctttacttgtattctaa

SEQ ID NO: 4700 - DNA, 22 bp, Artificial sequence
  SiRNA target sequence
tacgctttacttgtattctaag

SEQ ID NO: 4701 - DNA, 22 bp, Artificial sequence
  SiRNA target sequence
acgctttacttgtattctaaga

SEQ ID NO: 4702 - DNA, 22 bp, Artificial sequence
  SiRNA target sequence
cgctttacttgtattctaagat

SEQ ID NO: 4703 - DNA, 22 bp, Artificial sequence
  SiRNA target sequence
gctttacttgtattctaagatt

SEQ ID NO: 4704 - DNA, 22 bp, Artificial sequence
  SiRNA target sequence
ctttacttgtattctaagattt

SEQ ID NO: 4705 - DNA, 22 bp, Artificial sequence
  SiRNA target sequence
tttacttgtattctaagatttt

SEQ ID NO: 4706 - DNA, 22 bp, Artificial sequence
  SiRNA target sequence
ttacttgtattctaagattttt

SEQ ID NO: 4707 - DNA, 22 bp, Artificial sequence
  SiRNA target sequence
tacttgtattctaagattttta

SEQ ID NO: 4708 - DNA, 22 bp, Artificial sequence
  SiRNA target sequence
acttgtattctaagatttttaa

SEQ ID NO: 4709 - DNA, 22 bp, Artificial sequence
  SiRNA target sequence
cttgtattctaagatttttaaa

SEQ ID NO: 4710 - DNA, 22 bp, Artificial sequence
  SiRNA target sequence
ttgtattctaagatttttaaag

SEQ ID NO: 4711 - DNA, 22 bp, Artificial sequence
  SiRNA target sequence
tgtattctaagatttttaaaga

SEQ ID NO: 4712 - DNA, 22 bp, Artificial sequence
  SiRNA target sequence
gtattctaagatttttaaagat

SEQ ID NO: 4713 - DNA, 22 bp, Artificial sequence
  SiRNA target sequence
tattctaagatttttaaagata

SEQ ID NO: 4714 - DNA, 22 bp, Artificial sequence
  SiRNA target sequence
attctaagatttttaaagataa

SEQ ID NO: 4715 - DNA, 22 bp, Artificial sequence
  SiRNA target sequence
ttctaagatttttaaagataaa

SEQ ID NO: 4716 - DNA, 22 bp, Artificial sequence
  SiRNA target sequence
tctaagatttttaaagataaat

SEQ ID NO: 4717 - DNA, 22 bp, Artificial sequence
  SiRNA target sequence
ctaagatttttaaagataaatc

SEQ ID NO: 4718 - DNA, 22 bp, Artificial sequence
  SiRNA target sequence
taagatttttaaagataaatct

SEQ ID NO: 4719 - DNA, 22 bp, Artificial sequence
  SiRNA target sequence
aagatttttaaagataaatctg

SEQ ID NO: 4720 - DNA, 22 bp, Artificial sequence
  SiRNA target sequence
agatttttaaagataaatctga

SEQ ID NO: 4721 - DNA, 22 bp, Artificial sequence
  SiRNA target sequence
gatttttaaagataaatctgat

SEQ ID NO: 4722 - DNA, 22 bp, Artificial sequence
  SiRNA target sequence
atttttaaagataaatctgata

SEQ ID NO: 4723 - DNA, 22 bp, Artificial sequence
  SiRNA target sequence
tttttaaagataaatctgatac

SEQ ID NO: 4724 - DNA, 22 bp, Artificial sequence
  SiRNA target sequence
ttttaaagataaatctgatact

SEQ ID NO: 4725 - DNA, 22 bp, Artificial sequence
  SiRNA target sequence
tttaaagataaatctgatactt

SEQ ID NO: 4726 - DNA, 22 bp, Artificial sequence
  SiRNA target sequence
ttaaagataaatctgatactta

SEQ ID NO: 4727 - DNA, 22 bp, Artificial sequence
  SiRNA target sequence
taaagataaatctgatacttac

SEQ ID NO: 4728 - DNA, 22 bp, Artificial sequence
  SiRNA target sequence
aaagataaatctgatacttacc

SEQ ID NO: 4729 - DNA, 22 bp, Artificial sequence
  SiRNA target sequence
aagataaatctgatacttacct

SEQ ID NO: 4730 - DNA, 22 bp, Artificial sequence
  SiRNA target sequence
agataaatctgatacttacctt

SEQ ID NO: 4731 - DNA, 22 bp, Artificial sequence
  SiRNA target sequence
gataaatctgatacttacctta

SEQ ID NO: 4732 - DNA, 22 bp, Artificial sequence
  SiRNA target sequence
ataaatctgatacttaccttaa

SEQ ID NO: 4733 - DNA, 22 bp, Artificial sequence
  SiRNA target sequence
taaatctgatacttaccttaaa

SEQ ID NO: 4734 - DNA, 22 bp, Artificial sequence
  SiRNA target sequence
aaatctgatacttaccttaaat

SEQ ID NO: 4735 - DNA, 22 bp, Artificial sequence
  SiRNA target sequence
aatctgatacttaccttaaatc

SEQ ID NO: 4736 - DNA, 22 bp, Artificial sequence
  SiRNA target sequence
atctgatacttaccttaaatct

SEQ ID NO: 4737 - DNA, 22 bp, Artificial sequence
  SiRNA target sequence
tctgatacttaccttaaatctg

SEQ ID NO: 4738 - DNA, 22 bp, Artificial sequence
  SiRNA target sequence
ctgatacttaccttaaatctgc

SEQ ID NO: 4739 - DNA, 22 bp, Artificial sequence
  SiRNA target sequence
tgatacttaccttaaatctgct

SEQ ID NO: 4740 - DNA, 22 bp, Artificial sequence
  SiRNA target sequence
gatacttaccttaaatctgcta

SEQ ID NO: 4741 - DNA, 22 bp, Artificial sequence
  SiRNA target sequence
atacttaccttaaatctgctat

SEQ ID NO: 4742 - DNA, 22 bp, Artificial sequence
  SiRNA target sequence
tacttaccttaaatctgctata

SEQ ID NO: 4743 - DNA, 22 bp, Artificial sequence
  SiRNA target sequence
acttaccttaaatctgctatag

SEQ ID NO: 4744 - DNA, 22 bp, Artificial sequence
  SiRNA target sequence
cttaccttaaatctgctataga

SEQ ID NO: 4745 - DNA, 22 bp, Artificial sequence
  SiRNA target sequence
ttaccttaaatctgctatagat

SEQ ID NO: 4746 - DNA, 22 bp, Artificial sequence
  SiRNA target sequence
taccttaaatctgctatagata

SEQ ID NO: 4747 - DNA, 22 bp, Artificial sequence
  SiRNA target sequence
accttaaatctgctatagataa

SEQ ID NO: 4748 - DNA, 22 bp, Artificial sequence
  SiRNA target sequence
ccttaaatctgctatagataaa

SEQ ID NO: 4749 - DNA, 22 bp, Artificial sequence
  SiRNA target sequence
cttaaatctgctatagataaat

SEQ ID NO: 4750 - DNA, 22 bp, Artificial sequence
  SiRNA target sequence
ttaaatctgctatagataaatc

SEQ ID NO: 4751 - DNA, 22 bp, Artificial sequence
  SiRNA target sequence
taaatctgctatagataaatca

SEQ ID NO: 4752 - DNA, 22 bp, Artificial sequence
  SiRNA target sequence
aaatctgctatagataaatcag

SEQ ID NO: 4753 - DNA, 22 bp, Artificial sequence
  SiRNA target sequence
aatctgctatagataaatcagt

SEQ ID NO: 4754 - DNA, 22 bp, Artificial sequence
  SiRNA target sequence
atctgctatagataaatcagta

SEQ ID NO: 4755 - DNA, 22 bp, Artificial sequence
  SiRNA target sequence
tctgctatagataaatcagtag

SEQ ID NO: 4756 - DNA, 22 bp, Artificial sequence
  SiRNA target sequence
ctgctatagataaatcagtaga

SEQ ID NO: 4757 - DNA, 22 bp, Artificial sequence
  SiRNA target sequence
tgctatagataaatcagtagat

SEQ ID NO: 4758 - DNA, 22 bp, Artificial sequence
  SiRNA target sequence
gctatagataaatcagtagatc

SEQ ID NO: 4759 - DNA, 22 bp, Artificial sequence
  SiRNA target sequence
ctatagataaatcagtagatct

SEQ ID NO: 4760 - DNA, 22 bp, Artificial sequence
  SiRNA target sequence
tatagataaatcagtagatcta

SEQ ID NO: 4761 - DNA, 22 bp, Artificial sequence
  SiRNA target sequence
atagataaatcagtagatctac

SEQ ID NO: 4762 - DNA, 22 bp, Artificial sequence
  SiRNA target sequence
tagataaatcagtagatctacc

SEQ ID NO: 4763 - DNA, 22 bp, Artificial sequence
  SiRNA target sequence
agataaatcagtagatctacct

SEQ ID NO: 4764 - DNA, 22 bp, Artificial sequence
  SiRNA target sequence
gataaatcagtagatctaccta

SEQ ID NO: 4765 - DNA, 22 bp, Artificial sequence
  SiRNA target sequence
ataaatcagtagatctacctat

SEQ ID NO: 4766 - DNA, 22 bp, Artificial sequence
  SiRNA target sequence
taaatcagtagatctacctatt

SEQ ID NO: 4767 - DNA, 22 bp, Artificial sequence
  SiRNA target sequence
aaatcagtagatctacctattg

SEQ ID NO: 4768 - DNA, 22 bp, Artificial sequence
  SiRNA target sequence
aatcagtagatctacctattga

SEQ ID NO: 4769 - DNA, 22 bp, Artificial sequence
  SiRNA target sequence
atcagtagatctacctattgaa

SEQ ID NO: 4770 - DNA, 22 bp, Artificial sequence
  SiRNA target sequence
tcagtagatctacctattgaac

SEQ ID NO: 4771 - DNA, 22 bp, Artificial sequence
  SiRNA target sequence
cagtagatctacctattgaaca

SEQ ID NO: 4772 - DNA, 22 bp, Artificial sequence
  SiRNA target sequence
agtagatctacctattgaacag

SEQ ID NO: 4773 - DNA, 22 bp, Artificial sequence
  SiRNA target sequence
gtagatctacctattgaacaga

SEQ ID NO: 4774 - DNA, 22 bp, Artificial sequence
  SiRNA target sequence
tagatctacctattgaacagaa

SEQ ID NO: 4775 - DNA, 22 bp, Artificial sequence
  SiRNA target sequence
agatctacctattgaacagaaa

SEQ ID NO: 4776 - DNA, 22 bp, Artificial sequence
  SiRNA target sequence
gatctacctattgaacagaaag

SEQ ID NO: 4777 - DNA, 22 bp, Artificial sequence
  SiRNA target sequence
atctacctattgaacagaaaga

SEQ ID NO: 4778 - DNA, 22 bp, Artificial sequence
  SiRNA target sequence
tctacctattgaacagaaagac

SEQ ID NO: 4779 - DNA, 22 bp, Artificial sequence
  SiRNA target sequence
ctacctattgaacagaaagact

SEQ ID NO: 4780 - DNA, 22 bp, Artificial sequence
  SiRNA target sequence
tacctattgaacagaaagactt

SEQ ID NO: 4781 - DNA, 22 bp, Artificial sequence
  SiRNA target sequence
acctattgaacagaaagacttt

SEQ ID NO: 4782 - DNA, 22 bp, Artificial sequence
  SiRNA target sequence
cctattgaacagaaagactttc

SEQ ID NO: 4783 - DNA, 22 bp, Artificial sequence
  SiRNA target sequence
ctattgaacagaaagactttct

SEQ ID NO: 4784 - DNA, 22 bp, Artificial sequence
  SiRNA target sequence
tattgaacagaaagactttctg

SEQ ID NO: 4785 - DNA, 22 bp, Artificial sequence
  SiRNA target sequence
attgaacagaaagactttctgt

SEQ ID NO: 4786 - DNA, 22 bp, Artificial sequence
  SiRNA target sequence
ttgaacagaaagactttctgta

SEQ ID NO: 4787 - DNA, 22 bp, Artificial sequence
  SiRNA target sequence
tgaacagaaagactttctgtac

SEQ ID NO: 4788 - DNA, 22 bp, Artificial sequence
  SiRNA target sequence
gaacagaaagactttctgtacg

SEQ ID NO: 4789 - DNA, 22 bp, Artificial sequence
  SiRNA target sequence
aacagaaagactttctgtacgt

SEQ ID NO: 4790 - DNA, 22 bp, Artificial sequence
  SiRNA target sequence
acagaaagactttctgtacgta

SEQ ID NO: 4791 - DNA, 22 bp, Artificial sequence
  SiRNA target sequence
cagaaagactttctgtacgtag

SEQ ID NO: 4792 - DNA, 22 bp, Artificial sequence
  SiRNA target sequence
agaaagactttctgtacgtaga

SEQ ID NO: 4793 - DNA, 22 bp, Artificial sequence
  SiRNA target sequence
gaaagactttctgtacgtagat

SEQ ID NO: 4794 - DNA, 22 bp, Artificial sequence
  SiRNA target sequence
aaagactttctgtacgtagatc

SEQ ID NO: 4795 - DNA, 22 bp, Artificial sequence
  SiRNA target sequence
aagactttctgtacgtagatct

SEQ ID NO: 4796 - DNA, 22 bp, Artificial sequence
  SiRNA target sequence
agactttctgtacgtagatctt

SEQ ID NO: 4797 - DNA, 22 bp, Artificial sequence
  SiRNA target sequence
gactttctgtacgtagatcttc

SEQ ID NO: 4798 - DNA, 22 bp, Artificial sequence
  SiRNA target sequence
actttctgtacgtagatcttct

SEQ ID NO: 4799 - DNA, 22 bp, Artificial sequence
  SiRNA target sequence
ctttctgtacgtagatcttctt

SEQ ID NO: 4800 - DNA, 22 bp, Artificial sequence
  SiRNA target sequence
tttctgtacgtagatcttcttg

SEQ ID NO: 4801 - DNA, 22 bp, Artificial sequence
  SiRNA target sequence
ttctgtacgtagatcttcttgt

SEQ ID NO: 4802 - DNA, 22 bp, Artificial sequence
  SiRNA target sequence
tctgtacgtagatcttcttgta

SEQ ID NO: 4803 - DNA, 22 bp, Artificial sequence
  SiRNA target sequence
ctgtacgtagatcttcttgtat

SEQ ID NO: 4804 - DNA, 22 bp, Artificial sequence
  SiRNA target sequence
tgtacgtagatcttcttgtatt

SEQ ID NO: 4805 - DNA, 22 bp, Artificial sequence
  SiRNA target sequence
gtacgtagatcttcttgtattt

SEQ ID NO: 4806 - DNA, 22 bp, Artificial sequence
  SiRNA target sequence
tacgtagatcttcttgtatttt

SEQ ID NO: 4807 - DNA, 22 bp, Artificial sequence
  SiRNA target sequence
acgtagatcttcttgtatttta

SEQ ID NO: 4808 - DNA, 22 bp, Artificial sequence
  SiRNA target sequence
cgtagatcttcttgtattttac

SEQ ID NO: 4809 - DNA, 22 bp, Artificial sequence
  SiRNA target sequence
gtagatcttcttgtattttaca

SEQ ID NO: 4810 - DNA, 22 bp, Artificial sequence
  SiRNA target sequence
tagatcttcttgtattttacat

SEQ ID NO: 4811 - DNA, 22 bp, Artificial sequence
  SiRNA target sequence
agatcttcttgtattttacatt

SEQ ID NO: 4812 - DNA, 22 bp, Artificial sequence
  SiRNA target sequence
gatcttcttgtattttacattt

SEQ ID NO: 4813 - DNA, 22 bp, Artificial sequence
  SiRNA target sequence
atcttcttgtattttacatttc

SEQ ID NO: 4814 - DNA, 22 bp, Artificial sequence
  SiRNA target sequence
tcttcttgtattttacatttct

SEQ ID NO: 4815 - DNA, 22 bp, Artificial sequence
  SiRNA target sequence
cttcttgtattttacatttcta

SEQ ID NO: 4816 - DNA, 22 bp, Artificial sequence
  SiRNA target sequence
ttcttgtattttacatttctaa

SEQ ID NO: 4817 - DNA, 22 bp, Artificial sequence
  SiRNA target sequence
tcttgtattttacatttctaaa

SEQ ID NO: 4818 - DNA, 22 bp, Artificial sequence
  SiRNA target sequence
cttgtattttacatttctaaaa

SEQ ID NO: 4819 - DNA, 22 bp, Artificial sequence
  SiRNA target sequence
ttgtattttacatttctaaaaa

SEQ ID NO: 4820 - DNA, 22 bp, Artificial sequence
  SiRNA target sequence
tgtattttacatttctaaaaag

SEQ ID NO: 4821 - DNA, 22 bp, Artificial sequence
  SiRNA target sequence
gtattttacatttctaaaaagg

SEQ ID NO: 4822 - DNA, 22 bp, Artificial sequence
  SiRNA target sequence
tattttacatttctaaaaagga

SEQ ID NO: 4823 - DNA, 22 bp, Artificial sequence
  SiRNA target sequence
attttacatttctaaaaaggat

SEQ ID NO: 4824 - DNA, 22 bp, Artificial sequence
  SiRNA target sequence
ttttacatttctaaaaaggatg

SEQ ID NO: 4825 - DNA, 22 bp, Artificial sequence
  SiRNA target sequence
tttacatttctaaaaaggatgt

SEQ ID NO: 4826 - DNA, 22 bp, Artificial sequence
  SiRNA target sequence
ttacatttctaaaaaggatgtt

SEQ ID NO: 4827 - DNA, 22 bp, Artificial sequence
  SiRNA target sequence
tacatttctaaaaaggatgttg

SEQ ID NO: 4828 - DNA, 22 bp, Artificial sequence
  SiRNA target sequence
acatttctaaaaaggatgttga

SEQ ID NO: 4829 - DNA, 22 bp, Artificial sequence
  SiRNA target sequence
catttctaaaaaggatgttgaa

SEQ ID NO: 4830 - DNA, 22 bp, Artificial sequence
  SiRNA target sequence
atttctaaaaaggatgttgaaa

SEQ ID NO: 4831 - DNA, 22 bp, Artificial sequence
  SiRNA target sequence
tttctaaaaaggatgttgaaaa

SEQ ID NO: 4832 - DNA, 22 bp, Artificial sequence
  SiRNA target sequence
ttctaaaaaggatgttgaaaaa

SEQ ID NO: 4833 - DNA, 22 bp, Artificial sequence
  SiRNA target sequence
tctaaaaaggatgttgaaaaag

SEQ ID NO: 4834 - DNA, 22 bp, Artificial sequence
  SiRNA target sequence
ctaaaaaggatgttgaaaaagt

SEQ ID NO: 4835 - DNA, 22 bp, Artificial sequence
  SiRNA target sequence
taaaaaggatgttgaaaaagtt

SEQ ID NO: 4836 - DNA, 22 bp, Artificial sequence
  SiRNA target sequence
aaaaaggatgttgaaaaagtta

SEQ ID NO: 4837 - DNA, 22 bp, Artificial sequence
  SiRNA target sequence
aaaaggatgttgaaaaagttaa

SEQ ID NO: 4838 - DNA, 22 bp, Artificial sequence
  SiRNA target sequence
aaaggatgttgaaaaagttaat

SEQ ID NO: 4839 - DNA, 22 bp, Artificial sequence
  SiRNA target sequence
aaggatgttgaaaaagttaatg

SEQ ID NO: 4840 - DNA, 22 bp, Artificial sequence
  SiRNA target sequence
aggatgttgaaaaagttaatga

SEQ ID NO: 4841 - DNA, 22 bp, Artificial sequence
  SiRNA target sequence
ggatgttgaaaaagttaatgaa

SEQ ID NO: 4842 - DNA, 22 bp, Artificial sequence
  SiRNA target sequence
gatgttgaaaaagttaatgaaa

SEQ ID NO: 4843 - DNA, 22 bp, Artificial sequence
  SiRNA target sequence
atgttgaaaaagttaatgaaac

SEQ ID NO: 4844 - DNA, 22 bp, Artificial sequence
  SiRNA target sequence
tgttgaaaaagttaatgaaaca

SEQ ID NO: 4845 - DNA, 22 bp, Artificial sequence
  SiRNA target sequence
gttgaaaaagttaatgaaacaa

SEQ ID NO: 4846 - DNA, 22 bp, Artificial sequence
  SiRNA target sequence
ttgaaaaagttaatgaaacaat

SEQ ID NO: 4847 - DNA, 22 bp, Artificial sequence
  SiRNA target sequence
tgaaaaagttaatgaaacaatt

SEQ ID NO: 4848 - DNA, 22 bp, Artificial sequence
  SiRNA target sequence
gaaaaagttaatgaaacaatta

SEQ ID NO: 4849 - DNA, 22 bp, Artificial sequence
  SiRNA target sequence
aaaaagttaatgaaacaattaa

SEQ ID NO: 4850 - DNA, 22 bp, Artificial sequence
  SiRNA target sequence
aaaagttaatgaaacaattaat

SEQ ID NO: 4851 - DNA, 22 bp, Artificial sequence
  SiRNA target sequence
aaagttaatgaaacaattaata

SEQ ID NO: 4852 - DNA, 22 bp, Artificial sequence
  SiRNA target sequence
aagttaatgaaacaattaataa

SEQ ID NO: 4853 - DNA, 22 bp, Artificial sequence
  SiRNA target sequence
agttaatgaaacaattaataat

SEQ ID NO: 4854 - DNA, 22 bp, Artificial sequence
  SiRNA target sequence
gttaatgaaacaattaataatt

SEQ ID NO: 4855 - DNA, 22 bp, Artificial sequence
  SiRNA target sequence
ttaatgaaacaattaataattt

SEQ ID NO: 4856 - DNA, 22 bp, Artificial sequence
  SiRNA target sequence
taatgaaacaattaataattta

SEQ ID NO: 4857 - DNA, 22 bp, Artificial sequence
  SiRNA target sequence
aatgaaacaattaataatttaa

SEQ ID NO: 4858 - DNA, 22 bp, Artificial sequence
  SiRNA target sequence
atgaaacaattaataatttaaa

SEQ ID NO: 4859 - DNA, 22 bp, Artificial sequence
  SiRNA target sequence
tgaaacaattaataatttaaaa

SEQ ID NO: 4860 - DNA, 22 bp, Artificial sequence
  SiRNA target sequence
gaaacaattaataatttaaaag

SEQ ID NO: 4861 - DNA, 22 bp, Artificial sequence
  SiRNA target sequence
aaacaattaataatttaaaaga

SEQ ID NO: 4862 - DNA, 22 bp, Artificial sequence
  SiRNA target sequence
aacaattaataatttaaaagag

SEQ ID NO: 4863 - DNA, 22 bp, Artificial sequence
  SiRNA target sequence
acaattaataatttaaaagaga

SEQ ID NO: 4864 - DNA, 22 bp, Artificial sequence
  SiRNA target sequence
caattaataatttaaaagagac

SEQ ID NO: 4865 - DNA, 22 bp, Artificial sequence
  SiRNA target sequence
aattaataatttaaaagagact

SEQ ID NO: 4866 - DNA, 22 bp, Artificial sequence
  SiRNA target sequence
attaataatttaaaagagactc

SEQ ID NO: 4867 - DNA, 22 bp, Artificial sequence
  SiRNA target sequence
ttaataatttaaaagagactct

SEQ ID NO: 4868 - DNA, 22 bp, Artificial sequence
  SiRNA target sequence
taataatttaaaagagactctt

SEQ ID NO: 4869 - DNA, 22 bp, Artificial sequence
  SiRNA target sequence
aataatttaaaagagactctta

SEQ ID NO: 4870 - DNA, 22 bp, Artificial sequence
  SiRNA target sequence
ataatttaaaagagactcttac

SEQ ID NO: 4871 - DNA, 22 bp, Artificial sequence
  SiRNA target sequence
taatttaaaagagactcttacc

SEQ ID NO: 4872 - DNA, 22 bp, Artificial sequence
  SiRNA target sequence
aatttaaaagagactcttaccc

SEQ ID NO: 4873 - DNA, 22 bp, Artificial sequence
  SiRNA target sequence
atttaaaagagactcttacccc

SEQ ID NO: 4874 - DNA, 22 bp, Artificial sequence
  SiRNA target sequence
tttaaaagagactcttaccccc

SEQ ID NO: 4875 - DNA, 22 bp, Artificial sequence
  SiRNA target sequence
ttaaaagagactcttaccccca

SEQ ID NO: 4876 - DNA, 22 bp, Artificial sequence
  SiRNA target sequence
taaaagagactcttacccccac

SEQ ID NO: 4877 - DNA, 22 bp, Artificial sequence
  SiRNA target sequence
aaaagagactcttacccccact

SEQ ID NO: 4878 - DNA, 22 bp, Artificial sequence
  SiRNA target sequence
aaagagactcttacccccactt

SEQ ID NO: 4879 - DNA, 22 bp, Artificial sequence
  SiRNA target sequence
aagagactcttacccccacttt

SEQ ID NO: 4880 - DNA, 22 bp, Artificial sequence
  SiRNA target sequence
agagactcttacccccacttta

SEQ ID NO: 4881 - DNA, 22 bp, Artificial sequence
  SiRNA target sequence
gagactcttacccccactttat

SEQ ID NO: 4882 - DNA, 22 bp, Artificial sequence
  SiRNA target sequence
agactcttacccccactttatt

SEQ ID NO: 4883 - DNA, 22 bp, Artificial sequence
  SiRNA target sequence
gactcttacccccactttattg

SEQ ID NO: 4884 - DNA, 22 bp, Artificial sequence
  SiRNA target sequence
actcttacccccactttattgg

SEQ ID NO: 4885 - DNA, 22 bp, Artificial sequence
  SiRNA target sequence
ctcttacccccactttattgga

SEQ ID NO: 4886 - DNA, 22 bp, Artificial sequence
  SiRNA target sequence
tcttacccccactttattggaa

SEQ ID NO: 4887 - DNA, 22 bp, Artificial sequence
  SiRNA target sequence
cttacccccactttattggaac

SEQ ID NO: 4888 - DNA, 22 bp, Artificial sequence
  SiRNA target sequence
ttacccccactttattggaact

SEQ ID NO: 4889 - DNA, 22 bp, Artificial sequence
  SiRNA target sequence
tacccccactttattggaactt

SEQ ID NO: 4890 - DNA, 22 bp, Artificial sequence
  SiRNA target sequence
acccccactttattggaactta

SEQ ID NO: 4891 - DNA, 22 bp, Artificial sequence
  SiRNA target sequence
cccccactttattggaacttat

SEQ ID NO: 4892 - DNA, 22 bp, Artificial sequence
  SiRNA target sequence
ccccactttattggaacttatt

SEQ ID NO: 4893 - DNA, 22 bp, Artificial sequence
  SiRNA target sequence
cccactttattggaacttattg

SEQ ID NO: 4894 - DNA, 22 bp, Artificial sequence
  SiRNA target sequence
ccactttattggaacttattgg

SEQ ID NO: 4895 - DNA, 22 bp, Artificial sequence
  SiRNA target sequence
cactttattggaacttattgga

SEQ ID NO: 4896 - DNA, 22 bp, Artificial sequence
  SiRNA target sequence
actttattggaacttattggag

SEQ ID NO: 4897 - DNA, 22 bp, Artificial sequence
  SiRNA target sequence
ctttattggaacttattggaga

SEQ ID NO: 4898 - DNA, 22 bp, Artificial sequence
  SiRNA target sequence
tttattggaacttattggagaa

SEQ ID NO: 4899 - DNA, 22 bp, Artificial sequence
  SiRNA target sequence
ttattggaacttattggagaat

SEQ ID NO: 4900 - DNA, 22 bp, Artificial sequence
  SiRNA target sequence
tattggaacttattggagaata

SEQ ID NO: 4901 - DNA, 22 bp, Artificial sequence
  SiRNA target sequence
attggaacttattggagaatat

SEQ ID NO: 4902 - DNA, 22 bp, Artificial sequence
  SiRNA target sequence
ttggaacttattggagaatatt

SEQ ID NO: 4903 - DNA, 22 bp, Artificial sequence
  SiRNA target sequence
tggaacttattggagaatatta

SEQ ID NO: 4904 - DNA, 22 bp, Artificial sequence
  SiRNA target sequence
ggaacttattggagaatattat

SEQ ID NO: 4905 - DNA, 22 bp, Artificial sequence
  SiRNA target sequence
gaacttattggagaatattatt

SEQ ID NO: 4906 - DNA, 22 bp, Artificial sequence
  SiRNA target sequence
aacttattggagaatattattt

SEQ ID NO: 4907 - DNA, 22 bp, Artificial sequence
  SiRNA target sequence
acttattggagaatattattta

SEQ ID NO: 4908 - DNA, 22 bp, Artificial sequence
  SiRNA target sequence
cttattggagaatattatttaa

SEQ ID NO: 4909 - DNA, 22 bp, Artificial sequence
  SiRNA target sequence
ttattggagaatattatttaaa

SEQ ID NO: 4910 - DNA, 22 bp, Artificial sequence
  SiRNA target sequence
tattggagaatattatttaaaa

SEQ ID NO: 4911 - DNA, 22 bp, Artificial sequence
  SiRNA target sequence
attggagaatattatttaaaaa

SEQ ID NO: 4912 - DNA, 22 bp, Artificial sequence
  SiRNA target sequence
ttggagaatattatttaaaaag

SEQ ID NO: 4913 - DNA, 22 bp, Artificial sequence
  SiRNA target sequence
tggagaatattatttaaaaagt

SEQ ID NO: 4914 - DNA, 22 bp, Artificial sequence
  SiRNA target sequence
ggagaatattatttaaaaagtg

SEQ ID NO: 4915 - DNA, 22 bp, Artificial sequence
  SiRNA target sequence
gagaatattatttaaaaagtgg

SEQ ID NO: 4916 - DNA, 22 bp, Artificial sequence
  SiRNA target sequence
agaatattatttaaaaagtgga

SEQ ID NO: 4917 - DNA, 22 bp, Artificial sequence
  SiRNA target sequence
gaatattatttaaaaagtggaa

SEQ ID NO: 4918 - DNA, 22 bp, Artificial sequence
  SiRNA target sequence
aatattatttaaaaagtggaaa

SEQ ID NO: 4919 - DNA, 22 bp, Artificial sequence
  SiRNA target sequence
atattatttaaaaagtggaaat

SEQ ID NO: 4920 - DNA, 22 bp, Artificial sequence
  SiRNA target sequence
tattatttaaaaagtggaaatc

SEQ ID NO: 4921 - DNA, 22 bp, Artificial sequence
  SiRNA target sequence
attatttaaaaagtggaaatca

SEQ ID NO: 4922 - DNA, 22 bp, Artificial sequence
  SiRNA target sequence
ttatttaaaaagtggaaatcac

SEQ ID NO: 4923 - DNA, 22 bp, Artificial sequence
  SiRNA target sequence
tatttaaaaagtggaaatcact

SEQ ID NO: 4924 - DNA, 22 bp, Artificial sequence
  SiRNA target sequence
atttaaaaagtggaaatcactc

SEQ ID NO: 4925 - DNA, 22 bp, Artificial sequence
  SiRNA target sequence
tttaaaaagtggaaatcactct

SEQ ID NO: 4926 - DNA, 22 bp, Artificial sequence
  SiRNA target sequence
ttaaaaagtggaaatcactcta

SEQ ID NO: 4927 - DNA, 22 bp, Artificial sequence
  SiRNA target sequence
taaaaagtggaaatcactctaa

SEQ ID NO: 4928 - DNA, 22 bp, Artificial sequence
  SiRNA target sequence
aaaaagtggaaatcactctaaa

SEQ ID NO: 4929 - DNA, 22 bp, Artificial sequence
  SiRNA target sequence
aaaagtggaaatcactctaaaa

SEQ ID NO: 4930 - DNA, 22 bp, Artificial sequence
  SiRNA target sequence
aaagtggaaatcactctaaaat

SEQ ID NO: 4931 - DNA, 22 bp, Artificial sequence
  SiRNA target sequence
aagtggaaatcactctaaaatg

SEQ ID NO: 4932 - DNA, 22 bp, Artificial sequence
  SiRNA target sequence
agtggaaatcactctaaaatgt

SEQ ID NO: 4933 - DNA, 22 bp, Artificial sequence
  SiRNA target sequence
gtggaaatcactctaaaatgtt

SEQ ID NO: 4934 - DNA, 22 bp, Artificial sequence
  SiRNA target sequence
tggaaatcactctaaaatgtta

SEQ ID NO: 4935 - DNA, 22 bp, Artificial sequence
  SiRNA target sequence
ggaaatcactctaaaatgttag

SEQ ID NO: 4936 - DNA, 22 bp, Artificial sequence
  SiRNA target sequence
gaaatcactctaaaatgttaga

SEQ ID NO: 4937 - DNA, 22 bp, Artificial sequence
  SiRNA target sequence
aaatcactctaaaatgttagat

SEQ ID NO: 4938 - DNA, 22 bp, Artificial sequence
  SiRNA target sequence
aatcactctaaaatgttagatc

SEQ ID NO: 4939 - DNA, 22 bp, Artificial sequence
  SiRNA target sequence
atcactctaaaatgttagatct

SEQ ID NO: 4940 - DNA, 22 bp, Artificial sequence
  SiRNA target sequence
tcactctaaaatgttagatcta

SEQ ID NO: 4941 - DNA, 22 bp, Artificial sequence
  SiRNA target sequence
cactctaaaatgttagatctat

SEQ ID NO: 4942 - DNA, 22 bp, Artificial sequence
  SiRNA target sequence
actctaaaatgttagatctatt

SEQ ID NO: 4943 - DNA, 22 bp, Artificial sequence
  SiRNA target sequence
ctctaaaatgttagatctatta

SEQ ID NO: 4944 - DNA, 22 bp, Artificial sequence
  SiRNA target sequence
tctaaaatgttagatctattat

SEQ ID NO: 4945 - DNA, 22 bp, Artificial sequence
  SiRNA target sequence
ctaaaatgttagatctattatc

SEQ ID NO: 4946 - DNA, 22 bp, Artificial sequence
  SiRNA target sequence
taaaatgttagatctattatct

SEQ ID NO: 4947 - DNA, 22 bp, Artificial sequence
  SiRNA target sequence
aaaatgttagatctattatcta

SEQ ID NO: 4948 - DNA, 22 bp, Artificial sequence
  SiRNA target sequence
aaatgttagatctattatctag

SEQ ID NO: 4949 - DNA, 22 bp, Artificial sequence
  SiRNA target sequence
aatgttagatctattatctagt

SEQ ID NO: 4950 - DNA, 22 bp, Artificial sequence
  SiRNA target sequence
atgttagatctattatctagtc

SEQ ID NO: 4951 - DNA, 22 bp, Artificial sequence
  SiRNA target sequence
tgttagatctattatctagtca

SEQ ID NO: 4952 - DNA, 22 bp, Artificial sequence
  SiRNA target sequence
gttagatctattatctagtcat

SEQ ID NO: 4953 - DNA, 22 bp, Artificial sequence
  SiRNA target sequence
ttagatctattatctagtcatc

SEQ ID NO: 4954 - DNA, 22 bp, Artificial sequence
  SiRNA target sequence
tagatctattatctagtcatcc

SEQ ID NO: 4955 - DNA, 22 bp, Artificial sequence
  SiRNA target sequence
agatctattatctagtcatcca

SEQ ID NO: 4956 - DNA, 22 bp, Artificial sequence
  SiRNA target sequence
gatctattatctagtcatccag

SEQ ID NO: 4957 - DNA, 22 bp, Artificial sequence
  SiRNA target sequence
atctattatctagtcatccaga

SEQ ID NO: 4958 - DNA, 22 bp, Artificial sequence
  SiRNA target sequence
tctattatctagtcatccagat

SEQ ID NO: 4959 - DNA, 22 bp, Artificial sequence
  SiRNA target sequence
ctattatctagtcatccagata

SEQ ID NO: 4960 - DNA, 22 bp, Artificial sequence
  SiRNA target sequence
tattatctagtcatccagatac

SEQ ID NO: 4961 - DNA, 22 bp, Artificial sequence
  SiRNA target sequence
attatctagtcatccagatact

SEQ ID NO: 4962 - DNA, 22 bp, Artificial sequence
  SiRNA target sequence
ttatctagtcatccagatactc

SEQ ID NO: 4963 - DNA, 22 bp, Artificial sequence
  SiRNA target sequence
tatctagtcatccagatactcc

SEQ ID NO: 4964 - DNA, 22 bp, Artificial sequence
  SiRNA target sequence
atctagtcatccagatactcct

SEQ ID NO: 4965 - DNA, 22 bp, Artificial sequence
  SiRNA target sequence
tctagtcatccagatactcctg

SEQ ID NO: 4966 - DNA, 22 bp, Artificial sequence
  SiRNA target sequence
ctagtcatccagatactcctgg

SEQ ID NO: 4967 - DNA, 22 bp, Artificial sequence
  SiRNA target sequence
tagtcatccagatactcctggt

SEQ ID NO: 4968 - DNA, 22 bp, Artificial sequence
  SiRNA target sequence
agtcatccagatactcctggta

SEQ ID NO: 4969 - DNA, 22 bp, Artificial sequence
  SiRNA target sequence
gtcatccagatactcctggtaa

SEQ ID NO: 4970 - DNA, 22 bp, Artificial sequence
  SiRNA target sequence
tcatccagatactcctggtaaa

SEQ ID NO: 4971 - DNA, 22 bp, Artificial sequence
  SiRNA target sequence
catccagatactcctggtaaat

SEQ ID NO: 4972 - DNA, 22 bp, Artificial sequence
  SiRNA target sequence
atccagatactcctggtaaatt

SEQ ID NO: 4973 - DNA, 22 bp, Artificial sequence
  SiRNA target sequence
tccagatactcctggtaaatta

SEQ ID NO: 4974 - DNA, 22 bp, Artificial sequence
  SiRNA target sequence
ccagatactcctggtaaattac

SEQ ID NO: 4975 - DNA, 22 bp, Artificial sequence
  SiRNA target sequence
cagatactcctggtaaattact

SEQ ID NO: 4976 - DNA, 22 bp, Artificial sequence
  SiRNA target sequence
agatactcctggtaaattactt

SEQ ID NO: 4977 - DNA, 22 bp, Artificial sequence
  SiRNA target sequence
gatactcctggtaaattacttt

SEQ ID NO: 4978 - DNA, 22 bp, Artificial sequence
  SiRNA target sequence
atactcctggtaaattactttt

SEQ ID NO: 4979 - DNA, 22 bp, Artificial sequence
  SiRNA target sequence
tactcctggtaaattactttta

SEQ ID NO: 4980 - DNA, 22 bp, Artificial sequence
  SiRNA target sequence
actcctggtaaattacttttaa

SEQ ID NO: 4981 - DNA, 22 bp, Artificial sequence
  SiRNA target sequence
ctcctggtaaattacttttaac

SEQ ID NO: 4982 - DNA, 22 bp, Artificial sequence
  SiRNA target sequence
tcctggtaaattacttttaacg

SEQ ID NO: 4983 - DNA, 22 bp, Artificial sequence
  SiRNA target sequence
cctggtaaattacttttaacgg

SEQ ID NO: 4984 - DNA, 22 bp, Artificial sequence
  SiRNA target sequence
ctggtaaattacttttaacggc

SEQ ID NO: 4985 - DNA, 22 bp, Artificial sequence
  SiRNA target sequence
tggtaaattacttttaacggca

SEQ ID NO: 4986 - DNA, 22 bp, Artificial sequence
  SiRNA target sequence
ggtaaattacttttaacggcac

SEQ ID NO: 4987 - DNA, 22 bp, Artificial sequence
  SiRNA target sequence
gtaaattacttttaacggcact

SEQ ID NO: 4988 - DNA, 22 bp, Artificial sequence
  SiRNA target sequence
taaattacttttaacggcactt

SEQ ID NO: 4989 - DNA, 22 bp, Artificial sequence
  SiRNA target sequence
aaattacttttaacggcacttt

SEQ ID NO: 4990 - DNA, 22 bp, Artificial sequence
  SiRNA target sequence
aattacttttaacggcacttta

SEQ ID NO: 4991 - DNA, 22 bp, Artificial sequence
  SiRNA target sequence
attacttttaacggcactttat

SEQ ID NO: 4992 - DNA, 22 bp, Artificial sequence
  SiRNA target sequence
ttacttttaacggcactttatg

SEQ ID NO: 4993 - DNA, 22 bp, Artificial sequence
  SiRNA target sequence
tacttttaacggcactttatgc

SEQ ID NO: 4994 - DNA, 22 bp, Artificial sequence
  SiRNA target sequence
acttttaacggcactttatgca

SEQ ID NO: 4995 - DNA, 22 bp, Artificial sequence
  SiRNA target sequence
cttttaacggcactttatgcaa

SEQ ID NO: 4996 - DNA, 22 bp, Artificial sequence
  SiRNA target sequence
ttttaacggcactttatgcaat

SEQ ID NO: 4997 - DNA, 22 bp, Artificial sequence
  SiRNA target sequence
tttaacggcactttatgcaata

SEQ ID NO: 4998 - DNA, 22 bp, Artificial sequence
  SiRNA target sequence
ttaacggcactttatgcaataa

SEQ ID NO: 4999 - DNA, 22 bp, Artificial sequence
  SiRNA target sequence
taacggcactttatgcaataag

SEQ ID NO: 5000 - DNA, 22 bp, Artificial sequence
  SiRNA target sequence
aacggcactttatgcaataagt

SEQ ID NO: 5001 - DNA, 22 bp, Artificial sequence
  SiRNA target sequence
acggcactttatgcaataagta

SEQ ID NO: 5002 - DNA, 22 bp, Artificial sequence
  SiRNA target sequence
cggcactttatgcaataagtat

SEQ ID NO: 5003 - DNA, 22 bp, Artificial sequence
  SiRNA target sequence
ggcactttatgcaataagtatt

SEQ ID NO: 5004 - DNA, 22 bp, Artificial sequence
  SiRNA target sequence
gcactttatgcaataagtattg

SEQ ID NO: 5005 - DNA, 22 bp, Artificial sequence
  SiRNA target sequence
cactttatgcaataagtattga

SEQ ID NO: 5006 - DNA, 22 bp, Artificial sequence
  SiRNA target sequence
actttatgcaataagtattgat

SEQ ID NO: 5007 - DNA, 22 bp, Artificial sequence
  SiRNA target sequence
ctttatgcaataagtattgata

SEQ ID NO: 5008 - DNA, 22 bp, Artificial sequence
  SiRNA target sequence
tttatgcaataagtattgataa

SEQ ID NO: 5009 - DNA, 22 bp, Artificial sequence
  SiRNA target sequence
ttatgcaataagtattgataag

SEQ ID NO: 5010 - DNA, 22 bp, Artificial sequence
  SiRNA target sequence
tatgcaataagtattgataaga

SEQ ID NO: 5011 - DNA, 22 bp, Artificial sequence
  SiRNA target sequence
atgcaataagtattgataagaa

SEQ ID NO: 5012 - DNA, 22 bp, Artificial sequence
  SiRNA target sequence
tgcaataagtattgataagaaa

SEQ ID NO: 5013 - DNA, 22 bp, Artificial sequence
  SiRNA target sequence
gcaataagtattgataagaaaa

SEQ ID NO: 5014 - DNA, 22 bp, Artificial sequence
  SiRNA target sequence
caataagtattgataagaaaaa

SEQ ID NO: 5015 - DNA, 22 bp, Artificial sequence
  SiRNA target sequence
aataagtattgataagaaaaag

SEQ ID NO: 5016 - DNA, 22 bp, Artificial sequence
  SiRNA target sequence
ataagtattgataagaaaaagg

SEQ ID NO: 5017 - DNA, 22 bp, Artificial sequence
  SiRNA target sequence
taagtattgataagaaaaagga

SEQ ID NO: 5018 - DNA, 22 bp, Artificial sequence
  SiRNA target sequence
aagtattgataagaaaaaggat

SEQ ID NO: 5019 - DNA, 22 bp, Artificial sequence
  SiRNA target sequence
agtattgataagaaaaaggatg

SEQ ID NO: 5020 - DNA, 22 bp, Artificial sequence
  SiRNA target sequence
gtattgataagaaaaaggatgc

SEQ ID NO: 5021 - DNA, 22 bp, Artificial sequence
  SiRNA target sequence
tattgataagaaaaaggatgct

SEQ ID NO: 5022 - DNA, 22 bp, Artificial sequence
  SiRNA target sequence
attgataagaaaaaggatgcta

SEQ ID NO: 5023 - DNA, 22 bp, Artificial sequence
  SiRNA target sequence
ttgataagaaaaaggatgctat

SEQ ID NO: 5024 - DNA, 22 bp, Artificial sequence
  SiRNA target sequence
tgataagaaaaaggatgctata

SEQ ID NO: 5025 - DNA, 22 bp, Artificial sequence
  SiRNA target sequence
gataagaaaaaggatgctatag

SEQ ID NO: 5026 - DNA, 22 bp, Artificial sequence
  SiRNA target sequence
ataagaaaaaggatgctataga

SEQ ID NO: 5027 - DNA, 22 bp, Artificial sequence
  SiRNA target sequence
taagaaaaaggatgctatagaa

SEQ ID NO: 5028 - DNA, 22 bp, Artificial sequence
  SiRNA target sequence
aagaaaaaggatgctatagaaa

SEQ ID NO: 5029 - DNA, 22 bp, Artificial sequence
  SiRNA target sequence
agaaaaaggatgctatagaaat

SEQ ID NO: 5030 - DNA, 22 bp, Artificial sequence
  SiRNA target sequence
gaaaaaggatgctatagaaatt

SEQ ID NO: 5031 - DNA, 22 bp, Artificial sequence
  SiRNA target sequence
aaaaaggatgctatagaaattt

SEQ ID NO: 5032 - DNA, 22 bp, Artificial sequence
  SiRNA target sequence
aaaaggatgctatagaaatttt

SEQ ID NO: 5033 - DNA, 22 bp, Artificial sequence
  SiRNA target sequence
aaaggatgctatagaaatttta

SEQ ID NO: 5034 - DNA, 22 bp, Artificial sequence
  SiRNA target sequence
aaggatgctatagaaattttat

SEQ ID NO: 5035 - DNA, 22 bp, Artificial sequence
  SiRNA target sequence
aggatgctatagaaattttata

SEQ ID NO: 5036 - DNA, 22 bp, Artificial sequence
  SiRNA target sequence
ggatgctatagaaattttatat

SEQ ID NO: 5037 - DNA, 22 bp, Artificial sequence
  SiRNA target sequence
gatgctatagaaattttatata

SEQ ID NO: 5038 - DNA, 22 bp, Artificial sequence
  SiRNA target sequence
atgctatagaaattttatatag

SEQ ID NO: 5039 - DNA, 22 bp, Artificial sequence
  SiRNA target sequence
tgctatagaaattttatataga

SEQ ID NO: 5040 - DNA, 22 bp, Artificial sequence
  SiRNA target sequence
gctatagaaattttatatagaa

SEQ ID NO: 5041 - DNA, 22 bp, Artificial sequence
  SiRNA target sequence
ctatagaaattttatatagaag

SEQ ID NO: 5042 - DNA, 22 bp, Artificial sequence
  SiRNA target sequence
tatagaaattttatatagaagt

SEQ ID NO: 5043 - DNA, 22 bp, Artificial sequence
  SiRNA target sequence
atagaaattttatatagaagta

SEQ ID NO: 5044 - DNA, 22 bp, Artificial sequence
  SiRNA target sequence
tagaaattttatatagaagtat

SEQ ID NO: 5045 - DNA, 22 bp, Artificial sequence
  SiRNA target sequence
agaaattttatatagaagtata

SEQ ID NO: 5046 - DNA, 22 bp, Artificial sequence
  SiRNA target sequence
gaaattttatatagaagtatat

SEQ ID NO: 5047 - DNA, 22 bp, Artificial sequence
  SiRNA target sequence
aaattttatatagaagtatatc

SEQ ID NO: 5048 - DNA, 22 bp, Artificial sequence
  SiRNA target sequence
aattttatatagaagtatatca

SEQ ID NO: 5049 - DNA, 22 bp, Artificial sequence
  SiRNA target sequence
attttatatagaagtatatcag

SEQ ID NO: 5050 - DNA, 22 bp, Artificial sequence
  SiRNA target sequence
ttttatatagaagtatatcaga

SEQ ID NO: 5051 - DNA, 22 bp, Artificial sequence
  SiRNA target sequence
tttatatagaagtatatcagaa

SEQ ID NO: 5052 - DNA, 22 bp, Artificial sequence
  SiRNA target sequence
ttatatagaagtatatcagaat

SEQ ID NO: 5053 - DNA, 22 bp, Artificial sequence
  SiRNA target sequence
tatatagaagtatatcagaata

SEQ ID NO: 5054 - DNA, 22 bp, Artificial sequence
  SiRNA target sequence
atatagaagtatatcagaatat

SEQ ID NO: 5055 - DNA, 22 bp, Artificial sequence
  SiRNA target sequence
tatagaagtatatcagaatatt

SEQ ID NO: 5056 - DNA, 22 bp, Artificial sequence
  SiRNA target sequence
atagaagtatatcagaatattc

SEQ ID NO: 5057 - DNA, 22 bp, Artificial sequence
  SiRNA target sequence
tagaagtatatcagaatattca

SEQ ID NO: 5058 - DNA, 22 bp, Artificial sequence
  SiRNA target sequence
agaagtatatcagaatattcat

SEQ ID NO: 5059 - DNA, 22 bp, Artificial sequence
  SiRNA target sequence
gaagtatatcagaatattcatc

SEQ ID NO: 5060 - DNA, 22 bp, Artificial sequence
  SiRNA target sequence
aagtatatcagaatattcatct

SEQ ID NO: 5061 - DNA, 22 bp, Artificial sequence
  SiRNA target sequence
agtatatcagaatattcatctt

SEQ ID NO: 5062 - DNA, 22 bp, Artificial sequence
  SiRNA target sequence
gtatatcagaatattcatctta

SEQ ID NO: 5063 - DNA, 22 bp, Artificial sequence
  SiRNA target sequence
tatatcagaatattcatcttat

SEQ ID NO: 5064 - DNA, 22 bp, Artificial sequence
  SiRNA target sequence
atatcagaatattcatcttatt

SEQ ID NO: 5065 - DNA, 22 bp, Artificial sequence
  SiRNA target sequence
tatcagaatattcatcttattt

SEQ ID NO: 5066 - DNA, 22 bp, Artificial sequence
  SiRNA target sequence
atcagaatattcatcttatttt

SEQ ID NO: 5067 - DNA, 22 bp, Artificial sequence
  SiRNA target sequence
tcagaatattcatcttatttta

SEQ ID NO: 5068 - DNA, 22 bp, Artificial sequence
  SiRNA target sequence
cagaatattcatcttattttaa

SEQ ID NO: 5069 - DNA, 22 bp, Artificial sequence
  SiRNA target sequence
agaatattcatcttattttaaa

SEQ ID NO: 5070 - DNA, 22 bp, Artificial sequence
  SiRNA target sequence
gaatattcatcttattttaaat

SEQ ID NO: 5071 - DNA, 22 bp, Artificial sequence
  SiRNA target sequence
aatattcatcttattttaaatc

SEQ ID NO: 5072 - DNA, 22 bp, Artificial sequence
  SiRNA target sequence
atattcatcttattttaaatct

SEQ ID NO: 5073 - DNA, 22 bp, Artificial sequence
  SiRNA target sequence
tattcatcttattttaaatctt

SEQ ID NO: 5074 - DNA, 22 bp, Artificial sequence
  SiRNA target sequence
attcatcttattttaaatctta

SEQ ID NO: 5075 - DNA, 22 bp, Artificial sequence
  SiRNA target sequence
ttcatcttattttaaatcttat

SEQ ID NO: 5076 - DNA, 22 bp, Artificial sequence
  SiRNA target sequence
tcatcttattttaaatcttatt

SEQ ID NO: 5077 - DNA, 22 bp, Artificial sequence
  SiRNA target sequence
catcttattttaaatcttattt

SEQ ID NO: 5078 - DNA, 22 bp, Artificial sequence
  SiRNA target sequence
atcttattttaaatcttatttg

SEQ ID NO: 5079 - DNA, 22 bp, Artificial sequence
  SiRNA target sequence
tcttattttaaatcttatttgt

SEQ ID NO: 5080 - DNA, 22 bp, Artificial sequence
  SiRNA target sequence
cttattttaaatcttatttgta

SEQ ID NO: 5081 - DNA, 22 bp, Artificial sequence
  SiRNA target sequence
ttattttaaatcttatttgtat

SEQ ID NO: 5082 - DNA, 22 bp, Artificial sequence
  SiRNA target sequence
tattttaaatcttatttgtatt

SEQ ID NO: 5083 - DNA, 22 bp, Artificial sequence
  SiRNA target sequence
attttaaatcttatttgtattt

SEQ ID NO: 5084 - DNA, 22 bp, Artificial sequence
  SiRNA target sequence
ttttaaatcttatttgtattta

SEQ ID NO: 5085 - DNA, 22 bp, Artificial sequence
  SiRNA target sequence
tttaaatcttatttgtatttag

SEQ ID NO: 5086 - DNA, 22 bp, Artificial sequence
  SiRNA target sequence
ttaaatcttatttgtatttagg

SEQ ID NO: 5087 - DNA, 22 bp, Artificial sequence
  SiRNA target sequence
taaatcttatttgtatttagga

SEQ ID NO: 5088 - DNA, 22 bp, Artificial sequence
  SiRNA target sequence
aaatcttatttgtatttaggaa

SEQ ID NO: 5089 - DNA, 22 bp, Artificial sequence
  SiRNA target sequence
aatcttatttgtatttaggaaa

SEQ ID NO: 5090 - DNA, 22 bp, Artificial sequence
  SiRNA target sequence
atcttatttgtatttaggaaat

SEQ ID NO: 5091 - DNA, 22 bp, Artificial sequence
  SiRNA target sequence
tcttatttgtatttaggaaata

SEQ ID NO: 5092 - DNA, 22 bp, Artificial sequence
  SiRNA target sequence
cttatttgtatttaggaaatat

SEQ ID NO: 5093 - DNA, 22 bp, Artificial sequence
  SiRNA target sequence
ttatttgtatttaggaaatatt

SEQ ID NO: 5094 - DNA, 22 bp, Artificial sequence
  SiRNA target sequence
tatttgtatttaggaaatattt

SEQ ID NO: 5095 - DNA, 22 bp, Artificial sequence
  SiRNA target sequence
atttgtatttaggaaatatttt

SEQ ID NO: 5096 - DNA, 22 bp, Artificial sequence
  SiRNA target sequence
tttgtatttaggaaatatttta

SEQ ID NO: 5097 - DNA, 22 bp, Artificial sequence
  SiRNA target sequence
ttgtatttaggaaatattttaa

SEQ ID NO: 5098 - DNA, 22 bp, Artificial sequence
  SiRNA target sequence
tgtatttaggaaatattttaat

SEQ ID NO: 5099 - DNA, 22 bp, Artificial sequence
  SiRNA target sequence
gtatttaggaaatattttaata

SEQ ID NO: 5100 - DNA, 22 bp, Artificial sequence
  SiRNA target sequence
tatttaggaaatattttaataa

SEQ ID NO: 5101 - DNA, 22 bp, Artificial sequence
  SiRNA target sequence
atttaggaaatattttaataaa

SEQ ID NO: 5102 - DNA, 22 bp, Artificial sequence
  SiRNA target sequence
tttaggaaatattttaataaat

SEQ ID NO: 5103 - DNA, 22 bp, Artificial sequence
  SiRNA target sequence
ttaggaaatattttaataaatg

SEQ ID NO: 5104 - DNA, 22 bp, Artificial sequence
  SiRNA target sequence
taggaaatattttaataaatga

SEQ ID NO: 5105 - DNA, 22 bp, Artificial sequence
  SiRNA target sequence
aggaaatattttaataaatgat

SEQ ID NO: 5106 - DNA, 22 bp, Artificial sequence
  SiRNA target sequence
ggaaatattttaataaatgatg

SEQ ID NO: 5107 - DNA, 22 bp, Artificial sequence
  SiRNA target sequence
gaaatattttaataaatgatga

SEQ ID NO: 5108 - DNA, 22 bp, Artificial sequence
  SiRNA target sequence
aaatattttaataaatgatgac

SEQ ID NO: 5109 - DNA, 22 bp, Artificial sequence
  SiRNA target sequence
aatattttaataaatgatgact

SEQ ID NO: 5110 - DNA, 22 bp, Artificial sequence
  SiRNA target sequence
atattttaataaatgatgactt

SEQ ID NO: 5111 - DNA, 22 bp, Artificial sequence
  SiRNA target sequence
tattttaataaatgatgactta

SEQ ID NO: 5112 - DNA, 22 bp, Artificial sequence
  SiRNA target sequence
attttaataaatgatgacttaa

SEQ ID NO: 5113 - DNA, 22 bp, Artificial sequence
  SiRNA target sequence
ttttaataaatgatgacttaaa

SEQ ID NO: 5114 - DNA, 22 bp, Artificial sequence
  SiRNA target sequence
tttaataaatgatgacttaaat

SEQ ID NO: 5115 - DNA, 22 bp, Artificial sequence
  SiRNA target sequence
ttaataaatgatgacttaaatg

SEQ ID NO: 5116 - DNA, 22 bp, Artificial sequence
  SiRNA target sequence
taataaatgatgacttaaatga

SEQ ID NO: 5117 - DNA, 22 bp, Artificial sequence
  SiRNA target sequence
aataaatgatgacttaaatgaa

SEQ ID NO: 5118 - DNA, 22 bp, Artificial sequence
  SiRNA target sequence
ataaatgatgacttaaatgaat

SEQ ID NO: 5119 - DNA, 22 bp, Artificial sequence
  SiRNA target sequence
taaatgatgacttaaatgaatg

SEQ ID NO: 5120 - DNA, 22 bp, Artificial sequence
  SiRNA target sequence
aaatgatgacttaaatgaatgc

SEQ ID NO: 5121 - DNA, 22 bp, Artificial sequence
  SiRNA target sequence
aatgatgacttaaatgaatgca

SEQ ID NO: 5122 - DNA, 22 bp, Artificial sequence
  SiRNA target sequence
atgatgacttaaatgaatgcag

SEQ ID NO: 5123 - DNA, 22 bp, Artificial sequence
  SiRNA target sequence
tgatgacttaaatgaatgcagg

SEQ ID NO: 5124 - DNA, 22 bp, Artificial sequence
  SiRNA target sequence
gatgacttaaatgaatgcagga

SEQ ID NO: 5125 - DNA, 22 bp, Artificial sequence
  SiRNA target sequence
atgacttaaatgaatgcaggaa

SEQ ID NO: 5126 - DNA, 22 bp, Artificial sequence
  SiRNA target sequence
tgacttaaatgaatgcaggaaa

SEQ ID NO: 5127 - DNA, 22 bp, Artificial sequence
  SiRNA target sequence
gacttaaatgaatgcaggaaat

SEQ ID NO: 5128 - DNA, 22 bp, Artificial sequence
  SiRNA target sequence
acttaaatgaatgcaggaaatt

SEQ ID NO: 5129 - DNA, 22 bp, Artificial sequence
  SiRNA target sequence
cttaaatgaatgcaggaaattg

SEQ ID NO: 5130 - DNA, 22 bp, Artificial sequence
  SiRNA target sequence
ttaaatgaatgcaggaaattgt

SEQ ID NO: 5131 - DNA, 22 bp, Artificial sequence
  SiRNA target sequence
taaatgaatgcaggaaattgtt

SEQ ID NO: 5132 - DNA, 22 bp, Artificial sequence
  SiRNA target sequence
aaatgaatgcaggaaattgttt

SEQ ID NO: 5133 - DNA, 22 bp, Artificial sequence
  SiRNA target sequence
aatgaatgcaggaaattgttta

SEQ ID NO: 5134 - DNA, 22 bp, Artificial sequence
  SiRNA target sequence
atgaatgcaggaaattgtttaa

SEQ ID NO: 5135 - DNA, 22 bp, Artificial sequence
  SiRNA target sequence
tgaatgcaggaaattgtttaat

SEQ ID NO: 5136 - DNA, 22 bp, Artificial sequence
  SiRNA target sequence
gaatgcaggaaattgtttaata

SEQ ID NO: 5137 - DNA, 22 bp, Artificial sequence
  SiRNA target sequence
aatgcaggaaattgtttaatac

SEQ ID NO: 5138 - DNA, 22 bp, Artificial sequence
  SiRNA target sequence
atgcaggaaattgtttaataca

SEQ ID NO: 5139 - DNA, 22 bp, Artificial sequence
  SiRNA target sequence
tgcaggaaattgtttaatacat

SEQ ID NO: 5140 - DNA, 22 bp, Artificial sequence
  SiRNA target sequence
gcaggaaattgtttaatacatc

SEQ ID NO: 5141 - DNA, 22 bp, Artificial sequence
  SiRNA target sequence
caggaaattgtttaatacatca

SEQ ID NO: 5142 - DNA, 22 bp, Artificial sequence
  SiRNA target sequence
aggaaattgtttaatacatcac

SEQ ID NO: 5143 - DNA, 22 bp, Artificial sequence
  SiRNA target sequence
ggaaattgtttaatacatcact

SEQ ID NO: 5144 - DNA, 22 bp, Artificial sequence
  SiRNA target sequence
gaaattgtttaatacatcactt

SEQ ID NO: 5145 - DNA, 22 bp, Artificial sequence
  SiRNA target sequence
aaattgtttaatacatcacttc

SEQ ID NO: 5146 - DNA, 22 bp, Artificial sequence
  SiRNA target sequence
aattgtttaatacatcacttca

SEQ ID NO: 5147 - DNA, 22 bp, Artificial sequence
  SiRNA target sequence
attgtttaatacatcacttcaa

SEQ ID NO: 5148 - DNA, 22 bp, Artificial sequence
  SiRNA target sequence
ttgtttaatacatcacttcaat

SEQ ID NO: 5149 - DNA, 22 bp, Artificial sequence
  SiRNA target sequence
tgtttaatacatcacttcaata

SEQ ID NO: 5150 - DNA, 22 bp, Artificial sequence
  SiRNA target sequence
gtttaatacatcacttcaatat

SEQ ID NO: 5151 - DNA, 22 bp, Artificial sequence
  SiRNA target sequence
tttaatacatcacttcaatatt

SEQ ID NO: 5152 - DNA, 22 bp, Artificial sequence
  SiRNA target sequence
ttaatacatcacttcaatattg

SEQ ID NO: 5153 - DNA, 22 bp, Artificial sequence
  SiRNA target sequence
taatacatcacttcaatattgt

SEQ ID NO: 5154 - DNA, 22 bp, Artificial sequence
  SiRNA target sequence
aatacatcacttcaatattgtt

SEQ ID NO: 5155 - DNA, 22 bp, Artificial sequence
  SiRNA target sequence
atacatcacttcaatattgttg

SEQ ID NO: 5156 - DNA, 22 bp, Artificial sequence
  SiRNA target sequence
tacatcacttcaatattgttgt

SEQ ID NO: 5157 - DNA, 22 bp, Artificial sequence
  SiRNA target sequence
acatcacttcaatattgttgta

SEQ ID NO: 5158 - DNA, 22 bp, Artificial sequence
  SiRNA target sequence
catcacttcaatattgttgtaa

SEQ ID NO: 5159 - DNA, 22 bp, Artificial sequence
  SiRNA target sequence
atcacttcaatattgttgtaat

SEQ ID NO: 5160 - DNA, 22 bp, Artificial sequence
  SiRNA target sequence
tcacttcaatattgttgtaatt

SEQ ID NO: 5161 - DNA, 22 bp, Artificial sequence
  SiRNA target sequence
cacttcaatattgttgtaattc

SEQ ID NO: 5162 - DNA, 22 bp, Artificial sequence
  SiRNA target sequence
acttcaatattgttgtaattct

SEQ ID NO: 5163 - DNA, 22 bp, Artificial sequence
  SiRNA target sequence
cttcaatattgttgtaattctg

SEQ ID NO: 5164 - DNA, 22 bp, Artificial sequence
  SiRNA target sequence
ttcaatattgttgtaattctga

SEQ ID NO: 5165 - DNA, 22 bp, Artificial sequence
  SiRNA target sequence
tcaatattgttgtaattctgat

SEQ ID NO: 5166 - DNA, 22 bp, Artificial sequence
  SiRNA target sequence
caatattgttgtaattctgatg

SEQ ID NO: 5167 - DNA, 22 bp, Artificial sequence
  SiRNA target sequence
aatattgttgtaattctgatga

SEQ ID NO: 5168 - DNA, 22 bp, Artificial sequence
  SiRNA target sequence
atattgttgtaattctgatgag

SEQ ID NO: 5169 - DNA, 22 bp, Artificial sequence
  SiRNA target sequence
tattgttgtaattctgatgagg

SEQ ID NO: 5170 - DNA, 22 bp, Artificial sequence
  SiRNA target sequence
attgttgtaattctgatgaggt

SEQ ID NO: 5171 - DNA, 22 bp, Artificial sequence
  SiRNA target sequence
ttgttgtaattctgatgaggtt

SEQ ID NO: 5172 - DNA, 22 bp, Artificial sequence
  SiRNA target sequence
tgttgtaattctgatgaggttt

SEQ ID NO: 5173 - DNA, 22 bp, Artificial sequence
  SiRNA target sequence
gttgtaattctgatgaggtttt

SEQ ID NO: 5174 - DNA, 22 bp, Artificial sequence
  SiRNA target sequence
ttgtaattctgatgaggttttt

SEQ ID NO: 5175 - DNA, 22 bp, Artificial sequence
  SiRNA target sequence
tgtaattctgatgaggttttta

SEQ ID NO: 5176 - DNA, 22 bp, Artificial sequence
  SiRNA target sequence
gtaattctgatgaggtttttat

SEQ ID NO: 5177 - DNA, 22 bp, Artificial sequence
  SiRNA target sequence
taattctgatgaggtttttatt

SEQ ID NO: 5178 - DNA, 22 bp, Artificial sequence
  SiRNA target sequence
aattctgatgaggtttttattg

SEQ ID NO: 5179 - DNA, 22 bp, Artificial sequence
  SiRNA target sequence
attctgatgaggtttttattgt

SEQ ID NO: 5180 - DNA, 22 bp, Artificial sequence
  SiRNA target sequence
ttctgatgaggtttttattgtt

SEQ ID NO: 5181 - DNA, 22 bp, Artificial sequence
  SiRNA target sequence
tctgatgaggtttttattgtta

SEQ ID NO: 5182 - DNA, 22 bp, Artificial sequence
  SiRNA target sequence
ctgatgaggtttttattgttaa

SEQ ID NO: 5183 - DNA, 22 bp, Artificial sequence
  SiRNA target sequence
tgatgaggtttttattgttaag

SEQ ID NO: 5184 - DNA, 22 bp, Artificial sequence
  SiRNA target sequence
gatgaggtttttattgttaagc

SEQ ID NO: 5185 - DNA, 22 bp, Artificial sequence
  SiRNA target sequence
atgaggtttttattgttaagca

SEQ ID NO: 5186 - DNA, 22 bp, Artificial sequence
  SiRNA target sequence
tgaggtttttattgttaagcag

SEQ ID NO: 5187 - DNA, 22 bp, Artificial sequence
  SiRNA target sequence
gaggtttttattgttaagcagt

SEQ ID NO: 5188 - DNA, 22 bp, Artificial sequence
  SiRNA target sequence
aggtttttattgttaagcagtc

SEQ ID NO: 5189 - DNA, 22 bp, Artificial sequence
  SiRNA target sequence
ggtttttattgttaagcagtca

SEQ ID NO: 5190 - DNA, 22 bp, Artificial sequence
  SiRNA target sequence
gtttttattgttaagcagtcac

SEQ ID NO: 5191 - DNA, 22 bp, Artificial sequence
  SiRNA target sequence
tttttattgttaagcagtcact

SEQ ID NO: 5192 - DNA, 22 bp, Artificial sequence
  SiRNA target sequence
ttttattgttaagcagtcactt

SEQ ID NO: 5193 - DNA, 22 bp, Artificial sequence
  SiRNA target sequence
tttattgttaagcagtcactta

SEQ ID NO: 5194 - DNA, 22 bp, Artificial sequence
  SiRNA target sequence
ttattgttaagcagtcacttat

SEQ ID NO: 5195 - DNA, 22 bp, Artificial sequence
  SiRNA target sequence
tattgttaagcagtcacttatt

SEQ ID NO: 5196 - DNA, 22 bp, Artificial sequence
  SiRNA target sequence
attgttaagcagtcacttattt

SEQ ID NO: 5197 - DNA, 22 bp, Artificial sequence
  SiRNA target sequence
ttgttaagcagtcacttatttt

SEQ ID NO: 5198 - DNA, 22 bp, Artificial sequence
  SiRNA target sequence
tgttaagcagtcacttatttta

SEQ ID NO: 5199 - DNA, 22 bp, Artificial sequence
  SiRNA target sequence
gttaagcagtcacttattttaa

SEQ ID NO: 5200 - DNA, 22 bp, Artificial sequence
  SiRNA target sequence
ttaagcagtcacttattttaat

SEQ ID NO: 5201 - DNA, 22 bp, Artificial sequence
  SiRNA target sequence
taagcagtcacttattttaata

SEQ ID NO: 5202 - DNA, 22 bp, Artificial sequence
  SiRNA target sequence
aagcagtcacttattttaatag

SEQ ID NO: 5203 - DNA, 22 bp, Artificial sequence
  SiRNA target sequence
agcagtcacttattttaataga

SEQ ID NO: 5204 - DNA, 22 bp, Artificial sequence
  SiRNA target sequence
gcagtcacttattttaatagaa

SEQ ID NO: 5205 - DNA, 22 bp, Artificial sequence
  SiRNA target sequence
cagtcacttattttaatagaag

SEQ ID NO: 5206 - DNA, 22 bp, Artificial sequence
  SiRNA target sequence
agtcacttattttaatagaagt

SEQ ID NO: 5207 - DNA, 22 bp, Artificial sequence
  SiRNA target sequence
gtcacttattttaatagaagta

SEQ ID NO: 5208 - DNA, 22 bp, Artificial sequence
  SiRNA target sequence
tcacttattttaatagaagtac

SEQ ID NO: 5209 - DNA, 22 bp, Artificial sequence
  SiRNA target sequence
cacttattttaatagaagtaca

SEQ ID NO: 5210 - DNA, 22 bp, Artificial sequence
  SiRNA target sequence
acttattttaatagaagtacat

SEQ ID NO: 5211 - DNA, 22 bp, Artificial sequence
  SiRNA target sequence
cttattttaatagaagtacatg

SEQ ID NO: 5212 - DNA, 22 bp, Artificial sequence
  SiRNA target sequence
ttattttaatagaagtacatga

SEQ ID NO: 5213 - DNA, 22 bp, Artificial sequence
  SiRNA target sequence
tattttaatagaagtacatgaa

SEQ ID NO: 5214 - DNA, 22 bp, Artificial sequence
  SiRNA target sequence
attttaatagaagtacatgaat

SEQ ID NO: 5215 - DNA, 22 bp, Artificial sequence
  SiRNA target sequence
ttttaatagaagtacatgaata

SEQ ID NO: 5216 - DNA, 22 bp, Artificial sequence
  SiRNA target sequence
tttaatagaagtacatgaatac

SEQ ID NO: 5217 - DNA, 22 bp, Artificial sequence
  SiRNA target sequence
ttaatagaagtacatgaataca

SEQ ID NO: 5218 - DNA, 22 bp, Artificial sequence
  SiRNA target sequence
taatagaagtacatgaatacat

SEQ ID NO: 5219 - DNA, 22 bp, Artificial sequence
  SiRNA target sequence
aatagaagtacatgaatacatc

SEQ ID NO: 5220 - DNA, 22 bp, Artificial sequence
  SiRNA target sequence
atagaagtacatgaatacatca

SEQ ID NO: 5221 - DNA, 22 bp, Artificial sequence
  SiRNA target sequence
tagaagtacatgaatacatcaa

SEQ ID NO: 5222 - DNA, 22 bp, Artificial sequence
  SiRNA target sequence
agaagtacatgaatacatcaaa

SEQ ID NO: 5223 - DNA, 22 bp, Artificial sequence
  SiRNA target sequence
gaagtacatgaatacatcaaag

SEQ ID NO: 5224 - DNA, 22 bp, Artificial sequence
  SiRNA target sequence
aagtacatgaatacatcaaaga

SEQ ID NO: 5225 - DNA, 22 bp, Artificial sequence
  SiRNA target sequence
agtacatgaatacatcaaagaa

SEQ ID NO: 5226 - DNA, 22 bp, Artificial sequence
  SiRNA target sequence
gtacatgaatacatcaaagaaa

SEQ ID NO: 5227 - DNA, 22 bp, Artificial sequence
  SiRNA target sequence
tacatgaatacatcaaagaaaa

SEQ ID NO: 5228 - DNA, 22 bp, Artificial sequence
  SiRNA target sequence
acatgaatacatcaaagaaaat

SEQ ID NO: 5229 - DNA, 22 bp, Artificial sequence
  SiRNA target sequence
catgaatacatcaaagaaaata

SEQ ID NO: 5230 - DNA, 22 bp, Artificial sequence
  SiRNA target sequence
atgaatacatcaaagaaaataa

SEQ ID NO: 5231 - DNA, 22 bp, Artificial sequence
  SiRNA target sequence
tgaatacatcaaagaaaataaa

SEQ ID NO: 5232 - DNA, 22 bp, Artificial sequence
  SiRNA target sequence
gaatacatcaaagaaaataaaa

SEQ ID NO: 5233 - DNA, 22 bp, Artificial sequence
  SiRNA target sequence
aatacatcaaagaaaataaaat

SEQ ID NO: 5234 - DNA, 22 bp, Artificial sequence
  SiRNA target sequence
atacatcaaagaaaataaaata

SEQ ID NO: 5235 - DNA, 22 bp, Artificial sequence
  SiRNA target sequence
tacatcaaagaaaataaaatat

SEQ ID NO: 5236 - DNA, 22 bp, Artificial sequence
  SiRNA target sequence
acatcaaagaaaataaaatata

SEQ ID NO: 5237 - DNA, 22 bp, Artificial sequence
  SiRNA target sequence
catcaaagaaaataaaatataa

SEQ ID NO: 5238 - DNA, 23 bp, Artificial sequence
  SiRNA target sequence
atgaaacgaaaaacagaaatatt

SEQ ID NO: 5239 - DNA, 23 bp, Artificial sequence
  SiRNA target sequence
tgaaacgaaaaacagaaatattt

SEQ ID NO: 5240 - DNA, 23 bp, Artificial sequence
  SiRNA target sequence
gaaacgaaaaacagaaatattta

SEQ ID NO: 5241 - DNA, 23 bp, Artificial sequence
  SiRNA target sequence
aaacgaaaaacagaaatatttat

SEQ ID NO: 5242 - DNA, 23 bp, Artificial sequence
  SiRNA target sequence
aacgaaaaacagaaatatttatt

SEQ ID NO: 5243 - DNA, 23 bp, Artificial sequence
  SiRNA target sequence
acgaaaaacagaaatatttattg

SEQ ID NO: 5244 - DNA, 23 bp, Artificial sequence
  SiRNA target sequence
cgaaaaacagaaatatttattgc

SEQ ID NO: 5245 - DNA, 23 bp, Artificial sequence
  SiRNA target sequence
gaaaaacagaaatatttattgct

SEQ ID NO: 5246 - DNA, 23 bp, Artificial sequence
  SiRNA target sequence
aaaaacagaaatatttattgcta

SEQ ID NO: 5247 - DNA, 23 bp, Artificial sequence
  SiRNA target sequence
aaaacagaaatatttattgctat

SEQ ID NO: 5248 - DNA, 23 bp, Artificial sequence
  SiRNA target sequence
aaacagaaatatttattgctatt

SEQ ID NO: 5249 - DNA, 23 bp, Artificial sequence
  SiRNA target sequence
aacagaaatatttattgctatta

SEQ ID NO: 5250 - DNA, 23 bp, Artificial sequence
  SiRNA target sequence
acagaaatatttattgctattac

SEQ ID NO: 5251 - DNA, 23 bp, Artificial sequence
  SiRNA target sequence
cagaaatatttattgctattaca

SEQ ID NO: 5252 - DNA, 23 bp, Artificial sequence
  SiRNA target sequence
agaaatatttattgctattacag

SEQ ID NO: 5253 - DNA, 23 bp, Artificial sequence
  SiRNA target sequence
gaaatatttattgctattacagt

SEQ ID NO: 5254 - DNA, 23 bp, Artificial sequence
  SiRNA target sequence
aaatatttattgctattacagta

SEQ ID NO: 5255 - DNA, 23 bp, Artificial sequence
  SiRNA target sequence
aatatttattgctattacagtag

SEQ ID NO: 5256 - DNA, 23 bp, Artificial sequence
  SiRNA target sequence
atatttattgctattacagtagt

SEQ ID NO: 5257 - DNA, 23 bp, Artificial sequence
  SiRNA target sequence
tatttattgctattacagtagtc

SEQ ID NO: 5258 - DNA, 23 bp, Artificial sequence
  SiRNA target sequence
atttattgctattacagtagtca

SEQ ID NO: 5259 - DNA, 23 bp, Artificial sequence
  SiRNA target sequence
tttattgctattacagtagtcac

SEQ ID NO: 5260 - DNA, 23 bp, Artificial sequence
  SiRNA target sequence
ttattgctattacagtagtcact

SEQ ID NO: 5261 - DNA, 23 bp, Artificial sequence
  SiRNA target sequence
tattgctattacagtagtcactg

SEQ ID NO: 5262 - DNA, 23 bp, Artificial sequence
  SiRNA target sequence
attgctattacagtagtcactgc

SEQ ID NO: 5263 - DNA, 23 bp, Artificial sequence
  SiRNA target sequence
ttgctattacagtagtcactgca

SEQ ID NO: 5264 - DNA, 23 bp, Artificial sequence
  SiRNA target sequence
tgctattacagtagtcactgcag

SEQ ID NO: 5265 - DNA, 23 bp, Artificial sequence
  SiRNA target sequence
gctattacagtagtcactgcagt

SEQ ID NO: 5266 - DNA, 23 bp, Artificial sequence
  SiRNA target sequence
ctattacagtagtcactgcagtg

SEQ ID NO: 5267 - DNA, 23 bp, Artificial sequence
  SiRNA target sequence
tattacagtagtcactgcagtga

SEQ ID NO: 5268 - DNA, 23 bp, Artificial sequence
  SiRNA target sequence
attacagtagtcactgcagtgac

SEQ ID NO: 5269 - DNA, 23 bp, Artificial sequence
  SiRNA target sequence
ttacagtagtcactgcagtgaca

SEQ ID NO: 5270 - DNA, 23 bp, Artificial sequence
  SiRNA target sequence
tacagtagtcactgcagtgacat

SEQ ID NO: 5271 - DNA, 23 bp, Artificial sequence
  SiRNA target sequence
acagtagtcactgcagtgacatg

SEQ ID NO: 5272 - DNA, 23 bp, Artificial sequence
  SiRNA target sequence
cagtagtcactgcagtgacatgt

SEQ ID NO: 5273 - DNA, 23 bp, Artificial sequence
  SiRNA target sequence
agtagtcactgcagtgacatgtt

SEQ ID NO: 5274 - DNA, 23 bp, Artificial sequence
  SiRNA target sequence
gtagtcactgcagtgacatgtta

SEQ ID NO: 5275 - DNA, 23 bp, Artificial sequence
  SiRNA target sequence
tagtcactgcagtgacatgttac

SEQ ID NO: 5276 - DNA, 23 bp, Artificial sequence
  SiRNA target sequence
agtcactgcagtgacatgttact

SEQ ID NO: 5277 - DNA, 23 bp, Artificial sequence
  SiRNA target sequence
gtcactgcagtgacatgttactt

SEQ ID NO: 5278 - DNA, 23 bp, Artificial sequence
  SiRNA target sequence
tcactgcagtgacatgttactta

SEQ ID NO: 5279 - DNA, 23 bp, Artificial sequence
  SiRNA target sequence
cactgcagtgacatgttacttat

SEQ ID NO: 5280 - DNA, 23 bp, Artificial sequence
  SiRNA target sequence
actgcagtgacatgttacttatt

SEQ ID NO: 5281 - DNA, 23 bp, Artificial sequence
  SiRNA target sequence
ctgcagtgacatgttacttattt

SEQ ID NO: 5282 - DNA, 23 bp, Artificial sequence
  SiRNA target sequence
tgcagtgacatgttacttattta

SEQ ID NO: 5283 - DNA, 23 bp, Artificial sequence
  SiRNA target sequence
gcagtgacatgttacttatttaa

SEQ ID NO: 5284 - DNA, 23 bp, Artificial sequence
  SiRNA target sequence
cagtgacatgttacttatttaaa

SEQ ID NO: 5285 - DNA, 23 bp, Artificial sequence
  SiRNA target sequence
agtgacatgttacttatttaaaa

SEQ ID NO: 5286 - DNA, 23 bp, Artificial sequence
  SiRNA target sequence
gtgacatgttacttatttaaaaa

SEQ ID NO: 5287 - DNA, 23 bp, Artificial sequence
  SiRNA target sequence
tgacatgttacttatttaaaaaa

SEQ ID NO: 5288 - DNA, 23 bp, Artificial sequence
  SiRNA target sequence
gacatgttacttatttaaaaaaa

SEQ ID NO: 5289 - DNA, 23 bp, Artificial sequence
  SiRNA target sequence
acatgttacttatttaaaaaaat

SEQ ID NO: 5290 - DNA, 23 bp, Artificial sequence
  SiRNA target sequence
catgttacttatttaaaaaaata

SEQ ID NO: 5291 - DNA, 23 bp, Artificial sequence
  SiRNA target sequence
atgttacttatttaaaaaaataa

SEQ ID NO: 5292 - DNA, 23 bp, Artificial sequence
  SiRNA target sequence
tgttacttatttaaaaaaataat

SEQ ID NO: 5293 - DNA, 23 bp, Artificial sequence
  SiRNA target sequence
gttacttatttaaaaaaataata

SEQ ID NO: 5294 - DNA, 23 bp, Artificial sequence
  SiRNA target sequence
ttacttatttaaaaaaataataa

SEQ ID NO: 5295 - DNA, 23 bp, Artificial sequence
  SiRNA target sequence
tacttatttaaaaaaataataaa

SEQ ID NO: 5296 - DNA, 23 bp, Artificial sequence
  SiRNA target sequence
acttatttaaaaaaataataaat

SEQ ID NO: 5297 - DNA, 23 bp, Artificial sequence
  SiRNA target sequence
cttatttaaaaaaataataaata

SEQ ID NO: 5298 - DNA, 23 bp, Artificial sequence
  SiRNA target sequence
ttatttaaaaaaataataaatag

SEQ ID NO: 5299 - DNA, 23 bp, Artificial sequence
  SiRNA target sequence
tatttaaaaaaataataaataga

SEQ ID NO: 5300 - DNA, 23 bp, Artificial sequence
  SiRNA target sequence
atttaaaaaaataataaatagac

SEQ ID NO: 5301 - DNA, 23 bp, Artificial sequence
  SiRNA target sequence
tttaaaaaaataataaatagaca

SEQ ID NO: 5302 - DNA, 23 bp, Artificial sequence
  SiRNA target sequence
ttaaaaaaataataaatagacaa

SEQ ID NO: 5303 - DNA, 23 bp, Artificial sequence
  SiRNA target sequence
taaaaaaataataaatagacaaa

SEQ ID NO: 5304 - DNA, 23 bp, Artificial sequence
  SiRNA target sequence
aaaaaaataataaatagacaaaa

SEQ ID NO: 5305 - DNA, 23 bp, Artificial sequence
  SiRNA target sequence
aaaaaataataaatagacaaaag

SEQ ID NO: 5306 - DNA, 23 bp, Artificial sequence
  SiRNA target sequence
aaaaataataaatagacaaaagt

SEQ ID NO: 5307 - DNA, 23 bp, Artificial sequence
  SiRNA target sequence
aaaataataaatagacaaaagtc

SEQ ID NO: 5308 - DNA, 23 bp, Artificial sequence
  SiRNA target sequence
aaataataaatagacaaaagtct

SEQ ID NO: 5309 - DNA, 23 bp, Artificial sequence
  SiRNA target sequence
aataataaatagacaaaagtctg

SEQ ID NO: 5310 - DNA, 23 bp, Artificial sequence
  SiRNA target sequence
ataataaatagacaaaagtctga

SEQ ID NO: 5311 - DNA, 23 bp, Artificial sequence
  SiRNA target sequence
taataaatagacaaaagtctgat

SEQ ID NO: 5312 - DNA, 23 bp, Artificial sequence
  SiRNA target sequence
aataaatagacaaaagtctgatt

SEQ ID NO: 5313 - DNA, 23 bp, Artificial sequence
  SiRNA target sequence
ataaatagacaaaagtctgatta

SEQ ID NO: 5314 - DNA, 23 bp, Artificial sequence
  SiRNA target sequence
taaatagacaaaagtctgattat

SEQ ID NO: 5315 - DNA, 23 bp, Artificial sequence
  SiRNA target sequence
aaatagacaaaagtctgattata

SEQ ID NO: 5316 - DNA, 23 bp, Artificial sequence
  SiRNA target sequence
aatagacaaaagtctgattatac

SEQ ID NO: 5317 - DNA, 23 bp, Artificial sequence
  SiRNA target sequence
atagacaaaagtctgattataca

SEQ ID NO: 5318 - DNA, 23 bp, Artificial sequence
  SiRNA target sequence
tagacaaaagtctgattatacat

SEQ ID NO: 5319 - DNA, 23 bp, Artificial sequence
  SiRNA target sequence
agacaaaagtctgattatacatc

SEQ ID NO: 5320 - DNA, 23 bp, Artificial sequence
  SiRNA target sequence
gacaaaagtctgattatacatca

SEQ ID NO: 5321 - DNA, 23 bp, Artificial sequence
  SiRNA target sequence
acaaaagtctgattatacatcaa

SEQ ID NO: 5322 - DNA, 23 bp, Artificial sequence
  SiRNA target sequence
caaaagtctgattatacatcaat

SEQ ID NO: 5323 - DNA, 23 bp, Artificial sequence
  SiRNA target sequence
aaaagtctgattatacatcaata

SEQ ID NO: 5324 - DNA, 23 bp, Artificial sequence
  SiRNA target sequence
aaagtctgattatacatcaataa

SEQ ID NO: 5325 - DNA, 23 bp, Artificial sequence
  SiRNA target sequence
aagtctgattatacatcaataaa

SEQ ID NO: 5326 - DNA, 23 bp, Artificial sequence
  SiRNA target sequence
agtctgattatacatcaataaaa

SEQ ID NO: 5327 - DNA, 23 bp, Artificial sequence
  SiRNA target sequence
gtctgattatacatcaataaaac

SEQ ID NO: 5328 - DNA, 23 bp, Artificial sequence
  SiRNA target sequence
tctgattatacatcaataaaaca

SEQ ID NO: 5329 - DNA, 23 bp, Artificial sequence
  SiRNA target sequence
ctgattatacatcaataaaacag

SEQ ID NO: 5330 - DNA, 23 bp, Artificial sequence
  SiRNA target sequence
tgattatacatcaataaaacagg

SEQ ID NO: 5331 - DNA, 23 bp, Artificial sequence
  SiRNA target sequence
gattatacatcaataaaacagga

SEQ ID NO: 5332 - DNA, 23 bp, Artificial sequence
  SiRNA target sequence
attatacatcaataaaacaggaa

SEQ ID NO: 5333 - DNA, 23 bp, Artificial sequence
  SiRNA target sequence
ttatacatcaataaaacaggaag

SEQ ID NO: 5334 - DNA, 23 bp, Artificial sequence
  SiRNA target sequence
tatacatcaataaaacaggaagc

SEQ ID NO: 5335 - DNA, 23 bp, Artificial sequence
  SiRNA target sequence
atacatcaataaaacaggaagca

SEQ ID NO: 5336 - DNA, 23 bp, Artificial sequence
  SiRNA target sequence
tacatcaataaaacaggaagcag

SEQ ID NO: 5337 - DNA, 23 bp, Artificial sequence
  SiRNA target sequence
acatcaataaaacaggaagcaga

SEQ ID NO: 5338 - DNA, 23 bp, Artificial sequence
  SiRNA target sequence
catcaataaaacaggaagcagat

SEQ ID NO: 5339 - DNA, 23 bp, Artificial sequence
  SiRNA target sequence
atcaataaaacaggaagcagata

SEQ ID NO: 5340 - DNA, 23 bp, Artificial sequence
  SiRNA target sequence
tcaataaaacaggaagcagataa

SEQ ID NO: 5341 - DNA, 23 bp, Artificial sequence
  SiRNA target sequence
caataaaacaggaagcagataaa

SEQ ID NO: 5342 - DNA, 23 bp, Artificial sequence
  SiRNA target sequence
aataaaacaggaagcagataaat

SEQ ID NO: 5343 - DNA, 23 bp, Artificial sequence
  SiRNA target sequence
ataaaacaggaagcagataaata

SEQ ID NO: 5344 - DNA, 23 bp, Artificial sequence
  SiRNA target sequence
taaaacaggaagcagataaatat

SEQ ID NO: 5345 - DNA, 23 bp, Artificial sequence
  SiRNA target sequence
aaaacaggaagcagataaatatt

SEQ ID NO: 5346 - DNA, 23 bp, Artificial sequence
  SiRNA target sequence
aaacaggaagcagataaatattt

SEQ ID NO: 5347 - DNA, 23 bp, Artificial sequence
  SiRNA target sequence
aacaggaagcagataaatatttt

SEQ ID NO: 5348 - DNA, 23 bp, Artificial sequence
  SiRNA target sequence
acaggaagcagataaatatttta

SEQ ID NO: 5349 - DNA, 23 bp, Artificial sequence
  SiRNA target sequence
caggaagcagataaatattttat

SEQ ID NO: 5350 - DNA, 23 bp, Artificial sequence
  SiRNA target sequence
aggaagcagataaatattttata

SEQ ID NO: 5351 - DNA, 23 bp, Artificial sequence
  SiRNA target sequence
ggaagcagataaatattttatac

SEQ ID NO: 5352 - DNA, 23 bp, Artificial sequence
  SiRNA target sequence
gaagcagataaatattttataca

SEQ ID NO: 5353 - DNA, 23 bp, Artificial sequence
  SiRNA target sequence
aagcagataaatattttatacaa

SEQ ID NO: 5354 - DNA, 23 bp, Artificial sequence
  SiRNA target sequence
agcagataaatattttatacaag

SEQ ID NO: 5355 - DNA, 23 bp, Artificial sequence
  SiRNA target sequence
gcagataaatattttatacaaga

SEQ ID NO: 5356 - DNA, 23 bp, Artificial sequence
  SiRNA target sequence
cagataaatattttatacaagaa

SEQ ID NO: 5357 - DNA, 23 bp, Artificial sequence
  SiRNA target sequence
agataaatattttatacaagaag

SEQ ID NO: 5358 - DNA, 23 bp, Artificial sequence
  SiRNA target sequence
gataaatattttatacaagaaga

SEQ ID NO: 5359 - DNA, 23 bp, Artificial sequence
  SiRNA target sequence
ataaatattttatacaagaagat

SEQ ID NO: 5360 - DNA, 23 bp, Artificial sequence
  SiRNA target sequence
taaatattttatacaagaagatt

SEQ ID NO: 5361 - DNA, 23 bp, Artificial sequence
  SiRNA target sequence
aaatattttatacaagaagatta

SEQ ID NO: 5362 - DNA, 23 bp, Artificial sequence
  SiRNA target sequence
aatattttatacaagaagattat

SEQ ID NO: 5363 - DNA, 23 bp, Artificial sequence
  SiRNA target sequence
atattttatacaagaagattata

SEQ ID NO: 5364 - DNA, 23 bp, Artificial sequence
  SiRNA target sequence
tattttatacaagaagattataa

SEQ ID NO: 5365 - DNA, 23 bp, Artificial sequence
  SiRNA target sequence
attttatacaagaagattataaa

SEQ ID NO: 5366 - DNA, 23 bp, Artificial sequence
  SiRNA target sequence
ttttatacaagaagattataaaa

SEQ ID NO: 5367 - DNA, 23 bp, Artificial sequence
  SiRNA target sequence
tttatacaagaagattataaaaa

SEQ ID NO: 5368 - DNA, 23 bp, Artificial sequence
  SiRNA target sequence
ttatacaagaagattataaaaat

SEQ ID NO: 5369 - DNA, 23 bp, Artificial sequence
  SiRNA target sequence
tatacaagaagattataaaaatg

SEQ ID NO: 5370 - DNA, 23 bp, Artificial sequence
  SiRNA target sequence
atacaagaagattataaaaatgc

SEQ ID NO: 5371 - DNA, 23 bp, Artificial sequence
  SiRNA target sequence
tacaagaagattataaaaatgct

SEQ ID NO: 5372 - DNA, 23 bp, Artificial sequence
  SiRNA target sequence
acaagaagattataaaaatgcta

SEQ ID NO: 5373 - DNA, 23 bp, Artificial sequence
  SiRNA target sequence
caagaagattataaaaatgctat

SEQ ID NO: 5374 - DNA, 23 bp, Artificial sequence
  SiRNA target sequence
aagaagattataaaaatgctatt

SEQ ID NO: 5375 - DNA, 23 bp, Artificial sequence
  SiRNA target sequence
agaagattataaaaatgctattc

SEQ ID NO: 5376 - DNA, 23 bp, Artificial sequence
  SiRNA target sequence
gaagattataaaaatgctattct

SEQ ID NO: 5377 - DNA, 23 bp, Artificial sequence
  SiRNA target sequence
aagattataaaaatgctattctg

SEQ ID NO: 5378 - DNA, 23 bp, Artificial sequence
  SiRNA target sequence
agattataaaaatgctattctgt

SEQ ID NO: 5379 - DNA, 23 bp, Artificial sequence
  SiRNA target sequence
gattataaaaatgctattctgtt

SEQ ID NO: 5380 - DNA, 23 bp, Artificial sequence
  SiRNA target sequence
attataaaaatgctattctgttg

SEQ ID NO: 5381 - DNA, 23 bp, Artificial sequence
  SiRNA target sequence
ttataaaaatgctattctgttgt

SEQ ID NO: 5382 - DNA, 23 bp, Artificial sequence
  SiRNA target sequence
tataaaaatgctattctgttgta

SEQ ID NO: 5383 - DNA, 23 bp, Artificial sequence
  SiRNA target sequence
ataaaaatgctattctgttgtac

SEQ ID NO: 5384 - DNA, 23 bp, Artificial sequence
  SiRNA target sequence
taaaaatgctattctgttgtaca

SEQ ID NO: 5385 - DNA, 23 bp, Artificial sequence
  SiRNA target sequence
aaaaatgctattctgttgtacac

SEQ ID NO: 5386 - DNA, 23 bp, Artificial sequence
  SiRNA target sequence
aaaatgctattctgttgtacact

SEQ ID NO: 5387 - DNA, 23 bp, Artificial sequence
  SiRNA target sequence
aaatgctattctgttgtacacta

SEQ ID NO: 5388 - DNA, 23 bp, Artificial sequence
  SiRNA target sequence
aatgctattctgttgtacactaa

SEQ ID NO: 5389 - DNA, 23 bp, Artificial sequence
  SiRNA target sequence
atgctattctgttgtacactaaa

SEQ ID NO: 5390 - DNA, 23 bp, Artificial sequence
  SiRNA target sequence
tgctattctgttgtacactaaat

SEQ ID NO: 5391 - DNA, 23 bp, Artificial sequence
  SiRNA target sequence
gctattctgttgtacactaaatg

SEQ ID NO: 5392 - DNA, 23 bp, Artificial sequence
  SiRNA target sequence
ctattctgttgtacactaaatgt

SEQ ID NO: 5393 - DNA, 23 bp, Artificial sequence
  SiRNA target sequence
tattctgttgtacactaaatgta

SEQ ID NO: 5394 - DNA, 23 bp, Artificial sequence
  SiRNA target sequence
attctgttgtacactaaatgtaa

SEQ ID NO: 5395 - DNA, 23 bp, Artificial sequence
  SiRNA target sequence
ttctgttgtacactaaatgtaaa

SEQ ID NO: 5396 - DNA, 23 bp, Artificial sequence
  SiRNA target sequence
tctgttgtacactaaatgtaaat

SEQ ID NO: 5397 - DNA, 23 bp, Artificial sequence
  SiRNA target sequence
ctgttgtacactaaatgtaaata

SEQ ID NO: 5398 - DNA, 23 bp, Artificial sequence
  SiRNA target sequence
tgttgtacactaaatgtaaatat

SEQ ID NO: 5399 - DNA, 23 bp, Artificial sequence
  SiRNA target sequence
gttgtacactaaatgtaaatata

SEQ ID NO: 5400 - DNA, 23 bp, Artificial sequence
  SiRNA target sequence
ttgtacactaaatgtaaatatat

SEQ ID NO: 5401 - DNA, 23 bp, Artificial sequence
  SiRNA target sequence
tgtacactaaatgtaaatatatg

SEQ ID NO: 5402 - DNA, 23 bp, Artificial sequence
  SiRNA target sequence
gtacactaaatgtaaatatatga

SEQ ID NO: 5403 - DNA, 23 bp, Artificial sequence
  SiRNA target sequence
tacactaaatgtaaatatatgaa

SEQ ID NO: 5404 - DNA, 23 bp, Artificial sequence
  SiRNA target sequence
acactaaatgtaaatatatgaaa

SEQ ID NO: 5405 - DNA, 23 bp, Artificial sequence
  SiRNA target sequence
cactaaatgtaaatatatgaaaa

SEQ ID NO: 5406 - DNA, 23 bp, Artificial sequence
  SiRNA target sequence
actaaatgtaaatatatgaaaag

SEQ ID NO: 5407 - DNA, 23 bp, Artificial sequence
  SiRNA target sequence
ctaaatgtaaatatatgaaaagt

SEQ ID NO: 5408 - DNA, 23 bp, Artificial sequence
  SiRNA target sequence
taaatgtaaatatatgaaaagtg

SEQ ID NO: 5409 - DNA, 23 bp, Artificial sequence
  SiRNA target sequence
aaatgtaaatatatgaaaagtga

SEQ ID NO: 5410 - DNA, 23 bp, Artificial sequence
  SiRNA target sequence
aatgtaaatatatgaaaagtgat

SEQ ID NO: 5411 - DNA, 23 bp, Artificial sequence
  SiRNA target sequence
atgtaaatatatgaaaagtgatg

SEQ ID NO: 5412 - DNA, 23 bp, Artificial sequence
  SiRNA target sequence
tgtaaatatatgaaaagtgatgc

SEQ ID NO: 5413 - DNA, 23 bp, Artificial sequence
  SiRNA target sequence
gtaaatatatgaaaagtgatgct

SEQ ID NO: 5414 - DNA, 23 bp, Artificial sequence
  SiRNA target sequence
taaatatatgaaaagtgatgctg

SEQ ID NO: 5415 - DNA, 23 bp, Artificial sequence
  SiRNA target sequence
aaatatatgaaaagtgatgctga

SEQ ID NO: 5416 - DNA, 23 bp, Artificial sequence
  SiRNA target sequence
aatatatgaaaagtgatgctgaa

SEQ ID NO: 5417 - DNA, 23 bp, Artificial sequence
  SiRNA target sequence
atatatgaaaagtgatgctgaaa

SEQ ID NO: 5418 - DNA, 23 bp, Artificial sequence
  SiRNA target sequence
tatatgaaaagtgatgctgaaat

SEQ ID NO: 5419 - DNA, 23 bp, Artificial sequence
  SiRNA target sequence
atatgaaaagtgatgctgaaatt

SEQ ID NO: 5420 - DNA, 23 bp, Artificial sequence
  SiRNA target sequence
tatgaaaagtgatgctgaaattc

SEQ ID NO: 5421 - DNA, 23 bp, Artificial sequence
  SiRNA target sequence
atgaaaagtgatgctgaaattct

SEQ ID NO: 5422 - DNA, 23 bp, Artificial sequence
  SiRNA target sequence
tgaaaagtgatgctgaaattctt

SEQ ID NO: 5423 - DNA, 23 bp, Artificial sequence
  SiRNA target sequence
gaaaagtgatgctgaaattctta

SEQ ID NO: 5424 - DNA, 23 bp, Artificial sequence
  SiRNA target sequence
aaaagtgatgctgaaattcttac

SEQ ID NO: 5425 - DNA, 23 bp, Artificial sequence
  SiRNA target sequence
aaagtgatgctgaaattcttact

SEQ ID NO: 5426 - DNA, 23 bp, Artificial sequence
  SiRNA target sequence
aagtgatgctgaaattcttacta

SEQ ID NO: 5427 - DNA, 23 bp, Artificial sequence
  SiRNA target sequence
agtgatgctgaaattcttactaa

SEQ ID NO: 5428 - DNA, 23 bp, Artificial sequence
  SiRNA target sequence
gtgatgctgaaattcttactaaa

SEQ ID NO: 5429 - DNA, 23 bp, Artificial sequence
  SiRNA target sequence
tgatgctgaaattcttactaaaa

SEQ ID NO: 5430 - DNA, 23 bp, Artificial sequence
  SiRNA target sequence
gatgctgaaattcttactaaaat

SEQ ID NO: 5431 - DNA, 23 bp, Artificial sequence
  SiRNA target sequence
atgctgaaattcttactaaaatt

SEQ ID NO: 5432 - DNA, 23 bp, Artificial sequence
  SiRNA target sequence
tgctgaaattcttactaaaatta

SEQ ID NO: 5433 - DNA, 23 bp, Artificial sequence
  SiRNA target sequence
gctgaaattcttactaaaattag

SEQ ID NO: 5434 - DNA, 23 bp, Artificial sequence
  SiRNA target sequence
ctgaaattcttactaaaattagt

SEQ ID NO: 5435 - DNA, 23 bp, Artificial sequence
  SiRNA target sequence
tgaaattcttactaaaattagtc

SEQ ID NO: 5436 - DNA, 23 bp, Artificial sequence
  SiRNA target sequence
gaaattcttactaaaattagtct

SEQ ID NO: 5437 - DNA, 23 bp, Artificial sequence
  SiRNA target sequence
aaattcttactaaaattagtctc

SEQ ID NO: 5438 - DNA, 23 bp, Artificial sequence
  SiRNA target sequence
aattcttactaaaattagtctct

SEQ ID NO: 5439 - DNA, 23 bp, Artificial sequence
  SiRNA target sequence
attcttactaaaattagtctctg

SEQ ID NO: 5440 - DNA, 23 bp, Artificial sequence
  SiRNA target sequence
ttcttactaaaattagtctctgt

SEQ ID NO: 5441 - DNA, 23 bp, Artificial sequence
  SiRNA target sequence
tcttactaaaattagtctctgta

SEQ ID NO: 5442 - DNA, 23 bp, Artificial sequence
  SiRNA target sequence
cttactaaaattagtctctgtaa

SEQ ID NO: 5443 - DNA, 23 bp, Artificial sequence
  SiRNA target sequence
ttactaaaattagtctctgtaat

SEQ ID NO: 5444 - DNA, 23 bp, Artificial sequence
  SiRNA target sequence
tactaaaattagtctctgtaatt

SEQ ID NO: 5445 - DNA, 23 bp, Artificial sequence
  SiRNA target sequence
actaaaattagtctctgtaatta

SEQ ID NO: 5446 - DNA, 23 bp, Artificial sequence
  SiRNA target sequence
ctaaaattagtctctgtaattat

SEQ ID NO: 5447 - DNA, 23 bp, Artificial sequence
  SiRNA target sequence
taaaattagtctctgtaattatt

SEQ ID NO: 5448 - DNA, 23 bp, Artificial sequence
  SiRNA target sequence
aaaattagtctctgtaattattt

SEQ ID NO: 5449 - DNA, 23 bp, Artificial sequence
  SiRNA target sequence
aaattagtctctgtaattatttc

SEQ ID NO: 5450 - DNA, 23 bp, Artificial sequence
  SiRNA target sequence
aattagtctctgtaattatttct

SEQ ID NO: 5451 - DNA, 23 bp, Artificial sequence
  SiRNA target sequence
attagtctctgtaattatttctt

SEQ ID NO: 5452 - DNA, 23 bp, Artificial sequence
  SiRNA target sequence
ttagtctctgtaattatttctta

SEQ ID NO: 5453 - DNA, 23 bp, Artificial sequence
  SiRNA target sequence
tagtctctgtaattatttcttaa

SEQ ID NO: 5454 - DNA, 23 bp, Artificial sequence
  SiRNA target sequence
agtctctgtaattatttcttaaa

SEQ ID NO: 5455 - DNA, 23 bp, Artificial sequence
  SiRNA target sequence
gtctctgtaattatttcttaaaa

SEQ ID NO: 5456 - DNA, 23 bp, Artificial sequence
  SiRNA target sequence
tctctgtaattatttcttaaaaa

SEQ ID NO: 5457 - DNA, 23 bp, Artificial sequence
  SiRNA target sequence
ctctgtaattatttcttaaaaaa

SEQ ID NO: 5458 - DNA, 23 bp, Artificial sequence
  SiRNA target sequence
tctgtaattatttcttaaaaaat

SEQ ID NO: 5459 - DNA, 23 bp, Artificial sequence
  SiRNA target sequence
ctgtaattatttcttaaaaaatt

SEQ ID NO: 5460 - DNA, 23 bp, Artificial sequence
  SiRNA target sequence
tgtaattatttcttaaaaaatta

SEQ ID NO: 5461 - DNA, 23 bp, Artificial sequence
  SiRNA target sequence
gtaattatttcttaaaaaattat

SEQ ID NO: 5462 - DNA, 23 bp, Artificial sequence
  SiRNA target sequence
taattatttcttaaaaaattatc

SEQ ID NO: 5463 - DNA, 23 bp, Artificial sequence
  SiRNA target sequence
aattatttcttaaaaaattatca

SEQ ID NO: 5464 - DNA, 23 bp, Artificial sequence
  SiRNA target sequence
attatttcttaaaaaattatcaa

SEQ ID NO: 5465 - DNA, 23 bp, Artificial sequence
  SiRNA target sequence
ttatttcttaaaaaattatcaag

SEQ ID NO: 5466 - DNA, 23 bp, Artificial sequence
  SiRNA target sequence
tatttcttaaaaaattatcaaga

SEQ ID NO: 5467 - DNA, 23 bp, Artificial sequence
  SiRNA target sequence
atttcttaaaaaattatcaagaa

SEQ ID NO: 5468 - DNA, 23 bp, Artificial sequence
  SiRNA target sequence
tttcttaaaaaattatcaagaag

SEQ ID NO: 5469 - DNA, 23 bp, Artificial sequence
  SiRNA target sequence
ttcttaaaaaattatcaagaagt

SEQ ID NO: 5470 - DNA, 23 bp, Artificial sequence
  SiRNA target sequence
tcttaaaaaattatcaagaagtt

SEQ ID NO: 5471 - DNA, 23 bp, Artificial sequence
  SiRNA target sequence
cttaaaaaattatcaagaagtta

SEQ ID NO: 5472 - DNA, 23 bp, Artificial sequence
  SiRNA target sequence
ttaaaaaattatcaagaagttat

SEQ ID NO: 5473 - DNA, 23 bp, Artificial sequence
  SiRNA target sequence
taaaaaattatcaagaagttata

SEQ ID NO: 5474 - DNA, 23 bp, Artificial sequence
  SiRNA target sequence
aaaaaattatcaagaagttataa

SEQ ID NO: 5475 - DNA, 23 bp, Artificial sequence
  SiRNA target sequence
aaaaattatcaagaagttataaa

SEQ ID NO: 5476 - DNA, 23 bp, Artificial sequence
  SiRNA target sequence
aaaattatcaagaagttataaat

SEQ ID NO: 5477 - DNA, 23 bp, Artificial sequence
  SiRNA target sequence
aaattatcaagaagttataaata

SEQ ID NO: 5478 - DNA, 23 bp, Artificial sequence
  SiRNA target sequence
aattatcaagaagttataaataa

SEQ ID NO: 5479 - DNA, 23 bp, Artificial sequence
  SiRNA target sequence
attatcaagaagttataaataat

SEQ ID NO: 5480 - DNA, 23 bp, Artificial sequence
  SiRNA target sequence
ttatcaagaagttataaataatt

SEQ ID NO: 5481 - DNA, 23 bp, Artificial sequence
  SiRNA target sequence
tatcaagaagttataaataattc

SEQ ID NO: 5482 - DNA, 23 bp, Artificial sequence
  SiRNA target sequence
atcaagaagttataaataattct

SEQ ID NO: 5483 - DNA, 23 bp, Artificial sequence
  SiRNA target sequence
tcaagaagttataaataattctt

SEQ ID NO: 5484 - DNA, 23 bp, Artificial sequence
  SiRNA target sequence
caagaagttataaataattcttt

SEQ ID NO: 5485 - DNA, 23 bp, Artificial sequence
  SiRNA target sequence
aagaagttataaataattcttta

SEQ ID NO: 5486 - DNA, 23 bp, Artificial sequence
  SiRNA target sequence
agaagttataaataattctttat

SEQ ID NO: 5487 - DNA, 23 bp, Artificial sequence
  SiRNA target sequence
gaagttataaataattctttatt

SEQ ID NO: 5488 - DNA, 23 bp, Artificial sequence
  SiRNA target sequence
aagttataaataattctttattt

SEQ ID NO: 5489 - DNA, 23 bp, Artificial sequence
  SiRNA target sequence
agttataaataattctttattta

SEQ ID NO: 5490 - DNA, 23 bp, Artificial sequence
  SiRNA target sequence
gttataaataattctttatttaa

SEQ ID NO: 5491 - DNA, 23 bp, Artificial sequence
  SiRNA target sequence
ttataaataattctttatttaag

SEQ ID NO: 5492 - DNA, 23 bp, Artificial sequence
  SiRNA target sequence
tataaataattctttatttaaga

SEQ ID NO: 5493 - DNA, 23 bp, Artificial sequence
  SiRNA target sequence
ataaataattctttatttaagac

SEQ ID NO: 5494 - DNA, 23 bp, Artificial sequence
  SiRNA target sequence
taaataattctttatttaagaca

SEQ ID NO: 5495 - DNA, 23 bp, Artificial sequence
  SiRNA target sequence
aaataattctttatttaagacaa

SEQ ID NO: 5496 - DNA, 23 bp, Artificial sequence
  SiRNA target sequence
aataattctttatttaagacaaa

SEQ ID NO: 5497 - DNA, 23 bp, Artificial sequence
  SiRNA target sequence
ataattctttatttaagacaaat

SEQ ID NO: 5498 - DNA, 23 bp, Artificial sequence
  SiRNA target sequence
taattctttatttaagacaaata

SEQ ID NO: 5499 - DNA, 23 bp, Artificial sequence
  SiRNA target sequence
aattctttatttaagacaaataa

SEQ ID NO: 5500 - DNA, 23 bp, Artificial sequence
  SiRNA target sequence
attctttatttaagacaaataat

SEQ ID NO: 5501 - DNA, 23 bp, Artificial sequence
  SiRNA target sequence
ttctttatttaagacaaataata

SEQ ID NO: 5502 - DNA, 23 bp, Artificial sequence
  SiRNA target sequence
tctttatttaagacaaataataa

SEQ ID NO: 5503 - DNA, 23 bp, Artificial sequence
  SiRNA target sequence
ctttatttaagacaaataataaa

SEQ ID NO: 5504 - DNA, 23 bp, Artificial sequence
  SiRNA target sequence
tttatttaagacaaataataaag

SEQ ID NO: 5505 - DNA, 23 bp, Artificial sequence
  SiRNA target sequence
ttatttaagacaaataataaaga

SEQ ID NO: 5506 - DNA, 23 bp, Artificial sequence
  SiRNA target sequence
tatttaagacaaataataaagat

SEQ ID NO: 5507 - DNA, 23 bp, Artificial sequence
  SiRNA target sequence
atttaagacaaataataaagatc

SEQ ID NO: 5508 - DNA, 23 bp, Artificial sequence
  SiRNA target sequence
tttaagacaaataataaagatct

SEQ ID NO: 5509 - DNA, 23 bp, Artificial sequence
  SiRNA target sequence
ttaagacaaataataaagatcta

SEQ ID NO: 5510 - DNA, 23 bp, Artificial sequence
  SiRNA target sequence
taagacaaataataaagatctaa

SEQ ID NO: 5511 - DNA, 23 bp, Artificial sequence
  SiRNA target sequence
aagacaaataataaagatctaat

SEQ ID NO: 5512 - DNA, 23 bp, Artificial sequence
  SiRNA target sequence
agacaaataataaagatctaata

SEQ ID NO: 5513 - DNA, 23 bp, Artificial sequence
  SiRNA target sequence
gacaaataataaagatctaataa

SEQ ID NO: 5514 - DNA, 23 bp, Artificial sequence
  SiRNA target sequence
acaaataataaagatctaataaa

SEQ ID NO: 5515 - DNA, 23 bp, Artificial sequence
  SiRNA target sequence
caaataataaagatctaataaaa

SEQ ID NO: 5516 - DNA, 23 bp, Artificial sequence
  SiRNA target sequence
aaataataaagatctaataaaaa

SEQ ID NO: 5517 - DNA, 23 bp, Artificial sequence
  SiRNA target sequence
aataataaagatctaataaaaat

SEQ ID NO: 5518 - DNA, 23 bp, Artificial sequence
  SiRNA target sequence
ataataaagatctaataaaaata

SEQ ID NO: 5519 - DNA, 23 bp, Artificial sequence
  SiRNA target sequence
taataaagatctaataaaaataa

SEQ ID NO: 5520 - DNA, 23 bp, Artificial sequence
  SiRNA target sequence
aataaagatctaataaaaataag

SEQ ID NO: 5521 - DNA, 23 bp, Artificial sequence
  SiRNA target sequence
ataaagatctaataaaaataaga

SEQ ID NO: 5522 - DNA, 23 bp, Artificial sequence
  SiRNA target sequence
taaagatctaataaaaataagat

SEQ ID NO: 5523 - DNA, 23 bp, Artificial sequence
  SiRNA target sequence
aaagatctaataaaaataagatc

SEQ ID NO: 5524 - DNA, 23 bp, Artificial sequence
  SiRNA target sequence
aagatctaataaaaataagatct

SEQ ID NO: 5525 - DNA, 23 bp, Artificial sequence
  SiRNA target sequence
agatctaataaaaataagatctg

SEQ ID NO: 5526 - DNA, 23 bp, Artificial sequence
  SiRNA target sequence
gatctaataaaaataagatctga

SEQ ID NO: 5527 - DNA, 23 bp, Artificial sequence
  SiRNA target sequence
atctaataaaaataagatctgaa

SEQ ID NO: 5528 - DNA, 23 bp, Artificial sequence
  SiRNA target sequence
tctaataaaaataagatctgaat

SEQ ID NO: 5529 - DNA, 23 bp, Artificial sequence
  SiRNA target sequence
ctaataaaaataagatctgaatg

SEQ ID NO: 5530 - DNA, 23 bp, Artificial sequence
  SiRNA target sequence
taataaaaataagatctgaatgt

SEQ ID NO: 5531 - DNA, 23 bp, Artificial sequence
  SiRNA target sequence
aataaaaataagatctgaatgtt

SEQ ID NO: 5532 - DNA, 23 bp, Artificial sequence
  SiRNA target sequence
ataaaaataagatctgaatgtta

SEQ ID NO: 5533 - DNA, 23 bp, Artificial sequence
  SiRNA target sequence
taaaaataagatctgaatgttac

SEQ ID NO: 5534 - DNA, 23 bp, Artificial sequence
  SiRNA target sequence
aaaaataagatctgaatgttaca

SEQ ID NO: 5535 - DNA, 23 bp, Artificial sequence
  SiRNA target sequence
aaaataagatctgaatgttacaa

SEQ ID NO: 5536 - DNA, 23 bp, Artificial sequence
  SiRNA target sequence
aaataagatctgaatgttacaag

SEQ ID NO: 5537 - DNA, 23 bp, Artificial sequence
  SiRNA target sequence
aataagatctgaatgttacaagc

SEQ ID NO: 5538 - DNA, 23 bp, Artificial sequence
  SiRNA target sequence
ataagatctgaatgttacaagca

SEQ ID NO: 5539 - DNA, 23 bp, Artificial sequence
  SiRNA target sequence
taagatctgaatgttacaagcag

SEQ ID NO: 5540 - DNA, 23 bp, Artificial sequence
  SiRNA target sequence
aagatctgaatgttacaagcaga

SEQ ID NO: 5541 - DNA, 23 bp, Artificial sequence
  SiRNA target sequence
agatctgaatgttacaagcagat

SEQ ID NO: 5542 - DNA, 23 bp, Artificial sequence
  SiRNA target sequence
gatctgaatgttacaagcagatg

SEQ ID NO: 5543 - DNA, 23 bp, Artificial sequence
  SiRNA target sequence
atctgaatgttacaagcagatgg

SEQ ID NO: 5544 - DNA, 23 bp, Artificial sequence
  SiRNA target sequence
tctgaatgttacaagcagatggg

SEQ ID NO: 5545 - DNA, 23 bp, Artificial sequence
  SiRNA target sequence
ctgaatgttacaagcagatggga

SEQ ID NO: 5546 - DNA, 23 bp, Artificial sequence
  SiRNA target sequence
tgaatgttacaagcagatgggaa

SEQ ID NO: 5547 - DNA, 23 bp, Artificial sequence
  SiRNA target sequence
gaatgttacaagcagatgggaaa

SEQ ID NO: 5548 - DNA, 23 bp, Artificial sequence
  SiRNA target sequence
aatgttacaagcagatgggaaat

SEQ ID NO: 5549 - DNA, 23 bp, Artificial sequence
  SiRNA target sequence
atgttacaagcagatgggaaata

SEQ ID NO: 5550 - DNA, 23 bp, Artificial sequence
  SiRNA target sequence
tgttacaagcagatgggaaataa

SEQ ID NO: 5551 - DNA, 23 bp, Artificial sequence
  SiRNA target sequence
gttacaagcagatgggaaataaa

SEQ ID NO: 5552 - DNA, 23 bp, Artificial sequence
  SiRNA target sequence
ttacaagcagatgggaaataaaa

SEQ ID NO: 5553 - DNA, 23 bp, Artificial sequence
  SiRNA target sequence
tacaagcagatgggaaataaaaa

SEQ ID NO: 5554 - DNA, 23 bp, Artificial sequence
  SiRNA target sequence
acaagcagatgggaaataaaaaa

SEQ ID NO: 5555 - DNA, 23 bp, Artificial sequence
  SiRNA target sequence
caagcagatgggaaataaaaaaa

SEQ ID NO: 5556 - DNA, 23 bp, Artificial sequence
  SiRNA target sequence
aagcagatgggaaataaaaaaaa

SEQ ID NO: 5557 - DNA, 23 bp, Artificial sequence
  SiRNA target sequence
agcagatgggaaataaaaaaaaa

SEQ ID NO: 5558 - DNA, 23 bp, Artificial sequence
  SiRNA target sequence
gcagatgggaaataaaaaaaaat

SEQ ID NO: 5559 - DNA, 23 bp, Artificial sequence
  SiRNA target sequence
cagatgggaaataaaaaaaaatt

SEQ ID NO: 5560 - DNA, 23 bp, Artificial sequence
  SiRNA target sequence
agatgggaaataaaaaaaaattt

SEQ ID NO: 5561 - DNA, 23 bp, Artificial sequence
  SiRNA target sequence
gatgggaaataaaaaaaaatttc

SEQ ID NO: 5562 - DNA, 23 bp, Artificial sequence
  SiRNA target sequence
atgggaaataaaaaaaaatttct

SEQ ID NO: 5563 - DNA, 23 bp, Artificial sequence
  SiRNA target sequence
tgggaaataaaaaaaaatttctt

SEQ ID NO: 5564 - DNA, 23 bp, Artificial sequence
  SiRNA target sequence
gggaaataaaaaaaaatttctta

SEQ ID NO: 5565 - DNA, 23 bp, Artificial sequence
  SiRNA target sequence
ggaaataaaaaaaaatttcttaa

SEQ ID NO: 5566 - DNA, 23 bp, Artificial sequence
  SiRNA target sequence
gaaataaaaaaaaatttcttaag

SEQ ID NO: 5567 - DNA, 23 bp, Artificial sequence
  SiRNA target sequence
aaataaaaaaaaatttcttaagg

SEQ ID NO: 5568 - DNA, 23 bp, Artificial sequence
  SiRNA target sequence
aataaaaaaaaatttcttaagga

SEQ ID NO: 5569 - DNA, 23 bp, Artificial sequence
  SiRNA target sequence
ataaaaaaaaatttcttaaggat

SEQ ID NO: 5570 - DNA, 23 bp, Artificial sequence
  SiRNA target sequence
taaaaaaaaatttcttaaggatt

SEQ ID NO: 5571 - DNA, 23 bp, Artificial sequence
  SiRNA target sequence
aaaaaaaaatttcttaaggattt

SEQ ID NO: 5572 - DNA, 23 bp, Artificial sequence
  SiRNA target sequence
aaaaaaaatttcttaaggattta

SEQ ID NO: 5573 - DNA, 23 bp, Artificial sequence
  SiRNA target sequence
aaaaaaatttcttaaggatttag

SEQ ID NO: 5574 - DNA, 23 bp, Artificial sequence
  SiRNA target sequence
aaaaaatttcttaaggatttagc

SEQ ID NO: 5575 - DNA, 23 bp, Artificial sequence
  SiRNA target sequence
aaaaatttcttaaggatttagca

SEQ ID NO: 5576 - DNA, 23 bp, Artificial sequence
  SiRNA target sequence
aaaatttcttaaggatttagcac

SEQ ID NO: 5577 - DNA, 23 bp, Artificial sequence
  SiRNA target sequence
aaatttcttaaggatttagcact

SEQ ID NO: 5578 - DNA, 23 bp, Artificial sequence
  SiRNA target sequence
aatttcttaaggatttagcactt

SEQ ID NO: 5579 - DNA, 23 bp, Artificial sequence
  SiRNA target sequence
atttcttaaggatttagcacttt

SEQ ID NO: 5580 - DNA, 23 bp, Artificial sequence
  SiRNA target sequence
tttcttaaggatttagcacttta

SEQ ID NO: 5581 - DNA, 23 bp, Artificial sequence
  SiRNA target sequence
ttcttaaggatttagcactttat

SEQ ID NO: 5582 - DNA, 23 bp, Artificial sequence
  SiRNA target sequence
tcttaaggatttagcactttatg

SEQ ID NO: 5583 - DNA, 23 bp, Artificial sequence
  SiRNA target sequence
cttaaggatttagcactttatga

SEQ ID NO: 5584 - DNA, 23 bp, Artificial sequence
  SiRNA target sequence
ttaaggatttagcactttatgaa

SEQ ID NO: 5585 - DNA, 23 bp, Artificial sequence
  SiRNA target sequence
taaggatttagcactttatgaaa

SEQ ID NO: 5586 - DNA, 23 bp, Artificial sequence
  SiRNA target sequence
aaggatttagcactttatgaaac

SEQ ID NO: 5587 - DNA, 23 bp, Artificial sequence
  SiRNA target sequence
aggatttagcactttatgaaaca

SEQ ID NO: 5588 - DNA, 23 bp, Artificial sequence
  SiRNA target sequence
ggatttagcactttatgaaacat

SEQ ID NO: 5589 - DNA, 23 bp, Artificial sequence
  SiRNA target sequence
gatttagcactttatgaaacatt

SEQ ID NO: 5590 - DNA, 23 bp, Artificial sequence
  SiRNA target sequence
atttagcactttatgaaacattt

SEQ ID NO: 5591 - DNA, 23 bp, Artificial sequence
  SiRNA target sequence
tttagcactttatgaaacatttg

SEQ ID NO: 5592 - DNA, 23 bp, Artificial sequence
  SiRNA target sequence
ttagcactttatgaaacatttgc

SEQ ID NO: 5593 - DNA, 23 bp, Artificial sequence
  SiRNA target sequence
tagcactttatgaaacatttgct

SEQ ID NO: 5594 - DNA, 23 bp, Artificial sequence
  SiRNA target sequence
agcactttatgaaacatttgcta

SEQ ID NO: 5595 - DNA, 23 bp, Artificial sequence
  SiRNA target sequence
gcactttatgaaacatttgctaa

SEQ ID NO: 5596 - DNA, 23 bp, Artificial sequence
  SiRNA target sequence
cactttatgaaacatttgctaat

SEQ ID NO: 5597 - DNA, 23 bp, Artificial sequence
  SiRNA target sequence
actttatgaaacatttgctaata

SEQ ID NO: 5598 - DNA, 23 bp, Artificial sequence
  SiRNA target sequence
ctttatgaaacatttgctaataa

SEQ ID NO: 5599 - DNA, 23 bp, Artificial sequence
  SiRNA target sequence
tttatgaaacatttgctaataat

SEQ ID NO: 5600 - DNA, 23 bp, Artificial sequence
  SiRNA target sequence
ttatgaaacatttgctaataata

SEQ ID NO: 5601 - DNA, 23 bp, Artificial sequence
  SiRNA target sequence
tatgaaacatttgctaataataa

SEQ ID NO: 5602 - DNA, 23 bp, Artificial sequence
  SiRNA target sequence
atgaaacatttgctaataataaa

SEQ ID NO: 5603 - DNA, 23 bp, Artificial sequence
  SiRNA target sequence
tgaaacatttgctaataataaag

SEQ ID NO: 5604 - DNA, 23 bp, Artificial sequence
  SiRNA target sequence
gaaacatttgctaataataaaga

SEQ ID NO: 5605 - DNA, 23 bp, Artificial sequence
  SiRNA target sequence
aaacatttgctaataataaagaa

SEQ ID NO: 5606 - DNA, 23 bp, Artificial sequence
  SiRNA target sequence
aacatttgctaataataaagaag

SEQ ID NO: 5607 - DNA, 23 bp, Artificial sequence
  SiRNA target sequence
acatttgctaataataaagaagt

SEQ ID NO: 5608 - DNA, 23 bp, Artificial sequence
  SiRNA target sequence
catttgctaataataaagaagtc

SEQ ID NO: 5609 - DNA, 23 bp, Artificial sequence
  SiRNA target sequence
atttgctaataataaagaagtcc

SEQ ID NO: 5610 - DNA, 23 bp, Artificial sequence
  SiRNA target sequence
tttgctaataataaagaagtcca

SEQ ID NO: 5611 - DNA, 23 bp, Artificial sequence
  SiRNA target sequence
ttgctaataataaagaagtccaa

SEQ ID NO: 5612 - DNA, 23 bp, Artificial sequence
  SiRNA target sequence
tgctaataataaagaagtccaag

SEQ ID NO: 5613 - DNA, 23 bp, Artificial sequence
  SiRNA target sequence
gctaataataaagaagtccaaga

SEQ ID NO: 5614 - DNA, 23 bp, Artificial sequence
  SiRNA target sequence
ctaataataaagaagtccaagat

SEQ ID NO: 5615 - DNA, 23 bp, Artificial sequence
  SiRNA target sequence
taataataaagaagtccaagatg

SEQ ID NO: 5616 - DNA, 23 bp, Artificial sequence
  SiRNA target sequence
aataataaagaagtccaagatga

SEQ ID NO: 5617 - DNA, 23 bp, Artificial sequence
  SiRNA target sequence
ataataaagaagtccaagatgaa

SEQ ID NO: 5618 - DNA, 23 bp, Artificial sequence
  SiRNA target sequence
taataaagaagtccaagatgaaa

SEQ ID NO: 5619 - DNA, 23 bp, Artificial sequence
  SiRNA target sequence
aataaagaagtccaagatgaaat

SEQ ID NO: 5620 - DNA, 23 bp, Artificial sequence
  SiRNA target sequence
ataaagaagtccaagatgaaatt

SEQ ID NO: 5621 - DNA, 23 bp, Artificial sequence
  SiRNA target sequence
taaagaagtccaagatgaaatta

SEQ ID NO: 5622 - DNA, 23 bp, Artificial sequence
  SiRNA target sequence
aaagaagtccaagatgaaattat

SEQ ID NO: 5623 - DNA, 23 bp, Artificial sequence
  SiRNA target sequence
aagaagtccaagatgaaattatg

SEQ ID NO: 5624 - DNA, 23 bp, Artificial sequence
  SiRNA target sequence
agaagtccaagatgaaattatgc

SEQ ID NO: 5625 - DNA, 23 bp, Artificial sequence
  SiRNA target sequence
gaagtccaagatgaaattatgca

SEQ ID NO: 5626 - DNA, 23 bp, Artificial sequence
  SiRNA target sequence
aagtccaagatgaaattatgcag

SEQ ID NO: 5627 - DNA, 23 bp, Artificial sequence
  SiRNA target sequence
agtccaagatgaaattatgcaga

SEQ ID NO: 5628 - DNA, 23 bp, Artificial sequence
  SiRNA target sequence
gtccaagatgaaattatgcagac

SEQ ID NO: 5629 - DNA, 23 bp, Artificial sequence
  SiRNA target sequence
tccaagatgaaattatgcagact

SEQ ID NO: 5630 - DNA, 23 bp, Artificial sequence
  SiRNA target sequence
ccaagatgaaattatgcagactg

SEQ ID NO: 5631 - DNA, 23 bp, Artificial sequence
  SiRNA target sequence
caagatgaaattatgcagactgt

SEQ ID NO: 5632 - DNA, 23 bp, Artificial sequence
  SiRNA target sequence
aagatgaaattatgcagactgtt

SEQ ID NO: 5633 - DNA, 23 bp, Artificial sequence
  SiRNA target sequence
agatgaaattatgcagactgtta

SEQ ID NO: 5634 - DNA, 23 bp, Artificial sequence
  SiRNA target sequence
gatgaaattatgcagactgttaa

SEQ ID NO: 5635 - DNA, 23 bp, Artificial sequence
  SiRNA target sequence
atgaaattatgcagactgttaaa

SEQ ID NO: 5636 - DNA, 23 bp, Artificial sequence
  SiRNA target sequence
tgaaattatgcagactgttaaag

SEQ ID NO: 5637 - DNA, 23 bp, Artificial sequence
  SiRNA target sequence
gaaattatgcagactgttaaaga

SEQ ID NO: 5638 - DNA, 23 bp, Artificial sequence
  SiRNA target sequence
aaattatgcagactgttaaagaa

SEQ ID NO: 5639 - DNA, 23 bp, Artificial sequence
  SiRNA target sequence
aattatgcagactgttaaagaaa

SEQ ID NO: 5640 - DNA, 23 bp, Artificial sequence
  SiRNA target sequence
attatgcagactgttaaagaaat

SEQ ID NO: 5641 - DNA, 23 bp, Artificial sequence
  SiRNA target sequence
ttatgcagactgttaaagaaatt

SEQ ID NO: 5642 - DNA, 23 bp, Artificial sequence
  SiRNA target sequence
tatgcagactgttaaagaaattt

SEQ ID NO: 5643 - DNA, 23 bp, Artificial sequence
  SiRNA target sequence
atgcagactgttaaagaaatttg

SEQ ID NO: 5644 - DNA, 23 bp, Artificial sequence
  SiRNA target sequence
tgcagactgttaaagaaatttgt

SEQ ID NO: 5645 - DNA, 23 bp, Artificial sequence
  SiRNA target sequence
gcagactgttaaagaaatttgtg

SEQ ID NO: 5646 - DNA, 23 bp, Artificial sequence
  SiRNA target sequence
cagactgttaaagaaatttgtga

SEQ ID NO: 5647 - DNA, 23 bp, Artificial sequence
  SiRNA target sequence
agactgttaaagaaatttgtgaa

SEQ ID NO: 5648 - DNA, 23 bp, Artificial sequence
  SiRNA target sequence
gactgttaaagaaatttgtgaag

SEQ ID NO: 5649 - DNA, 23 bp, Artificial sequence
  SiRNA target sequence
actgttaaagaaatttgtgaaga

SEQ ID NO: 5650 - DNA, 23 bp, Artificial sequence
  SiRNA target sequence
ctgttaaagaaatttgtgaagaa

SEQ ID NO: 5651 - DNA, 23 bp, Artificial sequence
  SiRNA target sequence
tgttaaagaaatttgtgaagaag

SEQ ID NO: 5652 - DNA, 23 bp, Artificial sequence
  SiRNA target sequence
gttaaagaaatttgtgaagaaga

SEQ ID NO: 5653 - DNA, 23 bp, Artificial sequence
  SiRNA target sequence
ttaaagaaatttgtgaagaagaa

SEQ ID NO: 5654 - DNA, 23 bp, Artificial sequence
  SiRNA target sequence
taaagaaatttgtgaagaagaag

SEQ ID NO: 5655 - DNA, 23 bp, Artificial sequence
  SiRNA target sequence
aaagaaatttgtgaagaagaagt

SEQ ID NO: 5656 - DNA, 23 bp, Artificial sequence
  SiRNA target sequence
aagaaatttgtgaagaagaagtg

SEQ ID NO: 5657 - DNA, 23 bp, Artificial sequence
  SiRNA target sequence
agaaatttgtgaagaagaagtga

SEQ ID NO: 5658 - DNA, 23 bp, Artificial sequence
  SiRNA target sequence
gaaatttgtgaagaagaagtgaa

SEQ ID NO: 5659 - DNA, 23 bp, Artificial sequence
  SiRNA target sequence
aaatttgtgaagaagaagtgaat

SEQ ID NO: 5660 - DNA, 23 bp, Artificial sequence
  SiRNA target sequence
aatttgtgaagaagaagtgaatg

SEQ ID NO: 5661 - DNA, 23 bp, Artificial sequence
  SiRNA target sequence
atttgtgaagaagaagtgaatga

SEQ ID NO: 5662 - DNA, 23 bp, Artificial sequence
  SiRNA target sequence
tttgtgaagaagaagtgaatgag

SEQ ID NO: 5663 - DNA, 23 bp, Artificial sequence
  SiRNA target sequence
ttgtgaagaagaagtgaatgagt

SEQ ID NO: 5664 - DNA, 23 bp, Artificial sequence
  SiRNA target sequence
tgtgaagaagaagtgaatgagtt

SEQ ID NO: 5665 - DNA, 23 bp, Artificial sequence
  SiRNA target sequence
gtgaagaagaagtgaatgagttt

SEQ ID NO: 5666 - DNA, 23 bp, Artificial sequence
  SiRNA target sequence
tgaagaagaagtgaatgagttta

SEQ ID NO: 5667 - DNA, 23 bp, Artificial sequence
  SiRNA target sequence
gaagaagaagtgaatgagtttat

SEQ ID NO: 5668 - DNA, 23 bp, Artificial sequence
  SiRNA target sequence
aagaagaagtgaatgagtttatt

SEQ ID NO: 5669 - DNA, 23 bp, Artificial sequence
  SiRNA target sequence
agaagaagtgaatgagtttattg

SEQ ID NO: 5670 - DNA, 23 bp, Artificial sequence
  SiRNA target sequence
gaagaagtgaatgagtttattga

SEQ ID NO: 5671 - DNA, 23 bp, Artificial sequence
  SiRNA target sequence
aagaagtgaatgagtttattgaa

SEQ ID NO: 5672 - DNA, 23 bp, Artificial sequence
  SiRNA target sequence
agaagtgaatgagtttattgaac

SEQ ID NO: 5673 - DNA, 23 bp, Artificial sequence
  SiRNA target sequence
gaagtgaatgagtttattgaaca

SEQ ID NO: 5674 - DNA, 23 bp, Artificial sequence
  SiRNA target sequence
aagtgaatgagtttattgaacaa

SEQ ID NO: 5675 - DNA, 23 bp, Artificial sequence
  SiRNA target sequence
agtgaatgagtttattgaacaag

SEQ ID NO: 5676 - DNA, 23 bp, Artificial sequence
  SiRNA target sequence
gtgaatgagtttattgaacaaga

SEQ ID NO: 5677 - DNA, 23 bp, Artificial sequence
  SiRNA target sequence
tgaatgagtttattgaacaagaa

SEQ ID NO: 5678 - DNA, 23 bp, Artificial sequence
  SiRNA target sequence
gaatgagtttattgaacaagaag

SEQ ID NO: 5679 - DNA, 23 bp, Artificial sequence
  SiRNA target sequence
aatgagtttattgaacaagaagg

SEQ ID NO: 5680 - DNA, 23 bp, Artificial sequence
  SiRNA target sequence
atgagtttattgaacaagaaggt

SEQ ID NO: 5681 - DNA, 23 bp, Artificial sequence
  SiRNA target sequence
tgagtttattgaacaagaaggtt

SEQ ID NO: 5682 - DNA, 23 bp, Artificial sequence
  SiRNA target sequence
gagtttattgaacaagaaggttt

SEQ ID NO: 5683 - DNA, 23 bp, Artificial sequence
  SiRNA target sequence
agtttattgaacaagaaggttta

SEQ ID NO: 5684 - DNA, 23 bp, Artificial sequence
  SiRNA target sequence
gtttattgaacaagaaggtttaa

SEQ ID NO: 5685 - DNA, 23 bp, Artificial sequence
  SiRNA target sequence
tttattgaacaagaaggtttaaa

SEQ ID NO: 5686 - DNA, 23 bp, Artificial sequence
  SiRNA target sequence
ttattgaacaagaaggtttaaaa

SEQ ID NO: 5687 - DNA, 23 bp, Artificial sequence
  SiRNA target sequence
tattgaacaagaaggtttaaaaa

SEQ ID NO: 5688 - DNA, 23 bp, Artificial sequence
  SiRNA target sequence
attgaacaagaaggtttaaaaat

SEQ ID NO: 5689 - DNA, 23 bp, Artificial sequence
  SiRNA target sequence
ttgaacaagaaggtttaaaaatt

SEQ ID NO: 5690 - DNA, 23 bp, Artificial sequence
  SiRNA target sequence
tgaacaagaaggtttaaaaatta

SEQ ID NO: 5691 - DNA, 23 bp, Artificial sequence
  SiRNA target sequence
gaacaagaaggtttaaaaattaa

SEQ ID NO: 5692 - DNA, 23 bp, Artificial sequence
  SiRNA target sequence
aacaagaaggtttaaaaattaat

SEQ ID NO: 5693 - DNA, 23 bp, Artificial sequence
  SiRNA target sequence
acaagaaggtttaaaaattaata

SEQ ID NO: 5694 - DNA, 23 bp, Artificial sequence
  SiRNA target sequence
caagaaggtttaaaaattaataa

SEQ ID NO: 5695 - DNA, 23 bp, Artificial sequence
  SiRNA target sequence
aagaaggtttaaaaattaataaa

SEQ ID NO: 5696 - DNA, 23 bp, Artificial sequence
  SiRNA target sequence
agaaggtttaaaaattaataaag

SEQ ID NO: 5697 - DNA, 23 bp, Artificial sequence
  SiRNA target sequence
gaaggtttaaaaattaataaaga

SEQ ID NO: 5698 - DNA, 23 bp, Artificial sequence
  SiRNA target sequence
aaggtttaaaaattaataaagaa

SEQ ID NO: 5699 - DNA, 23 bp, Artificial sequence
  SiRNA target sequence
aggtttaaaaattaataaagaag

SEQ ID NO: 5700 - DNA, 23 bp, Artificial sequence
  SiRNA target sequence
ggtttaaaaattaataaagaaga

SEQ ID NO: 5701 - DNA, 23 bp, Artificial sequence
  SiRNA target sequence
gtttaaaaattaataaagaagat

SEQ ID NO: 5702 - DNA, 23 bp, Artificial sequence
  SiRNA target sequence
tttaaaaattaataaagaagatg

SEQ ID NO: 5703 - DNA, 23 bp, Artificial sequence
  SiRNA target sequence
ttaaaaattaataaagaagatgt

SEQ ID NO: 5704 - DNA, 23 bp, Artificial sequence
  SiRNA target sequence
taaaaattaataaagaagatgtg

SEQ ID NO: 5705 - DNA, 23 bp, Artificial sequence
  SiRNA target sequence
aaaaattaataaagaagatgtgc

SEQ ID NO: 5706 - DNA, 23 bp, Artificial sequence
  SiRNA target sequence
aaaattaataaagaagatgtgct

SEQ ID NO: 5707 - DNA, 23 bp, Artificial sequence
  SiRNA target sequence
aaattaataaagaagatgtgcta

SEQ ID NO: 5708 - DNA, 23 bp, Artificial sequence
  SiRNA target sequence
aattaataaagaagatgtgctaa

SEQ ID NO: 5709 - DNA, 23 bp, Artificial sequence
  SiRNA target sequence
attaataaagaagatgtgctaag

SEQ ID NO: 5710 - DNA, 23 bp, Artificial sequence
  SiRNA target sequence
ttaataaagaagatgtgctaaga

SEQ ID NO: 5711 - DNA, 23 bp, Artificial sequence
  SiRNA target sequence
taataaagaagatgtgctaagag

SEQ ID NO: 5712 - DNA, 23 bp, Artificial sequence
  SiRNA target sequence
aataaagaagatgtgctaagagg

SEQ ID NO: 5713 - DNA, 23 bp, Artificial sequence
  SiRNA target sequence
ataaagaagatgtgctaagagga

SEQ ID NO: 5714 - DNA, 23 bp, Artificial sequence
  SiRNA target sequence
taaagaagatgtgctaagaggac

SEQ ID NO: 5715 - DNA, 23 bp, Artificial sequence
  SiRNA target sequence
aaagaagatgtgctaagaggact

SEQ ID NO: 5716 - DNA, 23 bp, Artificial sequence
  SiRNA target sequence
aagaagatgtgctaagaggactt

SEQ ID NO: 5717 - DNA, 23 bp, Artificial sequence
  SiRNA target sequence
agaagatgtgctaagaggacttg

SEQ ID NO: 5718 - DNA, 23 bp, Artificial sequence
  SiRNA target sequence
gaagatgtgctaagaggacttgt

SEQ ID NO: 5719 - DNA, 23 bp, Artificial sequence
  SiRNA target sequence
aagatgtgctaagaggacttgtt

SEQ ID NO: 5720 - DNA, 23 bp, Artificial sequence
  SiRNA target sequence
agatgtgctaagaggacttgttt

SEQ ID NO: 5721 - DNA, 23 bp, Artificial sequence
  SiRNA target sequence
gatgtgctaagaggacttgtttc

SEQ ID NO: 5722 - DNA, 23 bp, Artificial sequence
  SiRNA target sequence
atgtgctaagaggacttgtttca

SEQ ID NO: 5723 - DNA, 23 bp, Artificial sequence
  SiRNA target sequence
tgtgctaagaggacttgtttcaa

SEQ ID NO: 5724 - DNA, 23 bp, Artificial sequence
  SiRNA target sequence
gtgctaagaggacttgtttcaat

SEQ ID NO: 5725 - DNA, 23 bp, Artificial sequence
  SiRNA target sequence
tgctaagaggacttgtttcaata

SEQ ID NO: 5726 - DNA, 23 bp, Artificial sequence
  SiRNA target sequence
gctaagaggacttgtttcaataa

SEQ ID NO: 5727 - DNA, 23 bp, Artificial sequence
  SiRNA target sequence
ctaagaggacttgtttcaataaa

SEQ ID NO: 5728 - DNA, 23 bp, Artificial sequence
  SiRNA target sequence
taagaggacttgtttcaataaaa

SEQ ID NO: 5729 - DNA, 23 bp, Artificial sequence
  SiRNA target sequence
aagaggacttgtttcaataaaaa

SEQ ID NO: 5730 - DNA, 23 bp, Artificial sequence
  SiRNA target sequence
agaggacttgtttcaataaaaaa

SEQ ID NO: 5731 - DNA, 23 bp, Artificial sequence
  SiRNA target sequence
gaggacttgtttcaataaaaaat

SEQ ID NO: 5732 - DNA, 23 bp, Artificial sequence
  SiRNA target sequence
aggacttgtttcaataaaaaata

SEQ ID NO: 5733 - DNA, 23 bp, Artificial sequence
  SiRNA target sequence
ggacttgtttcaataaaaaatat

SEQ ID NO: 5734 - DNA, 23 bp, Artificial sequence
  SiRNA target sequence
gacttgtttcaataaaaaatata

SEQ ID NO: 5735 - DNA, 23 bp, Artificial sequence
  SiRNA target sequence
acttgtttcaataaaaaatataa

SEQ ID NO: 5736 - DNA, 23 bp, Artificial sequence
  SiRNA target sequence
cttgtttcaataaaaaatataaa

SEQ ID NO: 5737 - DNA, 23 bp, Artificial sequence
  SiRNA target sequence
ttgtttcaataaaaaatataaat

SEQ ID NO: 5738 - DNA, 23 bp, Artificial sequence
  SiRNA target sequence
tgtttcaataaaaaatataaatg

SEQ ID NO: 5739 - DNA, 23 bp, Artificial sequence
  SiRNA target sequence
gtttcaataaaaaatataaatga

SEQ ID NO: 5740 - DNA, 23 bp, Artificial sequence
  SiRNA target sequence
tttcaataaaaaatataaatgag

SEQ ID NO: 5741 - DNA, 23 bp, Artificial sequence
  SiRNA target sequence
ttcaataaaaaatataaatgaga

SEQ ID NO: 5742 - DNA, 23 bp, Artificial sequence
  SiRNA target sequence
tcaataaaaaatataaatgagat

SEQ ID NO: 5743 - DNA, 23 bp, Artificial sequence
  SiRNA target sequence
caataaaaaatataaatgagatt

SEQ ID NO: 5744 - DNA, 23 bp, Artificial sequence
  SiRNA target sequence
aataaaaaatataaatgagattt

SEQ ID NO: 5745 - DNA, 23 bp, Artificial sequence
  SiRNA target sequence
ataaaaaatataaatgagattta

SEQ ID NO: 5746 - DNA, 23 bp, Artificial sequence
  SiRNA target sequence
taaaaaatataaatgagatttat

SEQ ID NO: 5747 - DNA, 23 bp, Artificial sequence
  SiRNA target sequence
aaaaaatataaatgagatttatg

SEQ ID NO: 5748 - DNA, 23 bp, Artificial sequence
  SiRNA target sequence
aaaaatataaatgagatttatga

SEQ ID NO: 5749 - DNA, 23 bp, Artificial sequence
  SiRNA target sequence
aaaatataaatgagatttatgat

SEQ ID NO: 5750 - DNA, 23 bp, Artificial sequence
  SiRNA target sequence
aaatataaatgagatttatgatg

SEQ ID NO: 5751 - DNA, 23 bp, Artificial sequence
  SiRNA target sequence
aatataaatgagatttatgatgc

SEQ ID NO: 5752 - DNA, 23 bp, Artificial sequence
  SiRNA target sequence
atataaatgagatttatgatgca

SEQ ID NO: 5753 - DNA, 23 bp, Artificial sequence
  SiRNA target sequence
tataaatgagatttatgatgcat

SEQ ID NO: 5754 - DNA, 23 bp, Artificial sequence
  SiRNA target sequence
ataaatgagatttatgatgcatt

SEQ ID NO: 5755 - DNA, 23 bp, Artificial sequence
  SiRNA target sequence
taaatgagatttatgatgcattt

SEQ ID NO: 5756 - DNA, 23 bp, Artificial sequence
  SiRNA target sequence
aaatgagatttatgatgcatttg

SEQ ID NO: 5757 - DNA, 23 bp, Artificial sequence
  SiRNA target sequence
aatgagatttatgatgcatttgg

SEQ ID NO: 5758 - DNA, 23 bp, Artificial sequence
  SiRNA target sequence
atgagatttatgatgcatttgga

SEQ ID NO: 5759 - DNA, 23 bp, Artificial sequence
  SiRNA target sequence
tgagatttatgatgcatttggag

SEQ ID NO: 5760 - DNA, 23 bp, Artificial sequence
  SiRNA target sequence
gagatttatgatgcatttggagg

SEQ ID NO: 5761 - DNA, 23 bp, Artificial sequence
  SiRNA target sequence
agatttatgatgcatttggaggt

SEQ ID NO: 5762 - DNA, 23 bp, Artificial sequence
  SiRNA target sequence
gatttatgatgcatttggaggta

SEQ ID NO: 5763 - DNA, 23 bp, Artificial sequence
  SiRNA target sequence
atttatgatgcatttggaggtaa

SEQ ID NO: 5764 - DNA, 23 bp, Artificial sequence
  SiRNA target sequence
tttatgatgcatttggaggtaaa

SEQ ID NO: 5765 - DNA, 23 bp, Artificial sequence
  SiRNA target sequence
ttatgatgcatttggaggtaaat

SEQ ID NO: 5766 - DNA, 23 bp, Artificial sequence
  SiRNA target sequence
tatgatgcatttggaggtaaatc

SEQ ID NO: 5767 - DNA, 23 bp, Artificial sequence
  SiRNA target sequence
atgatgcatttggaggtaaatct

SEQ ID NO: 5768 - DNA, 23 bp, Artificial sequence
  SiRNA target sequence
tgatgcatttggaggtaaatcta

SEQ ID NO: 5769 - DNA, 23 bp, Artificial sequence
  SiRNA target sequence
gatgcatttggaggtaaatctaa

SEQ ID NO: 5770 - DNA, 23 bp, Artificial sequence
  SiRNA target sequence
atgcatttggaggtaaatctaag

SEQ ID NO: 5771 - DNA, 23 bp, Artificial sequence
  SiRNA target sequence
tgcatttggaggtaaatctaaga

SEQ ID NO: 5772 - DNA, 23 bp, Artificial sequence
  SiRNA target sequence
gcatttggaggtaaatctaagaa

SEQ ID NO: 5773 - DNA, 23 bp, Artificial sequence
  SiRNA target sequence
catttggaggtaaatctaagaag

SEQ ID NO: 5774 - DNA, 23 bp, Artificial sequence
  SiRNA target sequence
atttggaggtaaatctaagaagt

SEQ ID NO: 5775 - DNA, 23 bp, Artificial sequence
  SiRNA target sequence
tttggaggtaaatctaagaagtt

SEQ ID NO: 5776 - DNA, 23 bp, Artificial sequence
  SiRNA target sequence
ttggaggtaaatctaagaagttt

SEQ ID NO: 5777 - DNA, 23 bp, Artificial sequence
  SiRNA target sequence
tggaggtaaatctaagaagttta

SEQ ID NO: 5778 - DNA, 23 bp, Artificial sequence
  SiRNA target sequence
ggaggtaaatctaagaagtttaa

SEQ ID NO: 5779 - DNA, 23 bp, Artificial sequence
  SiRNA target sequence
gaggtaaatctaagaagtttaaa

SEQ ID NO: 5780 - DNA, 23 bp, Artificial sequence
  SiRNA target sequence
aggtaaatctaagaagtttaaat

SEQ ID NO: 5781 - DNA, 23 bp, Artificial sequence
  SiRNA target sequence
ggtaaatctaagaagtttaaatt

SEQ ID NO: 5782 - DNA, 23 bp, Artificial sequence
  SiRNA target sequence
gtaaatctaagaagtttaaattt

SEQ ID NO: 5783 - DNA, 23 bp, Artificial sequence
  SiRNA target sequence
taaatctaagaagtttaaatttt

SEQ ID NO: 5784 - DNA, 23 bp, Artificial sequence
  SiRNA target sequence
aaatctaagaagtttaaattttc

SEQ ID NO: 5785 - DNA, 23 bp, Artificial sequence
  SiRNA target sequence
aatctaagaagtttaaattttct

SEQ ID NO: 5786 - DNA, 23 bp, Artificial sequence
  SiRNA target sequence
atctaagaagtttaaattttcta

SEQ ID NO: 5787 - DNA, 23 bp, Artificial sequence
  SiRNA target sequence
tctaagaagtttaaattttctaa

SEQ ID NO: 5788 - DNA, 23 bp, Artificial sequence
  SiRNA target sequence
ctaagaagtttaaattttctaat

SEQ ID NO: 5789 - DNA, 23 bp, Artificial sequence
  SiRNA target sequence
taagaagtttaaattttctaatg

SEQ ID NO: 5790 - DNA, 23 bp, Artificial sequence
  SiRNA target sequence
aagaagtttaaattttctaatga

SEQ ID NO: 5791 - DNA, 23 bp, Artificial sequence
  SiRNA target sequence
agaagtttaaattttctaatgat

SEQ ID NO: 5792 - DNA, 23 bp, Artificial sequence
  SiRNA target sequence
gaagtttaaattttctaatgatg

SEQ ID NO: 5793 - DNA, 23 bp, Artificial sequence
  SiRNA target sequence
aagtttaaattttctaatgatga

SEQ ID NO: 5794 - DNA, 23 bp, Artificial sequence
  SiRNA target sequence
agtttaaattttctaatgatgaa

SEQ ID NO: 5795 - DNA, 23 bp, Artificial sequence
  SiRNA target sequence
gtttaaattttctaatgatgaaa

SEQ ID NO: 5796 - DNA, 23 bp, Artificial sequence
  SiRNA target sequence
tttaaattttctaatgatgaaaa

SEQ ID NO: 5797 - DNA, 23 bp, Artificial sequence
  SiRNA target sequence
ttaaattttctaatgatgaaaag

SEQ ID NO: 5798 - DNA, 23 bp, Artificial sequence
  SiRNA target sequence
taaattttctaatgatgaaaagg

SEQ ID NO: 5799 - DNA, 23 bp, Artificial sequence
  SiRNA target sequence
aaattttctaatgatgaaaagga

SEQ ID NO: 5800 - DNA, 23 bp, Artificial sequence
  SiRNA target sequence
aattttctaatgatgaaaaggaa

SEQ ID NO: 5801 - DNA, 23 bp, Artificial sequence
  SiRNA target sequence
attttctaatgatgaaaaggaag

SEQ ID NO: 5802 - DNA, 23 bp, Artificial sequence
  SiRNA target sequence
ttttctaatgatgaaaaggaagt

SEQ ID NO: 5803 - DNA, 23 bp, Artificial sequence
  SiRNA target sequence
tttctaatgatgaaaaggaagtg

SEQ ID NO: 5804 - DNA, 23 bp, Artificial sequence
  SiRNA target sequence
ttctaatgatgaaaaggaagtgt

SEQ ID NO: 5805 - DNA, 23 bp, Artificial sequence
  SiRNA target sequence
tctaatgatgaaaaggaagtgtt

SEQ ID NO: 5806 - DNA, 23 bp, Artificial sequence
  SiRNA target sequence
ctaatgatgaaaaggaagtgtta

SEQ ID NO: 5807 - DNA, 23 bp, Artificial sequence
  SiRNA target sequence
taatgatgaaaaggaagtgttaa

SEQ ID NO: 5808 - DNA, 23 bp, Artificial sequence
  SiRNA target sequence
aatgatgaaaaggaagtgttaaa

SEQ ID NO: 5809 - DNA, 23 bp, Artificial sequence
  SiRNA target sequence
atgatgaaaaggaagtgttaaat

SEQ ID NO: 5810 - DNA, 23 bp, Artificial sequence
  SiRNA target sequence
tgatgaaaaggaagtgttaaatc

SEQ ID NO: 5811 - DNA, 23 bp, Artificial sequence
  SiRNA target sequence
gatgaaaaggaagtgttaaatct

SEQ ID NO: 5812 - DNA, 23 bp, Artificial sequence
  SiRNA target sequence
atgaaaaggaagtgttaaatctt

SEQ ID NO: 5813 - DNA, 23 bp, Artificial sequence
  SiRNA target sequence
tgaaaaggaagtgttaaatcttc

SEQ ID NO: 5814 - DNA, 23 bp, Artificial sequence
  SiRNA target sequence
gaaaaggaagtgttaaatcttct

SEQ ID NO: 5815 - DNA, 23 bp, Artificial sequence
  SiRNA target sequence
aaaaggaagtgttaaatcttctt

SEQ ID NO: 5816 - DNA, 23 bp, Artificial sequence
  SiRNA target sequence
aaaggaagtgttaaatcttctta

SEQ ID NO: 5817 - DNA, 23 bp, Artificial sequence
  SiRNA target sequence
aaggaagtgttaaatcttcttaa

SEQ ID NO: 5818 - DNA, 23 bp, Artificial sequence
  SiRNA target sequence
aggaagtgttaaatcttcttaat

SEQ ID NO: 5819 - DNA, 23 bp, Artificial sequence
  SiRNA target sequence
ggaagtgttaaatcttcttaatg

SEQ ID NO: 5820 - DNA, 23 bp, Artificial sequence
  SiRNA target sequence
gaagtgttaaatcttcttaatgc

SEQ ID NO: 5821 - DNA, 23 bp, Artificial sequence
  SiRNA target sequence
aagtgttaaatcttcttaatgcc

SEQ ID NO: 5822 - DNA, 23 bp, Artificial sequence
  SiRNA target sequence
agtgttaaatcttcttaatgcca

SEQ ID NO: 5823 - DNA, 23 bp, Artificial sequence
  SiRNA target sequence
gtgttaaatcttcttaatgccat

SEQ ID NO: 5824 - DNA, 23 bp, Artificial sequence
  SiRNA target sequence
tgttaaatcttcttaatgccatt

SEQ ID NO: 5825 - DNA, 23 bp, Artificial sequence
  SiRNA target sequence
gttaaatcttcttaatgccatta

SEQ ID NO: 5826 - DNA, 23 bp, Artificial sequence
  SiRNA target sequence
ttaaatcttcttaatgccattat

SEQ ID NO: 5827 - DNA, 23 bp, Artificial sequence
  SiRNA target sequence
taaatcttcttaatgccattatt

SEQ ID NO: 5828 - DNA, 23 bp, Artificial sequence
  SiRNA target sequence
aaatcttcttaatgccattattt

SEQ ID NO: 5829 - DNA, 23 bp, Artificial sequence
  SiRNA target sequence
aatcttcttaatgccattatttt

SEQ ID NO: 5830 - DNA, 23 bp, Artificial sequence
  SiRNA target sequence
atcttcttaatgccattatttta

SEQ ID NO: 5831 - DNA, 23 bp, Artificial sequence
  SiRNA target sequence
tcttcttaatgccattattttac

SEQ ID NO: 5832 - DNA, 23 bp, Artificial sequence
  SiRNA target sequence
cttcttaatgccattattttaca

SEQ ID NO: 5833 - DNA, 23 bp, Artificial sequence
  SiRNA target sequence
ttcttaatgccattattttacac

SEQ ID NO: 5834 - DNA, 23 bp, Artificial sequence
  SiRNA target sequence
tcttaatgccattattttacacc

SEQ ID NO: 5835 - DNA, 23 bp, Artificial sequence
  SiRNA target sequence
cttaatgccattattttacacct

SEQ ID NO: 5836 - DNA, 23 bp, Artificial sequence
  SiRNA target sequence
ttaatgccattattttacaccta

SEQ ID NO: 5837 - DNA, 23 bp, Artificial sequence
  SiRNA target sequence
taatgccattattttacacctaa

SEQ ID NO: 5838 - DNA, 23 bp, Artificial sequence
  SiRNA target sequence
aatgccattattttacacctaaa

SEQ ID NO: 5839 - DNA, 23 bp, Artificial sequence
  SiRNA target sequence
atgccattattttacacctaaaa

SEQ ID NO: 5840 - DNA, 23 bp, Artificial sequence
  SiRNA target sequence
tgccattattttacacctaaaag

SEQ ID NO: 5841 - DNA, 23 bp, Artificial sequence
  SiRNA target sequence
gccattattttacacctaaaagg

SEQ ID NO: 5842 - DNA, 23 bp, Artificial sequence
  SiRNA target sequence
ccattattttacacctaaaagga

SEQ ID NO: 5843 - DNA, 23 bp, Artificial sequence
  SiRNA target sequence
cattattttacacctaaaaggaa

SEQ ID NO: 5844 - DNA, 23 bp, Artificial sequence
  SiRNA target sequence
attattttacacctaaaaggaaa

SEQ ID NO: 5845 - DNA, 23 bp, Artificial sequence
  SiRNA target sequence
ttattttacacctaaaaggaaaa

SEQ ID NO: 5846 - DNA, 23 bp, Artificial sequence
  SiRNA target sequence
tattttacacctaaaaggaaaaa

SEQ ID NO: 5847 - DNA, 23 bp, Artificial sequence
  SiRNA target sequence
attttacacctaaaaggaaaaaa

SEQ ID NO: 5848 - DNA, 23 bp, Artificial sequence
  SiRNA target sequence
ttttacacctaaaaggaaaaaaa

SEQ ID NO: 5849 - DNA, 23 bp, Artificial sequence
  SiRNA target sequence
tttacacctaaaaggaaaaaaag

SEQ ID NO: 5850 - DNA, 23 bp, Artificial sequence
  SiRNA target sequence
ttacacctaaaaggaaaaaaaga

SEQ ID NO: 5851 - DNA, 23 bp, Artificial sequence
  SiRNA target sequence
tacacctaaaaggaaaaaaagaa

SEQ ID NO: 5852 - DNA, 23 bp, Artificial sequence
  SiRNA target sequence
acacctaaaaggaaaaaaagaac

SEQ ID NO: 5853 - DNA, 23 bp, Artificial sequence
  SiRNA target sequence
cacctaaaaggaaaaaaagaaca

SEQ ID NO: 5854 - DNA, 23 bp, Artificial sequence
  SiRNA target sequence
acctaaaaggaaaaaaagaacag

SEQ ID NO: 5855 - DNA, 23 bp, Artificial sequence
  SiRNA target sequence
cctaaaaggaaaaaaagaacagg

SEQ ID NO: 5856 - DNA, 23 bp, Artificial sequence
  SiRNA target sequence
ctaaaaggaaaaaaagaacaggc

SEQ ID NO: 5857 - DNA, 23 bp, Artificial sequence
  SiRNA target sequence
taaaaggaaaaaaagaacaggca

SEQ ID NO: 5858 - DNA, 23 bp, Artificial sequence
  SiRNA target sequence
aaaaggaaaaaaagaacaggcaa

SEQ ID NO: 5859 - DNA, 23 bp, Artificial sequence
  SiRNA target sequence
aaaggaaaaaaagaacaggcaat

SEQ ID NO: 5860 - DNA, 23 bp, Artificial sequence
  SiRNA target sequence
aaggaaaaaaagaacaggcaatt

SEQ ID NO: 5861 - DNA, 23 bp, Artificial sequence
  SiRNA target sequence
aggaaaaaaagaacaggcaattc

SEQ ID NO: 5862 - DNA, 23 bp, Artificial sequence
  SiRNA target sequence
ggaaaaaaagaacaggcaattct

SEQ ID NO: 5863 - DNA, 23 bp, Artificial sequence
  SiRNA target sequence
gaaaaaaagaacaggcaattctt

SEQ ID NO: 5864 - DNA, 23 bp, Artificial sequence
  SiRNA target sequence
aaaaaaagaacaggcaattcttt

SEQ ID NO: 5865 - DNA, 23 bp, Artificial sequence
  SiRNA target sequence
aaaaaagaacaggcaattctttt

SEQ ID NO: 5866 - DNA, 23 bp, Artificial sequence
  SiRNA target sequence
aaaaagaacaggcaattctttta

SEQ ID NO: 5867 - DNA, 23 bp, Artificial sequence
  SiRNA target sequence
aaaagaacaggcaattcttttat

SEQ ID NO: 5868 - DNA, 23 bp, Artificial sequence
  SiRNA target sequence
aaagaacaggcaattcttttatt

SEQ ID NO: 5869 - DNA, 23 bp, Artificial sequence
  SiRNA target sequence
aagaacaggcaattcttttatta

SEQ ID NO: 5870 - DNA, 23 bp, Artificial sequence
  SiRNA target sequence
agaacaggcaattcttttattag

SEQ ID NO: 5871 - DNA, 23 bp, Artificial sequence
  SiRNA target sequence
gaacaggcaattcttttattaga

SEQ ID NO: 5872 - DNA, 23 bp, Artificial sequence
  SiRNA target sequence
aacaggcaattcttttattagaa

SEQ ID NO: 5873 - DNA, 23 bp, Artificial sequence
  SiRNA target sequence
acaggcaattcttttattagaaa

SEQ ID NO: 5874 - DNA, 23 bp, Artificial sequence
  SiRNA target sequence
caggcaattcttttattagaaaa

SEQ ID NO: 5875 - DNA, 23 bp, Artificial sequence
  SiRNA target sequence
aggcaattcttttattagaaaaa

SEQ ID NO: 5876 - DNA, 23 bp, Artificial sequence
  SiRNA target sequence
ggcaattcttttattagaaaaat

SEQ ID NO: 5877 - DNA, 23 bp, Artificial sequence
  SiRNA target sequence
gcaattcttttattagaaaaatc

SEQ ID NO: 5878 - DNA, 23 bp, Artificial sequence
  SiRNA target sequence
caattcttttattagaaaaatct

SEQ ID NO: 5879 - DNA, 23 bp, Artificial sequence
  SiRNA target sequence
aattcttttattagaaaaatcta

SEQ ID NO: 5880 - DNA, 23 bp, Artificial sequence
  SiRNA target sequence
attcttttattagaaaaatctac

SEQ ID NO: 5881 - DNA, 23 bp, Artificial sequence
  SiRNA target sequence
ttcttttattagaaaaatctact

SEQ ID NO: 5882 - DNA, 23 bp, Artificial sequence
  SiRNA target sequence
tcttttattagaaaaatctactt

SEQ ID NO: 5883 - DNA, 23 bp, Artificial sequence
  SiRNA target sequence
cttttattagaaaaatctactta

SEQ ID NO: 5884 - DNA, 23 bp, Artificial sequence
  SiRNA target sequence
ttttattagaaaaatctacttat

SEQ ID NO: 5885 - DNA, 23 bp, Artificial sequence
  SiRNA target sequence
tttattagaaaaatctacttata

SEQ ID NO: 5886 - DNA, 23 bp, Artificial sequence
  SiRNA target sequence
ttattagaaaaatctacttataa

SEQ ID NO: 5887 - DNA, 23 bp, Artificial sequence
  SiRNA target sequence
tattagaaaaatctacttataaa

SEQ ID NO: 5888 - DNA, 23 bp, Artificial sequence
  SiRNA target sequence
attagaaaaatctacttataaat

SEQ ID NO: 5889 - DNA, 23 bp, Artificial sequence
  SiRNA target sequence
ttagaaaaatctacttataaata

SEQ ID NO: 5890 - DNA, 23 bp, Artificial sequence
  SiRNA target sequence
tagaaaaatctacttataaatac

SEQ ID NO: 5891 - DNA, 23 bp, Artificial sequence
  SiRNA target sequence
agaaaaatctacttataaataca

SEQ ID NO: 5892 - DNA, 23 bp, Artificial sequence
  SiRNA target sequence
gaaaaatctacttataaatacag

SEQ ID NO: 5893 - DNA, 23 bp, Artificial sequence
  SiRNA target sequence
aaaaatctacttataaatacagt

SEQ ID NO: 5894 - DNA, 23 bp, Artificial sequence
  SiRNA target sequence
aaaatctacttataaatacagta

SEQ ID NO: 5895 - DNA, 23 bp, Artificial sequence
  SiRNA target sequence
aaatctacttataaatacagtat

SEQ ID NO: 5896 - DNA, 23 bp, Artificial sequence
  SiRNA target sequence
aatctacttataaatacagtatc

SEQ ID NO: 5897 - DNA, 23 bp, Artificial sequence
  SiRNA target sequence
atctacttataaatacagtatct

SEQ ID NO: 5898 - DNA, 23 bp, Artificial sequence
  SiRNA target sequence
tctacttataaatacagtatctt

SEQ ID NO: 5899 - DNA, 23 bp, Artificial sequence
  SiRNA target sequence
ctacttataaatacagtatcttg

SEQ ID NO: 5900 - DNA, 23 bp, Artificial sequence
  SiRNA target sequence
tacttataaatacagtatcttgt

SEQ ID NO: 5901 - DNA, 23 bp, Artificial sequence
  SiRNA target sequence
acttataaatacagtatcttgta

SEQ ID NO: 5902 - DNA, 23 bp, Artificial sequence
  SiRNA target sequence
cttataaatacagtatcttgtat

SEQ ID NO: 5903 - DNA, 23 bp, Artificial sequence
  SiRNA target sequence
ttataaatacagtatcttgtata

SEQ ID NO: 5904 - DNA, 23 bp, Artificial sequence
  SiRNA target sequence
tataaatacagtatcttgtatag

SEQ ID NO: 5905 - DNA, 23 bp, Artificial sequence
  SiRNA target sequence
ataaatacagtatcttgtataga

SEQ ID NO: 5906 - DNA, 23 bp, Artificial sequence
  SiRNA target sequence
taaatacagtatcttgtatagag

SEQ ID NO: 5907 - DNA, 23 bp, Artificial sequence
  SiRNA target sequence
aaatacagtatcttgtatagagc

SEQ ID NO: 5908 - DNA, 23 bp, Artificial sequence
  SiRNA target sequence
aatacagtatcttgtatagagca

SEQ ID NO: 5909 - DNA, 23 bp, Artificial sequence
  SiRNA target sequence
atacagtatcttgtatagagcat

SEQ ID NO: 5910 - DNA, 23 bp, Artificial sequence
  SiRNA target sequence
tacagtatcttgtatagagcata

SEQ ID NO: 5911 - DNA, 23 bp, Artificial sequence
  SiRNA target sequence
acagtatcttgtatagagcatat

SEQ ID NO: 5912 - DNA, 23 bp, Artificial sequence
  SiRNA target sequence
cagtatcttgtatagagcatatt

SEQ ID NO: 5913 - DNA, 23 bp, Artificial sequence
  SiRNA target sequence
agtatcttgtatagagcatattt

SEQ ID NO: 5914 - DNA, 23 bp, Artificial sequence
  SiRNA target sequence
gtatcttgtatagagcatatttt

SEQ ID NO: 5915 - DNA, 23 bp, Artificial sequence
  SiRNA target sequence
tatcttgtatagagcatattttc

SEQ ID NO: 5916 - DNA, 23 bp, Artificial sequence
  SiRNA target sequence
atcttgtatagagcatattttct

SEQ ID NO: 5917 - DNA, 23 bp, Artificial sequence
  SiRNA target sequence
tcttgtatagagcatattttctt

SEQ ID NO: 5918 - DNA, 23 bp, Artificial sequence
  SiRNA target sequence
cttgtatagagcatattttctta

SEQ ID NO: 5919 - DNA, 23 bp, Artificial sequence
  SiRNA target sequence
ttgtatagagcatattttcttac

SEQ ID NO: 5920 - DNA, 23 bp, Artificial sequence
  SiRNA target sequence
tgtatagagcatattttcttaca

SEQ ID NO: 5921 - DNA, 23 bp, Artificial sequence
  SiRNA target sequence
gtatagagcatattttcttacat

SEQ ID NO: 5922 - DNA, 23 bp, Artificial sequence
  SiRNA target sequence
tatagagcatattttcttacatt

SEQ ID NO: 5923 - DNA, 23 bp, Artificial sequence
  SiRNA target sequence
atagagcatattttcttacattg

SEQ ID NO: 5924 - DNA, 23 bp, Artificial sequence
  SiRNA target sequence
tagagcatattttcttacattga

SEQ ID NO: 5925 - DNA, 23 bp, Artificial sequence
  SiRNA target sequence
agagcatattttcttacattgaa

SEQ ID NO: 5926 - DNA, 23 bp, Artificial sequence
  SiRNA target sequence
gagcatattttcttacattgaag

SEQ ID NO: 5927 - DNA, 23 bp, Artificial sequence
  SiRNA target sequence
agcatattttcttacattgaaga

SEQ ID NO: 5928 - DNA, 23 bp, Artificial sequence
  SiRNA target sequence
gcatattttcttacattgaagaa

SEQ ID NO: 5929 - DNA, 23 bp, Artificial sequence
  SiRNA target sequence
catattttcttacattgaagaat

SEQ ID NO: 5930 - DNA, 23 bp, Artificial sequence
  SiRNA target sequence
atattttcttacattgaagaatg

SEQ ID NO: 5931 - DNA, 23 bp, Artificial sequence
  SiRNA target sequence
tattttcttacattgaagaatga

SEQ ID NO: 5932 - DNA, 23 bp, Artificial sequence
  SiRNA target sequence
attttcttacattgaagaatgaa

SEQ ID NO: 5933 - DNA, 23 bp, Artificial sequence
  SiRNA target sequence
ttttcttacattgaagaatgaat

SEQ ID NO: 5934 - DNA, 23 bp, Artificial sequence
  SiRNA target sequence
tttcttacattgaagaatgaata

SEQ ID NO: 5935 - DNA, 23 bp, Artificial sequence
  SiRNA target sequence
ttcttacattgaagaatgaatat

SEQ ID NO: 5936 - DNA, 23 bp, Artificial sequence
  SiRNA target sequence
tcttacattgaagaatgaatata

SEQ ID NO: 5937 - DNA, 23 bp, Artificial sequence
  SiRNA target sequence
cttacattgaagaatgaatatat

SEQ ID NO: 5938 - DNA, 23 bp, Artificial sequence
  SiRNA target sequence
ttacattgaagaatgaatatatt

SEQ ID NO: 5939 - DNA, 23 bp, Artificial sequence
  SiRNA target sequence
tacattgaagaatgaatatattt

SEQ ID NO: 5940 - DNA, 23 bp, Artificial sequence
  SiRNA target sequence
acattgaagaatgaatatatttc

SEQ ID NO: 5941 - DNA, 23 bp, Artificial sequence
  SiRNA target sequence
cattgaagaatgaatatatttca

SEQ ID NO: 5942 - DNA, 23 bp, Artificial sequence
  SiRNA target sequence
attgaagaatgaatatatttcat

SEQ ID NO: 5943 - DNA, 23 bp, Artificial sequence
  SiRNA target sequence
ttgaagaatgaatatatttcatc

SEQ ID NO: 5944 - DNA, 23 bp, Artificial sequence
  SiRNA target sequence
tgaagaatgaatatatttcatct

SEQ ID NO: 5945 - DNA, 23 bp, Artificial sequence
  SiRNA target sequence
gaagaatgaatatatttcatctt

SEQ ID NO: 5946 - DNA, 23 bp, Artificial sequence
  SiRNA target sequence
aagaatgaatatatttcatcttc

SEQ ID NO: 5947 - DNA, 23 bp, Artificial sequence
  SiRNA target sequence
agaatgaatatatttcatcttca

SEQ ID NO: 5948 - DNA, 23 bp, Artificial sequence
  SiRNA target sequence
gaatgaatatatttcatcttcat

SEQ ID NO: 5949 - DNA, 23 bp, Artificial sequence
  SiRNA target sequence
aatgaatatatttcatcttcatt

SEQ ID NO: 5950 - DNA, 23 bp, Artificial sequence
  SiRNA target sequence
atgaatatatttcatcttcattg

SEQ ID NO: 5951 - DNA, 23 bp, Artificial sequence
  SiRNA target sequence
tgaatatatttcatcttcattgc

SEQ ID NO: 5952 - DNA, 23 bp, Artificial sequence
  SiRNA target sequence
gaatatatttcatcttcattgcc

SEQ ID NO: 5953 - DNA, 23 bp, Artificial sequence
  SiRNA target sequence
aatatatttcatcttcattgcct

SEQ ID NO: 5954 - DNA, 23 bp, Artificial sequence
  SiRNA target sequence
atatatttcatcttcattgcctt

SEQ ID NO: 5955 - DNA, 23 bp, Artificial sequence
  SiRNA target sequence
tatatttcatcttcattgccttt

SEQ ID NO: 5956 - DNA, 23 bp, Artificial sequence
  SiRNA target sequence
atatttcatcttcattgccttta

SEQ ID NO: 5957 - DNA, 23 bp, Artificial sequence
  SiRNA target sequence
tatttcatcttcattgcctttag

SEQ ID NO: 5958 - DNA, 23 bp, Artificial sequence
  SiRNA target sequence
atttcatcttcattgcctttaga

SEQ ID NO: 5959 - DNA, 23 bp, Artificial sequence
  SiRNA target sequence
tttcatcttcattgcctttagat

SEQ ID NO: 5960 - DNA, 23 bp, Artificial sequence
  SiRNA target sequence
ttcatcttcattgcctttagatg

SEQ ID NO: 5961 - DNA, 23 bp, Artificial sequence
  SiRNA target sequence
tcatcttcattgcctttagatga

SEQ ID NO: 5962 - DNA, 23 bp, Artificial sequence
  SiRNA target sequence
catcttcattgcctttagatgac

SEQ ID NO: 5963 - DNA, 23 bp, Artificial sequence
  SiRNA target sequence
atcttcattgcctttagatgacg

SEQ ID NO: 5964 - DNA, 23 bp, Artificial sequence
  SiRNA target sequence
tcttcattgcctttagatgacga

SEQ ID NO: 5965 - DNA, 23 bp, Artificial sequence
  SiRNA target sequence
cttcattgcctttagatgacgag

SEQ ID NO: 5966 - DNA, 23 bp, Artificial sequence
  SiRNA target sequence
ttcattgcctttagatgacgaga

SEQ ID NO: 5967 - DNA, 23 bp, Artificial sequence
  SiRNA target sequence
tcattgcctttagatgacgagat

SEQ ID NO: 5968 - DNA, 23 bp, Artificial sequence
  SiRNA target sequence
cattgcctttagatgacgagatt

SEQ ID NO: 5969 - DNA, 23 bp, Artificial sequence
  SiRNA target sequence
attgcctttagatgacgagatta

SEQ ID NO: 5970 - DNA, 23 bp, Artificial sequence
  SiRNA target sequence
ttgcctttagatgacgagattac

SEQ ID NO: 5971 - DNA, 23 bp, Artificial sequence
  SiRNA target sequence
tgcctttagatgacgagattact

SEQ ID NO: 5972 - DNA, 23 bp, Artificial sequence
  SiRNA target sequence
gcctttagatgacgagattacta

SEQ ID NO: 5973 - DNA, 23 bp, Artificial sequence
  SiRNA target sequence
cctttagatgacgagattactac

SEQ ID NO: 5974 - DNA, 23 bp, Artificial sequence
  SiRNA target sequence
ctttagatgacgagattactacg

SEQ ID NO: 5975 - DNA, 23 bp, Artificial sequence
  SiRNA target sequence
tttagatgacgagattactacgc

SEQ ID NO: 5976 - DNA, 23 bp, Artificial sequence
  SiRNA target sequence
ttagatgacgagattactacgct

SEQ ID NO: 5977 - DNA, 23 bp, Artificial sequence
  SiRNA target sequence
tagatgacgagattactacgctt

SEQ ID NO: 5978 - DNA, 23 bp, Artificial sequence
  SiRNA target sequence
agatgacgagattactacgcttt

SEQ ID NO: 5979 - DNA, 23 bp, Artificial sequence
  SiRNA target sequence
gatgacgagattactacgcttta

SEQ ID NO: 5980 - DNA, 23 bp, Artificial sequence
  SiRNA target sequence
atgacgagattactacgctttac

SEQ ID NO: 5981 - DNA, 23 bp, Artificial sequence
  SiRNA target sequence
tgacgagattactacgctttact

SEQ ID NO: 5982 - DNA, 23 bp, Artificial sequence
  SiRNA target sequence
gacgagattactacgctttactt

SEQ ID NO: 5983 - DNA, 23 bp, Artificial sequence
  SiRNA target sequence
acgagattactacgctttacttg

SEQ ID NO: 5984 - DNA, 23 bp, Artificial sequence
  SiRNA target sequence
cgagattactacgctttacttgt

SEQ ID NO: 5985 - DNA, 23 bp, Artificial sequence
  SiRNA target sequence
gagattactacgctttacttgta

SEQ ID NO: 5986 - DNA, 23 bp, Artificial sequence
  SiRNA target sequence
agattactacgctttacttgtat

SEQ ID NO: 5987 - DNA, 23 bp, Artificial sequence
  SiRNA target sequence
gattactacgctttacttgtatt

SEQ ID NO: 5988 - DNA, 23 bp, Artificial sequence
  SiRNA target sequence
attactacgctttacttgtattc

SEQ ID NO: 5989 - DNA, 23 bp, Artificial sequence
  SiRNA target sequence
ttactacgctttacttgtattct

SEQ ID NO: 5990 - DNA, 23 bp, Artificial sequence
  SiRNA target sequence
tactacgctttacttgtattcta

SEQ ID NO: 5991 - DNA, 23 bp, Artificial sequence
  SiRNA target sequence
actacgctttacttgtattctaa

SEQ ID NO: 5992 - DNA, 23 bp, Artificial sequence
  SiRNA target sequence
ctacgctttacttgtattctaag

SEQ ID NO: 5993 - DNA, 23 bp, Artificial sequence
  SiRNA target sequence
tacgctttacttgtattctaaga

SEQ ID NO: 5994 - DNA, 23 bp, Artificial sequence
  SiRNA target sequence
acgctttacttgtattctaagat

SEQ ID NO: 5995 - DNA, 23 bp, Artificial sequence
  SiRNA target sequence
cgctttacttgtattctaagatt

SEQ ID NO: 5996 - DNA, 23 bp, Artificial sequence
  SiRNA target sequence
gctttacttgtattctaagattt

SEQ ID NO: 5997 - DNA, 23 bp, Artificial sequence
  SiRNA target sequence
ctttacttgtattctaagatttt

SEQ ID NO: 5998 - DNA, 23 bp, Artificial sequence
  SiRNA target sequence
tttacttgtattctaagattttt

SEQ ID NO: 5999 - DNA, 23 bp, Artificial sequence
  SiRNA target sequence
ttacttgtattctaagattttta

SEQ ID NO: 6000 - DNA, 23 bp, Artificial sequence
  SiRNA target sequence
tacttgtattctaagatttttaa

SEQ ID NO: 6001 - DNA, 23 bp, Artificial sequence
  SiRNA target sequence
acttgtattctaagatttttaaa

SEQ ID NO: 6002 - DNA, 23 bp, Artificial sequence
  SiRNA target sequence
cttgtattctaagatttttaaag

SEQ ID NO: 6003 - DNA, 23 bp, Artificial sequence
  SiRNA target sequence
ttgtattctaagatttttaaaga

SEQ ID NO: 6004 - DNA, 23 bp, Artificial sequence
  SiRNA target sequence
tgtattctaagatttttaaagat

SEQ ID NO: 6005 - DNA, 23 bp, Artificial sequence
  SiRNA target sequence
gtattctaagatttttaaagata

SEQ ID NO: 6006 - DNA, 23 bp, Artificial sequence
  SiRNA target sequence
tattctaagatttttaaagataa

SEQ ID NO: 6007 - DNA, 23 bp, Artificial sequence
  SiRNA target sequence
attctaagatttttaaagataaa

SEQ ID NO: 6008 - DNA, 23 bp, Artificial sequence
  SiRNA target sequence
ttctaagatttttaaagataaat

SEQ ID NO: 6009 - DNA, 23 bp, Artificial sequence
  SiRNA target sequence
tctaagatttttaaagataaatc

SEQ ID NO: 6010 - DNA, 23 bp, Artificial sequence
  SiRNA target sequence
ctaagatttttaaagataaatct

SEQ ID NO: 6011 - DNA, 23 bp, Artificial sequence
  SiRNA target sequence
taagatttttaaagataaatctg

SEQ ID NO: 6012 - DNA, 23 bp, Artificial sequence
  SiRNA target sequence
aagatttttaaagataaatctga

SEQ ID NO: 6013 - DNA, 23 bp, Artificial sequence
  SiRNA target sequence
agatttttaaagataaatctgat

SEQ ID NO: 6014 - DNA, 23 bp, Artificial sequence
  SiRNA target sequence
gatttttaaagataaatctgata

SEQ ID NO: 6015 - DNA, 23 bp, Artificial sequence
  SiRNA target sequence
atttttaaagataaatctgatac

SEQ ID NO: 6016 - DNA, 23 bp, Artificial sequence
  SiRNA target sequence
tttttaaagataaatctgatact

SEQ ID NO: 6017 - DNA, 23 bp, Artificial sequence
  SiRNA target sequence
ttttaaagataaatctgatactt

SEQ ID NO: 6018 - DNA, 23 bp, Artificial sequence
  SiRNA target sequence
tttaaagataaatctgatactta

SEQ ID NO: 6019 - DNA, 23 bp, Artificial sequence
  SiRNA target sequence
ttaaagataaatctgatacttac

SEQ ID NO: 6020 - DNA, 23 bp, Artificial sequence
  SiRNA target sequence
taaagataaatctgatacttacc

SEQ ID NO: 6021 - DNA, 23 bp, Artificial sequence
  SiRNA target sequence
aaagataaatctgatacttacct

SEQ ID NO: 6022 - DNA, 23 bp, Artificial sequence
  SiRNA target sequence
aagataaatctgatacttacctt

SEQ ID NO: 6023 - DNA, 23 bp, Artificial sequence
  SiRNA target sequence
agataaatctgatacttacctta

SEQ ID NO: 6024 - DNA, 23 bp, Artificial sequence
  SiRNA target sequence
gataaatctgatacttaccttaa

SEQ ID NO: 6025 - DNA, 23 bp, Artificial sequence
  SiRNA target sequence
ataaatctgatacttaccttaaa

SEQ ID NO: 6026 - DNA, 23 bp, Artificial sequence
  SiRNA target sequence
taaatctgatacttaccttaaat

SEQ ID NO: 6027 - DNA, 23 bp, Artificial sequence
  SiRNA target sequence
aaatctgatacttaccttaaatc

SEQ ID NO: 6028 - DNA, 23 bp, Artificial sequence
  SiRNA target sequence
aatctgatacttaccttaaatct

SEQ ID NO: 6029 - DNA, 23 bp, Artificial sequence
  SiRNA target sequence
atctgatacttaccttaaatctg

SEQ ID NO: 6030 - DNA, 23 bp, Artificial sequence
  SiRNA target sequence
tctgatacttaccttaaatctgc

SEQ ID NO: 6031 - DNA, 23 bp, Artificial sequence
  SiRNA target sequence
ctgatacttaccttaaatctgct

SEQ ID NO: 6032 - DNA, 23 bp, Artificial sequence
  SiRNA target sequence
tgatacttaccttaaatctgcta

SEQ ID NO: 6033 - DNA, 23 bp, Artificial sequence
  SiRNA target sequence
gatacttaccttaaatctgctat

SEQ ID NO: 6034 - DNA, 23 bp, Artificial sequence
  SiRNA target sequence
atacttaccttaaatctgctata

SEQ ID NO: 6035 - DNA, 23 bp, Artificial sequence
  SiRNA target sequence
tacttaccttaaatctgctatag

SEQ ID NO: 6036 - DNA, 23 bp, Artificial sequence
  SiRNA target sequence
acttaccttaaatctgctataga

SEQ ID NO: 6037 - DNA, 23 bp, Artificial sequence
  SiRNA target sequence
cttaccttaaatctgctatagat

SEQ ID NO: 6038 - DNA, 23 bp, Artificial sequence
  SiRNA target sequence
ttaccttaaatctgctatagata

SEQ ID NO: 6039 - DNA, 23 bp, Artificial sequence
  SiRNA target sequence
taccttaaatctgctatagataa

SEQ ID NO: 6040 - DNA, 23 bp, Artificial sequence
  SiRNA target sequence
accttaaatctgctatagataaa

SEQ ID NO: 6041 - DNA, 23 bp, Artificial sequence
  SiRNA target sequence
ccttaaatctgctatagataaat

SEQ ID NO: 6042 - DNA, 23 bp, Artificial sequence
  SiRNA target sequence
cttaaatctgctatagataaatc

SEQ ID NO: 6043 - DNA, 23 bp, Artificial sequence
  SiRNA target sequence
ttaaatctgctatagataaatca

SEQ ID NO: 6044 - DNA, 23 bp, Artificial sequence
  SiRNA target sequence
taaatctgctatagataaatcag

SEQ ID NO: 6045 - DNA, 23 bp, Artificial sequence
  SiRNA target sequence
aaatctgctatagataaatcagt

SEQ ID NO: 6046 - DNA, 23 bp, Artificial sequence
  SiRNA target sequence
aatctgctatagataaatcagta

SEQ ID NO: 6047 - DNA, 23 bp, Artificial sequence
  SiRNA target sequence
atctgctatagataaatcagtag

SEQ ID NO: 6048 - DNA, 23 bp, Artificial sequence
  SiRNA target sequence
tctgctatagataaatcagtaga

SEQ ID NO: 6049 - DNA, 23 bp, Artificial sequence
  SiRNA target sequence
ctgctatagataaatcagtagat

SEQ ID NO: 6050 - DNA, 23 bp, Artificial sequence
  SiRNA target sequence
tgctatagataaatcagtagatc

SEQ ID NO: 6051 - DNA, 23 bp, Artificial sequence
  SiRNA target sequence
gctatagataaatcagtagatct

SEQ ID NO: 6052 - DNA, 23 bp, Artificial sequence
  SiRNA target sequence
ctatagataaatcagtagatcta

SEQ ID NO: 6053 - DNA, 23 bp, Artificial sequence
  SiRNA target sequence
tatagataaatcagtagatctac

SEQ ID NO: 6054 - DNA, 23 bp, Artificial sequence
  SiRNA target sequence
atagataaatcagtagatctacc

SEQ ID NO: 6055 - DNA, 23 bp, Artificial sequence
  SiRNA target sequence
tagataaatcagtagatctacct

SEQ ID NO: 6056 - DNA, 23 bp, Artificial sequence
  SiRNA target sequence
agataaatcagtagatctaccta

SEQ ID NO: 6057 - DNA, 23 bp, Artificial sequence
  SiRNA target sequence
gataaatcagtagatctacctat

SEQ ID NO: 6058 - DNA, 23 bp, Artificial sequence
  SiRNA target sequence
ataaatcagtagatctacctatt

SEQ ID NO: 6059 - DNA, 23 bp, Artificial sequence
  SiRNA target sequence
taaatcagtagatctacctattg

SEQ ID NO: 6060 - DNA, 23 bp, Artificial sequence
  SiRNA target sequence
aaatcagtagatctacctattga

SEQ ID NO: 6061 - DNA, 23 bp, Artificial sequence
  SiRNA target sequence
aatcagtagatctacctattgaa

SEQ ID NO: 6062 - DNA, 23 bp, Artificial sequence
  SiRNA target sequence
atcagtagatctacctattgaac

SEQ ID NO: 6063 - DNA, 23 bp, Artificial sequence
  SiRNA target sequence
tcagtagatctacctattgaaca

SEQ ID NO: 6064 - DNA, 23 bp, Artificial sequence
  SiRNA target sequence
cagtagatctacctattgaacag

SEQ ID NO: 6065 - DNA, 23 bp, Artificial sequence
  SiRNA target sequence
agtagatctacctattgaacaga

SEQ ID NO: 6066 - DNA, 23 bp, Artificial sequence
  SiRNA target sequence
gtagatctacctattgaacagaa

SEQ ID NO: 6067 - DNA, 23 bp, Artificial sequence
  SiRNA target sequence
tagatctacctattgaacagaaa

SEQ ID NO: 6068 - DNA, 23 bp, Artificial sequence
  SiRNA target sequence
agatctacctattgaacagaaag

SEQ ID NO: 6069 - DNA, 23 bp, Artificial sequence
  SiRNA target sequence
gatctacctattgaacagaaaga

SEQ ID NO: 6070 - DNA, 23 bp, Artificial sequence
  SiRNA target sequence
atctacctattgaacagaaagac

SEQ ID NO: 6071 - DNA, 23 bp, Artificial sequence
  SiRNA target sequence
tctacctattgaacagaaagact

SEQ ID NO: 6072 - DNA, 23 bp, Artificial sequence
  SiRNA target sequence
ctacctattgaacagaaagactt

SEQ ID NO: 6073 - DNA, 23 bp, Artificial sequence
  SiRNA target sequence
tacctattgaacagaaagacttt

SEQ ID NO: 6074 - DNA, 23 bp, Artificial sequence
  SiRNA target sequence
acctattgaacagaaagactttc

SEQ ID NO: 6075 - DNA, 23 bp, Artificial sequence
  SiRNA target sequence
cctattgaacagaaagactttct

SEQ ID NO: 6076 - DNA, 23 bp, Artificial sequence
  SiRNA target sequence
ctattgaacagaaagactttctg

SEQ ID NO: 6077 - DNA, 23 bp, Artificial sequence
  SiRNA target sequence
tattgaacagaaagactttctgt

SEQ ID NO: 6078 - DNA, 23 bp, Artificial sequence
  SiRNA target sequence
attgaacagaaagactttctgta

SEQ ID NO: 6079 - DNA, 23 bp, Artificial sequence
  SiRNA target sequence
ttgaacagaaagactttctgtac

SEQ ID NO: 6080 - DNA, 23 bp, Artificial sequence
  SiRNA target sequence
tgaacagaaagactttctgtacg

SEQ ID NO: 6081 - DNA, 23 bp, Artificial sequence
  SiRNA target sequence
gaacagaaagactttctgtacgt

SEQ ID NO: 6082 - DNA, 23 bp, Artificial sequence
  SiRNA target sequence
aacagaaagactttctgtacgta

SEQ ID NO: 6083 - DNA, 23 bp, Artificial sequence
  SiRNA target sequence
acagaaagactttctgtacgtag

SEQ ID NO: 6084 - DNA, 23 bp, Artificial sequence
  SiRNA target sequence
cagaaagactttctgtacgtaga

SEQ ID NO: 6085 - DNA, 23 bp, Artificial sequence
  SiRNA target sequence
agaaagactttctgtacgtagat

SEQ ID NO: 6086 - DNA, 23 bp, Artificial sequence
  SiRNA target sequence
gaaagactttctgtacgtagatc

SEQ ID NO: 6087 - DNA, 23 bp, Artificial sequence
  SiRNA target sequence
aaagactttctgtacgtagatct

SEQ ID NO: 6088 - DNA, 23 bp, Artificial sequence
  SiRNA target sequence
aagactttctgtacgtagatctt

SEQ ID NO: 6089 - DNA, 23 bp, Artificial sequence
  SiRNA target sequence
agactttctgtacgtagatcttc

SEQ ID NO: 6090 - DNA, 23 bp, Artificial sequence
  SiRNA target sequence
gactttctgtacgtagatcttct

SEQ ID NO: 6091 - DNA, 23 bp, Artificial sequence
  SiRNA target sequence
actttctgtacgtagatcttctt

SEQ ID NO: 6092 - DNA, 23 bp, Artificial sequence
  SiRNA target sequence
ctttctgtacgtagatcttcttg

SEQ ID NO: 6093 - DNA, 23 bp, Artificial sequence
  SiRNA target sequence
tttctgtacgtagatcttcttgt

SEQ ID NO: 6094 - DNA, 23 bp, Artificial sequence
  SiRNA target sequence
ttctgtacgtagatcttcttgta

SEQ ID NO: 6095 - DNA, 23 bp, Artificial sequence
  SiRNA target sequence
tctgtacgtagatcttcttgtat

SEQ ID NO: 6096 - DNA, 23 bp, Artificial sequence
  SiRNA target sequence
ctgtacgtagatcttcttgtatt

SEQ ID NO: 6097 - DNA, 23 bp, Artificial sequence
  SiRNA target sequence
tgtacgtagatcttcttgtattt

SEQ ID NO: 6098 - DNA, 23 bp, Artificial sequence
  SiRNA target sequence
gtacgtagatcttcttgtatttt

SEQ ID NO: 6099 - DNA, 23 bp, Artificial sequence
  SiRNA target sequence
tacgtagatcttcttgtatttta

SEQ ID NO: 6100 - DNA, 23 bp, Artificial sequence
  SiRNA target sequence
acgtagatcttcttgtattttac

SEQ ID NO: 6101 - DNA, 23 bp, Artificial sequence
  SiRNA target sequence
cgtagatcttcttgtattttaca

SEQ ID NO: 6102 - DNA, 23 bp, Artificial sequence
  SiRNA target sequence
gtagatcttcttgtattttacat

SEQ ID NO: 6103 - DNA, 23 bp, Artificial sequence
  SiRNA target sequence
tagatcttcttgtattttacatt

SEQ ID NO: 6104 - DNA, 23 bp, Artificial sequence
  SiRNA target sequence
agatcttcttgtattttacattt

SEQ ID NO: 6105 - DNA, 23 bp, Artificial sequence
  SiRNA target sequence
gatcttcttgtattttacatttc

SEQ ID NO: 6106 - DNA, 23 bp, Artificial sequence
  SiRNA target sequence
atcttcttgtattttacatttct

SEQ ID NO: 6107 - DNA, 23 bp, Artificial sequence
  SiRNA target sequence
tcttcttgtattttacatttcta

SEQ ID NO: 6108 - DNA, 23 bp, Artificial sequence
  SiRNA target sequence
cttcttgtattttacatttctaa

SEQ ID NO: 6109 - DNA, 23 bp, Artificial sequence
  SiRNA target sequence
ttcttgtattttacatttctaaa

SEQ ID NO: 6110 - DNA, 23 bp, Artificial sequence
  SiRNA target sequence
tcttgtattttacatttctaaaa

SEQ ID NO: 6111 - DNA, 23 bp, Artificial sequence
  SiRNA target sequence
cttgtattttacatttctaaaaa

SEQ ID NO: 6112 - DNA, 23 bp, Artificial sequence
  SiRNA target sequence
ttgtattttacatttctaaaaag

SEQ ID NO: 6113 - DNA, 23 bp, Artificial sequence
  SiRNA target sequence
tgtattttacatttctaaaaagg

SEQ ID NO: 6114 - DNA, 23 bp, Artificial sequence
  SiRNA target sequence
gtattttacatttctaaaaagga

SEQ ID NO: 6115 - DNA, 23 bp, Artificial sequence
  SiRNA target sequence
tattttacatttctaaaaaggat

SEQ ID NO: 6116 - DNA, 23 bp, Artificial sequence
  SiRNA target sequence
attttacatttctaaaaaggatg

SEQ ID NO: 6117 - DNA, 23 bp, Artificial sequence
  SiRNA target sequence
ttttacatttctaaaaaggatgt

SEQ ID NO: 6118 - DNA, 23 bp, Artificial sequence
  SiRNA target sequence
tttacatttctaaaaaggatgtt

SEQ ID NO: 6119 - DNA, 23 bp, Artificial sequence
  SiRNA target sequence
ttacatttctaaaaaggatgttg

SEQ ID NO: 6120 - DNA, 23 bp, Artificial sequence
  SiRNA target sequence
tacatttctaaaaaggatgttga

SEQ ID NO: 6121 - DNA, 23 bp, Artificial sequence
  SiRNA target sequence
acatttctaaaaaggatgttgaa

SEQ ID NO: 6122 - DNA, 23 bp, Artificial sequence
  SiRNA target sequence
catttctaaaaaggatgttgaaa

SEQ ID NO: 6123 - DNA, 23 bp, Artificial sequence
  SiRNA target sequence
atttctaaaaaggatgttgaaaa

SEQ ID NO: 6124 - DNA, 23 bp, Artificial sequence
  SiRNA target sequence
tttctaaaaaggatgttgaaaaa

SEQ ID NO: 6125 - DNA, 23 bp, Artificial sequence
  SiRNA target sequence
ttctaaaaaggatgttgaaaaag

SEQ ID NO: 6126 - DNA, 23 bp, Artificial sequence
  SiRNA target sequence
tctaaaaaggatgttgaaaaagt

SEQ ID NO: 6127 - DNA, 23 bp, Artificial sequence
  SiRNA target sequence
ctaaaaaggatgttgaaaaagtt

SEQ ID NO: 6128 - DNA, 23 bp, Artificial sequence
  SiRNA target sequence
taaaaaggatgttgaaaaagtta

SEQ ID NO: 6129 - DNA, 23 bp, Artificial sequence
  SiRNA target sequence
aaaaaggatgttgaaaaagttaa

SEQ ID NO: 6130 - DNA, 23 bp, Artificial sequence
  SiRNA target sequence
aaaaggatgttgaaaaagttaat

SEQ ID NO: 6131 - DNA, 23 bp, Artificial sequence
  SiRNA target sequence
aaaggatgttgaaaaagttaatg

SEQ ID NO: 6132 - DNA, 23 bp, Artificial sequence
  SiRNA target sequence
aaggatgttgaaaaagttaatga

SEQ ID NO: 6133 - DNA, 23 bp, Artificial sequence
  SiRNA target sequence
aggatgttgaaaaagttaatgaa

SEQ ID NO: 6134 - DNA, 23 bp, Artificial sequence
  SiRNA target sequence
ggatgttgaaaaagttaatgaaa

SEQ ID NO: 6135 - DNA, 23 bp, Artificial sequence
  SiRNA target sequence
gatgttgaaaaagttaatgaaac

SEQ ID NO: 6136 - DNA, 23 bp, Artificial sequence
  SiRNA target sequence
atgttgaaaaagttaatgaaaca

SEQ ID NO: 6137 - DNA, 23 bp, Artificial sequence
  SiRNA target sequence
tgttgaaaaagttaatgaaacaa

SEQ ID NO: 6138 - DNA, 23 bp, Artificial sequence
  SiRNA target sequence
gttgaaaaagttaatgaaacaat

SEQ ID NO: 6139 - DNA, 23 bp, Artificial sequence
  SiRNA target sequence
ttgaaaaagttaatgaaacaatt

SEQ ID NO: 6140 - DNA, 23 bp, Artificial sequence
  SiRNA target sequence
tgaaaaagttaatgaaacaatta

SEQ ID NO: 6141 - DNA, 23 bp, Artificial sequence
  SiRNA target sequence
gaaaaagttaatgaaacaattaa

SEQ ID NO: 6142 - DNA, 23 bp, Artificial sequence
  SiRNA target sequence
aaaaagttaatgaaacaattaat

SEQ ID NO: 6143 - DNA, 23 bp, Artificial sequence
  SiRNA target sequence
aaaagttaatgaaacaattaata

SEQ ID NO: 6144 - DNA, 23 bp, Artificial sequence
  SiRNA target sequence
aaagttaatgaaacaattaataa

SEQ ID NO: 6145 - DNA, 23 bp, Artificial sequence
  SiRNA target sequence
aagttaatgaaacaattaataat

SEQ ID NO: 6146 - DNA, 23 bp, Artificial sequence
  SiRNA target sequence
agttaatgaaacaattaataatt

SEQ ID NO: 6147 - DNA, 23 bp, Artificial sequence
  SiRNA target sequence
gttaatgaaacaattaataattt

SEQ ID NO: 6148 - DNA, 23 bp, Artificial sequence
  SiRNA target sequence
ttaatgaaacaattaataattta

SEQ ID NO: 6149 - DNA, 23 bp, Artificial sequence
  SiRNA target sequence
taatgaaacaattaataatttaa

SEQ ID NO: 6150 - DNA, 23 bp, Artificial sequence
  SiRNA target sequence
aatgaaacaattaataatttaaa

SEQ ID NO: 6151 - DNA, 23 bp, Artificial sequence
  SiRNA target sequence
atgaaacaattaataatttaaaa

SEQ ID NO: 6152 - DNA, 23 bp, Artificial sequence
  SiRNA target sequence
tgaaacaattaataatttaaaag

SEQ ID NO: 6153 - DNA, 23 bp, Artificial sequence
  SiRNA target sequence
gaaacaattaataatttaaaaga

SEQ ID NO: 6154 - DNA, 23 bp, Artificial sequence
  SiRNA target sequence
aaacaattaataatttaaaagag

SEQ ID NO: 6155 - DNA, 23 bp, Artificial sequence
  SiRNA target sequence
aacaattaataatttaaaagaga

SEQ ID NO: 6156 - DNA, 23 bp, Artificial sequence
  SiRNA target sequence
acaattaataatttaaaagagac

SEQ ID NO: 6157 - DNA, 23 bp, Artificial sequence
  SiRNA target sequence
caattaataatttaaaagagact

SEQ ID NO: 6158 - DNA, 23 bp, Artificial sequence
  SiRNA target sequence
aattaataatttaaaagagactc

SEQ ID NO: 6159 - DNA, 23 bp, Artificial sequence
  SiRNA target sequence
attaataatttaaaagagactct

SEQ ID NO: 6160 - DNA, 23 bp, Artificial sequence
  SiRNA target sequence
ttaataatttaaaagagactctt

SEQ ID NO: 6161 - DNA, 23 bp, Artificial sequence
  SiRNA target sequence
taataatttaaaagagactctta

SEQ ID NO: 6162 - DNA, 23 bp, Artificial sequence
  SiRNA target sequence
aataatttaaaagagactcttac

SEQ ID NO: 6163 - DNA, 23 bp, Artificial sequence
  SiRNA target sequence
ataatttaaaagagactcttacc

SEQ ID NO: 6164 - DNA, 23 bp, Artificial sequence
  SiRNA target sequence
taatttaaaagagactcttaccc

SEQ ID NO: 6165 - DNA, 23 bp, Artificial sequence
  SiRNA target sequence
aatttaaaagagactcttacccc

SEQ ID NO: 6166 - DNA, 23 bp, Artificial sequence
  SiRNA target sequence
atttaaaagagactcttaccccc

SEQ ID NO: 6167 - DNA, 23 bp, Artificial sequence
  SiRNA target sequence
tttaaaagagactcttaccccca

SEQ ID NO: 6168 - DNA, 23 bp, Artificial sequence
  SiRNA target sequence
ttaaaagagactcttacccccac

SEQ ID NO: 6169 - DNA, 23 bp, Artificial sequence
  SiRNA target sequence
taaaagagactcttacccccact

SEQ ID NO: 6170 - DNA, 23 bp, Artificial sequence
  SiRNA target sequence
aaaagagactcttacccccactt

SEQ ID NO: 6171 - DNA, 23 bp, Artificial sequence
  SiRNA target sequence
aaagagactcttacccccacttt

SEQ ID NO: 6172 - DNA, 23 bp, Artificial sequence
  SiRNA target sequence
aagagactcttacccccacttta

SEQ ID NO: 6173 - DNA, 23 bp, Artificial sequence
  SiRNA target sequence
agagactcttacccccactttat

SEQ ID NO: 6174 - DNA, 23 bp, Artificial sequence
  SiRNA target sequence
gagactcttacccccactttatt

SEQ ID NO: 6175 - DNA, 23 bp, Artificial sequence
  SiRNA target sequence
agactcttacccccactttattg

SEQ ID NO: 6176 - DNA, 23 bp, Artificial sequence
  SiRNA target sequence
gactcttacccccactttattgg

SEQ ID NO: 6177 - DNA, 23 bp, Artificial sequence
  SiRNA target sequence
actcttacccccactttattgga

SEQ ID NO: 6178 - DNA, 23 bp, Artificial sequence
  SiRNA target sequence
ctcttacccccactttattggaa

SEQ ID NO: 6179 - DNA, 23 bp, Artificial sequence
  SiRNA target sequence
tcttacccccactttattggaac

SEQ ID NO: 6180 - DNA, 23 bp, Artificial sequence
  SiRNA target sequence
cttacccccactttattggaact

SEQ ID NO: 6181 - DNA, 23 bp, Artificial sequence
  SiRNA target sequence
ttacccccactttattggaactt

SEQ ID NO: 6182 - DNA, 23 bp, Artificial sequence
  SiRNA target sequence
tacccccactttattggaactta

SEQ ID NO: 6183 - DNA, 23 bp, Artificial sequence
  SiRNA target sequence
acccccactttattggaacttat

SEQ ID NO: 6184 - DNA, 23 bp, Artificial sequence
  SiRNA target sequence
cccccactttattggaacttatt

SEQ ID NO: 6185 - DNA, 23 bp, Artificial sequence
  SiRNA target sequence
ccccactttattggaacttattg

SEQ ID NO: 6186 - DNA, 23 bp, Artificial sequence
  SiRNA target sequence
cccactttattggaacttattgg

SEQ ID NO: 6187 - DNA, 23 bp, Artificial sequence
  SiRNA target sequence
ccactttattggaacttattgga

SEQ ID NO: 6188 - DNA, 23 bp, Artificial sequence
  SiRNA target sequence
cactttattggaacttattggag

SEQ ID NO: 6189 - DNA, 23 bp, Artificial sequence
  SiRNA target sequence
actttattggaacttattggaga

SEQ ID NO: 6190 - DNA, 23 bp, Artificial sequence
  SiRNA target sequence
ctttattggaacttattggagaa

SEQ ID NO: 6191 - DNA, 23 bp, Artificial sequence
  SiRNA target sequence
tttattggaacttattggagaat

SEQ ID NO: 6192 - DNA, 23 bp, Artificial sequence
  SiRNA target sequence
ttattggaacttattggagaata

SEQ ID NO: 6193 - DNA, 23 bp, Artificial sequence
  SiRNA target sequence
tattggaacttattggagaatat

SEQ ID NO: 6194 - DNA, 23 bp, Artificial sequence
  SiRNA target sequence
attggaacttattggagaatatt

SEQ ID NO: 6195 - DNA, 23 bp, Artificial sequence
  SiRNA target sequence
ttggaacttattggagaatatta

SEQ ID NO: 6196 - DNA, 23 bp, Artificial sequence
  SiRNA target sequence
tggaacttattggagaatattat

SEQ ID NO: 6197 - DNA, 23 bp, Artificial sequence
  SiRNA target sequence
ggaacttattggagaatattatt

SEQ ID NO: 6198 - DNA, 23 bp, Artificial sequence
  SiRNA target sequence
gaacttattggagaatattattt

SEQ ID NO: 6199 - DNA, 23 bp, Artificial sequence
  SiRNA target sequence
aacttattggagaatattattta

SEQ ID NO: 6200 - DNA, 23 bp, Artificial sequence
  SiRNA target sequence
acttattggagaatattatttaa

SEQ ID NO: 6201 - DNA, 23 bp, Artificial sequence
  SiRNA target sequence
cttattggagaatattatttaaa

SEQ ID NO: 6202 - DNA, 23 bp, Artificial sequence
  SiRNA target sequence
ttattggagaatattatttaaaa

SEQ ID NO: 6203 - DNA, 23 bp, Artificial sequence
  SiRNA target sequence
tattggagaatattatttaaaaa

SEQ ID NO: 6204 - DNA, 23 bp, Artificial sequence
  SiRNA target sequence
attggagaatattatttaaaaag

SEQ ID NO: 6205 - DNA, 23 bp, Artificial sequence
  SiRNA target sequence
ttggagaatattatttaaaaagt

SEQ ID NO: 6206 - DNA, 23 bp, Artificial sequence
  SiRNA target sequence
tggagaatattatttaaaaagtg

SEQ ID NO: 6207 - DNA, 23 bp, Artificial sequence
  SiRNA target sequence
ggagaatattatttaaaaagtgg

SEQ ID NO: 6208 - DNA, 23 bp, Artificial sequence
  SiRNA target sequence
gagaatattatttaaaaagtgga

SEQ ID NO: 6209 - DNA, 23 bp, Artificial sequence
  SiRNA target sequence
agaatattatttaaaaagtggaa

SEQ ID NO: 6210 - DNA, 23 bp, Artificial sequence
  SiRNA target sequence
gaatattatttaaaaagtggaaa

SEQ ID NO: 6211 - DNA, 23 bp, Artificial sequence
  SiRNA target sequence
aatattatttaaaaagtggaaat

SEQ ID NO: 6212 - DNA, 23 bp, Artificial sequence
  SiRNA target sequence
atattatttaaaaagtggaaatc

SEQ ID NO: 6213 - DNA, 23 bp, Artificial sequence
  SiRNA target sequence
tattatttaaaaagtggaaatca

SEQ ID NO: 6214 - DNA, 23 bp, Artificial sequence
  SiRNA target sequence
attatttaaaaagtggaaatcac

SEQ ID NO: 6215 - DNA, 23 bp, Artificial sequence
  SiRNA target sequence
ttatttaaaaagtggaaatcact

SEQ ID NO: 6216 - DNA, 23 bp, Artificial sequence
  SiRNA target sequence
tatttaaaaagtggaaatcactc

SEQ ID NO: 6217 - DNA, 23 bp, Artificial sequence
  SiRNA target sequence
atttaaaaagtggaaatcactct

SEQ ID NO: 6218 - DNA, 23 bp, Artificial sequence
  SiRNA target sequence
tttaaaaagtggaaatcactcta

SEQ ID NO: 6219 - DNA, 23 bp, Artificial sequence
  SiRNA target sequence
ttaaaaagtggaaatcactctaa

SEQ ID NO: 6220 - DNA, 23 bp, Artificial sequence
  SiRNA target sequence
taaaaagtggaaatcactctaaa

SEQ ID NO: 6221 - DNA, 23 bp, Artificial sequence
  SiRNA target sequence
aaaaagtggaaatcactctaaaa

SEQ ID NO: 6222 - DNA, 23 bp, Artificial sequence
  SiRNA target sequence
aaaagtggaaatcactctaaaat

SEQ ID NO: 6223 - DNA, 23 bp, Artificial sequence
  SiRNA target sequence
aaagtggaaatcactctaaaatg

SEQ ID NO: 6224 - DNA, 23 bp, Artificial sequence
  SiRNA target sequence
aagtggaaatcactctaaaatgt

SEQ ID NO: 6225 - DNA, 23 bp, Artificial sequence
  SiRNA target sequence
agtggaaatcactctaaaatgtt

SEQ ID NO: 6226 - DNA, 23 bp, Artificial sequence
  SiRNA target sequence
gtggaaatcactctaaaatgtta

SEQ ID NO: 6227 - DNA, 23 bp, Artificial sequence
  SiRNA target sequence
tggaaatcactctaaaatgttag

SEQ ID NO: 6228 - DNA, 23 bp, Artificial sequence
  SiRNA target sequence
ggaaatcactctaaaatgttaga

SEQ ID NO: 6229 - DNA, 23 bp, Artificial sequence
  SiRNA target sequence
gaaatcactctaaaatgttagat

SEQ ID NO: 6230 - DNA, 23 bp, Artificial sequence
  SiRNA target sequence
aaatcactctaaaatgttagatc

SEQ ID NO: 6231 - DNA, 23 bp, Artificial sequence
  SiRNA target sequence
aatcactctaaaatgttagatct

SEQ ID NO: 6232 - DNA, 23 bp, Artificial sequence
  SiRNA target sequence
atcactctaaaatgttagatcta

SEQ ID NO: 6233 - DNA, 23 bp, Artificial sequence
  SiRNA target sequence
tcactctaaaatgttagatctat

SEQ ID NO: 6234 - DNA, 23 bp, Artificial sequence
  SiRNA target sequence
cactctaaaatgttagatctatt

SEQ ID NO: 6235 - DNA, 23 bp, Artificial sequence
  SiRNA target sequence
actctaaaatgttagatctatta

SEQ ID NO: 6236 - DNA, 23 bp, Artificial sequence
  SiRNA target sequence
ctctaaaatgttagatctattat

SEQ ID NO: 6237 - DNA, 23 bp, Artificial sequence
  SiRNA target sequence
tctaaaatgttagatctattatc

SEQ ID NO: 6238 - DNA, 23 bp, Artificial sequence
  SiRNA target sequence
ctaaaatgttagatctattatct

SEQ ID NO: 6239 - DNA, 23 bp, Artificial sequence
  SiRNA target sequence
taaaatgttagatctattatcta

SEQ ID NO: 6240 - DNA, 23 bp, Artificial sequence
  SiRNA target sequence
aaaatgttagatctattatctag

SEQ ID NO: 6241 - DNA, 23 bp, Artificial sequence
  SiRNA target sequence
aaatgttagatctattatctagt

SEQ ID NO: 6242 - DNA, 23 bp, Artificial sequence
  SiRNA target sequence
aatgttagatctattatctagtc

SEQ ID NO: 6243 - DNA, 23 bp, Artificial sequence
  SiRNA target sequence
atgttagatctattatctagtca

SEQ ID NO: 6244 - DNA, 23 bp, Artificial sequence
  SiRNA target sequence
tgttagatctattatctagtcat

SEQ ID NO: 6245 - DNA, 23 bp, Artificial sequence
  SiRNA target sequence
gttagatctattatctagtcatc

SEQ ID NO: 6246 - DNA, 23 bp, Artificial sequence
  SiRNA target sequence
ttagatctattatctagtcatcc

SEQ ID NO: 6247 - DNA, 23 bp, Artificial sequence
  SiRNA target sequence
tagatctattatctagtcatcca

SEQ ID NO: 6248 - DNA, 23 bp, Artificial sequence
  SiRNA target sequence
agatctattatctagtcatccag

SEQ ID NO: 6249 - DNA, 23 bp, Artificial sequence
  SiRNA target sequence
gatctattatctagtcatccaga

SEQ ID NO: 6250 - DNA, 23 bp, Artificial sequence
  SiRNA target sequence
atctattatctagtcatccagat

SEQ ID NO: 6251 - DNA, 23 bp, Artificial sequence
  SiRNA target sequence
tctattatctagtcatccagata

SEQ ID NO: 6252 - DNA, 23 bp, Artificial sequence
  SiRNA target sequence
ctattatctagtcatccagatac

SEQ ID NO: 6253 - DNA, 23 bp, Artificial sequence
  SiRNA target sequence
tattatctagtcatccagatact

SEQ ID NO: 6254 - DNA, 23 bp, Artificial sequence
  SiRNA target sequence
attatctagtcatccagatactc

SEQ ID NO: 6255 - DNA, 23 bp, Artificial sequence
  SiRNA target sequence
ttatctagtcatccagatactcc

SEQ ID NO: 6256 - DNA, 23 bp, Artificial sequence
  SiRNA target sequence
tatctagtcatccagatactcct

SEQ ID NO: 6257 - DNA, 23 bp, Artificial sequence
  SiRNA target sequence
atctagtcatccagatactcctg

SEQ ID NO: 6258 - DNA, 23 bp, Artificial sequence
  SiRNA target sequence
tctagtcatccagatactcctgg

SEQ ID NO: 6259 - DNA, 23 bp, Artificial sequence
  SiRNA target sequence
ctagtcatccagatactcctggt

SEQ ID NO: 6260 - DNA, 23 bp, Artificial sequence
  SiRNA target sequence
tagtcatccagatactcctggta

SEQ ID NO: 6261 - DNA, 23 bp, Artificial sequence
  SiRNA target sequence
agtcatccagatactcctggtaa

SEQ ID NO: 6262 - DNA, 23 bp, Artificial sequence
  SiRNA target sequence
gtcatccagatactcctggtaaa

SEQ ID NO: 6263 - DNA, 23 bp, Artificial sequence
  SiRNA target sequence
tcatccagatactcctggtaaat

SEQ ID NO: 6264 - DNA, 23 bp, Artificial sequence
  SiRNA target sequence
catccagatactcctggtaaatt

SEQ ID NO: 6265 - DNA, 23 bp, Artificial sequence
  SiRNA target sequence
atccagatactcctggtaaatta

SEQ ID NO: 6266 - DNA, 23 bp, Artificial sequence
  SiRNA target sequence
tccagatactcctggtaaattac

SEQ ID NO: 6267 - DNA, 23 bp, Artificial sequence
  SiRNA target sequence
ccagatactcctggtaaattact

SEQ ID NO: 6268 - DNA, 23 bp, Artificial sequence
  SiRNA target sequence
cagatactcctggtaaattactt

SEQ ID NO: 6269 - DNA, 23 bp, Artificial sequence
  SiRNA target sequence
agatactcctggtaaattacttt

SEQ ID NO: 6270 - DNA, 23 bp, Artificial sequence
  SiRNA target sequence
gatactcctggtaaattactttt

SEQ ID NO: 6271 - DNA, 23 bp, Artificial sequence
  SiRNA target sequence
atactcctggtaaattactttta

SEQ ID NO: 6272 - DNA, 23 bp, Artificial sequence
  SiRNA target sequence
tactcctggtaaattacttttaa

SEQ ID NO: 6273 - DNA, 23 bp, Artificial sequence
  SiRNA target sequence
actcctggtaaattacttttaac

SEQ ID NO: 6274 - DNA, 23 bp, Artificial sequence
  SiRNA target sequence
ctcctggtaaattacttttaacg

SEQ ID NO: 6275 - DNA, 23 bp, Artificial sequence
  SiRNA target sequence
tcctggtaaattacttttaacgg

SEQ ID NO: 6276 - DNA, 23 bp, Artificial sequence
  SiRNA target sequence
cctggtaaattacttttaacggc

SEQ ID NO: 6277 - DNA, 23 bp, Artificial sequence
  SiRNA target sequence
ctggtaaattacttttaacggca

SEQ ID NO: 6278 - DNA, 23 bp, Artificial sequence
  SiRNA target sequence
tggtaaattacttttaacggcac

SEQ ID NO: 6279 - DNA, 23 bp, Artificial sequence
  SiRNA target sequence
ggtaaattacttttaacggcact

SEQ ID NO: 6280 - DNA, 23 bp, Artificial sequence
  SiRNA target sequence
gtaaattacttttaacggcactt

SEQ ID NO: 6281 - DNA, 23 bp, Artificial sequence
  SiRNA target sequence
taaattacttttaacggcacttt

SEQ ID NO: 6282 - DNA, 23 bp, Artificial sequence
  SiRNA target sequence
aaattacttttaacggcacttta

SEQ ID NO: 6283 - DNA, 23 bp, Artificial sequence
  SiRNA target sequence
aattacttttaacggcactttat

SEQ ID NO: 6284 - DNA, 23 bp, Artificial sequence
  SiRNA target sequence
attacttttaacggcactttatg

SEQ ID NO: 6285 - DNA, 23 bp, Artificial sequence
  SiRNA target sequence
ttacttttaacggcactttatgc

SEQ ID NO: 6286 - DNA, 23 bp, Artificial sequence
  SiRNA target sequence
tacttttaacggcactttatgca

SEQ ID NO: 6287 - DNA, 23 bp, Artificial sequence
  SiRNA target sequence
acttttaacggcactttatgcaa

SEQ ID NO: 6288 - DNA, 23 bp, Artificial sequence
  SiRNA target sequence
cttttaacggcactttatgcaat

SEQ ID NO: 6289 - DNA, 23 bp, Artificial sequence
  SiRNA target sequence
ttttaacggcactttatgcaata

SEQ ID NO: 6290 - DNA, 23 bp, Artificial sequence
  SiRNA target sequence
tttaacggcactttatgcaataa

SEQ ID NO: 6291 - DNA, 23 bp, Artificial sequence
  SiRNA target sequence
ttaacggcactttatgcaataag

SEQ ID NO: 6292 - DNA, 23 bp, Artificial sequence
  SiRNA target sequence
taacggcactttatgcaataagt

SEQ ID NO: 6293 - DNA, 23 bp, Artificial sequence
  SiRNA target sequence
aacggcactttatgcaataagta

SEQ ID NO: 6294 - DNA, 23 bp, Artificial sequence
  SiRNA target sequence
acggcactttatgcaataagtat

SEQ ID NO: 6295 - DNA, 23 bp, Artificial sequence
  SiRNA target sequence
cggcactttatgcaataagtatt

SEQ ID NO: 6296 - DNA, 23 bp, Artificial sequence
  SiRNA target sequence
ggcactttatgcaataagtattg

SEQ ID NO: 6297 - DNA, 23 bp, Artificial sequence
  SiRNA target sequence
gcactttatgcaataagtattga

SEQ ID NO: 6298 - DNA, 23 bp, Artificial sequence
  SiRNA target sequence
cactttatgcaataagtattgat

SEQ ID NO: 6299 - DNA, 23 bp, Artificial sequence
  SiRNA target sequence
actttatgcaataagtattgata

SEQ ID NO: 6300 - DNA, 23 bp, Artificial sequence
  SiRNA target sequence
ctttatgcaataagtattgataa

SEQ ID NO: 6301 - DNA, 23 bp, Artificial sequence
  SiRNA target sequence
tttatgcaataagtattgataag

SEQ ID NO: 6302 - DNA, 23 bp, Artificial sequence
  SiRNA target sequence
ttatgcaataagtattgataaga

SEQ ID NO: 6303 - DNA, 23 bp, Artificial sequence
  SiRNA target sequence
tatgcaataagtattgataagaa

SEQ ID NO: 6304 - DNA, 23 bp, Artificial sequence
  SiRNA target sequence
atgcaataagtattgataagaaa

SEQ ID NO: 6305 - DNA, 23 bp, Artificial sequence
  SiRNA target sequence
tgcaataagtattgataagaaaa

SEQ ID NO: 6306 - DNA, 23 bp, Artificial sequence
  SiRNA target sequence
gcaataagtattgataagaaaaa

SEQ ID NO: 6307 - DNA, 23 bp, Artificial sequence
  SiRNA target sequence
caataagtattgataagaaaaag

SEQ ID NO: 6308 - DNA, 23 bp, Artificial sequence
  SiRNA target sequence
aataagtattgataagaaaaagg

SEQ ID NO: 6309 - DNA, 23 bp, Artificial sequence
  SiRNA target sequence
ataagtattgataagaaaaagga

SEQ ID NO: 6310 - DNA, 23 bp, Artificial sequence
  SiRNA target sequence
taagtattgataagaaaaaggat

SEQ ID NO: 6311 - DNA, 23 bp, Artificial sequence
  SiRNA target sequence
aagtattgataagaaaaaggatg

SEQ ID NO: 6312 - DNA, 23 bp, Artificial sequence
  SiRNA target sequence
agtattgataagaaaaaggatgc

SEQ ID NO: 6313 - DNA, 23 bp, Artificial sequence
  SiRNA target sequence
gtattgataagaaaaaggatgct

SEQ ID NO: 6314 - DNA, 23 bp, Artificial sequence
  SiRNA target sequence
tattgataagaaaaaggatgcta

SEQ ID NO: 6315 - DNA, 23 bp, Artificial sequence
  SiRNA target sequence
attgataagaaaaaggatgctat

SEQ ID NO: 6316 - DNA, 23 bp, Artificial sequence
  SiRNA target sequence
ttgataagaaaaaggatgctata

SEQ ID NO: 6317 - DNA, 23 bp, Artificial sequence
  SiRNA target sequence
tgataagaaaaaggatgctatag

SEQ ID NO: 6318 - DNA, 23 bp, Artificial sequence
  SiRNA target sequence
gataagaaaaaggatgctataga

SEQ ID NO: 6319 - DNA, 23 bp, Artificial sequence
  SiRNA target sequence
ataagaaaaaggatgctatagaa

SEQ ID NO: 6320 - DNA, 23 bp, Artificial sequence
  SiRNA target sequence
taagaaaaaggatgctatagaaa

SEQ ID NO: 6321 - DNA, 23 bp, Artificial sequence
  SiRNA target sequence
aagaaaaaggatgctatagaaat

SEQ ID NO: 6322 - DNA, 23 bp, Artificial sequence
  SiRNA target sequence
agaaaaaggatgctatagaaatt

SEQ ID NO: 6323 - DNA, 23 bp, Artificial sequence
  SiRNA target sequence
gaaaaaggatgctatagaaattt

SEQ ID NO: 6324 - DNA, 23 bp, Artificial sequence
  SiRNA target sequence
aaaaaggatgctatagaaatttt

SEQ ID NO: 6325 - DNA, 23 bp, Artificial sequence
  SiRNA target sequence
aaaaggatgctatagaaatttta

SEQ ID NO: 6326 - DNA, 23 bp, Artificial sequence
  SiRNA target sequence
aaaggatgctatagaaattttat

SEQ ID NO: 6327 - DNA, 23 bp, Artificial sequence
  SiRNA target sequence
aaggatgctatagaaattttata

SEQ ID NO: 6328 - DNA, 23 bp, Artificial sequence
  SiRNA target sequence
aggatgctatagaaattttatat

SEQ ID NO: 6329 - DNA, 23 bp, Artificial sequence
  SiRNA target sequence
ggatgctatagaaattttatata

SEQ ID NO: 6330 - DNA, 23 bp, Artificial sequence
  SiRNA target sequence
gatgctatagaaattttatatag

SEQ ID NO: 6331 - DNA, 23 bp, Artificial sequence
  SiRNA target sequence
atgctatagaaattttatataga

SEQ ID NO: 6332 - DNA, 23 bp, Artificial sequence
  SiRNA target sequence
tgctatagaaattttatatagaa

SEQ ID NO: 6333 - DNA, 23 bp, Artificial sequence
  SiRNA target sequence
gctatagaaattttatatagaag

SEQ ID NO: 6334 - DNA, 23 bp, Artificial sequence
  SiRNA target sequence
ctatagaaattttatatagaagt

SEQ ID NO: 6335 - DNA, 23 bp, Artificial sequence
  SiRNA target sequence
tatagaaattttatatagaagta

SEQ ID NO: 6336 - DNA, 23 bp, Artificial sequence
  SiRNA target sequence
atagaaattttatatagaagtat

SEQ ID NO: 6337 - DNA, 23 bp, Artificial sequence
  SiRNA target sequence
tagaaattttatatagaagtata

SEQ ID NO: 6338 - DNA, 23 bp, Artificial sequence
  SiRNA target sequence
agaaattttatatagaagtatat

SEQ ID NO: 6339 - DNA, 23 bp, Artificial sequence
  SiRNA target sequence
gaaattttatatagaagtatatc

SEQ ID NO: 6340 - DNA, 23 bp, Artificial sequence
  SiRNA target sequence
aaattttatatagaagtatatca

SEQ ID NO: 6341 - DNA, 23 bp, Artificial sequence
  SiRNA target sequence
aattttatatagaagtatatcag

SEQ ID NO: 6342 - DNA, 23 bp, Artificial sequence
  SiRNA target sequence
attttatatagaagtatatcaga

SEQ ID NO: 6343 - DNA, 23 bp, Artificial sequence
  SiRNA target sequence
ttttatatagaagtatatcagaa

SEQ ID NO: 6344 - DNA, 23 bp, Artificial sequence
  SiRNA target sequence
tttatatagaagtatatcagaat

SEQ ID NO: 6345 - DNA, 23 bp, Artificial sequence
  SiRNA target sequence
ttatatagaagtatatcagaata

SEQ ID NO: 6346 - DNA, 23 bp, Artificial sequence
  SiRNA target sequence
tatatagaagtatatcagaatat

SEQ ID NO: 6347 - DNA, 23 bp, Artificial sequence
  SiRNA target sequence
atatagaagtatatcagaatatt

SEQ ID NO: 6348 - DNA, 23 bp, Artificial sequence
  SiRNA target sequence
tatagaagtatatcagaatattc

SEQ ID NO: 6349 - DNA, 23 bp, Artificial sequence
  SiRNA target sequence
atagaagtatatcagaatattca

SEQ ID NO: 6350 - DNA, 23 bp, Artificial sequence
  SiRNA target sequence
tagaagtatatcagaatattcat

SEQ ID NO: 6351 - DNA, 23 bp, Artificial sequence
  SiRNA target sequence
agaagtatatcagaatattcatc

SEQ ID NO: 6352 - DNA, 23 bp, Artificial sequence
  SiRNA target sequence
gaagtatatcagaatattcatct

SEQ ID NO: 6353 - DNA, 23 bp, Artificial sequence
  SiRNA target sequence
aagtatatcagaatattcatctt

SEQ ID NO: 6354 - DNA, 23 bp, Artificial sequence
  SiRNA target sequence
agtatatcagaatattcatctta

SEQ ID NO: 6355 - DNA, 23 bp, Artificial sequence
  SiRNA target sequence
gtatatcagaatattcatcttat

SEQ ID NO: 6356 - DNA, 23 bp, Artificial sequence
  SiRNA target sequence
tatatcagaatattcatcttatt

SEQ ID NO: 6357 - DNA, 23 bp, Artificial sequence
  SiRNA target sequence
atatcagaatattcatcttattt

SEQ ID NO: 6358 - DNA, 23 bp, Artificial sequence
  SiRNA target sequence
tatcagaatattcatcttatttt

SEQ ID NO: 6359 - DNA, 23 bp, Artificial sequence
  SiRNA target sequence
atcagaatattcatcttatttta

SEQ ID NO: 6360 - DNA, 23 bp, Artificial sequence
  SiRNA target sequence
tcagaatattcatcttattttaa

SEQ ID NO: 6361 - DNA, 23 bp, Artificial sequence
  SiRNA target sequence
cagaatattcatcttattttaaa

SEQ ID NO: 6362 - DNA, 23 bp, Artificial sequence
  SiRNA target sequence
agaatattcatcttattttaaat

SEQ ID NO: 6363 - DNA, 23 bp, Artificial sequence
  SiRNA target sequence
gaatattcatcttattttaaatc

SEQ ID NO: 6364 - DNA, 23 bp, Artificial sequence
  SiRNA target sequence
aatattcatcttattttaaatct

SEQ ID NO: 6365 - DNA, 23 bp, Artificial sequence
  SiRNA target sequence
atattcatcttattttaaatctt

SEQ ID NO: 6366 - DNA, 23 bp, Artificial sequence
  SiRNA target sequence
tattcatcttattttaaatctta

SEQ ID NO: 6367 - DNA, 23 bp, Artificial sequence
  SiRNA target sequence
attcatcttattttaaatcttat

SEQ ID NO: 6368 - DNA, 23 bp, Artificial sequence
  SiRNA target sequence
ttcatcttattttaaatcttatt

SEQ ID NO: 6369 - DNA, 23 bp, Artificial sequence
  SiRNA target sequence
tcatcttattttaaatcttattt

SEQ ID NO: 6370 - DNA, 23 bp, Artificial sequence
  SiRNA target sequence
catcttattttaaatcttatttg

SEQ ID NO: 6371 - DNA, 23 bp, Artificial sequence
  SiRNA target sequence
atcttattttaaatcttatttgt

SEQ ID NO: 6372 - DNA, 23 bp, Artificial sequence
  SiRNA target sequence
tcttattttaaatcttatttgta

SEQ ID NO: 6373 - DNA, 23 bp, Artificial sequence
  SiRNA target sequence
cttattttaaatcttatttgtat

SEQ ID NO: 6374 - DNA, 23 bp, Artificial sequence
  SiRNA target sequence
ttattttaaatcttatttgtatt

SEQ ID NO: 6375 - DNA, 23 bp, Artificial sequence
  SiRNA target sequence
tattttaaatcttatttgtattt

SEQ ID NO: 6376 - DNA, 23 bp, Artificial sequence
  SiRNA target sequence
attttaaatcttatttgtattta

SEQ ID NO: 6377 - DNA, 23 bp, Artificial sequence
  SiRNA target sequence
ttttaaatcttatttgtatttag

SEQ ID NO: 6378 - DNA, 23 bp, Artificial sequence
  SiRNA target sequence
tttaaatcttatttgtatttagg

SEQ ID NO: 6379 - DNA, 23 bp, Artificial sequence
  SiRNA target sequence
ttaaatcttatttgtatttagga

SEQ ID NO: 6380 - DNA, 23 bp, Artificial sequence
  SiRNA target sequence
taaatcttatttgtatttaggaa

SEQ ID NO: 6381 - DNA, 23 bp, Artificial sequence
  SiRNA target sequence
aaatcttatttgtatttaggaaa

SEQ ID NO: 6382 - DNA, 23 bp, Artificial sequence
  SiRNA target sequence
aatcttatttgtatttaggaaat

SEQ ID NO: 6383 - DNA, 23 bp, Artificial sequence
  SiRNA target sequence
atcttatttgtatttaggaaata

SEQ ID NO: 6384 - DNA, 23 bp, Artificial sequence
  SiRNA target sequence
tcttatttgtatttaggaaatat

SEQ ID NO: 6385 - DNA, 23 bp, Artificial sequence
  SiRNA target sequence
cttatttgtatttaggaaatatt

SEQ ID NO: 6386 - DNA, 23 bp, Artificial sequence
  SiRNA target sequence
ttatttgtatttaggaaatattt

SEQ ID NO: 6387 - DNA, 23 bp, Artificial sequence
  SiRNA target sequence
tatttgtatttaggaaatatttt

SEQ ID NO: 6388 - DNA, 23 bp, Artificial sequence
  SiRNA target sequence
atttgtatttaggaaatatttta

SEQ ID NO: 6389 - DNA, 23 bp, Artificial sequence
  SiRNA target sequence
tttgtatttaggaaatattttaa

SEQ ID NO: 6390 - DNA, 23 bp, Artificial sequence
  SiRNA target sequence
ttgtatttaggaaatattttaat

SEQ ID NO: 6391 - DNA, 23 bp, Artificial sequence
  SiRNA target sequence
tgtatttaggaaatattttaata

SEQ ID NO: 6392 - DNA, 23 bp, Artificial sequence
  SiRNA target sequence
gtatttaggaaatattttaataa

SEQ ID NO: 6393 - DNA, 23 bp, Artificial sequence
  SiRNA target sequence
tatttaggaaatattttaataaa

SEQ ID NO: 6394 - DNA, 23 bp, Artificial sequence
  SiRNA target sequence
atttaggaaatattttaataaat

SEQ ID NO: 6395 - DNA, 23 bp, Artificial sequence
  SiRNA target sequence
tttaggaaatattttaataaatg

SEQ ID NO: 6396 - DNA, 23 bp, Artificial sequence
  SiRNA target sequence
ttaggaaatattttaataaatga

SEQ ID NO: 6397 - DNA, 23 bp, Artificial sequence
  SiRNA target sequence
taggaaatattttaataaatgat

SEQ ID NO: 6398 - DNA, 23 bp, Artificial sequence
  SiRNA target sequence
aggaaatattttaataaatgatg

SEQ ID NO: 6399 - DNA, 23 bp, Artificial sequence
  SiRNA target sequence
ggaaatattttaataaatgatga

SEQ ID NO: 6400 - DNA, 23 bp, Artificial sequence
  SiRNA target sequence
gaaatattttaataaatgatgac

SEQ ID NO: 6401 - DNA, 23 bp, Artificial sequence
  SiRNA target sequence
aaatattttaataaatgatgact

SEQ ID NO: 6402 - DNA, 23 bp, Artificial sequence
  SiRNA target sequence
aatattttaataaatgatgactt

SEQ ID NO: 6403 - DNA, 23 bp, Artificial sequence
  SiRNA target sequence
atattttaataaatgatgactta

SEQ ID NO: 6404 - DNA, 23 bp, Artificial sequence
  SiRNA target sequence
tattttaataaatgatgacttaa

SEQ ID NO: 6405 - DNA, 23 bp, Artificial sequence
  SiRNA target sequence
attttaataaatgatgacttaaa

SEQ ID NO: 6406 - DNA, 23 bp, Artificial sequence
  SiRNA target sequence
ttttaataaatgatgacttaaat

SEQ ID NO: 6407 - DNA, 23 bp, Artificial sequence
  SiRNA target sequence
tttaataaatgatgacttaaatg

SEQ ID NO: 6408 - DNA, 23 bp, Artificial sequence
  SiRNA target sequence
ttaataaatgatgacttaaatga

SEQ ID NO: 6409 - DNA, 23 bp, Artificial sequence
  SiRNA target sequence
taataaatgatgacttaaatgaa

SEQ ID NO: 6410 - DNA, 23 bp, Artificial sequence
  SiRNA target sequence
aataaatgatgacttaaatgaat

SEQ ID NO: 6411 - DNA, 23 bp, Artificial sequence
  SiRNA target sequence
ataaatgatgacttaaatgaatg

SEQ ID NO: 6412 - DNA, 23 bp, Artificial sequence
  SiRNA target sequence
taaatgatgacttaaatgaatgc

SEQ ID NO: 6413 - DNA, 23 bp, Artificial sequence
  SiRNA target sequence
aaatgatgacttaaatgaatgca

SEQ ID NO: 6414 - DNA, 23 bp, Artificial sequence
  SiRNA target sequence
aatgatgacttaaatgaatgcag

SEQ ID NO: 6415 - DNA, 23 bp, Artificial sequence
  SiRNA target sequence
atgatgacttaaatgaatgcagg

SEQ ID NO: 6416 - DNA, 23 bp, Artificial sequence
  SiRNA target sequence
tgatgacttaaatgaatgcagga

SEQ ID NO: 6417 - DNA, 23 bp, Artificial sequence
  SiRNA target sequence
gatgacttaaatgaatgcaggaa

SEQ ID NO: 6418 - DNA, 23 bp, Artificial sequence
  SiRNA target sequence
atgacttaaatgaatgcaggaaa

SEQ ID NO: 6419 - DNA, 23 bp, Artificial sequence
  SiRNA target sequence
tgacttaaatgaatgcaggaaat

SEQ ID NO: 6420 - DNA, 23 bp, Artificial sequence
  SiRNA target sequence
gacttaaatgaatgcaggaaatt

SEQ ID NO: 6421 - DNA, 23 bp, Artificial sequence
  SiRNA target sequence
acttaaatgaatgcaggaaattg

SEQ ID NO: 6422 - DNA, 23 bp, Artificial sequence
  SiRNA target sequence
cttaaatgaatgcaggaaattgt

SEQ ID NO: 6423 - DNA, 23 bp, Artificial sequence
  SiRNA target sequence
ttaaatgaatgcaggaaattgtt

SEQ ID NO: 6424 - DNA, 23 bp, Artificial sequence
  SiRNA target sequence
taaatgaatgcaggaaattgttt

SEQ ID NO: 6425 - DNA, 23 bp, Artificial sequence
  SiRNA target sequence
aaatgaatgcaggaaattgttta

SEQ ID NO: 6426 - DNA, 23 bp, Artificial sequence
  SiRNA target sequence
aatgaatgcaggaaattgtttaa

SEQ ID NO: 6427 - DNA, 23 bp, Artificial sequence
  SiRNA target sequence
atgaatgcaggaaattgtttaat

SEQ ID NO: 6428 - DNA, 23 bp, Artificial sequence
  SiRNA target sequence
tgaatgcaggaaattgtttaata

SEQ ID NO: 6429 - DNA, 23 bp, Artificial sequence
  SiRNA target sequence
gaatgcaggaaattgtttaatac

SEQ ID NO: 6430 - DNA, 23 bp, Artificial sequence
  SiRNA target sequence
aatgcaggaaattgtttaataca

SEQ ID NO: 6431 - DNA, 23 bp, Artificial sequence
  SiRNA target sequence
atgcaggaaattgtttaatacat

SEQ ID NO: 6432 - DNA, 23 bp, Artificial sequence
  SiRNA target sequence
tgcaggaaattgtttaatacatc

SEQ ID NO: 6433 - DNA, 23 bp, Artificial sequence
  SiRNA target sequence
gcaggaaattgtttaatacatca

SEQ ID NO: 6434 - DNA, 23 bp, Artificial sequence
  SiRNA target sequence
caggaaattgtttaatacatcac

SEQ ID NO: 6435 - DNA, 23 bp, Artificial sequence
  SiRNA target sequence
aggaaattgtttaatacatcact

SEQ ID NO: 6436 - DNA, 23 bp, Artificial sequence
  SiRNA target sequence
ggaaattgtttaatacatcactt

SEQ ID NO: 6437 - DNA, 23 bp, Artificial sequence
  SiRNA target sequence
gaaattgtttaatacatcacttc

SEQ ID NO: 6438 - DNA, 23 bp, Artificial sequence
  SiRNA target sequence
aaattgtttaatacatcacttca

SEQ ID NO: 6439 - DNA, 23 bp, Artificial sequence
  SiRNA target sequence
aattgtttaatacatcacttcaa

SEQ ID NO: 6440 - DNA, 23 bp, Artificial sequence
  SiRNA target sequence
attgtttaatacatcacttcaat

SEQ ID NO: 6441 - DNA, 23 bp, Artificial sequence
  SiRNA target sequence
ttgtttaatacatcacttcaata

SEQ ID NO: 6442 - DNA, 23 bp, Artificial sequence
  SiRNA target sequence
tgtttaatacatcacttcaatat

SEQ ID NO: 6443 - DNA, 23 bp, Artificial sequence
  SiRNA target sequence
gtttaatacatcacttcaatatt

SEQ ID NO: 6444 - DNA, 23 bp, Artificial sequence
  SiRNA target sequence
tttaatacatcacttcaatattg

SEQ ID NO: 6445 - DNA, 23 bp, Artificial sequence
  SiRNA target sequence
ttaatacatcacttcaatattgt

SEQ ID NO: 6446 - DNA, 23 bp, Artificial sequence
  SiRNA target sequence
taatacatcacttcaatattgtt

SEQ ID NO: 6447 - DNA, 23 bp, Artificial sequence
  SiRNA target sequence
aatacatcacttcaatattgttg

SEQ ID NO: 6448 - DNA, 23 bp, Artificial sequence
  SiRNA target sequence
atacatcacttcaatattgttgt

SEQ ID NO: 6449 - DNA, 23 bp, Artificial sequence
  SiRNA target sequence
tacatcacttcaatattgttgta

SEQ ID NO: 6450 - DNA, 23 bp, Artificial sequence
  SiRNA target sequence
acatcacttcaatattgttgtaa

SEQ ID NO: 6451 - DNA, 23 bp, Artificial sequence
  SiRNA target sequence
catcacttcaatattgttgtaat

SEQ ID NO: 6452 - DNA, 23 bp, Artificial sequence
  SiRNA target sequence
atcacttcaatattgttgtaatt

SEQ ID NO: 6453 - DNA, 23 bp, Artificial sequence
  SiRNA target sequence
tcacttcaatattgttgtaattc

SEQ ID NO: 6454 - DNA, 23 bp, Artificial sequence
  SiRNA target sequence
cacttcaatattgttgtaattct

SEQ ID NO: 6455 - DNA, 23 bp, Artificial sequence
  SiRNA target sequence
acttcaatattgttgtaattctg

SEQ ID NO: 6456 - DNA, 23 bp, Artificial sequence
  SiRNA target sequence
cttcaatattgttgtaattctga

SEQ ID NO: 6457 - DNA, 23 bp, Artificial sequence
  SiRNA target sequence
ttcaatattgttgtaattctgat

SEQ ID NO: 6458 - DNA, 23 bp, Artificial sequence
  SiRNA target sequence
tcaatattgttgtaattctgatg

SEQ ID NO: 6459 - DNA, 23 bp, Artificial sequence
  SiRNA target sequence
caatattgttgtaattctgatga

SEQ ID NO: 6460 - DNA, 23 bp, Artificial sequence
  SiRNA target sequence
aatattgttgtaattctgatgag

SEQ ID NO: 6461 - DNA, 23 bp, Artificial sequence
  SiRNA target sequence
atattgttgtaattctgatgagg

SEQ ID NO: 6462 - DNA, 23 bp, Artificial sequence
  SiRNA target sequence
tattgttgtaattctgatgaggt

SEQ ID NO: 6463 - DNA, 23 bp, Artificial sequence
  SiRNA target sequence
attgttgtaattctgatgaggtt

SEQ ID NO: 6464 - DNA, 23 bp, Artificial sequence
  SiRNA target sequence
ttgttgtaattctgatgaggttt

SEQ ID NO: 6465 - DNA, 23 bp, Artificial sequence
  SiRNA target sequence
tgttgtaattctgatgaggtttt

SEQ ID NO: 6466 - DNA, 23 bp, Artificial sequence
  SiRNA target sequence
gttgtaattctgatgaggttttt

SEQ ID NO: 6467 - DNA, 23 bp, Artificial sequence
  SiRNA target sequence
ttgtaattctgatgaggttttta

SEQ ID NO: 6468 - DNA, 23 bp, Artificial sequence
  SiRNA target sequence
tgtaattctgatgaggtttttat

SEQ ID NO: 6469 - DNA, 23 bp, Artificial sequence
  SiRNA target sequence
gtaattctgatgaggtttttatt

SEQ ID NO: 6470 - DNA, 23 bp, Artificial sequence
  SiRNA target sequence
taattctgatgaggtttttattg

SEQ ID NO: 6471 - DNA, 23 bp, Artificial sequence
  SiRNA target sequence
aattctgatgaggtttttattgt

SEQ ID NO: 6472 - DNA, 23 bp, Artificial sequence
  SiRNA target sequence
attctgatgaggtttttattgtt

SEQ ID NO: 6473 - DNA, 23 bp, Artificial sequence
  SiRNA target sequence
ttctgatgaggtttttattgtta

SEQ ID NO: 6474 - DNA, 23 bp, Artificial sequence
  SiRNA target sequence
tctgatgaggtttttattgttaa

SEQ ID NO: 6475 - DNA, 23 bp, Artificial sequence
  SiRNA target sequence
ctgatgaggtttttattgttaag

SEQ ID NO: 6476 - DNA, 23 bp, Artificial sequence
  SiRNA target sequence
tgatgaggtttttattgttaagc

SEQ ID NO: 6477 - DNA, 23 bp, Artificial sequence
  SiRNA target sequence
gatgaggtttttattgttaagca

SEQ ID NO: 6478 - DNA, 23 bp, Artificial sequence
  SiRNA target sequence
atgaggtttttattgttaagcag

SEQ ID NO: 6479 - DNA, 23 bp, Artificial sequence
  SiRNA target sequence
tgaggtttttattgttaagcagt

SEQ ID NO: 6480 - DNA, 23 bp, Artificial sequence
  SiRNA target sequence
gaggtttttattgttaagcagtc

SEQ ID NO: 6481 - DNA, 23 bp, Artificial sequence
  SiRNA target sequence
aggtttttattgttaagcagtca

SEQ ID NO: 6482 - DNA, 23 bp, Artificial sequence
  SiRNA target sequence
ggtttttattgttaagcagtcac

SEQ ID NO: 6483 - DNA, 23 bp, Artificial sequence
  SiRNA target sequence
gtttttattgttaagcagtcact

SEQ ID NO: 6484 - DNA, 23 bp, Artificial sequence
  SiRNA target sequence
tttttattgttaagcagtcactt

SEQ ID NO: 6485 - DNA, 23 bp, Artificial sequence
  SiRNA target sequence
ttttattgttaagcagtcactta

SEQ ID NO: 6486 - DNA, 23 bp, Artificial sequence
  SiRNA target sequence
tttattgttaagcagtcacttat

SEQ ID NO: 6487 - DNA, 23 bp, Artificial sequence
  SiRNA target sequence
ttattgttaagcagtcacttatt

SEQ ID NO: 6488 - DNA, 23 bp, Artificial sequence
  SiRNA target sequence
tattgttaagcagtcacttattt

SEQ ID NO: 6489 - DNA, 23 bp, Artificial sequence
  SiRNA target sequence
attgttaagcagtcacttatttt

SEQ ID NO: 6490 - DNA, 23 bp, Artificial sequence
  SiRNA target sequence
ttgttaagcagtcacttatttta

SEQ ID NO: 6491 - DNA, 23 bp, Artificial sequence
  SiRNA target sequence
tgttaagcagtcacttattttaa

SEQ ID NO: 6492 - DNA, 23 bp, Artificial sequence
  SiRNA target sequence
gttaagcagtcacttattttaat

SEQ ID NO: 6493 - DNA, 23 bp, Artificial sequence
  SiRNA target sequence
ttaagcagtcacttattttaata

SEQ ID NO: 6494 - DNA, 23 bp, Artificial sequence
  SiRNA target sequence
taagcagtcacttattttaatag

SEQ ID NO: 6495 - DNA, 23 bp, Artificial sequence
  SiRNA target sequence
aagcagtcacttattttaataga

SEQ ID NO: 6496 - DNA, 23 bp, Artificial sequence
  SiRNA target sequence
agcagtcacttattttaatagaa

SEQ ID NO: 6497 - DNA, 23 bp, Artificial sequence
  SiRNA target sequence
gcagtcacttattttaatagaag

SEQ ID NO: 6498 - DNA, 23 bp, Artificial sequence
  SiRNA target sequence
cagtcacttattttaatagaagt

SEQ ID NO: 6499 - DNA, 23 bp, Artificial sequence
  SiRNA target sequence
agtcacttattttaatagaagta

SEQ ID NO: 6500 - DNA, 23 bp, Artificial sequence
  SiRNA target sequence
gtcacttattttaatagaagtac

SEQ ID NO: 6501 - DNA, 23 bp, Artificial sequence
  SiRNA target sequence
tcacttattttaatagaagtaca

SEQ ID NO: 6502 - DNA, 23 bp, Artificial sequence
  SiRNA target sequence
cacttattttaatagaagtacat

SEQ ID NO: 6503 - DNA, 23 bp, Artificial sequence
  SiRNA target sequence
acttattttaatagaagtacatg

SEQ ID NO: 6504 - DNA, 23 bp, Artificial sequence
  SiRNA target sequence
cttattttaatagaagtacatga

SEQ ID NO: 6505 - DNA, 23 bp, Artificial sequence
  SiRNA target sequence
ttattttaatagaagtacatgaa

SEQ ID NO: 6506 - DNA, 23 bp, Artificial sequence
  SiRNA target sequence
tattttaatagaagtacatgaat

SEQ ID NO: 6507 - DNA, 23 bp, Artificial sequence
  SiRNA target sequence
attttaatagaagtacatgaata

SEQ ID NO: 6508 - DNA, 23 bp, Artificial sequence
  SiRNA target sequence
ttttaatagaagtacatgaatac

SEQ ID NO: 6509 - DNA, 23 bp, Artificial sequence
  SiRNA target sequence
tttaatagaagtacatgaataca

SEQ ID NO: 6510 - DNA, 23 bp, Artificial sequence
  SiRNA target sequence
ttaatagaagtacatgaatacat

SEQ ID NO: 6511 - DNA, 23 bp, Artificial sequence
  SiRNA target sequence
taatagaagtacatgaatacatc

SEQ ID NO: 6512 - DNA, 23 bp, Artificial sequence
  SiRNA target sequence
aatagaagtacatgaatacatca

SEQ ID NO: 6513 - DNA, 23 bp, Artificial sequence
  SiRNA target sequence
atagaagtacatgaatacatcaa

SEQ ID NO: 6514 - DNA, 23 bp, Artificial sequence
  SiRNA target sequence
tagaagtacatgaatacatcaaa

SEQ ID NO: 6515 - DNA, 23 bp, Artificial sequence
  SiRNA target sequence
agaagtacatgaatacatcaaag

SEQ ID NO: 6516 - DNA, 23 bp, Artificial sequence
  SiRNA target sequence
gaagtacatgaatacatcaaaga

SEQ ID NO: 6517 - DNA, 23 bp, Artificial sequence
  SiRNA target sequence
aagtacatgaatacatcaaagaa

SEQ ID NO: 6518 - DNA, 23 bp, Artificial sequence
  SiRNA target sequence
agtacatgaatacatcaaagaaa

SEQ ID NO: 6519 - DNA, 23 bp, Artificial sequence
  SiRNA target sequence
gtacatgaatacatcaaagaaaa

SEQ ID NO: 6520 - DNA, 23 bp, Artificial sequence
  SiRNA target sequence
tacatgaatacatcaaagaaaat

SEQ ID NO: 6521 - DNA, 23 bp, Artificial sequence
  SiRNA target sequence
acatgaatacatcaaagaaaata

SEQ ID NO: 6522 - DNA, 23 bp, Artificial sequence
  SiRNA target sequence
catgaatacatcaaagaaaataa

SEQ ID NO: 6523 - DNA, 23 bp, Artificial sequence
  SiRNA target sequence
atgaatacatcaaagaaaataaa

SEQ ID NO: 6524 - DNA, 23 bp, Artificial sequence
  SiRNA target sequence
tgaatacatcaaagaaaataaaa

SEQ ID NO: 6525 - DNA, 23 bp, Artificial sequence
  SiRNA target sequence
gaatacatcaaagaaaataaaat

SEQ ID NO: 6526 - DNA, 23 bp, Artificial sequence
  SiRNA target sequence
aatacatcaaagaaaataaaata

SEQ ID NO: 6527 - DNA, 23 bp, Artificial sequence
  SiRNA target sequence
atacatcaaagaaaataaaatat

SEQ ID NO: 6528 - DNA, 23 bp, Artificial sequence
  SiRNA target sequence
tacatcaaagaaaataaaatata

SEQ ID NO: 6529 - DNA, 23 bp, Artificial sequence
  SiRNA target sequence
acatcaaagaaaataaaatataa

SEQ ID NO: 6530 - DNA, 24 bp, Artificial sequence
  SiRNA target sequence
atgaaacgaaaaacagaaatattt

SEQ ID NO: 6531 - DNA, 24 bp, Artificial sequence
  SiRNA target sequence
tgaaacgaaaaacagaaatattta

SEQ ID NO: 6532 - DNA, 24 bp, Artificial sequence
  SiRNA target sequence
gaaacgaaaaacagaaatatttat

SEQ ID NO: 6533 - DNA, 24 bp, Artificial sequence
  SiRNA target sequence
aaacgaaaaacagaaatatttatt

SEQ ID NO: 6534 - DNA, 24 bp, Artificial sequence
  SiRNA target sequence
aacgaaaaacagaaatatttattg

SEQ ID NO: 6535 - DNA, 24 bp, Artificial sequence
  SiRNA target sequence
acgaaaaacagaaatatttattgc

SEQ ID NO: 6536 - DNA, 24 bp, Artificial sequence
  SiRNA target sequence
cgaaaaacagaaatatttattgct

SEQ ID NO: 6537 - DNA, 24 bp, Artificial sequence
  SiRNA target sequence
gaaaaacagaaatatttattgcta

SEQ ID NO: 6538 - DNA, 24 bp, Artificial sequence
  SiRNA target sequence
aaaaacagaaatatttattgctat

SEQ ID NO: 6539 - DNA, 24 bp, Artificial sequence
  SiRNA target sequence
aaaacagaaatatttattgctatt

SEQ ID NO: 6540 - DNA, 24 bp, Artificial sequence
  SiRNA target sequence
aaacagaaatatttattgctatta

SEQ ID NO: 6541 - DNA, 24 bp, Artificial sequence
  SiRNA target sequence
aacagaaatatttattgctattac

SEQ ID NO: 6542 - DNA, 24 bp, Artificial sequence
  SiRNA target sequence
acagaaatatttattgctattaca

SEQ ID NO: 6543 - DNA, 24 bp, Artificial sequence
  SiRNA target sequence
cagaaatatttattgctattacag

SEQ ID NO: 6544 - DNA, 24 bp, Artificial sequence
  SiRNA target sequence
agaaatatttattgctattacagt

SEQ ID NO: 6545 - DNA, 24 bp, Artificial sequence
  SiRNA target sequence
gaaatatttattgctattacagta

SEQ ID NO: 6546 - DNA, 24 bp, Artificial sequence
  SiRNA target sequence
aaatatttattgctattacagtag

SEQ ID NO: 6547 - DNA, 24 bp, Artificial sequence
  SiRNA target sequence
aatatttattgctattacagtagt

SEQ ID NO: 6548 - DNA, 24 bp, Artificial sequence
  SiRNA target sequence
atatttattgctattacagtagtc

SEQ ID NO: 6549 - DNA, 24 bp, Artificial sequence
  SiRNA target sequence
tatttattgctattacagtagtca

SEQ ID NO: 6550 - DNA, 24 bp, Artificial sequence
  SiRNA target sequence
atttattgctattacagtagtcac

SEQ ID NO: 6551 - DNA, 24 bp, Artificial sequence
  SiRNA target sequence
tttattgctattacagtagtcact

SEQ ID NO: 6552 - DNA, 24 bp, Artificial sequence
  SiRNA target sequence
ttattgctattacagtagtcactg

SEQ ID NO: 6553 - DNA, 24 bp, Artificial sequence
  SiRNA target sequence
tattgctattacagtagtcactgc

SEQ ID NO: 6554 - DNA, 24 bp, Artificial sequence
  SiRNA target sequence
attgctattacagtagtcactgca

SEQ ID NO: 6555 - DNA, 24 bp, Artificial sequence
  SiRNA target sequence
ttgctattacagtagtcactgcag

SEQ ID NO: 6556 - DNA, 24 bp, Artificial sequence
  SiRNA target sequence
tgctattacagtagtcactgcagt

SEQ ID NO: 6557 - DNA, 24 bp, Artificial sequence
  SiRNA target sequence
gctattacagtagtcactgcagtg

SEQ ID NO: 6558 - DNA, 24 bp, Artificial sequence
  SiRNA target sequence
ctattacagtagtcactgcagtga

SEQ ID NO: 6559 - DNA, 24 bp, Artificial sequence
  SiRNA target sequence
tattacagtagtcactgcagtgac

SEQ ID NO: 6560 - DNA, 24 bp, Artificial sequence
  SiRNA target sequence
attacagtagtcactgcagtgaca

SEQ ID NO: 6561 - DNA, 24 bp, Artificial sequence
  SiRNA target sequence
ttacagtagtcactgcagtgacat

SEQ ID NO: 6562 - DNA, 24 bp, Artificial sequence
  SiRNA target sequence
tacagtagtcactgcagtgacatg

SEQ ID NO: 6563 - DNA, 24 bp, Artificial sequence
  SiRNA target sequence
acagtagtcactgcagtgacatgt

SEQ ID NO: 6564 - DNA, 24 bp, Artificial sequence
  SiRNA target sequence
cagtagtcactgcagtgacatgtt

SEQ ID NO: 6565 - DNA, 24 bp, Artificial sequence
  SiRNA target sequence
agtagtcactgcagtgacatgtta

SEQ ID NO: 6566 - DNA, 24 bp, Artificial sequence
  SiRNA target sequence
gtagtcactgcagtgacatgttac

SEQ ID NO: 6567 - DNA, 24 bp, Artificial sequence
  SiRNA target sequence
tagtcactgcagtgacatgttact

SEQ ID NO: 6568 - DNA, 24 bp, Artificial sequence
  SiRNA target sequence
agtcactgcagtgacatgttactt

SEQ ID NO: 6569 - DNA, 24 bp, Artificial sequence
  SiRNA target sequence
gtcactgcagtgacatgttactta

SEQ ID NO: 6570 - DNA, 24 bp, Artificial sequence
  SiRNA target sequence
tcactgcagtgacatgttacttat

SEQ ID NO: 6571 - DNA, 24 bp, Artificial sequence
  SiRNA target sequence
cactgcagtgacatgttacttatt

SEQ ID NO: 6572 - DNA, 24 bp, Artificial sequence
  SiRNA target sequence
actgcagtgacatgttacttattt

SEQ ID NO: 6573 - DNA, 24 bp, Artificial sequence
  SiRNA target sequence
ctgcagtgacatgttacttattta

SEQ ID NO: 6574 - DNA, 24 bp, Artificial sequence
  SiRNA target sequence
tgcagtgacatgttacttatttaa

SEQ ID NO: 6575 - DNA, 24 bp, Artificial sequence
  SiRNA target sequence
gcagtgacatgttacttatttaaa

SEQ ID NO: 6576 - DNA, 24 bp, Artificial sequence
  SiRNA target sequence
cagtgacatgttacttatttaaaa

SEQ ID NO: 6577 - DNA, 24 bp, Artificial sequence
  SiRNA target sequence
agtgacatgttacttatttaaaaa

SEQ ID NO: 6578 - DNA, 24 bp, Artificial sequence
  SiRNA target sequence
gtgacatgttacttatttaaaaaa

SEQ ID NO: 6579 - DNA, 24 bp, Artificial sequence
  SiRNA target sequence
tgacatgttacttatttaaaaaaa

SEQ ID NO: 6580 - DNA, 24 bp, Artificial sequence
  SiRNA target sequence
gacatgttacttatttaaaaaaat

SEQ ID NO: 6581 - DNA, 24 bp, Artificial sequence
  SiRNA target sequence
acatgttacttatttaaaaaaata

SEQ ID NO: 6582 - DNA, 24 bp, Artificial sequence
  SiRNA target sequence
catgttacttatttaaaaaaataa

SEQ ID NO: 6583 - DNA, 24 bp, Artificial sequence
  SiRNA target sequence
atgttacttatttaaaaaaataat

SEQ ID NO: 6584 - DNA, 24 bp, Artificial sequence
  SiRNA target sequence
tgttacttatttaaaaaaataata

SEQ ID NO: 6585 - DNA, 24 bp, Artificial sequence
  SiRNA target sequence
gttacttatttaaaaaaataataa

SEQ ID NO: 6586 - DNA, 24 bp, Artificial sequence
  SiRNA target sequence
ttacttatttaaaaaaataataaa

SEQ ID NO: 6587 - DNA, 24 bp, Artificial sequence
  SiRNA target sequence
tacttatttaaaaaaataataaat

SEQ ID NO: 6588 - DNA, 24 bp, Artificial sequence
  SiRNA target sequence
acttatttaaaaaaataataaata

SEQ ID NO: 6589 - DNA, 24 bp, Artificial sequence
  SiRNA target sequence
cttatttaaaaaaataataaatag

SEQ ID NO: 6590 - DNA, 24 bp, Artificial sequence
  SiRNA target sequence
ttatttaaaaaaataataaataga

SEQ ID NO: 6591 - DNA, 24 bp, Artificial sequence
  SiRNA target sequence
tatttaaaaaaataataaatagac

SEQ ID NO: 6592 - DNA, 24 bp, Artificial sequence
  SiRNA target sequence
atttaaaaaaataataaatagaca

SEQ ID NO: 6593 - DNA, 24 bp, Artificial sequence
  SiRNA target sequence
tttaaaaaaataataaatagacaa

SEQ ID NO: 6594 - DNA, 24 bp, Artificial sequence
  SiRNA target sequence
ttaaaaaaataataaatagacaaa

SEQ ID NO: 6595 - DNA, 24 bp, Artificial sequence
  SiRNA target sequence
taaaaaaataataaatagacaaaa

SEQ ID NO: 6596 - DNA, 24 bp, Artificial sequence
  SiRNA target sequence
aaaaaaataataaatagacaaaag

SEQ ID NO: 6597 - DNA, 24 bp, Artificial sequence
  SiRNA target sequence
aaaaaataataaatagacaaaagt

SEQ ID NO: 6598 - DNA, 24 bp, Artificial sequence
  SiRNA target sequence
aaaaataataaatagacaaaagtc

SEQ ID NO: 6599 - DNA, 24 bp, Artificial sequence
  SiRNA target sequence
aaaataataaatagacaaaagtct

SEQ ID NO: 6600 - DNA, 24 bp, Artificial sequence
  SiRNA target sequence
aaataataaatagacaaaagtctg

SEQ ID NO: 6601 - DNA, 24 bp, Artificial sequence
  SiRNA target sequence
aataataaatagacaaaagtctga

SEQ ID NO: 6602 - DNA, 24 bp, Artificial sequence
  SiRNA target sequence
ataataaatagacaaaagtctgat

SEQ ID NO: 6603 - DNA, 24 bp, Artificial sequence
  SiRNA target sequence
taataaatagacaaaagtctgatt

SEQ ID NO: 6604 - DNA, 24 bp, Artificial sequence
  SiRNA target sequence
aataaatagacaaaagtctgatta

SEQ ID NO: 6605 - DNA, 24 bp, Artificial sequence
  SiRNA target sequence
ataaatagacaaaagtctgattat

SEQ ID NO: 6606 - DNA, 24 bp, Artificial sequence
  SiRNA target sequence
taaatagacaaaagtctgattata

SEQ ID NO: 6607 - DNA, 24 bp, Artificial sequence
  SiRNA target sequence
aaatagacaaaagtctgattatac

SEQ ID NO: 6608 - DNA, 24 bp, Artificial sequence
  SiRNA target sequence
aatagacaaaagtctgattataca

SEQ ID NO: 6609 - DNA, 24 bp, Artificial sequence
  SiRNA target sequence
atagacaaaagtctgattatacat

SEQ ID NO: 6610 - DNA, 24 bp, Artificial sequence
  SiRNA target sequence
tagacaaaagtctgattatacatc

SEQ ID NO: 6611 - DNA, 24 bp, Artificial sequence
  SiRNA target sequence
agacaaaagtctgattatacatca

SEQ ID NO: 6612 - DNA, 24 bp, Artificial sequence
  SiRNA target sequence
gacaaaagtctgattatacatcaa

SEQ ID NO: 6613 - DNA, 24 bp, Artificial sequence
  SiRNA target sequence
acaaaagtctgattatacatcaat

SEQ ID NO: 6614 - DNA, 24 bp, Artificial sequence
  SiRNA target sequence
caaaagtctgattatacatcaata

SEQ ID NO: 6615 - DNA, 24 bp, Artificial sequence
  SiRNA target sequence
aaaagtctgattatacatcaataa

SEQ ID NO: 6616 - DNA, 24 bp, Artificial sequence
  SiRNA target sequence
aaagtctgattatacatcaataaa

SEQ ID NO: 6617 - DNA, 24 bp, Artificial sequence
  SiRNA target sequence
aagtctgattatacatcaataaaa

SEQ ID NO: 6618 - DNA, 24 bp, Artificial sequence
  SiRNA target sequence
agtctgattatacatcaataaaac

SEQ ID NO: 6619 - DNA, 24 bp, Artificial sequence
  SiRNA target sequence
gtctgattatacatcaataaaaca

SEQ ID NO: 6620 - DNA, 24 bp, Artificial sequence
  SiRNA target sequence
tctgattatacatcaataaaacag

SEQ ID NO: 6621 - DNA, 24 bp, Artificial sequence
  SiRNA target sequence
ctgattatacatcaataaaacagg

SEQ ID NO: 6622 - DNA, 24 bp, Artificial sequence
  SiRNA target sequence
tgattatacatcaataaaacagga

SEQ ID NO: 6623 - DNA, 24 bp, Artificial sequence
  SiRNA target sequence
gattatacatcaataaaacaggaa

SEQ ID NO: 6624 - DNA, 24 bp, Artificial sequence
  SiRNA target sequence
attatacatcaataaaacaggaag

SEQ ID NO: 6625 - DNA, 24 bp, Artificial sequence
  SiRNA target sequence
ttatacatcaataaaacaggaagc

SEQ ID NO: 6626 - DNA, 24 bp, Artificial sequence
  SiRNA target sequence
tatacatcaataaaacaggaagca

SEQ ID NO: 6627 - DNA, 24 bp, Artificial sequence
  SiRNA target sequence
atacatcaataaaacaggaagcag

SEQ ID NO: 6628 - DNA, 24 bp, Artificial sequence
  SiRNA target sequence
tacatcaataaaacaggaagcaga

SEQ ID NO: 6629 - DNA, 24 bp, Artificial sequence
  SiRNA target sequence
acatcaataaaacaggaagcagat

SEQ ID NO: 6630 - DNA, 24 bp, Artificial sequence
  SiRNA target sequence
catcaataaaacaggaagcagata

SEQ ID NO: 6631 - DNA, 24 bp, Artificial sequence
  SiRNA target sequence
atcaataaaacaggaagcagataa

SEQ ID NO: 6632 - DNA, 24 bp, Artificial sequence
  SiRNA target sequence
tcaataaaacaggaagcagataaa

SEQ ID NO: 6633 - DNA, 24 bp, Artificial sequence
  SiRNA target sequence
caataaaacaggaagcagataaat

SEQ ID NO: 6634 - DNA, 24 bp, Artificial sequence
  SiRNA target sequence
aataaaacaggaagcagataaata

SEQ ID NO: 6635 - DNA, 24 bp, Artificial sequence
  SiRNA target sequence
ataaaacaggaagcagataaatat

SEQ ID NO: 6636 - DNA, 24 bp, Artificial sequence
  SiRNA target sequence
taaaacaggaagcagataaatatt

SEQ ID NO: 6637 - DNA, 24 bp, Artificial sequence
  SiRNA target sequence
aaaacaggaagcagataaatattt

SEQ ID NO: 6638 - DNA, 24 bp, Artificial sequence
  SiRNA target sequence
aaacaggaagcagataaatatttt

SEQ ID NO: 6639 - DNA, 24 bp, Artificial sequence
  SiRNA target sequence
aacaggaagcagataaatatttta

SEQ ID NO: 6640 - DNA, 24 bp, Artificial sequence
  SiRNA target sequence
acaggaagcagataaatattttat

SEQ ID NO: 6641 - DNA, 24 bp, Artificial sequence
  SiRNA target sequence
caggaagcagataaatattttata

SEQ ID NO: 6642 - DNA, 24 bp, Artificial sequence
  SiRNA target sequence
aggaagcagataaatattttatac

SEQ ID NO: 6643 - DNA, 24 bp, Artificial sequence
  SiRNA target sequence
ggaagcagataaatattttataca

SEQ ID NO: 6644 - DNA, 24 bp, Artificial sequence
  SiRNA target sequence
gaagcagataaatattttatacaa

SEQ ID NO: 6645 - DNA, 24 bp, Artificial sequence
  SiRNA target sequence
aagcagataaatattttatacaag

SEQ ID NO: 6646 - DNA, 24 bp, Artificial sequence
  SiRNA target sequence
agcagataaatattttatacaaga

SEQ ID NO: 6647 - DNA, 24 bp, Artificial sequence
  SiRNA target sequence
gcagataaatattttatacaagaa

SEQ ID NO: 6648 - DNA, 24 bp, Artificial sequence
  SiRNA target sequence
cagataaatattttatacaagaag

SEQ ID NO: 6649 - DNA, 24 bp, Artificial sequence
  SiRNA target sequence
agataaatattttatacaagaaga

SEQ ID NO: 6650 - DNA, 24 bp, Artificial sequence
  SiRNA target sequence
gataaatattttatacaagaagat

SEQ ID NO: 6651 - DNA, 24 bp, Artificial sequence
  SiRNA target sequence
ataaatattttatacaagaagatt

SEQ ID NO: 6652 - DNA, 24 bp, Artificial sequence
  SiRNA target sequence
taaatattttatacaagaagatta

SEQ ID NO: 6653 - DNA, 24 bp, Artificial sequence
  SiRNA target sequence
aaatattttatacaagaagattat

SEQ ID NO: 6654 - DNA, 24 bp, Artificial sequence
  SiRNA target sequence
aatattttatacaagaagattata

SEQ ID NO: 6655 - DNA, 24 bp, Artificial sequence
  SiRNA target sequence
atattttatacaagaagattataa

SEQ ID NO: 6656 - DNA, 24 bp, Artificial sequence
  SiRNA target sequence
tattttatacaagaagattataaa

SEQ ID NO: 6657 - DNA, 24 bp, Artificial sequence
  SiRNA target sequence
attttatacaagaagattataaaa

SEQ ID NO: 6658 - DNA, 24 bp, Artificial sequence
  SiRNA target sequence
ttttatacaagaagattataaaaa

SEQ ID NO: 6659 - DNA, 24 bp, Artificial sequence
  SiRNA target sequence
tttatacaagaagattataaaaat

SEQ ID NO: 6660 - DNA, 24 bp, Artificial sequence
  SiRNA target sequence
ttatacaagaagattataaaaatg

SEQ ID NO: 6661 - DNA, 24 bp, Artificial sequence
  SiRNA target sequence
tatacaagaagattataaaaatgc

SEQ ID NO: 6662 - DNA, 24 bp, Artificial sequence
  SiRNA target sequence
atacaagaagattataaaaatgct

SEQ ID NO: 6663 - DNA, 24 bp, Artificial sequence
  SiRNA target sequence
tacaagaagattataaaaatgcta

SEQ ID NO: 6664 - DNA, 24 bp, Artificial sequence
  SiRNA target sequence
acaagaagattataaaaatgctat

SEQ ID NO: 6665 - DNA, 24 bp, Artificial sequence
  SiRNA target sequence
caagaagattataaaaatgctatt

SEQ ID NO: 6666 - DNA, 24 bp, Artificial sequence
  SiRNA target sequence
aagaagattataaaaatgctattc

SEQ ID NO: 6667 - DNA, 24 bp, Artificial sequence
  SiRNA target sequence
agaagattataaaaatgctattct

SEQ ID NO: 6668 - DNA, 24 bp, Artificial sequence
  SiRNA target sequence
gaagattataaaaatgctattctg

SEQ ID NO: 6669 - DNA, 24 bp, Artificial sequence
  SiRNA target sequence
aagattataaaaatgctattctgt

SEQ ID NO: 6670 - DNA, 24 bp, Artificial sequence
  SiRNA target sequence
agattataaaaatgctattctgtt

SEQ ID NO: 6671 - DNA, 24 bp, Artificial sequence
  SiRNA target sequence
gattataaaaatgctattctgttg

SEQ ID NO: 6672 - DNA, 24 bp, Artificial sequence
  SiRNA target sequence
attataaaaatgctattctgttgt

SEQ ID NO: 6673 - DNA, 24 bp, Artificial sequence
  SiRNA target sequence
ttataaaaatgctattctgttgta

SEQ ID NO: 6674 - DNA, 24 bp, Artificial sequence
  SiRNA target sequence
tataaaaatgctattctgttgtac

SEQ ID NO: 6675 - DNA, 24 bp, Artificial sequence
  SiRNA target sequence
ataaaaatgctattctgttgtaca

SEQ ID NO: 6676 - DNA, 24 bp, Artificial sequence
  SiRNA target sequence
taaaaatgctattctgttgtacac

SEQ ID NO: 6677 - DNA, 24 bp, Artificial sequence
  SiRNA target sequence
aaaaatgctattctgttgtacact

SEQ ID NO: 6678 - DNA, 24 bp, Artificial sequence
  SiRNA target sequence
aaaatgctattctgttgtacacta

SEQ ID NO: 6679 - DNA, 24 bp, Artificial sequence
  SiRNA target sequence
aaatgctattctgttgtacactaa

SEQ ID NO: 6680 - DNA, 24 bp, Artificial sequence
  SiRNA target sequence
aatgctattctgttgtacactaaa

SEQ ID NO: 6681 - DNA, 24 bp, Artificial sequence
  SiRNA target sequence
atgctattctgttgtacactaaat

SEQ ID NO: 6682 - DNA, 24 bp, Artificial sequence
  SiRNA target sequence
tgctattctgttgtacactaaatg

SEQ ID NO: 6683 - DNA, 24 bp, Artificial sequence
  SiRNA target sequence
gctattctgttgtacactaaatgt

SEQ ID NO: 6684 - DNA, 24 bp, Artificial sequence
  SiRNA target sequence
ctattctgttgtacactaaatgta

SEQ ID NO: 6685 - DNA, 24 bp, Artificial sequence
  SiRNA target sequence
tattctgttgtacactaaatgtaa

SEQ ID NO: 6686 - DNA, 24 bp, Artificial sequence
  SiRNA target sequence
attctgttgtacactaaatgtaaa

SEQ ID NO: 6687 - DNA, 24 bp, Artificial sequence
  SiRNA target sequence
ttctgttgtacactaaatgtaaat

SEQ ID NO: 6688 - DNA, 24 bp, Artificial sequence
  SiRNA target sequence
tctgttgtacactaaatgtaaata

SEQ ID NO: 6689 - DNA, 24 bp, Artificial sequence
  SiRNA target sequence
ctgttgtacactaaatgtaaatat

SEQ ID NO: 6690 - DNA, 24 bp, Artificial sequence
  SiRNA target sequence
tgttgtacactaaatgtaaatata

SEQ ID NO: 6691 - DNA, 24 bp, Artificial sequence
  SiRNA target sequence
gttgtacactaaatgtaaatatat

SEQ ID NO: 6692 - DNA, 24 bp, Artificial sequence
  SiRNA target sequence
ttgtacactaaatgtaaatatatg

SEQ ID NO: 6693 - DNA, 24 bp, Artificial sequence
  SiRNA target sequence
tgtacactaaatgtaaatatatga

SEQ ID NO: 6694 - DNA, 24 bp, Artificial sequence
  SiRNA target sequence
gtacactaaatgtaaatatatgaa

SEQ ID NO: 6695 - DNA, 24 bp, Artificial sequence
  SiRNA target sequence
tacactaaatgtaaatatatgaaa

SEQ ID NO: 6696 - DNA, 24 bp, Artificial sequence
  SiRNA target sequence
acactaaatgtaaatatatgaaaa

SEQ ID NO: 6697 - DNA, 24 bp, Artificial sequence
  SiRNA target sequence
cactaaatgtaaatatatgaaaag

SEQ ID NO: 6698 - DNA, 24 bp, Artificial sequence
  SiRNA target sequence
actaaatgtaaatatatgaaaagt

SEQ ID NO: 6699 - DNA, 24 bp, Artificial sequence
  SiRNA target sequence
ctaaatgtaaatatatgaaaagtg

SEQ ID NO: 6700 - DNA, 24 bp, Artificial sequence
  SiRNA target sequence
taaatgtaaatatatgaaaagtga

SEQ ID NO: 6701 - DNA, 24 bp, Artificial sequence
  SiRNA target sequence
aaatgtaaatatatgaaaagtgat

SEQ ID NO: 6702 - DNA, 24 bp, Artificial sequence
  SiRNA target sequence
aatgtaaatatatgaaaagtgatg

SEQ ID NO: 6703 - DNA, 24 bp, Artificial sequence
  SiRNA target sequence
atgtaaatatatgaaaagtgatgc

SEQ ID NO: 6704 - DNA, 24 bp, Artificial sequence
  SiRNA target sequence
tgtaaatatatgaaaagtgatgct

SEQ ID NO: 6705 - DNA, 24 bp, Artificial sequence
  SiRNA target sequence
gtaaatatatgaaaagtgatgctg

SEQ ID NO: 6706 - DNA, 24 bp, Artificial sequence
  SiRNA target sequence
taaatatatgaaaagtgatgctga

SEQ ID NO: 6707 - DNA, 24 bp, Artificial sequence
  SiRNA target sequence
aaatatatgaaaagtgatgctgaa

SEQ ID NO: 6708 - DNA, 24 bp, Artificial sequence
  SiRNA target sequence
aatatatgaaaagtgatgctgaaa

SEQ ID NO: 6709 - DNA, 24 bp, Artificial sequence
  SiRNA target sequence
atatatgaaaagtgatgctgaaat

SEQ ID NO: 6710 - DNA, 24 bp, Artificial sequence
  SiRNA target sequence
tatatgaaaagtgatgctgaaatt

SEQ ID NO: 6711 - DNA, 24 bp, Artificial sequence
  SiRNA target sequence
atatgaaaagtgatgctgaaattc

SEQ ID NO: 6712 - DNA, 24 bp, Artificial sequence
  SiRNA target sequence
tatgaaaagtgatgctgaaattct

SEQ ID NO: 6713 - DNA, 24 bp, Artificial sequence
  SiRNA target sequence
atgaaaagtgatgctgaaattctt

SEQ ID NO: 6714 - DNA, 24 bp, Artificial sequence
  SiRNA target sequence
tgaaaagtgatgctgaaattctta

SEQ ID NO: 6715 - DNA, 24 bp, Artificial sequence
  SiRNA target sequence
gaaaagtgatgctgaaattcttac

SEQ ID NO: 6716 - DNA, 24 bp, Artificial sequence
  SiRNA target sequence
aaaagtgatgctgaaattcttact

SEQ ID NO: 6717 - DNA, 24 bp, Artificial sequence
  SiRNA target sequence
aaagtgatgctgaaattcttacta

SEQ ID NO: 6718 - DNA, 24 bp, Artificial sequence
  SiRNA target sequence
aagtgatgctgaaattcttactaa

SEQ ID NO: 6719 - DNA, 24 bp, Artificial sequence
  SiRNA target sequence
agtgatgctgaaattcttactaaa

SEQ ID NO: 6720 - DNA, 24 bp, Artificial sequence
  SiRNA target sequence
gtgatgctgaaattcttactaaaa

SEQ ID NO: 6721 - DNA, 24 bp, Artificial sequence
  SiRNA target sequence
tgatgctgaaattcttactaaaat

SEQ ID NO: 6722 - DNA, 24 bp, Artificial sequence
  SiRNA target sequence
gatgctgaaattcttactaaaatt

SEQ ID NO: 6723 - DNA, 24 bp, Artificial sequence
  SiRNA target sequence
atgctgaaattcttactaaaatta

SEQ ID NO: 6724 - DNA, 24 bp, Artificial sequence
  SiRNA target sequence
tgctgaaattcttactaaaattag

SEQ ID NO: 6725 - DNA, 24 bp, Artificial sequence
  SiRNA target sequence
gctgaaattcttactaaaattagt

SEQ ID NO: 6726 - DNA, 24 bp, Artificial sequence
  SiRNA target sequence
ctgaaattcttactaaaattagtc

SEQ ID NO: 6727 - DNA, 24 bp, Artificial sequence
  SiRNA target sequence
tgaaattcttactaaaattagtct

SEQ ID NO: 6728 - DNA, 24 bp, Artificial sequence
  SiRNA target sequence
gaaattcttactaaaattagtctc

SEQ ID NO: 6729 - DNA, 24 bp, Artificial sequence
  SiRNA target sequence
aaattcttactaaaattagtctct

SEQ ID NO: 6730 - DNA, 24 bp, Artificial sequence
  SiRNA target sequence
aattcttactaaaattagtctctg

SEQ ID NO: 6731 - DNA, 24 bp, Artificial sequence
  SiRNA target sequence
attcttactaaaattagtctctgt

SEQ ID NO: 6732 - DNA, 24 bp, Artificial sequence
  SiRNA target sequence
ttcttactaaaattagtctctgta

SEQ ID NO: 6733 - DNA, 24 bp, Artificial sequence
  SiRNA target sequence
tcttactaaaattagtctctgtaa

SEQ ID NO: 6734 - DNA, 24 bp, Artificial sequence
  SiRNA target sequence
cttactaaaattagtctctgtaat

SEQ ID NO: 6735 - DNA, 24 bp, Artificial sequence
  SiRNA target sequence
ttactaaaattagtctctgtaatt

SEQ ID NO: 6736 - DNA, 24 bp, Artificial sequence
  SiRNA target sequence
tactaaaattagtctctgtaatta

SEQ ID NO: 6737 - DNA, 24 bp, Artificial sequence
  SiRNA target sequence
actaaaattagtctctgtaattat

SEQ ID NO: 6738 - DNA, 24 bp, Artificial sequence
  SiRNA target sequence
ctaaaattagtctctgtaattatt

SEQ ID NO: 6739 - DNA, 24 bp, Artificial sequence
  SiRNA target sequence
taaaattagtctctgtaattattt

SEQ ID NO: 6740 - DNA, 24 bp, Artificial sequence
  SiRNA target sequence
aaaattagtctctgtaattatttc

SEQ ID NO: 6741 - DNA, 24 bp, Artificial sequence
  SiRNA target sequence
aaattagtctctgtaattatttct

SEQ ID NO: 6742 - DNA, 24 bp, Artificial sequence
  SiRNA target sequence
aattagtctctgtaattatttctt

SEQ ID NO: 6743 - DNA, 24 bp, Artificial sequence
  SiRNA target sequence
attagtctctgtaattatttctta

SEQ ID NO: 6744 - DNA, 24 bp, Artificial sequence
  SiRNA target sequence
ttagtctctgtaattatttcttaa

SEQ ID NO: 6745 - DNA, 24 bp, Artificial sequence
  SiRNA target sequence
tagtctctgtaattatttcttaaa

SEQ ID NO: 6746 - DNA, 24 bp, Artificial sequence
  SiRNA target sequence
agtctctgtaattatttcttaaaa

SEQ ID NO: 6747 - DNA, 24 bp, Artificial sequence
  SiRNA target sequence
gtctctgtaattatttcttaaaaa

SEQ ID NO: 6748 - DNA, 24 bp, Artificial sequence
  SiRNA target sequence
tctctgtaattatttcttaaaaaa

SEQ ID NO: 6749 - DNA, 24 bp, Artificial sequence
  SiRNA target sequence
ctctgtaattatttcttaaaaaat

SEQ ID NO: 6750 - DNA, 24 bp, Artificial sequence
  SiRNA target sequence
tctgtaattatttcttaaaaaatt

SEQ ID NO: 6751 - DNA, 24 bp, Artificial sequence
  SiRNA target sequence
ctgtaattatttcttaaaaaatta

SEQ ID NO: 6752 - DNA, 24 bp, Artificial sequence
  SiRNA target sequence
tgtaattatttcttaaaaaattat

SEQ ID NO: 6753 - DNA, 24 bp, Artificial sequence
  SiRNA target sequence
gtaattatttcttaaaaaattatc

SEQ ID NO: 6754 - DNA, 24 bp, Artificial sequence
  SiRNA target sequence
taattatttcttaaaaaattatca

SEQ ID NO: 6755 - DNA, 24 bp, Artificial sequence
  SiRNA target sequence
aattatttcttaaaaaattatcaa

SEQ ID NO: 6756 - DNA, 24 bp, Artificial sequence
  SiRNA target sequence
attatttcttaaaaaattatcaag

SEQ ID NO: 6757 - DNA, 24 bp, Artificial sequence
  SiRNA target sequence
ttatttcttaaaaaattatcaaga

SEQ ID NO: 6758 - DNA, 24 bp, Artificial sequence
  SiRNA target sequence
tatttcttaaaaaattatcaagaa

SEQ ID NO: 6759 - DNA, 24 bp, Artificial sequence
  SiRNA target sequence
atttcttaaaaaattatcaagaag

SEQ ID NO: 6760 - DNA, 24 bp, Artificial sequence
  SiRNA target sequence
tttcttaaaaaattatcaagaagt

SEQ ID NO: 6761 - DNA, 24 bp, Artificial sequence
  SiRNA target sequence
ttcttaaaaaattatcaagaagtt

SEQ ID NO: 6762 - DNA, 24 bp, Artificial sequence
  SiRNA target sequence
tcttaaaaaattatcaagaagtta

SEQ ID NO: 6763 - DNA, 24 bp, Artificial sequence
  SiRNA target sequence
cttaaaaaattatcaagaagttat

SEQ ID NO: 6764 - DNA, 24 bp, Artificial sequence
  SiRNA target sequence
ttaaaaaattatcaagaagttata

SEQ ID NO: 6765 - DNA, 24 bp, Artificial sequence
  SiRNA target sequence
taaaaaattatcaagaagttataa

SEQ ID NO: 6766 - DNA, 24 bp, Artificial sequence
  SiRNA target sequence
aaaaaattatcaagaagttataaa

SEQ ID NO: 6767 - DNA, 24 bp, Artificial sequence
  SiRNA target sequence
aaaaattatcaagaagttataaat

SEQ ID NO: 6768 - DNA, 24 bp, Artificial sequence
  SiRNA target sequence
aaaattatcaagaagttataaata

SEQ ID NO: 6769 - DNA, 24 bp, Artificial sequence
  SiRNA target sequence
aaattatcaagaagttataaataa

SEQ ID NO: 6770 - DNA, 24 bp, Artificial sequence
  SiRNA target sequence
aattatcaagaagttataaataat

SEQ ID NO: 6771 - DNA, 24 bp, Artificial sequence
  SiRNA target sequence
attatcaagaagttataaataatt

SEQ ID NO: 6772 - DNA, 24 bp, Artificial sequence
  SiRNA target sequence
ttatcaagaagttataaataattc

SEQ ID NO: 6773 - DNA, 24 bp, Artificial sequence
  SiRNA target sequence
tatcaagaagttataaataattct

SEQ ID NO: 6774 - DNA, 24 bp, Artificial sequence
  SiRNA target sequence
atcaagaagttataaataattctt

SEQ ID NO: 6775 - DNA, 24 bp, Artificial sequence
  SiRNA target sequence
tcaagaagttataaataattcttt

SEQ ID NO: 6776 - DNA, 24 bp, Artificial sequence
  SiRNA target sequence
caagaagttataaataattcttta

SEQ ID NO: 6777 - DNA, 24 bp, Artificial sequence
  SiRNA target sequence
aagaagttataaataattctttat

SEQ ID NO: 6778 - DNA, 24 bp, Artificial sequence
  SiRNA target sequence
agaagttataaataattctttatt

SEQ ID NO: 6779 - DNA, 24 bp, Artificial sequence
  SiRNA target sequence
gaagttataaataattctttattt

SEQ ID NO: 6780 - DNA, 24 bp, Artificial sequence
  SiRNA target sequence
aagttataaataattctttattta

SEQ ID NO: 6781 - DNA, 24 bp, Artificial sequence
  SiRNA target sequence
agttataaataattctttatttaa

SEQ ID NO: 6782 - DNA, 24 bp, Artificial sequence
  SiRNA target sequence
gttataaataattctttatttaag

SEQ ID NO: 6783 - DNA, 24 bp, Artificial sequence
  SiRNA target sequence
ttataaataattctttatttaaga

SEQ ID NO: 6784 - DNA, 24 bp, Artificial sequence
  SiRNA target sequence
tataaataattctttatttaagac

SEQ ID NO: 6785 - DNA, 24 bp, Artificial sequence
  SiRNA target sequence
ataaataattctttatttaagaca

SEQ ID NO: 6786 - DNA, 24 bp, Artificial sequence
  SiRNA target sequence
taaataattctttatttaagacaa

SEQ ID NO: 6787 - DNA, 24 bp, Artificial sequence
  SiRNA target sequence
aaataattctttatttaagacaaa

SEQ ID NO: 6788 - DNA, 24 bp, Artificial sequence
  SiRNA target sequence
aataattctttatttaagacaaat

SEQ ID NO: 6789 - DNA, 24 bp, Artificial sequence
  SiRNA target sequence
ataattctttatttaagacaaata

SEQ ID NO: 6790 - DNA, 24 bp, Artificial sequence
  SiRNA target sequence
taattctttatttaagacaaataa

SEQ ID NO: 6791 - DNA, 24 bp, Artificial sequence
  SiRNA target sequence
aattctttatttaagacaaataat

SEQ ID NO: 6792 - DNA, 24 bp, Artificial sequence
  SiRNA target sequence
attctttatttaagacaaataata

SEQ ID NO: 6793 - DNA, 24 bp, Artificial sequence
  SiRNA target sequence
ttctttatttaagacaaataataa

SEQ ID NO: 6794 - DNA, 24 bp, Artificial sequence
  SiRNA target sequence
tctttatttaagacaaataataaa

SEQ ID NO: 6795 - DNA, 24 bp, Artificial sequence
  SiRNA target sequence
ctttatttaagacaaataataaag

SEQ ID NO: 6796 - DNA, 24 bp, Artificial sequence
  SiRNA target sequence
tttatttaagacaaataataaaga

SEQ ID NO: 6797 - DNA, 24 bp, Artificial sequence
  SiRNA target sequence
ttatttaagacaaataataaagat

SEQ ID NO: 6798 - DNA, 24 bp, Artificial sequence
  SiRNA target sequence
tatttaagacaaataataaagatc

SEQ ID NO: 6799 - DNA, 24 bp, Artificial sequence
  SiRNA target sequence
atttaagacaaataataaagatct

SEQ ID NO: 6800 - DNA, 24 bp, Artificial sequence
  SiRNA target sequence
tttaagacaaataataaagatcta

SEQ ID NO: 6801 - DNA, 24 bp, Artificial sequence
  SiRNA target sequence
ttaagacaaataataaagatctaa

SEQ ID NO: 6802 - DNA, 24 bp, Artificial sequence
  SiRNA target sequence
taagacaaataataaagatctaat

SEQ ID NO: 6803 - DNA, 24 bp, Artificial sequence
  SiRNA target sequence
aagacaaataataaagatctaata

SEQ ID NO: 6804 - DNA, 24 bp, Artificial sequence
  SiRNA target sequence
agacaaataataaagatctaataa

SEQ ID NO: 6805 - DNA, 24 bp, Artificial sequence
  SiRNA target sequence
gacaaataataaagatctaataaa

SEQ ID NO: 6806 - DNA, 24 bp, Artificial sequence
  SiRNA target sequence
acaaataataaagatctaataaaa

SEQ ID NO: 6807 - DNA, 24 bp, Artificial sequence
  SiRNA target sequence
caaataataaagatctaataaaaa

SEQ ID NO: 6808 - DNA, 24 bp, Artificial sequence
  SiRNA target sequence
aaataataaagatctaataaaaat

SEQ ID NO: 6809 - DNA, 24 bp, Artificial sequence
  SiRNA target sequence
aataataaagatctaataaaaata

SEQ ID NO: 6810 - DNA, 24 bp, Artificial sequence
  SiRNA target sequence
ataataaagatctaataaaaataa

SEQ ID NO: 6811 - DNA, 24 bp, Artificial sequence
  SiRNA target sequence
taataaagatctaataaaaataag

SEQ ID NO: 6812 - DNA, 24 bp, Artificial sequence
  SiRNA target sequence
aataaagatctaataaaaataaga

SEQ ID NO: 6813 - DNA, 24 bp, Artificial sequence
  SiRNA target sequence
ataaagatctaataaaaataagat

SEQ ID NO: 6814 - DNA, 24 bp, Artificial sequence
  SiRNA target sequence
taaagatctaataaaaataagatc

SEQ ID NO: 6815 - DNA, 24 bp, Artificial sequence
  SiRNA target sequence
aaagatctaataaaaataagatct

SEQ ID NO: 6816 - DNA, 24 bp, Artificial sequence
  SiRNA target sequence
aagatctaataaaaataagatctg

SEQ ID NO: 6817 - DNA, 24 bp, Artificial sequence
  SiRNA target sequence
agatctaataaaaataagatctga

SEQ ID NO: 6818 - DNA, 24 bp, Artificial sequence
  SiRNA target sequence
gatctaataaaaataagatctgaa

SEQ ID NO: 6819 - DNA, 24 bp, Artificial sequence
  SiRNA target sequence
atctaataaaaataagatctgaat

SEQ ID NO: 6820 - DNA, 24 bp, Artificial sequence
  SiRNA target sequence
tctaataaaaataagatctgaatg

SEQ ID NO: 6821 - DNA, 24 bp, Artificial sequence
  SiRNA target sequence
ctaataaaaataagatctgaatgt

SEQ ID NO: 6822 - DNA, 24 bp, Artificial sequence
  SiRNA target sequence
taataaaaataagatctgaatgtt

SEQ ID NO: 6823 - DNA, 24 bp, Artificial sequence
  SiRNA target sequence
aataaaaataagatctgaatgtta

SEQ ID NO: 6824 - DNA, 24 bp, Artificial sequence
  SiRNA target sequence
ataaaaataagatctgaatgttac

SEQ ID NO: 6825 - DNA, 24 bp, Artificial sequence
  SiRNA target sequence
taaaaataagatctgaatgttaca

SEQ ID NO: 6826 - DNA, 24 bp, Artificial sequence
  SiRNA target sequence
aaaaataagatctgaatgttacaa

SEQ ID NO: 6827 - DNA, 24 bp, Artificial sequence
  SiRNA target sequence
aaaataagatctgaatgttacaag

SEQ ID NO: 6828 - DNA, 24 bp, Artificial sequence
  SiRNA target sequence
aaataagatctgaatgttacaagc

SEQ ID NO: 6829 - DNA, 24 bp, Artificial sequence
  SiRNA target sequence
aataagatctgaatgttacaagca

SEQ ID NO: 6830 - DNA, 24 bp, Artificial sequence
  SiRNA target sequence
ataagatctgaatgttacaagcag

SEQ ID NO: 6831 - DNA, 24 bp, Artificial sequence
  SiRNA target sequence
taagatctgaatgttacaagcaga

SEQ ID NO: 6832 - DNA, 24 bp, Artificial sequence
  SiRNA target sequence
aagatctgaatgttacaagcagat

SEQ ID NO: 6833 - DNA, 24 bp, Artificial sequence
  SiRNA target sequence
agatctgaatgttacaagcagatg

SEQ ID NO: 6834 - DNA, 24 bp, Artificial sequence
  SiRNA target sequence
gatctgaatgttacaagcagatgg

SEQ ID NO: 6835 - DNA, 24 bp, Artificial sequence
  SiRNA target sequence
atctgaatgttacaagcagatggg

SEQ ID NO: 6836 - DNA, 24 bp, Artificial sequence
  SiRNA target sequence
tctgaatgttacaagcagatggga

SEQ ID NO: 6837 - DNA, 24 bp, Artificial sequence
  SiRNA target sequence
ctgaatgttacaagcagatgggaa

SEQ ID NO: 6838 - DNA, 24 bp, Artificial sequence
  SiRNA target sequence
tgaatgttacaagcagatgggaaa

SEQ ID NO: 6839 - DNA, 24 bp, Artificial sequence
  SiRNA target sequence
gaatgttacaagcagatgggaaat

SEQ ID NO: 6840 - DNA, 24 bp, Artificial sequence
  SiRNA target sequence
aatgttacaagcagatgggaaata

SEQ ID NO: 6841 - DNA, 24 bp, Artificial sequence
  SiRNA target sequence
atgttacaagcagatgggaaataa

SEQ ID NO: 6842 - DNA, 24 bp, Artificial sequence
  SiRNA target sequence
tgttacaagcagatgggaaataaa

SEQ ID NO: 6843 - DNA, 24 bp, Artificial sequence
  SiRNA target sequence
gttacaagcagatgggaaataaaa

SEQ ID NO: 6844 - DNA, 24 bp, Artificial sequence
  SiRNA target sequence
ttacaagcagatgggaaataaaaa

SEQ ID NO: 6845 - DNA, 24 bp, Artificial sequence
  SiRNA target sequence
tacaagcagatgggaaataaaaaa

SEQ ID NO: 6846 - DNA, 24 bp, Artificial sequence
  SiRNA target sequence
acaagcagatgggaaataaaaaaa

SEQ ID NO: 6847 - DNA, 24 bp, Artificial sequence
  SiRNA target sequence
caagcagatgggaaataaaaaaaa

SEQ ID NO: 6848 - DNA, 24 bp, Artificial sequence
  SiRNA target sequence
aagcagatgggaaataaaaaaaaa

SEQ ID NO: 6849 - DNA, 24 bp, Artificial sequence
  SiRNA target sequence
agcagatgggaaataaaaaaaaat

SEQ ID NO: 6850 - DNA, 24 bp, Artificial sequence
  SiRNA target sequence
gcagatgggaaataaaaaaaaatt

SEQ ID NO: 6851 - DNA, 24 bp, Artificial sequence
  SiRNA target sequence
cagatgggaaataaaaaaaaattt

SEQ ID NO: 6852 - DNA, 24 bp, Artificial sequence
  SiRNA target sequence
agatgggaaataaaaaaaaatttc

SEQ ID NO: 6853 - DNA, 24 bp, Artificial sequence
  SiRNA target sequence
gatgggaaataaaaaaaaatttct

SEQ ID NO: 6854 - DNA, 24 bp, Artificial sequence
  SiRNA target sequence
atgggaaataaaaaaaaatttctt

SEQ ID NO: 6855 - DNA, 24 bp, Artificial sequence
  SiRNA target sequence
tgggaaataaaaaaaaatttctta

SEQ ID NO: 6856 - DNA, 24 bp, Artificial sequence
  SiRNA target sequence
gggaaataaaaaaaaatttcttaa

SEQ ID NO: 6857 - DNA, 24 bp, Artificial sequence
  SiRNA target sequence
ggaaataaaaaaaaatttcttaag

SEQ ID NO: 6858 - DNA, 24 bp, Artificial sequence
  SiRNA target sequence
gaaataaaaaaaaatttcttaagg

SEQ ID NO: 6859 - DNA, 24 bp, Artificial sequence
  SiRNA target sequence
aaataaaaaaaaatttcttaagga

SEQ ID NO: 6860 - DNA, 24 bp, Artificial sequence
  SiRNA target sequence
aataaaaaaaaatttcttaaggat

SEQ ID NO: 6861 - DNA, 24 bp, Artificial sequence
  SiRNA target sequence
ataaaaaaaaatttcttaaggatt

SEQ ID NO: 6862 - DNA, 24 bp, Artificial sequence
  SiRNA target sequence
taaaaaaaaatttcttaaggattt

SEQ ID NO: 6863 - DNA, 24 bp, Artificial sequence
  SiRNA target sequence
aaaaaaaaatttcttaaggattta

SEQ ID NO: 6864 - DNA, 24 bp, Artificial sequence
  SiRNA target sequence
aaaaaaaatttcttaaggatttag

SEQ ID NO: 6865 - DNA, 24 bp, Artificial sequence
  SiRNA target sequence
aaaaaaatttcttaaggatttagc

SEQ ID NO: 6866 - DNA, 24 bp, Artificial sequence
  SiRNA target sequence
aaaaaatttcttaaggatttagca

SEQ ID NO: 6867 - DNA, 24 bp, Artificial sequence
  SiRNA target sequence
aaaaatttcttaaggatttagcac

SEQ ID NO: 6868 - DNA, 24 bp, Artificial sequence
  SiRNA target sequence
aaaatttcttaaggatttagcact

SEQ ID NO: 6869 - DNA, 24 bp, Artificial sequence
  SiRNA target sequence
aaatttcttaaggatttagcactt

SEQ ID NO: 6870 - DNA, 24 bp, Artificial sequence
  SiRNA target sequence
aatttcttaaggatttagcacttt

SEQ ID NO: 6871 - DNA, 24 bp, Artificial sequence
  SiRNA target sequence
atttcttaaggatttagcacttta

SEQ ID NO: 6872 - DNA, 24 bp, Artificial sequence
  SiRNA target sequence
tttcttaaggatttagcactttat

SEQ ID NO: 6873 - DNA, 24 bp, Artificial sequence
  SiRNA target sequence
ttcttaaggatttagcactttatg

SEQ ID NO: 6874 - DNA, 24 bp, Artificial sequence
  SiRNA target sequence
tcttaaggatttagcactttatga

SEQ ID NO: 6875 - DNA, 24 bp, Artificial sequence
  SiRNA target sequence
cttaaggatttagcactttatgaa

SEQ ID NO: 6876 - DNA, 24 bp, Artificial sequence
  SiRNA target sequence
ttaaggatttagcactttatgaaa

SEQ ID NO: 6877 - DNA, 24 bp, Artificial sequence
  SiRNA target sequence
taaggatttagcactttatgaaac

SEQ ID NO: 6878 - DNA, 24 bp, Artificial sequence
  SiRNA target sequence
aaggatttagcactttatgaaaca

SEQ ID NO: 6879 - DNA, 24 bp, Artificial sequence
  SiRNA target sequence
aggatttagcactttatgaaacat

SEQ ID NO: 6880 - DNA, 24 bp, Artificial sequence
  SiRNA target sequence
ggatttagcactttatgaaacatt

SEQ ID NO: 6881 - DNA, 24 bp, Artificial sequence
  SiRNA target sequence
gatttagcactttatgaaacattt

SEQ ID NO: 6882 - DNA, 24 bp, Artificial sequence
  SiRNA target sequence
atttagcactttatgaaacatttg

SEQ ID NO: 6883 - DNA, 24 bp, Artificial sequence
  SiRNA target sequence
tttagcactttatgaaacatttgc

SEQ ID NO: 6884 - DNA, 24 bp, Artificial sequence
  SiRNA target sequence
ttagcactttatgaaacatttgct

SEQ ID NO: 6885 - DNA, 24 bp, Artificial sequence
  SiRNA target sequence
tagcactttatgaaacatttgcta

SEQ ID NO: 6886 - DNA, 24 bp, Artificial sequence
  SiRNA target sequence
agcactttatgaaacatttgctaa

SEQ ID NO: 6887 - DNA, 24 bp, Artificial sequence
  SiRNA target sequence
gcactttatgaaacatttgctaat

SEQ ID NO: 6888 - DNA, 24 bp, Artificial sequence
  SiRNA target sequence
cactttatgaaacatttgctaata

SEQ ID NO: 6889 - DNA, 24 bp, Artificial sequence
  SiRNA target sequence
actttatgaaacatttgctaataa

SEQ ID NO: 6890 - DNA, 24 bp, Artificial sequence
  SiRNA target sequence
ctttatgaaacatttgctaataat

SEQ ID NO: 6891 - DNA, 24 bp, Artificial sequence
  SiRNA target sequence
tttatgaaacatttgctaataata

SEQ ID NO: 6892 - DNA, 24 bp, Artificial sequence
  SiRNA target sequence
ttatgaaacatttgctaataataa

SEQ ID NO: 6893 - DNA, 24 bp, Artificial sequence
  SiRNA target sequence
tatgaaacatttgctaataataaa

SEQ ID NO: 6894 - DNA, 24 bp, Artificial sequence
  SiRNA target sequence
atgaaacatttgctaataataaag

SEQ ID NO: 6895 - DNA, 24 bp, Artificial sequence
  SiRNA target sequence
tgaaacatttgctaataataaaga

SEQ ID NO: 6896 - DNA, 24 bp, Artificial sequence
  SiRNA target sequence
gaaacatttgctaataataaagaa

SEQ ID NO: 6897 - DNA, 24 bp, Artificial sequence
  SiRNA target sequence
aaacatttgctaataataaagaag

SEQ ID NO: 6898 - DNA, 24 bp, Artificial sequence
  SiRNA target sequence
aacatttgctaataataaagaagt

SEQ ID NO: 6899 - DNA, 24 bp, Artificial sequence
  SiRNA target sequence
acatttgctaataataaagaagtc

SEQ ID NO: 6900 - DNA, 24 bp, Artificial sequence
  SiRNA target sequence
catttgctaataataaagaagtcc

SEQ ID NO: 6901 - DNA, 24 bp, Artificial sequence
  SiRNA target sequence
atttgctaataataaagaagtcca

SEQ ID NO: 6902 - DNA, 24 bp, Artificial sequence
  SiRNA target sequence
tttgctaataataaagaagtccaa

SEQ ID NO: 6903 - DNA, 24 bp, Artificial sequence
  SiRNA target sequence
ttgctaataataaagaagtccaag

SEQ ID NO: 6904 - DNA, 24 bp, Artificial sequence
  SiRNA target sequence
tgctaataataaagaagtccaaga

SEQ ID NO: 6905 - DNA, 24 bp, Artificial sequence
  SiRNA target sequence
gctaataataaagaagtccaagat

SEQ ID NO: 6906 - DNA, 24 bp, Artificial sequence
  SiRNA target sequence
ctaataataaagaagtccaagatg

SEQ ID NO: 6907 - DNA, 24 bp, Artificial sequence
  SiRNA target sequence
taataataaagaagtccaagatga

SEQ ID NO: 6908 - DNA, 24 bp, Artificial sequence
  SiRNA target sequence
aataataaagaagtccaagatgaa

SEQ ID NO: 6909 - DNA, 24 bp, Artificial sequence
  SiRNA target sequence
ataataaagaagtccaagatgaaa

SEQ ID NO: 6910 - DNA, 24 bp, Artificial sequence
  SiRNA target sequence
taataaagaagtccaagatgaaat

SEQ ID NO: 6911 - DNA, 24 bp, Artificial sequence
  SiRNA target sequence
aataaagaagtccaagatgaaatt

SEQ ID NO: 6912 - DNA, 24 bp, Artificial sequence
  SiRNA target sequence
ataaagaagtccaagatgaaatta

SEQ ID NO: 6913 - DNA, 24 bp, Artificial sequence
  SiRNA target sequence
taaagaagtccaagatgaaattat

SEQ ID NO: 6914 - DNA, 24 bp, Artificial sequence
  SiRNA target sequence
aaagaagtccaagatgaaattatg

SEQ ID NO: 6915 - DNA, 24 bp, Artificial sequence
  SiRNA target sequence
aagaagtccaagatgaaattatgc

SEQ ID NO: 6916 - DNA, 24 bp, Artificial sequence
  SiRNA target sequence
agaagtccaagatgaaattatgca

SEQ ID NO: 6917 - DNA, 24 bp, Artificial sequence
  SiRNA target sequence
gaagtccaagatgaaattatgcag

SEQ ID NO: 6918 - DNA, 24 bp, Artificial sequence
  SiRNA target sequence
aagtccaagatgaaattatgcaga

SEQ ID NO: 6919 - DNA, 24 bp, Artificial sequence
  SiRNA target sequence
agtccaagatgaaattatgcagac

SEQ ID NO: 6920 - DNA, 24 bp, Artificial sequence
  SiRNA target sequence
gtccaagatgaaattatgcagact

SEQ ID NO: 6921 - DNA, 24 bp, Artificial sequence
  SiRNA target sequence
tccaagatgaaattatgcagactg

SEQ ID NO: 6922 - DNA, 24 bp, Artificial sequence
  SiRNA target sequence
ccaagatgaaattatgcagactgt

SEQ ID NO: 6923 - DNA, 24 bp, Artificial sequence
  SiRNA target sequence
caagatgaaattatgcagactgtt

SEQ ID NO: 6924 - DNA, 24 bp, Artificial sequence
  SiRNA target sequence
aagatgaaattatgcagactgtta

SEQ ID NO: 6925 - DNA, 24 bp, Artificial sequence
  SiRNA target sequence
agatgaaattatgcagactgttaa

SEQ ID NO: 6926 - DNA, 24 bp, Artificial sequence
  SiRNA target sequence
gatgaaattatgcagactgttaaa

SEQ ID NO: 6927 - DNA, 24 bp, Artificial sequence
  SiRNA target sequence
atgaaattatgcagactgttaaag

SEQ ID NO: 6928 - DNA, 24 bp, Artificial sequence
  SiRNA target sequence
tgaaattatgcagactgttaaaga

SEQ ID NO: 6929 - DNA, 24 bp, Artificial sequence
  SiRNA target sequence
gaaattatgcagactgttaaagaa

SEQ ID NO: 6930 - DNA, 24 bp, Artificial sequence
  SiRNA target sequence
aaattatgcagactgttaaagaaa

SEQ ID NO: 6931 - DNA, 24 bp, Artificial sequence
  SiRNA target sequence
aattatgcagactgttaaagaaat

SEQ ID NO: 6932 - DNA, 24 bp, Artificial sequence
  SiRNA target sequence
attatgcagactgttaaagaaatt

SEQ ID NO: 6933 - DNA, 24 bp, Artificial sequence
  SiRNA target sequence
ttatgcagactgttaaagaaattt

SEQ ID NO: 6934 - DNA, 24 bp, Artificial sequence
  SiRNA target sequence
tatgcagactgttaaagaaatttg

SEQ ID NO: 6935 - DNA, 24 bp, Artificial sequence
  SiRNA target sequence
atgcagactgttaaagaaatttgt

SEQ ID NO: 6936 - DNA, 24 bp, Artificial sequence
  SiRNA target sequence
tgcagactgttaaagaaatttgtg

SEQ ID NO: 6937 - DNA, 24 bp, Artificial sequence
  SiRNA target sequence
gcagactgttaaagaaatttgtga

SEQ ID NO: 6938 - DNA, 24 bp, Artificial sequence
  SiRNA target sequence
cagactgttaaagaaatttgtgaa

SEQ ID NO: 6939 - DNA, 24 bp, Artificial sequence
  SiRNA target sequence
agactgttaaagaaatttgtgaag

SEQ ID NO: 6940 - DNA, 24 bp, Artificial sequence
  SiRNA target sequence
gactgttaaagaaatttgtgaaga

SEQ ID NO: 6941 - DNA, 24 bp, Artificial sequence
  SiRNA target sequence
actgttaaagaaatttgtgaagaa

SEQ ID NO: 6942 - DNA, 24 bp, Artificial sequence
  SiRNA target sequence
ctgttaaagaaatttgtgaagaag

SEQ ID NO: 6943 - DNA, 24 bp, Artificial sequence
  SiRNA target sequence
tgttaaagaaatttgtgaagaaga

SEQ ID NO: 6944 - DNA, 24 bp, Artificial sequence
  SiRNA target sequence
gttaaagaaatttgtgaagaagaa

SEQ ID NO: 6945 - DNA, 24 bp, Artificial sequence
  SiRNA target sequence
ttaaagaaatttgtgaagaagaag

SEQ ID NO: 6946 - DNA, 24 bp, Artificial sequence
  SiRNA target sequence
taaagaaatttgtgaagaagaagt

SEQ ID NO: 6947 - DNA, 24 bp, Artificial sequence
  SiRNA target sequence
aaagaaatttgtgaagaagaagtg

SEQ ID NO: 6948 - DNA, 24 bp, Artificial sequence
  SiRNA target sequence
aagaaatttgtgaagaagaagtga

SEQ ID NO: 6949 - DNA, 24 bp, Artificial sequence
  SiRNA target sequence
agaaatttgtgaagaagaagtgaa

SEQ ID NO: 6950 - DNA, 24 bp, Artificial sequence
  SiRNA target sequence
gaaatttgtgaagaagaagtgaat

SEQ ID NO: 6951 - DNA, 24 bp, Artificial sequence
  SiRNA target sequence
aaatttgtgaagaagaagtgaatg

SEQ ID NO: 6952 - DNA, 24 bp, Artificial sequence
  SiRNA target sequence
aatttgtgaagaagaagtgaatga

SEQ ID NO: 6953 - DNA, 24 bp, Artificial sequence
  SiRNA target sequence
atttgtgaagaagaagtgaatgag

SEQ ID NO: 6954 - DNA, 24 bp, Artificial sequence
  SiRNA target sequence
tttgtgaagaagaagtgaatgagt

SEQ ID NO: 6955 - DNA, 24 bp, Artificial sequence
  SiRNA target sequence
ttgtgaagaagaagtgaatgagtt

SEQ ID NO: 6956 - DNA, 24 bp, Artificial sequence
  SiRNA target sequence
tgtgaagaagaagtgaatgagttt

SEQ ID NO: 6957 - DNA, 24 bp, Artificial sequence
  SiRNA target sequence
gtgaagaagaagtgaatgagttta

SEQ ID NO: 6958 - DNA, 24 bp, Artificial sequence
  SiRNA target sequence
tgaagaagaagtgaatgagtttat

SEQ ID NO: 6959 - DNA, 24 bp, Artificial sequence
  SiRNA target sequence
gaagaagaagtgaatgagtttatt

SEQ ID NO: 6960 - DNA, 24 bp, Artificial sequence
  SiRNA target sequence
aagaagaagtgaatgagtttattg

SEQ ID NO: 6961 - DNA, 24 bp, Artificial sequence
  SiRNA target sequence
agaagaagtgaatgagtttattga

SEQ ID NO: 6962 - DNA, 24 bp, Artificial sequence
  SiRNA target sequence
gaagaagtgaatgagtttattgaa

SEQ ID NO: 6963 - DNA, 24 bp, Artificial sequence
  SiRNA target sequence
aagaagtgaatgagtttattgaac

SEQ ID NO: 6964 - DNA, 24 bp, Artificial sequence
  SiRNA target sequence
agaagtgaatgagtttattgaaca

SEQ ID NO: 6965 - DNA, 24 bp, Artificial sequence
  SiRNA target sequence
gaagtgaatgagtttattgaacaa

SEQ ID NO: 6966 - DNA, 24 bp, Artificial sequence
  SiRNA target sequence
aagtgaatgagtttattgaacaag

SEQ ID NO: 6967 - DNA, 24 bp, Artificial sequence
  SiRNA target sequence
agtgaatgagtttattgaacaaga

SEQ ID NO: 6968 - DNA, 24 bp, Artificial sequence
  SiRNA target sequence
gtgaatgagtttattgaacaagaa

SEQ ID NO: 6969 - DNA, 24 bp, Artificial sequence
  SiRNA target sequence
tgaatgagtttattgaacaagaag

SEQ ID NO: 6970 - DNA, 24 bp, Artificial sequence
  SiRNA target sequence
gaatgagtttattgaacaagaagg

SEQ ID NO: 6971 - DNA, 24 bp, Artificial sequence
  SiRNA target sequence
aatgagtttattgaacaagaaggt

SEQ ID NO: 6972 - DNA, 24 bp, Artificial sequence
  SiRNA target sequence
atgagtttattgaacaagaaggtt

SEQ ID NO: 6973 - DNA, 24 bp, Artificial sequence
  SiRNA target sequence
tgagtttattgaacaagaaggttt

SEQ ID NO: 6974 - DNA, 24 bp, Artificial sequence
  SiRNA target sequence
gagtttattgaacaagaaggttta

SEQ ID NO: 6975 - DNA, 24 bp, Artificial sequence
  SiRNA target sequence
agtttattgaacaagaaggtttaa

SEQ ID NO: 6976 - DNA, 24 bp, Artificial sequence
  SiRNA target sequence
gtttattgaacaagaaggtttaaa

SEQ ID NO: 6977 - DNA, 24 bp, Artificial sequence
  SiRNA target sequence
tttattgaacaagaaggtttaaaa

SEQ ID NO: 6978 - DNA, 24 bp, Artificial sequence
  SiRNA target sequence
ttattgaacaagaaggtttaaaaa

SEQ ID NO: 6979 - DNA, 24 bp, Artificial sequence
  SiRNA target sequence
tattgaacaagaaggtttaaaaat

SEQ ID NO: 6980 - DNA, 24 bp, Artificial sequence
  SiRNA target sequence
attgaacaagaaggtttaaaaatt

SEQ ID NO: 6981 - DNA, 24 bp, Artificial sequence
  SiRNA target sequence
ttgaacaagaaggtttaaaaatta

SEQ ID NO: 6982 - DNA, 24 bp, Artificial sequence
  SiRNA target sequence
tgaacaagaaggtttaaaaattaa

SEQ ID NO: 6983 - DNA, 24 bp, Artificial sequence
  SiRNA target sequence
gaacaagaaggtttaaaaattaat

SEQ ID NO: 6984 - DNA, 24 bp, Artificial sequence
  SiRNA target sequence
aacaagaaggtttaaaaattaata

SEQ ID NO: 6985 - DNA, 24 bp, Artificial sequence
  SiRNA target sequence
acaagaaggtttaaaaattaataa

SEQ ID NO: 6986 - DNA, 24 bp, Artificial sequence
  SiRNA target sequence
caagaaggtttaaaaattaataaa

SEQ ID NO: 6987 - DNA, 24 bp, Artificial sequence
  SiRNA target sequence
aagaaggtttaaaaattaataaag

SEQ ID NO: 6988 - DNA, 24 bp, Artificial sequence
  SiRNA target sequence
agaaggtttaaaaattaataaaga

SEQ ID NO: 6989 - DNA, 24 bp, Artificial sequence
  SiRNA target sequence
gaaggtttaaaaattaataaagaa

SEQ ID NO: 6990 - DNA, 24 bp, Artificial sequence
  SiRNA target sequence
aaggtttaaaaattaataaagaag

SEQ ID NO: 6991 - DNA, 24 bp, Artificial sequence
  SiRNA target sequence
aggtttaaaaattaataaagaaga

SEQ ID NO: 6992 - DNA, 24 bp, Artificial sequence
  SiRNA target sequence
ggtttaaaaattaataaagaagat

SEQ ID NO: 6993 - DNA, 24 bp, Artificial sequence
  SiRNA target sequence
gtttaaaaattaataaagaagatg

SEQ ID NO: 6994 - DNA, 24 bp, Artificial sequence
  SiRNA target sequence
tttaaaaattaataaagaagatgt

SEQ ID NO: 6995 - DNA, 24 bp, Artificial sequence
  SiRNA target sequence
ttaaaaattaataaagaagatgtg

SEQ ID NO: 6996 - DNA, 24 bp, Artificial sequence
  SiRNA target sequence
taaaaattaataaagaagatgtgc

SEQ ID NO: 6997 - DNA, 24 bp, Artificial sequence
  SiRNA target sequence
aaaaattaataaagaagatgtgct

SEQ ID NO: 6998 - DNA, 24 bp, Artificial sequence
  SiRNA target sequence
aaaattaataaagaagatgtgcta

SEQ ID NO: 6999 - DNA, 24 bp, Artificial sequence
  SiRNA target sequence
aaattaataaagaagatgtgctaa

SEQ ID NO: 7000 - DNA, 24 bp, Artificial sequence
  SiRNA target sequence
aattaataaagaagatgtgctaag

SEQ ID NO: 7001 - DNA, 24 bp, Artificial sequence
  SiRNA target sequence
attaataaagaagatgtgctaaga

SEQ ID NO: 7002 - DNA, 24 bp, Artificial sequence
  SiRNA target sequence
ttaataaagaagatgtgctaagag

SEQ ID NO: 7003 - DNA, 24 bp, Artificial sequence
  SiRNA target sequence
taataaagaagatgtgctaagagg

SEQ ID NO: 7004 - DNA, 24 bp, Artificial sequence
  SiRNA target sequence
aataaagaagatgtgctaagagga

SEQ ID NO: 7005 - DNA, 24 bp, Artificial sequence
  SiRNA target sequence
ataaagaagatgtgctaagaggac

SEQ ID NO: 7006 - DNA, 24 bp, Artificial sequence
  SiRNA target sequence
taaagaagatgtgctaagaggact

SEQ ID NO: 7007 - DNA, 24 bp, Artificial sequence
  SiRNA target sequence
aaagaagatgtgctaagaggactt

SEQ ID NO: 7008 - DNA, 24 bp, Artificial sequence
  SiRNA target sequence
aagaagatgtgctaagaggacttg

SEQ ID NO: 7009 - DNA, 24 bp, Artificial sequence
  SiRNA target sequence
agaagatgtgctaagaggacttgt

SEQ ID NO: 7010 - DNA, 24 bp, Artificial sequence
  SiRNA target sequence
gaagatgtgctaagaggacttgtt

SEQ ID NO: 7011 - DNA, 24 bp, Artificial sequence
  SiRNA target sequence
aagatgtgctaagaggacttgttt

SEQ ID NO: 7012 - DNA, 24 bp, Artificial sequence
  SiRNA target sequence
agatgtgctaagaggacttgtttc

SEQ ID NO: 7013 - DNA, 24 bp, Artificial sequence
  SiRNA target sequence
gatgtgctaagaggacttgtttca

SEQ ID NO: 7014 - DNA, 24 bp, Artificial sequence
  SiRNA target sequence
atgtgctaagaggacttgtttcaa

SEQ ID NO: 7015 - DNA, 24 bp, Artificial sequence
  SiRNA target sequence
tgtgctaagaggacttgtttcaat

SEQ ID NO: 7016 - DNA, 24 bp, Artificial sequence
  SiRNA target sequence
gtgctaagaggacttgtttcaata

SEQ ID NO: 7017 - DNA, 24 bp, Artificial sequence
  SiRNA target sequence
tgctaagaggacttgtttcaataa

SEQ ID NO: 7018 - DNA, 24 bp, Artificial sequence
  SiRNA target sequence
gctaagaggacttgtttcaataaa

SEQ ID NO: 7019 - DNA, 24 bp, Artificial sequence
  SiRNA target sequence
ctaagaggacttgtttcaataaaa

SEQ ID NO: 7020 - DNA, 24 bp, Artificial sequence
  SiRNA target sequence
taagaggacttgtttcaataaaaa

SEQ ID NO: 7021 - DNA, 24 bp, Artificial sequence
  SiRNA target sequence
aagaggacttgtttcaataaaaaa

SEQ ID NO: 7022 - DNA, 24 bp, Artificial sequence
  SiRNA target sequence
agaggacttgtttcaataaaaaat

SEQ ID NO: 7023 - DNA, 24 bp, Artificial sequence
  SiRNA target sequence
gaggacttgtttcaataaaaaata

SEQ ID NO: 7024 - DNA, 24 bp, Artificial sequence
  SiRNA target sequence
aggacttgtttcaataaaaaatat

SEQ ID NO: 7025 - DNA, 24 bp, Artificial sequence
  SiRNA target sequence
ggacttgtttcaataaaaaatata

SEQ ID NO: 7026 - DNA, 24 bp, Artificial sequence
  SiRNA target sequence
gacttgtttcaataaaaaatataa

SEQ ID NO: 7027 - DNA, 24 bp, Artificial sequence
  SiRNA target sequence
acttgtttcaataaaaaatataaa

SEQ ID NO: 7028 - DNA, 24 bp, Artificial sequence
  SiRNA target sequence
cttgtttcaataaaaaatataaat

SEQ ID NO: 7029 - DNA, 24 bp, Artificial sequence
  SiRNA target sequence
ttgtttcaataaaaaatataaatg

SEQ ID NO: 7030 - DNA, 24 bp, Artificial sequence
  SiRNA target sequence
tgtttcaataaaaaatataaatga

SEQ ID NO: 7031 - DNA, 24 bp, Artificial sequence
  SiRNA target sequence
gtttcaataaaaaatataaatgag

SEQ ID NO: 7032 - DNA, 24 bp, Artificial sequence
  SiRNA target sequence
tttcaataaaaaatataaatgaga

SEQ ID NO: 7033 - DNA, 24 bp, Artificial sequence
  SiRNA target sequence
ttcaataaaaaatataaatgagat

SEQ ID NO: 7034 - DNA, 24 bp, Artificial sequence
  SiRNA target sequence
tcaataaaaaatataaatgagatt

SEQ ID NO: 7035 - DNA, 24 bp, Artificial sequence
  SiRNA target sequence
caataaaaaatataaatgagattt

SEQ ID NO: 7036 - DNA, 24 bp, Artificial sequence
  SiRNA target sequence
aataaaaaatataaatgagattta

SEQ ID NO: 7037 - DNA, 24 bp, Artificial sequence
  SiRNA target sequence
ataaaaaatataaatgagatttat

SEQ ID NO: 7038 - DNA, 24 bp, Artificial sequence
  SiRNA target sequence
taaaaaatataaatgagatttatg

SEQ ID NO: 7039 - DNA, 24 bp, Artificial sequence
  SiRNA target sequence
aaaaaatataaatgagatttatga

SEQ ID NO: 7040 - DNA, 24 bp, Artificial sequence
  SiRNA target sequence
aaaaatataaatgagatttatgat

SEQ ID NO: 7041 - DNA, 24 bp, Artificial sequence
  SiRNA target sequence
aaaatataaatgagatttatgatg

SEQ ID NO: 7042 - DNA, 24 bp, Artificial sequence
  SiRNA target sequence
aaatataaatgagatttatgatgc

SEQ ID NO: 7043 - DNA, 24 bp, Artificial sequence
  SiRNA target sequence
aatataaatgagatttatgatgca

SEQ ID NO: 7044 - DNA, 24 bp, Artificial sequence
  SiRNA target sequence
atataaatgagatttatgatgcat

SEQ ID NO: 7045 - DNA, 24 bp, Artificial sequence
  SiRNA target sequence
tataaatgagatttatgatgcatt

SEQ ID NO: 7046 - DNA, 24 bp, Artificial sequence
  SiRNA target sequence
ataaatgagatttatgatgcattt

SEQ ID NO: 7047 - DNA, 24 bp, Artificial sequence
  SiRNA target sequence
taaatgagatttatgatgcatttg

SEQ ID NO: 7048 - DNA, 24 bp, Artificial sequence
  SiRNA target sequence
aaatgagatttatgatgcatttgg

SEQ ID NO: 7049 - DNA, 24 bp, Artificial sequence
  SiRNA target sequence
aatgagatttatgatgcatttgga

SEQ ID NO: 7050 - DNA, 24 bp, Artificial sequence
  SiRNA target sequence
atgagatttatgatgcatttggag

SEQ ID NO: 7051 - DNA, 24 bp, Artificial sequence
  SiRNA target sequence
tgagatttatgatgcatttggagg

SEQ ID NO: 7052 - DNA, 24 bp, Artificial sequence
  SiRNA target sequence
gagatttatgatgcatttggaggt

SEQ ID NO: 7053 - DNA, 24 bp, Artificial sequence
  SiRNA target sequence
agatttatgatgcatttggaggta

SEQ ID NO: 7054 - DNA, 24 bp, Artificial sequence
  SiRNA target sequence
gatttatgatgcatttggaggtaa

SEQ ID NO: 7055 - DNA, 24 bp, Artificial sequence
  SiRNA target sequence
atttatgatgcatttggaggtaaa

SEQ ID NO: 7056 - DNA, 24 bp, Artificial sequence
  SiRNA target sequence
tttatgatgcatttggaggtaaat

SEQ ID NO: 7057 - DNA, 24 bp, Artificial sequence
  SiRNA target sequence
ttatgatgcatttggaggtaaatc

SEQ ID NO: 7058 - DNA, 24 bp, Artificial sequence
  SiRNA target sequence
tatgatgcatttggaggtaaatct

SEQ ID NO: 7059 - DNA, 24 bp, Artificial sequence
  SiRNA target sequence
atgatgcatttggaggtaaatcta

SEQ ID NO: 7060 - DNA, 24 bp, Artificial sequence
  SiRNA target sequence
tgatgcatttggaggtaaatctaa

SEQ ID NO: 7061 - DNA, 24 bp, Artificial sequence
  SiRNA target sequence
gatgcatttggaggtaaatctaag

SEQ ID NO: 7062 - DNA, 24 bp, Artificial sequence
  SiRNA target sequence
atgcatttggaggtaaatctaaga

SEQ ID NO: 7063 - DNA, 24 bp, Artificial sequence
  SiRNA target sequence
tgcatttggaggtaaatctaagaa

SEQ ID NO: 7064 - DNA, 24 bp, Artificial sequence
  SiRNA target sequence
gcatttggaggtaaatctaagaag

SEQ ID NO: 7065 - DNA, 24 bp, Artificial sequence
  SiRNA target sequence
catttggaggtaaatctaagaagt

SEQ ID NO: 7066 - DNA, 24 bp, Artificial sequence
  SiRNA target sequence
atttggaggtaaatctaagaagtt

SEQ ID NO: 7067 - DNA, 24 bp, Artificial sequence
  SiRNA target sequence
tttggaggtaaatctaagaagttt

SEQ ID NO: 7068 - DNA, 24 bp, Artificial sequence
  SiRNA target sequence
ttggaggtaaatctaagaagttta

SEQ ID NO: 7069 - DNA, 24 bp, Artificial sequence
  SiRNA target sequence
tggaggtaaatctaagaagtttaa

SEQ ID NO: 7070 - DNA, 24 bp, Artificial sequence
  SiRNA target sequence
ggaggtaaatctaagaagtttaaa

SEQ ID NO: 7071 - DNA, 24 bp, Artificial sequence
  SiRNA target sequence
gaggtaaatctaagaagtttaaat

SEQ ID NO: 7072 - DNA, 24 bp, Artificial sequence
  SiRNA target sequence
aggtaaatctaagaagtttaaatt

SEQ ID NO: 7073 - DNA, 24 bp, Artificial sequence
  SiRNA target sequence
ggtaaatctaagaagtttaaattt

SEQ ID NO: 7074 - DNA, 24 bp, Artificial sequence
  SiRNA target sequence
gtaaatctaagaagtttaaatttt

SEQ ID NO: 7075 - DNA, 24 bp, Artificial sequence
  SiRNA target sequence
taaatctaagaagtttaaattttc

SEQ ID NO: 7076 - DNA, 24 bp, Artificial sequence
  SiRNA target sequence
aaatctaagaagtttaaattttct

SEQ ID NO: 7077 - DNA, 24 bp, Artificial sequence
  SiRNA target sequence
aatctaagaagtttaaattttcta

SEQ ID NO: 7078 - DNA, 24 bp, Artificial sequence
  SiRNA target sequence
atctaagaagtttaaattttctaa

SEQ ID NO: 7079 - DNA, 24 bp, Artificial sequence
  SiRNA target sequence
tctaagaagtttaaattttctaat

SEQ ID NO: 7080 - DNA, 24 bp, Artificial sequence
  SiRNA target sequence
ctaagaagtttaaattttctaatg

SEQ ID NO: 7081 - DNA, 24 bp, Artificial sequence
  SiRNA target sequence
taagaagtttaaattttctaatga

SEQ ID NO: 7082 - DNA, 24 bp, Artificial sequence
  SiRNA target sequence
aagaagtttaaattttctaatgat

SEQ ID NO: 7083 - DNA, 24 bp, Artificial sequence
  SiRNA target sequence
agaagtttaaattttctaatgatg

SEQ ID NO: 7084 - DNA, 24 bp, Artificial sequence
  SiRNA target sequence
gaagtttaaattttctaatgatga

SEQ ID NO: 7085 - DNA, 24 bp, Artificial sequence
  SiRNA target sequence
aagtttaaattttctaatgatgaa

SEQ ID NO: 7086 - DNA, 24 bp, Artificial sequence
  SiRNA target sequence
agtttaaattttctaatgatgaaa

SEQ ID NO: 7087 - DNA, 24 bp, Artificial sequence
  SiRNA target sequence
gtttaaattttctaatgatgaaaa

SEQ ID NO: 7088 - DNA, 24 bp, Artificial sequence
  SiRNA target sequence
tttaaattttctaatgatgaaaag

SEQ ID NO: 7089 - DNA, 24 bp, Artificial sequence
  SiRNA target sequence
ttaaattttctaatgatgaaaagg

SEQ ID NO: 7090 - DNA, 24 bp, Artificial sequence
  SiRNA target sequence
taaattttctaatgatgaaaagga

SEQ ID NO: 7091 - DNA, 24 bp, Artificial sequence
  SiRNA target sequence
aaattttctaatgatgaaaaggaa

SEQ ID NO: 7092 - DNA, 24 bp, Artificial sequence
  SiRNA target sequence
aattttctaatgatgaaaaggaag

SEQ ID NO: 7093 - DNA, 24 bp, Artificial sequence
  SiRNA target sequence
attttctaatgatgaaaaggaagt

SEQ ID NO: 7094 - DNA, 24 bp, Artificial sequence
  SiRNA target sequence
ttttctaatgatgaaaaggaagtg

SEQ ID NO: 7095 - DNA, 24 bp, Artificial sequence
  SiRNA target sequence
tttctaatgatgaaaaggaagtgt

SEQ ID NO: 7096 - DNA, 24 bp, Artificial sequence
  SiRNA target sequence
ttctaatgatgaaaaggaagtgtt

SEQ ID NO: 7097 - DNA, 24 bp, Artificial sequence
  SiRNA target sequence
tctaatgatgaaaaggaagtgtta

SEQ ID NO: 7098 - DNA, 24 bp, Artificial sequence
  SiRNA target sequence
ctaatgatgaaaaggaagtgttaa

SEQ ID NO: 7099 - DNA, 24 bp, Artificial sequence
  SiRNA target sequence
taatgatgaaaaggaagtgttaaa

SEQ ID NO: 7100 - DNA, 24 bp, Artificial sequence
  SiRNA target sequence
aatgatgaaaaggaagtgttaaat

SEQ ID NO: 7101 - DNA, 24 bp, Artificial sequence
  SiRNA target sequence
atgatgaaaaggaagtgttaaatc

SEQ ID NO: 7102 - DNA, 24 bp, Artificial sequence
  SiRNA target sequence
tgatgaaaaggaagtgttaaatct

SEQ ID NO: 7103 - DNA, 24 bp, Artificial sequence
  SiRNA target sequence
gatgaaaaggaagtgttaaatctt

SEQ ID NO: 7104 - DNA, 24 bp, Artificial sequence
  SiRNA target sequence
atgaaaaggaagtgttaaatcttc

SEQ ID NO: 7105 - DNA, 24 bp, Artificial sequence
  SiRNA target sequence
tgaaaaggaagtgttaaatcttct

SEQ ID NO: 7106 - DNA, 24 bp, Artificial sequence
  SiRNA target sequence
gaaaaggaagtgttaaatcttctt

SEQ ID NO: 7107 - DNA, 24 bp, Artificial sequence
  SiRNA target sequence
aaaaggaagtgttaaatcttctta

SEQ ID NO: 7108 - DNA, 24 bp, Artificial sequence
  SiRNA target sequence
aaaggaagtgttaaatcttcttaa

SEQ ID NO: 7109 - DNA, 24 bp, Artificial sequence
  SiRNA target sequence
aaggaagtgttaaatcttcttaat

SEQ ID NO: 7110 - DNA, 24 bp, Artificial sequence
  SiRNA target sequence
aggaagtgttaaatcttcttaatg

SEQ ID NO: 7111 - DNA, 24 bp, Artificial sequence
  SiRNA target sequence
ggaagtgttaaatcttcttaatgc

SEQ ID NO: 7112 - DNA, 24 bp, Artificial sequence
  SiRNA target sequence
gaagtgttaaatcttcttaatgcc

SEQ ID NO: 7113 - DNA, 24 bp, Artificial sequence
  SiRNA target sequence
aagtgttaaatcttcttaatgcca

SEQ ID NO: 7114 - DNA, 24 bp, Artificial sequence
  SiRNA target sequence
agtgttaaatcttcttaatgccat

SEQ ID NO: 7115 - DNA, 24 bp, Artificial sequence
  SiRNA target sequence
gtgttaaatcttcttaatgccatt

SEQ ID NO: 7116 - DNA, 24 bp, Artificial sequence
  SiRNA target sequence
tgttaaatcttcttaatgccatta

SEQ ID NO: 7117 - DNA, 24 bp, Artificial sequence
  SiRNA target sequence
gttaaatcttcttaatgccattat

SEQ ID NO: 7118 - DNA, 24 bp, Artificial sequence
  SiRNA target sequence
ttaaatcttcttaatgccattatt

SEQ ID NO: 7119 - DNA, 24 bp, Artificial sequence
  SiRNA target sequence
taaatcttcttaatgccattattt

SEQ ID NO: 7120 - DNA, 24 bp, Artificial sequence
  SiRNA target sequence
aaatcttcttaatgccattatttt

SEQ ID NO: 7121 - DNA, 24 bp, Artificial sequence
  SiRNA target sequence
aatcttcttaatgccattatttta

SEQ ID NO: 7122 - DNA, 24 bp, Artificial sequence
  SiRNA target sequence
atcttcttaatgccattattttac

SEQ ID NO: 7123 - DNA, 24 bp, Artificial sequence
  SiRNA target sequence
tcttcttaatgccattattttaca

SEQ ID NO: 7124 - DNA, 24 bp, Artificial sequence
  SiRNA target sequence
cttcttaatgccattattttacac

SEQ ID NO: 7125 - DNA, 24 bp, Artificial sequence
  SiRNA target sequence
ttcttaatgccattattttacacc

SEQ ID NO: 7126 - DNA, 24 bp, Artificial sequence
  SiRNA target sequence
tcttaatgccattattttacacct

SEQ ID NO: 7127 - DNA, 24 bp, Artificial sequence
  SiRNA target sequence
cttaatgccattattttacaccta

SEQ ID NO: 7128 - DNA, 24 bp, Artificial sequence
  SiRNA target sequence
ttaatgccattattttacacctaa

SEQ ID NO: 7129 - DNA, 24 bp, Artificial sequence
  SiRNA target sequence
taatgccattattttacacctaaa

SEQ ID NO: 7130 - DNA, 24 bp, Artificial sequence
  SiRNA target sequence
aatgccattattttacacctaaaa

SEQ ID NO: 7131 - DNA, 24 bp, Artificial sequence
  SiRNA target sequence
atgccattattttacacctaaaag

SEQ ID NO: 7132 - DNA, 24 bp, Artificial sequence
  SiRNA target sequence
tgccattattttacacctaaaagg

SEQ ID NO: 7133 - DNA, 24 bp, Artificial sequence
  SiRNA target sequence
gccattattttacacctaaaagga

SEQ ID NO: 7134 - DNA, 24 bp, Artificial sequence
  SiRNA target sequence
ccattattttacacctaaaaggaa

SEQ ID NO: 7135 - DNA, 24 bp, Artificial sequence
  SiRNA target sequence
cattattttacacctaaaaggaaa

SEQ ID NO: 7136 - DNA, 24 bp, Artificial sequence
  SiRNA target sequence
attattttacacctaaaaggaaaa

SEQ ID NO: 7137 - DNA, 24 bp, Artificial sequence
  SiRNA target sequence
ttattttacacctaaaaggaaaaa

SEQ ID NO: 7138 - DNA, 24 bp, Artificial sequence
  SiRNA target sequence
tattttacacctaaaaggaaaaaa

SEQ ID NO: 7139 - DNA, 24 bp, Artificial sequence
  SiRNA target sequence
attttacacctaaaaggaaaaaaa

SEQ ID NO: 7140 - DNA, 24 bp, Artificial sequence
  SiRNA target sequence
ttttacacctaaaaggaaaaaaag

SEQ ID NO: 7141 - DNA, 24 bp, Artificial sequence
  SiRNA target sequence
tttacacctaaaaggaaaaaaaga

SEQ ID NO: 7142 - DNA, 24 bp, Artificial sequence
  SiRNA target sequence
ttacacctaaaaggaaaaaaagaa

SEQ ID NO: 7143 - DNA, 24 bp, Artificial sequence
  SiRNA target sequence
tacacctaaaaggaaaaaaagaac

SEQ ID NO: 7144 - DNA, 24 bp, Artificial sequence
  SiRNA target sequence
acacctaaaaggaaaaaaagaaca

SEQ ID NO: 7145 - DNA, 24 bp, Artificial sequence
  SiRNA target sequence
cacctaaaaggaaaaaaagaacag

SEQ ID NO: 7146 - DNA, 24 bp, Artificial sequence
  SiRNA target sequence
acctaaaaggaaaaaaagaacagg

SEQ ID NO: 7147 - DNA, 24 bp, Artificial sequence
  SiRNA target sequence
cctaaaaggaaaaaaagaacaggc

SEQ ID NO: 7148 - DNA, 24 bp, Artificial sequence
  SiRNA target sequence
ctaaaaggaaaaaaagaacaggca

SEQ ID NO: 7149 - DNA, 24 bp, Artificial sequence
  SiRNA target sequence
taaaaggaaaaaaagaacaggcaa

SEQ ID NO: 7150 - DNA, 24 bp, Artificial sequence
  SiRNA target sequence
aaaaggaaaaaaagaacaggcaat

SEQ ID NO: 7151 - DNA, 24 bp, Artificial sequence
  SiRNA target sequence
aaaggaaaaaaagaacaggcaatt

SEQ ID NO: 7152 - DNA, 24 bp, Artificial sequence
  SiRNA target sequence
aaggaaaaaaagaacaggcaattc

SEQ ID NO: 7153 - DNA, 24 bp, Artificial sequence
  SiRNA target sequence
aggaaaaaaagaacaggcaattct

SEQ ID NO: 7154 - DNA, 24 bp, Artificial sequence
  SiRNA target sequence
ggaaaaaaagaacaggcaattctt

SEQ ID NO: 7155 - DNA, 24 bp, Artificial sequence
  SiRNA target sequence
gaaaaaaagaacaggcaattcttt

SEQ ID NO: 7156 - DNA, 24 bp, Artificial sequence
  SiRNA target sequence
aaaaaaagaacaggcaattctttt

SEQ ID NO: 7157 - DNA, 24 bp, Artificial sequence
  SiRNA target sequence
aaaaaagaacaggcaattctttta

SEQ ID NO: 7158 - DNA, 24 bp, Artificial sequence
  SiRNA target sequence
aaaaagaacaggcaattcttttat

SEQ ID NO: 7159 - DNA, 24 bp, Artificial sequence
  SiRNA target sequence
aaaagaacaggcaattcttttatt

SEQ ID NO: 7160 - DNA, 24 bp, Artificial sequence
  SiRNA target sequence
aaagaacaggcaattcttttatta

SEQ ID NO: 7161 - DNA, 24 bp, Artificial sequence
  SiRNA target sequence
aagaacaggcaattcttttattag

SEQ ID NO: 7162 - DNA, 24 bp, Artificial sequence
  SiRNA target sequence
agaacaggcaattcttttattaga

SEQ ID NO: 7163 - DNA, 24 bp, Artificial sequence
  SiRNA target sequence
gaacaggcaattcttttattagaa

SEQ ID NO: 7164 - DNA, 24 bp, Artificial sequence
  SiRNA target sequence
aacaggcaattcttttattagaaa

SEQ ID NO: 7165 - DNA, 24 bp, Artificial sequence
  SiRNA target sequence
acaggcaattcttttattagaaaa

SEQ ID NO: 7166 - DNA, 24 bp, Artificial sequence
  SiRNA target sequence
caggcaattcttttattagaaaaa

SEQ ID NO: 7167 - DNA, 24 bp, Artificial sequence
  SiRNA target sequence
aggcaattcttttattagaaaaat

SEQ ID NO: 7168 - DNA, 24 bp, Artificial sequence
  SiRNA target sequence
ggcaattcttttattagaaaaatc

SEQ ID NO: 7169 - DNA, 24 bp, Artificial sequence
  SiRNA target sequence
gcaattcttttattagaaaaatct

SEQ ID NO: 7170 - DNA, 24 bp, Artificial sequence
  SiRNA target sequence
caattcttttattagaaaaatcta

SEQ ID NO: 7171 - DNA, 24 bp, Artificial sequence
  SiRNA target sequence
aattcttttattagaaaaatctac

SEQ ID NO: 7172 - DNA, 24 bp, Artificial sequence
  SiRNA target sequence
attcttttattagaaaaatctact

SEQ ID NO: 7173 - DNA, 24 bp, Artificial sequence
  SiRNA target sequence
ttcttttattagaaaaatctactt

SEQ ID NO: 7174 - DNA, 24 bp, Artificial sequence
  SiRNA target sequence
tcttttattagaaaaatctactta

SEQ ID NO: 7175 - DNA, 24 bp, Artificial sequence
  SiRNA target sequence
cttttattagaaaaatctacttat

SEQ ID NO: 7176 - DNA, 24 bp, Artificial sequence
  SiRNA target sequence
ttttattagaaaaatctacttata

SEQ ID NO: 7177 - DNA, 24 bp, Artificial sequence
  SiRNA target sequence
tttattagaaaaatctacttataa

SEQ ID NO: 7178 - DNA, 24 bp, Artificial sequence
  SiRNA target sequence
ttattagaaaaatctacttataaa

SEQ ID NO: 7179 - DNA, 24 bp, Artificial sequence
  SiRNA target sequence
tattagaaaaatctacttataaat

SEQ ID NO: 7180 - DNA, 24 bp, Artificial sequence
  SiRNA target sequence
attagaaaaatctacttataaata

SEQ ID NO: 7181 - DNA, 24 bp, Artificial sequence
  SiRNA target sequence
ttagaaaaatctacttataaatac

SEQ ID NO: 7182 - DNA, 24 bp, Artificial sequence
  SiRNA target sequence
tagaaaaatctacttataaataca

SEQ ID NO: 7183 - DNA, 24 bp, Artificial sequence
  SiRNA target sequence
agaaaaatctacttataaatacag

SEQ ID NO: 7184 - DNA, 24 bp, Artificial sequence
  SiRNA target sequence
gaaaaatctacttataaatacagt

SEQ ID NO: 7185 - DNA, 24 bp, Artificial sequence
  SiRNA target sequence
aaaaatctacttataaatacagta

SEQ ID NO: 7186 - DNA, 24 bp, Artificial sequence
  SiRNA target sequence
aaaatctacttataaatacagtat

SEQ ID NO: 7187 - DNA, 24 bp, Artificial sequence
  SiRNA target sequence
aaatctacttataaatacagtatc

SEQ ID NO: 7188 - DNA, 24 bp, Artificial sequence
  SiRNA target sequence
aatctacttataaatacagtatct

SEQ ID NO: 7189 - DNA, 24 bp, Artificial sequence
  SiRNA target sequence
atctacttataaatacagtatctt

SEQ ID NO: 7190 - DNA, 24 bp, Artificial sequence
  SiRNA target sequence
tctacttataaatacagtatcttg

SEQ ID NO: 7191 - DNA, 24 bp, Artificial sequence
  SiRNA target sequence
ctacttataaatacagtatcttgt

SEQ ID NO: 7192 - DNA, 24 bp, Artificial sequence
  SiRNA target sequence
tacttataaatacagtatcttgta

SEQ ID NO: 7193 - DNA, 24 bp, Artificial sequence
  SiRNA target sequence
acttataaatacagtatcttgtat

SEQ ID NO: 7194 - DNA, 24 bp, Artificial sequence
  SiRNA target sequence
cttataaatacagtatcttgtata

SEQ ID NO: 7195 - DNA, 24 bp, Artificial sequence
  SiRNA target sequence
ttataaatacagtatcttgtatag

SEQ ID NO: 7196 - DNA, 24 bp, Artificial sequence
  SiRNA target sequence
tataaatacagtatcttgtataga

SEQ ID NO: 7197 - DNA, 24 bp, Artificial sequence
  SiRNA target sequence
ataaatacagtatcttgtatagag

SEQ ID NO: 7198 - DNA, 24 bp, Artificial sequence
  SiRNA target sequence
taaatacagtatcttgtatagagc

SEQ ID NO: 7199 - DNA, 24 bp, Artificial sequence
  SiRNA target sequence
aaatacagtatcttgtatagagca

SEQ ID NO: 7200 - DNA, 24 bp, Artificial sequence
  SiRNA target sequence
aatacagtatcttgtatagagcat

SEQ ID NO: 7201 - DNA, 24 bp, Artificial sequence
  SiRNA target sequence
atacagtatcttgtatagagcata

SEQ ID NO: 7202 - DNA, 24 bp, Artificial sequence
  SiRNA target sequence
tacagtatcttgtatagagcatat

SEQ ID NO: 7203 - DNA, 24 bp, Artificial sequence
  SiRNA target sequence
acagtatcttgtatagagcatatt

SEQ ID NO: 7204 - DNA, 24 bp, Artificial sequence
  SiRNA target sequence
cagtatcttgtatagagcatattt

SEQ ID NO: 7205 - DNA, 24 bp, Artificial sequence
  SiRNA target sequence
agtatcttgtatagagcatatttt

SEQ ID NO: 7206 - DNA, 24 bp, Artificial sequence
  SiRNA target sequence
gtatcttgtatagagcatattttc

SEQ ID NO: 7207 - DNA, 24 bp, Artificial sequence
  SiRNA target sequence
tatcttgtatagagcatattttct

SEQ ID NO: 7208 - DNA, 24 bp, Artificial sequence
  SiRNA target sequence
atcttgtatagagcatattttctt

SEQ ID NO: 7209 - DNA, 24 bp, Artificial sequence
  SiRNA target sequence
tcttgtatagagcatattttctta

SEQ ID NO: 7210 - DNA, 24 bp, Artificial sequence
  SiRNA target sequence
cttgtatagagcatattttcttac

SEQ ID NO: 7211 - DNA, 24 bp, Artificial sequence
  SiRNA target sequence
ttgtatagagcatattttcttaca

SEQ ID NO: 7212 - DNA, 24 bp, Artificial sequence
  SiRNA target sequence
tgtatagagcatattttcttacat

SEQ ID NO: 7213 - DNA, 24 bp, Artificial sequence
  SiRNA target sequence
gtatagagcatattttcttacatt

SEQ ID NO: 7214 - DNA, 24 bp, Artificial sequence
  SiRNA target sequence
tatagagcatattttcttacattg

SEQ ID NO: 7215 - DNA, 24 bp, Artificial sequence
  SiRNA target sequence
atagagcatattttcttacattga

SEQ ID NO: 7216 - DNA, 24 bp, Artificial sequence
  SiRNA target sequence
tagagcatattttcttacattgaa

SEQ ID NO: 7217 - DNA, 24 bp, Artificial sequence
  SiRNA target sequence
agagcatattttcttacattgaag

SEQ ID NO: 7218 - DNA, 24 bp, Artificial sequence
  SiRNA target sequence
gagcatattttcttacattgaaga

SEQ ID NO: 7219 - DNA, 24 bp, Artificial sequence
  SiRNA target sequence
agcatattttcttacattgaagaa

SEQ ID NO: 7220 - DNA, 24 bp, Artificial sequence
  SiRNA target sequence
gcatattttcttacattgaagaat

SEQ ID NO: 7221 - DNA, 24 bp, Artificial sequence
  SiRNA target sequence
catattttcttacattgaagaatg

SEQ ID NO: 7222 - DNA, 24 bp, Artificial sequence
  SiRNA target sequence
atattttcttacattgaagaatga

SEQ ID NO: 7223 - DNA, 24 bp, Artificial sequence
  SiRNA target sequence
tattttcttacattgaagaatgaa

SEQ ID NO: 7224 - DNA, 24 bp, Artificial sequence
  SiRNA target sequence
attttcttacattgaagaatgaat

SEQ ID NO: 7225 - DNA, 24 bp, Artificial sequence
  SiRNA target sequence
ttttcttacattgaagaatgaata

SEQ ID NO: 7226 - DNA, 24 bp, Artificial sequence
  SiRNA target sequence
tttcttacattgaagaatgaatat

SEQ ID NO: 7227 - DNA, 24 bp, Artificial sequence
  SiRNA target sequence
ttcttacattgaagaatgaatata

SEQ ID NO: 7228 - DNA, 24 bp, Artificial sequence
  SiRNA target sequence
tcttacattgaagaatgaatatat

SEQ ID NO: 7229 - DNA, 24 bp, Artificial sequence
  SiRNA target sequence
cttacattgaagaatgaatatatt

SEQ ID NO: 7230 - DNA, 24 bp, Artificial sequence
  SiRNA target sequence
ttacattgaagaatgaatatattt

SEQ ID NO: 7231 - DNA, 24 bp, Artificial sequence
  SiRNA target sequence
tacattgaagaatgaatatatttc

SEQ ID NO: 7232 - DNA, 24 bp, Artificial sequence
  SiRNA target sequence
acattgaagaatgaatatatttca

SEQ ID NO: 7233 - DNA, 24 bp, Artificial sequence
  SiRNA target sequence
cattgaagaatgaatatatttcat

SEQ ID NO: 7234 - DNA, 24 bp, Artificial sequence
  SiRNA target sequence
attgaagaatgaatatatttcatc

SEQ ID NO: 7235 - DNA, 24 bp, Artificial sequence
  SiRNA target sequence
ttgaagaatgaatatatttcatct

SEQ ID NO: 7236 - DNA, 24 bp, Artificial sequence
  SiRNA target sequence
tgaagaatgaatatatttcatctt

SEQ ID NO: 7237 - DNA, 24 bp, Artificial sequence
  SiRNA target sequence
gaagaatgaatatatttcatcttc

SEQ ID NO: 7238 - DNA, 24 bp, Artificial sequence
  SiRNA target sequence
aagaatgaatatatttcatcttca

SEQ ID NO: 7239 - DNA, 24 bp, Artificial sequence
  SiRNA target sequence
agaatgaatatatttcatcttcat

SEQ ID NO: 7240 - DNA, 24 bp, Artificial sequence
  SiRNA target sequence
gaatgaatatatttcatcttcatt

SEQ ID NO: 7241 - DNA, 24 bp, Artificial sequence
  SiRNA target sequence
aatgaatatatttcatcttcattg

SEQ ID NO: 7242 - DNA, 24 bp, Artificial sequence
  SiRNA target sequence
atgaatatatttcatcttcattgc

SEQ ID NO: 7243 - DNA, 24 bp, Artificial sequence
  SiRNA target sequence
tgaatatatttcatcttcattgcc

SEQ ID NO: 7244 - DNA, 24 bp, Artificial sequence
  SiRNA target sequence
gaatatatttcatcttcattgcct

SEQ ID NO: 7245 - DNA, 24 bp, Artificial sequence
  SiRNA target sequence
aatatatttcatcttcattgcctt

SEQ ID NO: 7246 - DNA, 24 bp, Artificial sequence
  SiRNA target sequence
atatatttcatcttcattgccttt

SEQ ID NO: 7247 - DNA, 24 bp, Artificial sequence
  SiRNA target sequence
tatatttcatcttcattgccttta

SEQ ID NO: 7248 - DNA, 24 bp, Artificial sequence
  SiRNA target sequence
atatttcatcttcattgcctttag

SEQ ID NO: 7249 - DNA, 24 bp, Artificial sequence
  SiRNA target sequence
tatttcatcttcattgcctttaga

SEQ ID NO: 7250 - DNA, 24 bp, Artificial sequence
  SiRNA target sequence
atttcatcttcattgcctttagat

SEQ ID NO: 7251 - DNA, 24 bp, Artificial sequence
  SiRNA target sequence
tttcatcttcattgcctttagatg

SEQ ID NO: 7252 - DNA, 24 bp, Artificial sequence
  SiRNA target sequence
ttcatcttcattgcctttagatga

SEQ ID NO: 7253 - DNA, 24 bp, Artificial sequence
  SiRNA target sequence
tcatcttcattgcctttagatgac

SEQ ID NO: 7254 - DNA, 24 bp, Artificial sequence
  SiRNA target sequence
catcttcattgcctttagatgacg

SEQ ID NO: 7255 - DNA, 24 bp, Artificial sequence
  SiRNA target sequence
atcttcattgcctttagatgacga

SEQ ID NO: 7256 - DNA, 24 bp, Artificial sequence
  SiRNA target sequence
tcttcattgcctttagatgacgag

SEQ ID NO: 7257 - DNA, 24 bp, Artificial sequence
  SiRNA target sequence
cttcattgcctttagatgacgaga

SEQ ID NO: 7258 - DNA, 24 bp, Artificial sequence
  SiRNA target sequence
ttcattgcctttagatgacgagat

SEQ ID NO: 7259 - DNA, 24 bp, Artificial sequence
  SiRNA target sequence
tcattgcctttagatgacgagatt

SEQ ID NO: 7260 - DNA, 24 bp, Artificial sequence
  SiRNA target sequence
cattgcctttagatgacgagatta

SEQ ID NO: 7261 - DNA, 24 bp, Artificial sequence
  SiRNA target sequence
attgcctttagatgacgagattac

SEQ ID NO: 7262 - DNA, 24 bp, Artificial sequence
  SiRNA target sequence
ttgcctttagatgacgagattact

SEQ ID NO: 7263 - DNA, 24 bp, Artificial sequence
  SiRNA target sequence
tgcctttagatgacgagattacta

SEQ ID NO: 7264 - DNA, 24 bp, Artificial sequence
  SiRNA target sequence
gcctttagatgacgagattactac

SEQ ID NO: 7265 - DNA, 24 bp, Artificial sequence
  SiRNA target sequence
cctttagatgacgagattactacg

SEQ ID NO: 7266 - DNA, 24 bp, Artificial sequence
  SiRNA target sequence
ctttagatgacgagattactacgc

SEQ ID NO: 7267 - DNA, 24 bp, Artificial sequence
  SiRNA target sequence
tttagatgacgagattactacgct

SEQ ID NO: 7268 - DNA, 24 bp, Artificial sequence
  SiRNA target sequence
ttagatgacgagattactacgctt

SEQ ID NO: 7269 - DNA, 24 bp, Artificial sequence
  SiRNA target sequence
tagatgacgagattactacgcttt

SEQ ID NO: 7270 - DNA, 24 bp, Artificial sequence
  SiRNA target sequence
agatgacgagattactacgcttta

SEQ ID NO: 7271 - DNA, 24 bp, Artificial sequence
  SiRNA target sequence
gatgacgagattactacgctttac

SEQ ID NO: 7272 - DNA, 24 bp, Artificial sequence
  SiRNA target sequence
atgacgagattactacgctttact

SEQ ID NO: 7273 - DNA, 24 bp, Artificial sequence
  SiRNA target sequence
tgacgagattactacgctttactt

SEQ ID NO: 7274 - DNA, 24 bp, Artificial sequence
  SiRNA target sequence
gacgagattactacgctttacttg

SEQ ID NO: 7275 - DNA, 24 bp, Artificial sequence
  SiRNA target sequence
acgagattactacgctttacttgt

SEQ ID NO: 7276 - DNA, 24 bp, Artificial sequence
  SiRNA target sequence
cgagattactacgctttacttgta

SEQ ID NO: 7277 - DNA, 24 bp, Artificial sequence
  SiRNA target sequence
gagattactacgctttacttgtat

SEQ ID NO: 7278 - DNA, 24 bp, Artificial sequence
  SiRNA target sequence
agattactacgctttacttgtatt

SEQ ID NO: 7279 - DNA, 24 bp, Artificial sequence
  SiRNA target sequence
gattactacgctttacttgtattc

SEQ ID NO: 7280 - DNA, 24 bp, Artificial sequence
  SiRNA target sequence
attactacgctttacttgtattct

SEQ ID NO: 7281 - DNA, 24 bp, Artificial sequence
  SiRNA target sequence
ttactacgctttacttgtattcta

SEQ ID NO: 7282 - DNA, 24 bp, Artificial sequence
  SiRNA target sequence
tactacgctttacttgtattctaa

SEQ ID NO: 7283 - DNA, 24 bp, Artificial sequence
  SiRNA target sequence
actacgctttacttgtattctaag

SEQ ID NO: 7284 - DNA, 24 bp, Artificial sequence
  SiRNA target sequence
ctacgctttacttgtattctaaga

SEQ ID NO: 7285 - DNA, 24 bp, Artificial sequence
  SiRNA target sequence
tacgctttacttgtattctaagat

SEQ ID NO: 7286 - DNA, 24 bp, Artificial sequence
  SiRNA target sequence
acgctttacttgtattctaagatt

SEQ ID NO: 7287 - DNA, 24 bp, Artificial sequence
  SiRNA target sequence
cgctttacttgtattctaagattt

SEQ ID NO: 7288 - DNA, 24 bp, Artificial sequence
  SiRNA target sequence
gctttacttgtattctaagatttt

SEQ ID NO: 7289 - DNA, 24 bp, Artificial sequence
  SiRNA target sequence
ctttacttgtattctaagattttt

SEQ ID NO: 7290 - DNA, 24 bp, Artificial sequence
  SiRNA target sequence
tttacttgtattctaagattttta

SEQ ID NO: 7291 - DNA, 24 bp, Artificial sequence
  SiRNA target sequence
ttacttgtattctaagatttttaa

SEQ ID NO: 7292 - DNA, 24 bp, Artificial sequence
  SiRNA target sequence
tacttgtattctaagatttttaaa

SEQ ID NO: 7293 - DNA, 24 bp, Artificial sequence
  SiRNA target sequence
acttgtattctaagatttttaaag

SEQ ID NO: 7294 - DNA, 24 bp, Artificial sequence
  SiRNA target sequence
cttgtattctaagatttttaaaga

SEQ ID NO: 7295 - DNA, 24 bp, Artificial sequence
  SiRNA target sequence
ttgtattctaagatttttaaagat

SEQ ID NO: 7296 - DNA, 24 bp, Artificial sequence
  SiRNA target sequence
tgtattctaagatttttaaagata

SEQ ID NO: 7297 - DNA, 24 bp, Artificial sequence
  SiRNA target sequence
gtattctaagatttttaaagataa

SEQ ID NO: 7298 - DNA, 24 bp, Artificial sequence
  SiRNA target sequence
tattctaagatttttaaagataaa

SEQ ID NO: 7299 - DNA, 24 bp, Artificial sequence
  SiRNA target sequence
attctaagatttttaaagataaat

SEQ ID NO: 7300 - DNA, 24 bp, Artificial sequence
  SiRNA target sequence
ttctaagatttttaaagataaatc

SEQ ID NO: 7301 - DNA, 24 bp, Artificial sequence
  SiRNA target sequence
tctaagatttttaaagataaatct

SEQ ID NO: 7302 - DNA, 24 bp, Artificial sequence
  SiRNA target sequence
ctaagatttttaaagataaatctg

SEQ ID NO: 7303 - DNA, 24 bp, Artificial sequence
  SiRNA target sequence
taagatttttaaagataaatctga

SEQ ID NO: 7304 - DNA, 24 bp, Artificial sequence
  SiRNA target sequence
aagatttttaaagataaatctgat

SEQ ID NO: 7305 - DNA, 24 bp, Artificial sequence
  SiRNA target sequence
agatttttaaagataaatctgata

SEQ ID NO: 7306 - DNA, 24 bp, Artificial sequence
  SiRNA target sequence
gatttttaaagataaatctgatac

SEQ ID NO: 7307 - DNA, 24 bp, Artificial sequence
  SiRNA target sequence
atttttaaagataaatctgatact

SEQ ID NO: 7308 - DNA, 24 bp, Artificial sequence
  SiRNA target sequence
tttttaaagataaatctgatactt

SEQ ID NO: 7309 - DNA, 24 bp, Artificial sequence
  SiRNA target sequence
ttttaaagataaatctgatactta

SEQ ID NO: 7310 - DNA, 24 bp, Artificial sequence
  SiRNA target sequence
tttaaagataaatctgatacttac

SEQ ID NO: 7311 - DNA, 24 bp, Artificial sequence
  SiRNA target sequence
ttaaagataaatctgatacttacc

SEQ ID NO: 7312 - DNA, 24 bp, Artificial sequence
  SiRNA target sequence
taaagataaatctgatacttacct

SEQ ID NO: 7313 - DNA, 24 bp, Artificial sequence
  SiRNA target sequence
aaagataaatctgatacttacctt

SEQ ID NO: 7314 - DNA, 24 bp, Artificial sequence
  SiRNA target sequence
aagataaatctgatacttacctta

SEQ ID NO: 7315 - DNA, 24 bp, Artificial sequence
  SiRNA target sequence
agataaatctgatacttaccttaa

SEQ ID NO: 7316 - DNA, 24 bp, Artificial sequence
  SiRNA target sequence
gataaatctgatacttaccttaaa

SEQ ID NO: 7317 - DNA, 24 bp, Artificial sequence
  SiRNA target sequence
ataaatctgatacttaccttaaat

SEQ ID NO: 7318 - DNA, 24 bp, Artificial sequence
  SiRNA target sequence
taaatctgatacttaccttaaatc

SEQ ID NO: 7319 - DNA, 24 bp, Artificial sequence
  SiRNA target sequence
aaatctgatacttaccttaaatct

SEQ ID NO: 7320 - DNA, 24 bp, Artificial sequence
  SiRNA target sequence
aatctgatacttaccttaaatctg

SEQ ID NO: 7321 - DNA, 24 bp, Artificial sequence
  SiRNA target sequence
atctgatacttaccttaaatctgc

SEQ ID NO: 7322 - DNA, 24 bp, Artificial sequence
  SiRNA target sequence
tctgatacttaccttaaatctgct

SEQ ID NO: 7323 - DNA, 24 bp, Artificial sequence
  SiRNA target sequence
ctgatacttaccttaaatctgcta

SEQ ID NO: 7324 - DNA, 24 bp, Artificial sequence
  SiRNA target sequence
tgatacttaccttaaatctgctat

SEQ ID NO: 7325 - DNA, 24 bp, Artificial sequence
  SiRNA target sequence
gatacttaccttaaatctgctata

SEQ ID NO: 7326 - DNA, 24 bp, Artificial sequence
  SiRNA target sequence
atacttaccttaaatctgctatag

SEQ ID NO: 7327 - DNA, 24 bp, Artificial sequence
  SiRNA target sequence
tacttaccttaaatctgctataga

SEQ ID NO: 7328 - DNA, 24 bp, Artificial sequence
  SiRNA target sequence
acttaccttaaatctgctatagat

SEQ ID NO: 7329 - DNA, 24 bp, Artificial sequence
  SiRNA target sequence
cttaccttaaatctgctatagata

SEQ ID NO: 7330 - DNA, 24 bp, Artificial sequence
  SiRNA target sequence
ttaccttaaatctgctatagataa

SEQ ID NO: 7331 - DNA, 24 bp, Artificial sequence
  SiRNA target sequence
taccttaaatctgctatagataaa

SEQ ID NO: 7332 - DNA, 24 bp, Artificial sequence
  SiRNA target sequence
accttaaatctgctatagataaat

SEQ ID NO: 7333 - DNA, 24 bp, Artificial sequence
  SiRNA target sequence
ccttaaatctgctatagataaatc

SEQ ID NO: 7334 - DNA, 24 bp, Artificial sequence
  SiRNA target sequence
cttaaatctgctatagataaatca

SEQ ID NO: 7335 - DNA, 24 bp, Artificial sequence
  SiRNA target sequence
ttaaatctgctatagataaatcag

SEQ ID NO: 7336 - DNA, 24 bp, Artificial sequence
  SiRNA target sequence
taaatctgctatagataaatcagt

SEQ ID NO: 7337 - DNA, 24 bp, Artificial sequence
  SiRNA target sequence
aaatctgctatagataaatcagta

SEQ ID NO: 7338 - DNA, 24 bp, Artificial sequence
  SiRNA target sequence
aatctgctatagataaatcagtag

SEQ ID NO: 7339 - DNA, 24 bp, Artificial sequence
  SiRNA target sequence
atctgctatagataaatcagtaga

SEQ ID NO: 7340 - DNA, 24 bp, Artificial sequence
  SiRNA target sequence
tctgctatagataaatcagtagat

SEQ ID NO: 7341 - DNA, 24 bp, Artificial sequence
  SiRNA target sequence
ctgctatagataaatcagtagatc

SEQ ID NO: 7342 - DNA, 24 bp, Artificial sequence
  SiRNA target sequence
tgctatagataaatcagtagatct

SEQ ID NO: 7343 - DNA, 24 bp, Artificial sequence
  SiRNA target sequence
gctatagataaatcagtagatcta

SEQ ID NO: 7344 - DNA, 24 bp, Artificial sequence
  SiRNA target sequence
ctatagataaatcagtagatctac

SEQ ID NO: 7345 - DNA, 24 bp, Artificial sequence
  SiRNA target sequence
tatagataaatcagtagatctacc

SEQ ID NO: 7346 - DNA, 24 bp, Artificial sequence
  SiRNA target sequence
atagataaatcagtagatctacct

SEQ ID NO: 7347 - DNA, 24 bp, Artificial sequence
  SiRNA target sequence
tagataaatcagtagatctaccta

SEQ ID NO: 7348 - DNA, 24 bp, Artificial sequence
  SiRNA target sequence
agataaatcagtagatctacctat

SEQ ID NO: 7349 - DNA, 24 bp, Artificial sequence
  SiRNA target sequence
gataaatcagtagatctacctatt

SEQ ID NO: 7350 - DNA, 24 bp, Artificial sequence
  SiRNA target sequence
ataaatcagtagatctacctattg

SEQ ID NO: 7351 - DNA, 24 bp, Artificial sequence
  SiRNA target sequence
taaatcagtagatctacctattga

SEQ ID NO: 7352 - DNA, 24 bp, Artificial sequence
  SiRNA target sequence
aaatcagtagatctacctattgaa

SEQ ID NO: 7353 - DNA, 24 bp, Artificial sequence
  SiRNA target sequence
aatcagtagatctacctattgaac

SEQ ID NO: 7354 - DNA, 24 bp, Artificial sequence
  SiRNA target sequence
atcagtagatctacctattgaaca

SEQ ID NO: 7355 - DNA, 24 bp, Artificial sequence
  SiRNA target sequence
tcagtagatctacctattgaacag

SEQ ID NO: 7356 - DNA, 24 bp, Artificial sequence
  SiRNA target sequence
cagtagatctacctattgaacaga

SEQ ID NO: 7357 - DNA, 24 bp, Artificial sequence
  SiRNA target sequence
agtagatctacctattgaacagaa

SEQ ID NO: 7358 - DNA, 24 bp, Artificial sequence
  SiRNA target sequence
gtagatctacctattgaacagaaa

SEQ ID NO: 7359 - DNA, 24 bp, Artificial sequence
  SiRNA target sequence
tagatctacctattgaacagaaag

SEQ ID NO: 7360 - DNA, 24 bp, Artificial sequence
  SiRNA target sequence
agatctacctattgaacagaaaga

SEQ ID NO: 7361 - DNA, 24 bp, Artificial sequence
  SiRNA target sequence
gatctacctattgaacagaaagac

SEQ ID NO: 7362 - DNA, 24 bp, Artificial sequence
  SiRNA target sequence
atctacctattgaacagaaagact

SEQ ID NO: 7363 - DNA, 24 bp, Artificial sequence
  SiRNA target sequence
tctacctattgaacagaaagactt

SEQ ID NO: 7364 - DNA, 24 bp, Artificial sequence
  SiRNA target sequence
ctacctattgaacagaaagacttt

SEQ ID NO: 7365 - DNA, 24 bp, Artificial sequence
  SiRNA target sequence
tacctattgaacagaaagactttc

SEQ ID NO: 7366 - DNA, 24 bp, Artificial sequence
  SiRNA target sequence
acctattgaacagaaagactttct

SEQ ID NO: 7367 - DNA, 24 bp, Artificial sequence
  SiRNA target sequence
cctattgaacagaaagactttctg

SEQ ID NO: 7368 - DNA, 24 bp, Artificial sequence
  SiRNA target sequence
ctattgaacagaaagactttctgt

SEQ ID NO: 7369 - DNA, 24 bp, Artificial sequence
  SiRNA target sequence
tattgaacagaaagactttctgta

SEQ ID NO: 7370 - DNA, 24 bp, Artificial sequence
  SiRNA target sequence
attgaacagaaagactttctgtac

SEQ ID NO: 7371 - DNA, 24 bp, Artificial sequence
  SiRNA target sequence
ttgaacagaaagactttctgtacg

SEQ ID NO: 7372 - DNA, 24 bp, Artificial sequence
  SiRNA target sequence
tgaacagaaagactttctgtacgt

SEQ ID NO: 7373 - DNA, 24 bp, Artificial sequence
  SiRNA target sequence
gaacagaaagactttctgtacgta

SEQ ID NO: 7374 - DNA, 24 bp, Artificial sequence
  SiRNA target sequence
aacagaaagactttctgtacgtag

SEQ ID NO: 7375 - DNA, 24 bp, Artificial sequence
  SiRNA target sequence
acagaaagactttctgtacgtaga

SEQ ID NO: 7376 - DNA, 24 bp, Artificial sequence
  SiRNA target sequence
cagaaagactttctgtacgtagat

SEQ ID NO: 7377 - DNA, 24 bp, Artificial sequence
  SiRNA target sequence
agaaagactttctgtacgtagatc

SEQ ID NO: 7378 - DNA, 24 bp, Artificial sequence
  SiRNA target sequence
gaaagactttctgtacgtagatct

SEQ ID NO: 7379 - DNA, 24 bp, Artificial sequence
  SiRNA target sequence
aaagactttctgtacgtagatctt

SEQ ID NO: 7380 - DNA, 24 bp, Artificial sequence
  SiRNA target sequence
aagactttctgtacgtagatcttc

SEQ ID NO: 7381 - DNA, 24 bp, Artificial sequence
  SiRNA target sequence
agactttctgtacgtagatcttct

SEQ ID NO: 7382 - DNA, 24 bp, Artificial sequence
  SiRNA target sequence
gactttctgtacgtagatcttctt

SEQ ID NO: 7383 - DNA, 24 bp, Artificial sequence
  SiRNA target sequence
actttctgtacgtagatcttcttg

SEQ ID NO: 7384 - DNA, 24 bp, Artificial sequence
  SiRNA target sequence
ctttctgtacgtagatcttcttgt

SEQ ID NO: 7385 - DNA, 24 bp, Artificial sequence
  SiRNA target sequence
tttctgtacgtagatcttcttgta

SEQ ID NO: 7386 - DNA, 24 bp, Artificial sequence
  SiRNA target sequence
ttctgtacgtagatcttcttgtat

SEQ ID NO: 7387 - DNA, 24 bp, Artificial sequence
  SiRNA target sequence
tctgtacgtagatcttcttgtatt

SEQ ID NO: 7388 - DNA, 24 bp, Artificial sequence
  SiRNA target sequence
ctgtacgtagatcttcttgtattt

SEQ ID NO: 7389 - DNA, 24 bp, Artificial sequence
  SiRNA target sequence
tgtacgtagatcttcttgtatttt

SEQ ID NO: 7390 - DNA, 24 bp, Artificial sequence
  SiRNA target sequence
gtacgtagatcttcttgtatttta

SEQ ID NO: 7391 - DNA, 24 bp, Artificial sequence
  SiRNA target sequence
tacgtagatcttcttgtattttac

SEQ ID NO: 7392 - DNA, 24 bp, Artificial sequence
  SiRNA target sequence
acgtagatcttcttgtattttaca

SEQ ID NO: 7393 - DNA, 24 bp, Artificial sequence
  SiRNA target sequence
cgtagatcttcttgtattttacat

SEQ ID NO: 7394 - DNA, 24 bp, Artificial sequence
  SiRNA target sequence
gtagatcttcttgtattttacatt

SEQ ID NO: 7395 - DNA, 24 bp, Artificial sequence
  SiRNA target sequence
tagatcttcttgtattttacattt

SEQ ID NO: 7396 - DNA, 24 bp, Artificial sequence
  SiRNA target sequence
agatcttcttgtattttacatttc

SEQ ID NO: 7397 - DNA, 24 bp, Artificial sequence
  SiRNA target sequence
gatcttcttgtattttacatttct

SEQ ID NO: 7398 - DNA, 24 bp, Artificial sequence
  SiRNA target sequence
atcttcttgtattttacatttcta

SEQ ID NO: 7399 - DNA, 24 bp, Artificial sequence
  SiRNA target sequence
tcttcttgtattttacatttctaa

SEQ ID NO: 7400 - DNA, 24 bp, Artificial sequence
  SiRNA target sequence
cttcttgtattttacatttctaaa

SEQ ID NO: 7401 - DNA, 24 bp, Artificial sequence
  SiRNA target sequence
ttcttgtattttacatttctaaaa

SEQ ID NO: 7402 - DNA, 24 bp, Artificial sequence
  SiRNA target sequence
tcttgtattttacatttctaaaaa

SEQ ID NO: 7403 - DNA, 24 bp, Artificial sequence
  SiRNA target sequence
cttgtattttacatttctaaaaag

SEQ ID NO: 7404 - DNA, 24 bp, Artificial sequence
  SiRNA target sequence
ttgtattttacatttctaaaaagg

SEQ ID NO: 7405 - DNA, 24 bp, Artificial sequence
  SiRNA target sequence
tgtattttacatttctaaaaagga

SEQ ID NO: 7406 - DNA, 24 bp, Artificial sequence
  SiRNA target sequence
gtattttacatttctaaaaaggat

SEQ ID NO: 7407 - DNA, 24 bp, Artificial sequence
  SiRNA target sequence
tattttacatttctaaaaaggatg

SEQ ID NO: 7408 - DNA, 24 bp, Artificial sequence
  SiRNA target sequence
attttacatttctaaaaaggatgt

SEQ ID NO: 7409 - DNA, 24 bp, Artificial sequence
  SiRNA target sequence
ttttacatttctaaaaaggatgtt

SEQ ID NO: 7410 - DNA, 24 bp, Artificial sequence
  SiRNA target sequence
tttacatttctaaaaaggatgttg

SEQ ID NO: 7411 - DNA, 24 bp, Artificial sequence
  SiRNA target sequence
ttacatttctaaaaaggatgttga

SEQ ID NO: 7412 - DNA, 24 bp, Artificial sequence
  SiRNA target sequence
tacatttctaaaaaggatgttgaa

SEQ ID NO: 7413 - DNA, 24 bp, Artificial sequence
  SiRNA target sequence
acatttctaaaaaggatgttgaaa

SEQ ID NO: 7414 - DNA, 24 bp, Artificial sequence
  SiRNA target sequence
catttctaaaaaggatgttgaaaa

SEQ ID NO: 7415 - DNA, 24 bp, Artificial sequence
  SiRNA target sequence
atttctaaaaaggatgttgaaaaa

SEQ ID NO: 7416 - DNA, 24 bp, Artificial sequence
  SiRNA target sequence
tttctaaaaaggatgttgaaaaag

SEQ ID NO: 7417 - DNA, 24 bp, Artificial sequence
  SiRNA target sequence
ttctaaaaaggatgttgaaaaagt

SEQ ID NO: 7418 - DNA, 24 bp, Artificial sequence
  SiRNA target sequence
tctaaaaaggatgttgaaaaagtt

SEQ ID NO: 7419 - DNA, 24 bp, Artificial sequence
  SiRNA target sequence
ctaaaaaggatgttgaaaaagtta

SEQ ID NO: 7420 - DNA, 24 bp, Artificial sequence
  SiRNA target sequence
taaaaaggatgttgaaaaagttaa

SEQ ID NO: 7421 - DNA, 24 bp, Artificial sequence
  SiRNA target sequence
aaaaaggatgttgaaaaagttaat

SEQ ID NO: 7422 - DNA, 24 bp, Artificial sequence
  SiRNA target sequence
aaaaggatgttgaaaaagttaatg

SEQ ID NO: 7423 - DNA, 24 bp, Artificial sequence
  SiRNA target sequence
aaaggatgttgaaaaagttaatga

SEQ ID NO: 7424 - DNA, 24 bp, Artificial sequence
  SiRNA target sequence
aaggatgttgaaaaagttaatgaa

SEQ ID NO: 7425 - DNA, 24 bp, Artificial sequence
  SiRNA target sequence
aggatgttgaaaaagttaatgaaa

SEQ ID NO: 7426 - DNA, 24 bp, Artificial sequence
  SiRNA target sequence
ggatgttgaaaaagttaatgaaac

SEQ ID NO: 7427 - DNA, 24 bp, Artificial sequence
  SiRNA target sequence
gatgttgaaaaagttaatgaaaca

SEQ ID NO: 7428 - DNA, 24 bp, Artificial sequence
  SiRNA target sequence
atgttgaaaaagttaatgaaacaa

SEQ ID NO: 7429 - DNA, 24 bp, Artificial sequence
  SiRNA target sequence
tgttgaaaaagttaatgaaacaat

SEQ ID NO: 7430 - DNA, 24 bp, Artificial sequence
  SiRNA target sequence
gttgaaaaagttaatgaaacaatt

SEQ ID NO: 7431 - DNA, 24 bp, Artificial sequence
  SiRNA target sequence
ttgaaaaagttaatgaaacaatta

SEQ ID NO: 7432 - DNA, 24 bp, Artificial sequence
  SiRNA target sequence
tgaaaaagttaatgaaacaattaa

SEQ ID NO: 7433 - DNA, 24 bp, Artificial sequence
  SiRNA target sequence
gaaaaagttaatgaaacaattaat

SEQ ID NO: 7434 - DNA, 24 bp, Artificial sequence
  SiRNA target sequence
aaaaagttaatgaaacaattaata

SEQ ID NO: 7435 - DNA, 24 bp, Artificial sequence
  SiRNA target sequence
aaaagttaatgaaacaattaataa

SEQ ID NO: 7436 - DNA, 24 bp, Artificial sequence
  SiRNA target sequence
aaagttaatgaaacaattaataat

SEQ ID NO: 7437 - DNA, 24 bp, Artificial sequence
  SiRNA target sequence
aagttaatgaaacaattaataatt

SEQ ID NO: 7438 - DNA, 24 bp, Artificial sequence
  SiRNA target sequence
agttaatgaaacaattaataattt

SEQ ID NO: 7439 - DNA, 24 bp, Artificial sequence
  SiRNA target sequence
gttaatgaaacaattaataattta

SEQ ID NO: 7440 - DNA, 24 bp, Artificial sequence
  SiRNA target sequence
ttaatgaaacaattaataatttaa

SEQ ID NO: 7441 - DNA, 24 bp, Artificial sequence
  SiRNA target sequence
taatgaaacaattaataatttaaa

SEQ ID NO: 7442 - DNA, 24 bp, Artificial sequence
  SiRNA target sequence
aatgaaacaattaataatttaaaa

SEQ ID NO: 7443 - DNA, 24 bp, Artificial sequence
  SiRNA target sequence
atgaaacaattaataatttaaaag

SEQ ID NO: 7444 - DNA, 24 bp, Artificial sequence
  SiRNA target sequence
tgaaacaattaataatttaaaaga

SEQ ID NO: 7445 - DNA, 24 bp, Artificial sequence
  SiRNA target sequence
gaaacaattaataatttaaaagag

SEQ ID NO: 7446 - DNA, 24 bp, Artificial sequence
  SiRNA target sequence
aaacaattaataatttaaaagaga

SEQ ID NO: 7447 - DNA, 24 bp, Artificial sequence
  SiRNA target sequence
aacaattaataatttaaaagagac

SEQ ID NO: 7448 - DNA, 24 bp, Artificial sequence
  SiRNA target sequence
acaattaataatttaaaagagact

SEQ ID NO: 7449 - DNA, 24 bp, Artificial sequence
  SiRNA target sequence
caattaataatttaaaagagactc

SEQ ID NO: 7450 - DNA, 24 bp, Artificial sequence
  SiRNA target sequence
aattaataatttaaaagagactct

SEQ ID NO: 7451 - DNA, 24 bp, Artificial sequence
  SiRNA target sequence
attaataatttaaaagagactctt

SEQ ID NO: 7452 - DNA, 24 bp, Artificial sequence
  SiRNA target sequence
ttaataatttaaaagagactctta

SEQ ID NO: 7453 - DNA, 24 bp, Artificial sequence
  SiRNA target sequence
taataatttaaaagagactcttac

SEQ ID NO: 7454 - DNA, 24 bp, Artificial sequence
  SiRNA target sequence
aataatttaaaagagactcttacc

SEQ ID NO: 7455 - DNA, 24 bp, Artificial sequence
  SiRNA target sequence
ataatttaaaagagactcttaccc

SEQ ID NO: 7456 - DNA, 24 bp, Artificial sequence
  SiRNA target sequence
taatttaaaagagactcttacccc

SEQ ID NO: 7457 - DNA, 24 bp, Artificial sequence
  SiRNA target sequence
aatttaaaagagactcttaccccc

SEQ ID NO: 7458 - DNA, 24 bp, Artificial sequence
  SiRNA target sequence
atttaaaagagactcttaccccca

SEQ ID NO: 7459 - DNA, 24 bp, Artificial sequence
  SiRNA target sequence
tttaaaagagactcttacccccac

SEQ ID NO: 7460 - DNA, 24 bp, Artificial sequence
  SiRNA target sequence
ttaaaagagactcttacccccact

SEQ ID NO: 7461 - DNA, 24 bp, Artificial sequence
  SiRNA target sequence
taaaagagactcttacccccactt

SEQ ID NO: 7462 - DNA, 24 bp, Artificial sequence
  SiRNA target sequence
aaaagagactcttacccccacttt

SEQ ID NO: 7463 - DNA, 24 bp, Artificial sequence
  SiRNA target sequence
aaagagactcttacccccacttta

SEQ ID NO: 7464 - DNA, 24 bp, Artificial sequence
  SiRNA target sequence
aagagactcttacccccactttat

SEQ ID NO: 7465 - DNA, 24 bp, Artificial sequence
  SiRNA target sequence
agagactcttacccccactttatt

SEQ ID NO: 7466 - DNA, 24 bp, Artificial sequence
  SiRNA target sequence
gagactcttacccccactttattg

SEQ ID NO: 7467 - DNA, 24 bp, Artificial sequence
  SiRNA target sequence
agactcttacccccactttattgg

SEQ ID NO: 7468 - DNA, 24 bp, Artificial sequence
  SiRNA target sequence
gactcttacccccactttattgga

SEQ ID NO: 7469 - DNA, 24 bp, Artificial sequence
  SiRNA target sequence
actcttacccccactttattggaa

SEQ ID NO: 7470 - DNA, 24 bp, Artificial sequence
  SiRNA target sequence
ctcttacccccactttattggaac

SEQ ID NO: 7471 - DNA, 24 bp, Artificial sequence
  SiRNA target sequence
tcttacccccactttattggaact

SEQ ID NO: 7472 - DNA, 24 bp, Artificial sequence
  SiRNA target sequence
cttacccccactttattggaactt

SEQ ID NO: 7473 - DNA, 24 bp, Artificial sequence
  SiRNA target sequence
ttacccccactttattggaactta

SEQ ID NO: 7474 - DNA, 24 bp, Artificial sequence
  SiRNA target sequence
tacccccactttattggaacttat

SEQ ID NO: 7475 - DNA, 24 bp, Artificial sequence
  SiRNA target sequence
acccccactttattggaacttatt

SEQ ID NO: 7476 - DNA, 24 bp, Artificial sequence
  SiRNA target sequence
cccccactttattggaacttattg

SEQ ID NO: 7477 - DNA, 24 bp, Artificial sequence
  SiRNA target sequence
ccccactttattggaacttattgg

SEQ ID NO: 7478 - DNA, 24 bp, Artificial sequence
  SiRNA target sequence
cccactttattggaacttattgga

SEQ ID NO: 7479 - DNA, 24 bp, Artificial sequence
  SiRNA target sequence
ccactttattggaacttattggag

SEQ ID NO: 7480 - DNA, 24 bp, Artificial sequence
  SiRNA target sequence
cactttattggaacttattggaga

SEQ ID NO: 7481 - DNA, 24 bp, Artificial sequence
  SiRNA target sequence
actttattggaacttattggagaa

SEQ ID NO: 7482 - DNA, 24 bp, Artificial sequence
  SiRNA target sequence
ctttattggaacttattggagaat

SEQ ID NO: 7483 - DNA, 24 bp, Artificial sequence
  SiRNA target sequence
tttattggaacttattggagaata

SEQ ID NO: 7484 - DNA, 24 bp, Artificial sequence
  SiRNA target sequence
ttattggaacttattggagaatat

SEQ ID NO: 7485 - DNA, 24 bp, Artificial sequence
  SiRNA target sequence
tattggaacttattggagaatatt

SEQ ID NO: 7486 - DNA, 24 bp, Artificial sequence
  SiRNA target sequence
attggaacttattggagaatatta

SEQ ID NO: 7487 - DNA, 24 bp, Artificial sequence
  SiRNA target sequence
ttggaacttattggagaatattat

SEQ ID NO: 7488 - DNA, 24 bp, Artificial sequence
  SiRNA target sequence
tggaacttattggagaatattatt

SEQ ID NO: 7489 - DNA, 24 bp, Artificial sequence
  SiRNA target sequence
ggaacttattggagaatattattt

SEQ ID NO: 7490 - DNA, 24 bp, Artificial sequence
  SiRNA target sequence
gaacttattggagaatattattta

SEQ ID NO: 7491 - DNA, 24 bp, Artificial sequence
  SiRNA target sequence
aacttattggagaatattatttaa

SEQ ID NO: 7492 - DNA, 24 bp, Artificial sequence
  SiRNA target sequence
acttattggagaatattatttaaa

SEQ ID NO: 7493 - DNA, 24 bp, Artificial sequence
  SiRNA target sequence
cttattggagaatattatttaaaa

SEQ ID NO: 7494 - DNA, 24 bp, Artificial sequence
  SiRNA target sequence
ttattggagaatattatttaaaaa

SEQ ID NO: 7495 - DNA, 24 bp, Artificial sequence
  SiRNA target sequence
tattggagaatattatttaaaaag

SEQ ID NO: 7496 - DNA, 24 bp, Artificial sequence
  SiRNA target sequence
attggagaatattatttaaaaagt

SEQ ID NO: 7497 - DNA, 24 bp, Artificial sequence
  SiRNA target sequence
ttggagaatattatttaaaaagtg

SEQ ID NO: 7498 - DNA, 24 bp, Artificial sequence
  SiRNA target sequence
tggagaatattatttaaaaagtgg

SEQ ID NO: 7499 - DNA, 24 bp, Artificial sequence
  SiRNA target sequence
ggagaatattatttaaaaagtgga

SEQ ID NO: 7500 - DNA, 24 bp, Artificial sequence
  SiRNA target sequence
gagaatattatttaaaaagtggaa

SEQ ID NO: 7501 - DNA, 24 bp, Artificial sequence
  SiRNA target sequence
agaatattatttaaaaagtggaaa

SEQ ID NO: 7502 - DNA, 24 bp, Artificial sequence
  SiRNA target sequence
gaatattatttaaaaagtggaaat

SEQ ID NO: 7503 - DNA, 24 bp, Artificial sequence
  SiRNA target sequence
aatattatttaaaaagtggaaatc

SEQ ID NO: 7504 - DNA, 24 bp, Artificial sequence
  SiRNA target sequence
atattatttaaaaagtggaaatca

SEQ ID NO: 7505 - DNA, 24 bp, Artificial sequence
  SiRNA target sequence
tattatttaaaaagtggaaatcac

SEQ ID NO: 7506 - DNA, 24 bp, Artificial sequence
  SiRNA target sequence
attatttaaaaagtggaaatcact

SEQ ID NO: 7507 - DNA, 24 bp, Artificial sequence
  SiRNA target sequence
ttatttaaaaagtggaaatcactc

SEQ ID NO: 7508 - DNA, 24 bp, Artificial sequence
  SiRNA target sequence
tatttaaaaagtggaaatcactct

SEQ ID NO: 7509 - DNA, 24 bp, Artificial sequence
  SiRNA target sequence
atttaaaaagtggaaatcactcta

SEQ ID NO: 7510 - DNA, 24 bp, Artificial sequence
  SiRNA target sequence
tttaaaaagtggaaatcactctaa

SEQ ID NO: 7511 - DNA, 24 bp, Artificial sequence
  SiRNA target sequence
ttaaaaagtggaaatcactctaaa

SEQ ID NO: 7512 - DNA, 24 bp, Artificial sequence
  SiRNA target sequence
taaaaagtggaaatcactctaaaa

SEQ ID NO: 7513 - DNA, 24 bp, Artificial sequence
  SiRNA target sequence
aaaaagtggaaatcactctaaaat

SEQ ID NO: 7514 - DNA, 24 bp, Artificial sequence
  SiRNA target sequence
aaaagtggaaatcactctaaaatg

SEQ ID NO: 7515 - DNA, 24 bp, Artificial sequence
  SiRNA target sequence
aaagtggaaatcactctaaaatgt

SEQ ID NO: 7516 - DNA, 24 bp, Artificial sequence
  SiRNA target sequence
aagtggaaatcactctaaaatgtt

SEQ ID NO: 7517 - DNA, 24 bp, Artificial sequence
  SiRNA target sequence
agtggaaatcactctaaaatgtta

SEQ ID NO: 7518 - DNA, 24 bp, Artificial sequence
  SiRNA target sequence
gtggaaatcactctaaaatgttag

SEQ ID NO: 7519 - DNA, 24 bp, Artificial sequence
  SiRNA target sequence
tggaaatcactctaaaatgttaga

SEQ ID NO: 7520 - DNA, 24 bp, Artificial sequence
  SiRNA target sequence
ggaaatcactctaaaatgttagat

SEQ ID NO: 7521 - DNA, 24 bp, Artificial sequence
  SiRNA target sequence
gaaatcactctaaaatgttagatc

SEQ ID NO: 7522 - DNA, 24 bp, Artificial sequence
  SiRNA target sequence
aaatcactctaaaatgttagatct

SEQ ID NO: 7523 - DNA, 24 bp, Artificial sequence
  SiRNA target sequence
aatcactctaaaatgttagatcta

SEQ ID NO: 7524 - DNA, 24 bp, Artificial sequence
  SiRNA target sequence
atcactctaaaatgttagatctat

SEQ ID NO: 7525 - DNA, 24 bp, Artificial sequence
  SiRNA target sequence
tcactctaaaatgttagatctatt

SEQ ID NO: 7526 - DNA, 24 bp, Artificial sequence
  SiRNA target sequence
cactctaaaatgttagatctatta

SEQ ID NO: 7527 - DNA, 24 bp, Artificial sequence
  SiRNA target sequence
actctaaaatgttagatctattat

SEQ ID NO: 7528 - DNA, 24 bp, Artificial sequence
  SiRNA target sequence
ctctaaaatgttagatctattatc

SEQ ID NO: 7529 - DNA, 24 bp, Artificial sequence
  SiRNA target sequence
tctaaaatgttagatctattatct

SEQ ID NO: 7530 - DNA, 24 bp, Artificial sequence
  SiRNA target sequence
ctaaaatgttagatctattatcta

SEQ ID NO: 7531 - DNA, 24 bp, Artificial sequence
  SiRNA target sequence
taaaatgttagatctattatctag

SEQ ID NO: 7532 - DNA, 24 bp, Artificial sequence
  SiRNA target sequence
aaaatgttagatctattatctagt

SEQ ID NO: 7533 - DNA, 24 bp, Artificial sequence
  SiRNA target sequence
aaatgttagatctattatctagtc

SEQ ID NO: 7534 - DNA, 24 bp, Artificial sequence
  SiRNA target sequence
aatgttagatctattatctagtca

SEQ ID NO: 7535 - DNA, 24 bp, Artificial sequence
  SiRNA target sequence
atgttagatctattatctagtcat

SEQ ID NO: 7536 - DNA, 24 bp, Artificial sequence
  SiRNA target sequence
tgttagatctattatctagtcatc

SEQ ID NO: 7537 - DNA, 24 bp, Artificial sequence
  SiRNA target sequence
gttagatctattatctagtcatcc

SEQ ID NO: 7538 - DNA, 24 bp, Artificial sequence
  SiRNA target sequence
ttagatctattatctagtcatcca

SEQ ID NO: 7539 - DNA, 24 bp, Artificial sequence
  SiRNA target sequence
tagatctattatctagtcatccag

SEQ ID NO: 7540 - DNA, 24 bp, Artificial sequence
  SiRNA target sequence
agatctattatctagtcatccaga

SEQ ID NO: 7541 - DNA, 24 bp, Artificial sequence
  SiRNA target sequence
gatctattatctagtcatccagat

SEQ ID NO: 7542 - DNA, 24 bp, Artificial sequence
  SiRNA target sequence
atctattatctagtcatccagata

SEQ ID NO: 7543 - DNA, 24 bp, Artificial sequence
  SiRNA target sequence
tctattatctagtcatccagatac

SEQ ID NO: 7544 - DNA, 24 bp, Artificial sequence
  SiRNA target sequence
ctattatctagtcatccagatact

SEQ ID NO: 7545 - DNA, 24 bp, Artificial sequence
  SiRNA target sequence
tattatctagtcatccagatactc

SEQ ID NO: 7546 - DNA, 24 bp, Artificial sequence
  SiRNA target sequence
attatctagtcatccagatactcc

SEQ ID NO: 7547 - DNA, 24 bp, Artificial sequence
  SiRNA target sequence
ttatctagtcatccagatactcct

SEQ ID NO: 7548 - DNA, 24 bp, Artificial sequence
  SiRNA target sequence
tatctagtcatccagatactcctg

SEQ ID NO: 7549 - DNA, 24 bp, Artificial sequence
  SiRNA target sequence
atctagtcatccagatactcctgg

SEQ ID NO: 7550 - DNA, 24 bp, Artificial sequence
  SiRNA target sequence
tctagtcatccagatactcctggt

SEQ ID NO: 7551 - DNA, 24 bp, Artificial sequence
  SiRNA target sequence
ctagtcatccagatactcctggta

SEQ ID NO: 7552 - DNA, 24 bp, Artificial sequence
  SiRNA target sequence
tagtcatccagatactcctggtaa

SEQ ID NO: 7553 - DNA, 24 bp, Artificial sequence
  SiRNA target sequence
agtcatccagatactcctggtaaa

SEQ ID NO: 7554 - DNA, 24 bp, Artificial sequence
  SiRNA target sequence
gtcatccagatactcctggtaaat

SEQ ID NO: 7555 - DNA, 24 bp, Artificial sequence
  SiRNA target sequence
tcatccagatactcctggtaaatt

SEQ ID NO: 7556 - DNA, 24 bp, Artificial sequence
  SiRNA target sequence
catccagatactcctggtaaatta

SEQ ID NO: 7557 - DNA, 24 bp, Artificial sequence
  SiRNA target sequence
atccagatactcctggtaaattac

SEQ ID NO: 7558 - DNA, 24 bp, Artificial sequence
  SiRNA target sequence
tccagatactcctggtaaattact

SEQ ID NO: 7559 - DNA, 24 bp, Artificial sequence
  SiRNA target sequence
ccagatactcctggtaaattactt

SEQ ID NO: 7560 - DNA, 24 bp, Artificial sequence
  SiRNA target sequence
cagatactcctggtaaattacttt

SEQ ID NO: 7561 - DNA, 24 bp, Artificial sequence
  SiRNA target sequence
agatactcctggtaaattactttt

SEQ ID NO: 7562 - DNA, 24 bp, Artificial sequence
  SiRNA target sequence
gatactcctggtaaattactttta

SEQ ID NO: 7563 - DNA, 24 bp, Artificial sequence
  SiRNA target sequence
atactcctggtaaattacttttaa

SEQ ID NO: 7564 - DNA, 24 bp, Artificial sequence
  SiRNA target sequence
tactcctggtaaattacttttaac

SEQ ID NO: 7565 - DNA, 24 bp, Artificial sequence
  SiRNA target sequence
actcctggtaaattacttttaacg

SEQ ID NO: 7566 - DNA, 24 bp, Artificial sequence
  SiRNA target sequence
ctcctggtaaattacttttaacgg

SEQ ID NO: 7567 - DNA, 24 bp, Artificial sequence
  SiRNA target sequence
tcctggtaaattacttttaacggc

SEQ ID NO: 7568 - DNA, 24 bp, Artificial sequence
  SiRNA target sequence
cctggtaaattacttttaacggca

SEQ ID NO: 7569 - DNA, 24 bp, Artificial sequence
  SiRNA target sequence
ctggtaaattacttttaacggcac

SEQ ID NO: 7570 - DNA, 24 bp, Artificial sequence
  SiRNA target sequence
tggtaaattacttttaacggcact

SEQ ID NO: 7571 - DNA, 24 bp, Artificial sequence
  SiRNA target sequence
ggtaaattacttttaacggcactt

SEQ ID NO: 7572 - DNA, 24 bp, Artificial sequence
  SiRNA target sequence
gtaaattacttttaacggcacttt

SEQ ID NO: 7573 - DNA, 24 bp, Artificial sequence
  SiRNA target sequence
taaattacttttaacggcacttta

SEQ ID NO: 7574 - DNA, 24 bp, Artificial sequence
  SiRNA target sequence
aaattacttttaacggcactttat

SEQ ID NO: 7575 - DNA, 24 bp, Artificial sequence
  SiRNA target sequence
aattacttttaacggcactttatg

SEQ ID NO: 7576 - DNA, 24 bp, Artificial sequence
  SiRNA target sequence
attacttttaacggcactttatgc

SEQ ID NO: 7577 - DNA, 24 bp, Artificial sequence
  SiRNA target sequence
ttacttttaacggcactttatgca

SEQ ID NO: 7578 - DNA, 24 bp, Artificial sequence
  SiRNA target sequence
tacttttaacggcactttatgcaa

SEQ ID NO: 7579 - DNA, 24 bp, Artificial sequence
  SiRNA target sequence
acttttaacggcactttatgcaat

SEQ ID NO: 7580 - DNA, 24 bp, Artificial sequence
  SiRNA target sequence
cttttaacggcactttatgcaata

SEQ ID NO: 7581 - DNA, 24 bp, Artificial sequence
  SiRNA target sequence
ttttaacggcactttatgcaataa

SEQ ID NO: 7582 - DNA, 24 bp, Artificial sequence
  SiRNA target sequence
tttaacggcactttatgcaataag

SEQ ID NO: 7583 - DNA, 24 bp, Artificial sequence
  SiRNA target sequence
ttaacggcactttatgcaataagt

SEQ ID NO: 7584 - DNA, 24 bp, Artificial sequence
  SiRNA target sequence
taacggcactttatgcaataagta

SEQ ID NO: 7585 - DNA, 24 bp, Artificial sequence
  SiRNA target sequence
aacggcactttatgcaataagtat

SEQ ID NO: 7586 - DNA, 24 bp, Artificial sequence
  SiRNA target sequence
acggcactttatgcaataagtatt

SEQ ID NO: 7587 - DNA, 24 bp, Artificial sequence
  SiRNA target sequence
cggcactttatgcaataagtattg

SEQ ID NO: 7588 - DNA, 24 bp, Artificial sequence
  SiRNA target sequence
ggcactttatgcaataagtattga

SEQ ID NO: 7589 - DNA, 24 bp, Artificial sequence
  SiRNA target sequence
gcactttatgcaataagtattgat

SEQ ID NO: 7590 - DNA, 24 bp, Artificial sequence
  SiRNA target sequence
cactttatgcaataagtattgata

SEQ ID NO: 7591 - DNA, 24 bp, Artificial sequence
  SiRNA target sequence
actttatgcaataagtattgataa

SEQ ID NO: 7592 - DNA, 24 bp, Artificial sequence
  SiRNA target sequence
ctttatgcaataagtattgataag

SEQ ID NO: 7593 - DNA, 24 bp, Artificial sequence
  SiRNA target sequence
tttatgcaataagtattgataaga

SEQ ID NO: 7594 - DNA, 24 bp, Artificial sequence
  SiRNA target sequence
ttatgcaataagtattgataagaa

SEQ ID NO: 7595 - DNA, 24 bp, Artificial sequence
  SiRNA target sequence
tatgcaataagtattgataagaaa

SEQ ID NO: 7596 - DNA, 24 bp, Artificial sequence
  SiRNA target sequence
atgcaataagtattgataagaaaa

SEQ ID NO: 7597 - DNA, 24 bp, Artificial sequence
  SiRNA target sequence
tgcaataagtattgataagaaaaa

SEQ ID NO: 7598 - DNA, 24 bp, Artificial sequence
  SiRNA target sequence
gcaataagtattgataagaaaaag

SEQ ID NO: 7599 - DNA, 24 bp, Artificial sequence
  SiRNA target sequence
caataagtattgataagaaaaagg

SEQ ID NO: 7600 - DNA, 24 bp, Artificial sequence
  SiRNA target sequence
aataagtattgataagaaaaagga

SEQ ID NO: 7601 - DNA, 24 bp, Artificial sequence
  SiRNA target sequence
ataagtattgataagaaaaaggat

SEQ ID NO: 7602 - DNA, 24 bp, Artificial sequence
  SiRNA target sequence
taagtattgataagaaaaaggatg

SEQ ID NO: 7603 - DNA, 24 bp, Artificial sequence
  SiRNA target sequence
aagtattgataagaaaaaggatgc

SEQ ID NO: 7604 - DNA, 24 bp, Artificial sequence
  SiRNA target sequence
agtattgataagaaaaaggatgct

SEQ ID NO: 7605 - DNA, 24 bp, Artificial sequence
  SiRNA target sequence
gtattgataagaaaaaggatgcta

SEQ ID NO: 7606 - DNA, 24 bp, Artificial sequence
  SiRNA target sequence
tattgataagaaaaaggatgctat

SEQ ID NO: 7607 - DNA, 24 bp, Artificial sequence
  SiRNA target sequence
attgataagaaaaaggatgctata

SEQ ID NO: 7608 - DNA, 24 bp, Artificial sequence
  SiRNA target sequence
ttgataagaaaaaggatgctatag

SEQ ID NO: 7609 - DNA, 24 bp, Artificial sequence
  SiRNA target sequence
tgataagaaaaaggatgctataga

SEQ ID NO: 7610 - DNA, 24 bp, Artificial sequence
  SiRNA target sequence
gataagaaaaaggatgctatagaa

SEQ ID NO: 7611 - DNA, 24 bp, Artificial sequence
  SiRNA target sequence
ataagaaaaaggatgctatagaaa

SEQ ID NO: 7612 - DNA, 24 bp, Artificial sequence
  SiRNA target sequence
taagaaaaaggatgctatagaaat

SEQ ID NO: 7613 - DNA, 24 bp, Artificial sequence
  SiRNA target sequence
aagaaaaaggatgctatagaaatt

SEQ ID NO: 7614 - DNA, 24 bp, Artificial sequence
  SiRNA target sequence
agaaaaaggatgctatagaaattt

SEQ ID NO: 7615 - DNA, 24 bp, Artificial sequence
  SiRNA target sequence
gaaaaaggatgctatagaaatttt

SEQ ID NO: 7616 - DNA, 24 bp, Artificial sequence
  SiRNA target sequence
aaaaaggatgctatagaaatttta

SEQ ID NO: 7617 - DNA, 24 bp, Artificial sequence
  SiRNA target sequence
aaaaggatgctatagaaattttat

SEQ ID NO: 7618 - DNA, 24 bp, Artificial sequence
  SiRNA target sequence
aaaggatgctatagaaattttata

SEQ ID NO: 7619 - DNA, 24 bp, Artificial sequence
  SiRNA target sequence
aaggatgctatagaaattttatat

SEQ ID NO: 7620 - DNA, 24 bp, Artificial sequence
  SiRNA target sequence
aggatgctatagaaattttatata

SEQ ID NO: 7621 - DNA, 24 bp, Artificial sequence
  SiRNA target sequence
ggatgctatagaaattttatatag

SEQ ID NO: 7622 - DNA, 24 bp, Artificial sequence
  SiRNA target sequence
gatgctatagaaattttatataga

SEQ ID NO: 7623 - DNA, 24 bp, Artificial sequence
  SiRNA target sequence
atgctatagaaattttatatagaa

SEQ ID NO: 7624 - DNA, 24 bp, Artificial sequence
  SiRNA target sequence
tgctatagaaattttatatagaag

SEQ ID NO: 7625 - DNA, 24 bp, Artificial sequence
  SiRNA target sequence
gctatagaaattttatatagaagt

SEQ ID NO: 7626 - DNA, 24 bp, Artificial sequence
  SiRNA target sequence
ctatagaaattttatatagaagta

SEQ ID NO: 7627 - DNA, 24 bp, Artificial sequence
  SiRNA target sequence
tatagaaattttatatagaagtat

SEQ ID NO: 7628 - DNA, 24 bp, Artificial sequence
  SiRNA target sequence
atagaaattttatatagaagtata

SEQ ID NO: 7629 - DNA, 24 bp, Artificial sequence
  SiRNA target sequence
tagaaattttatatagaagtatat

SEQ ID NO: 7630 - DNA, 24 bp, Artificial sequence
  SiRNA target sequence
agaaattttatatagaagtatatc

SEQ ID NO: 7631 - DNA, 24 bp, Artificial sequence
  SiRNA target sequence
gaaattttatatagaagtatatca

SEQ ID NO: 7632 - DNA, 24 bp, Artificial sequence
  SiRNA target sequence
aaattttatatagaagtatatcag

SEQ ID NO: 7633 - DNA, 24 bp, Artificial sequence
  SiRNA target sequence
aattttatatagaagtatatcaga

SEQ ID NO: 7634 - DNA, 24 bp, Artificial sequence
  SiRNA target sequence
attttatatagaagtatatcagaa

SEQ ID NO: 7635 - DNA, 24 bp, Artificial sequence
  SiRNA target sequence
ttttatatagaagtatatcagaat

SEQ ID NO: 7636 - DNA, 24 bp, Artificial sequence
  SiRNA target sequence
tttatatagaagtatatcagaata

SEQ ID NO: 7637 - DNA, 24 bp, Artificial sequence
  SiRNA target sequence
ttatatagaagtatatcagaatat

SEQ ID NO: 7638 - DNA, 24 bp, Artificial sequence
  SiRNA target sequence
tatatagaagtatatcagaatatt

SEQ ID NO: 7639 - DNA, 24 bp, Artificial sequence
  SiRNA target sequence
atatagaagtatatcagaatattc

SEQ ID NO: 7640 - DNA, 24 bp, Artificial sequence
  SiRNA target sequence
tatagaagtatatcagaatattca

SEQ ID NO: 7641 - DNA, 24 bp, Artificial sequence
  SiRNA target sequence
atagaagtatatcagaatattcat

SEQ ID NO: 7642 - DNA, 24 bp, Artificial sequence
  SiRNA target sequence
tagaagtatatcagaatattcatc

SEQ ID NO: 7643 - DNA, 24 bp, Artificial sequence
  SiRNA target sequence
agaagtatatcagaatattcatct

SEQ ID NO: 7644 - DNA, 24 bp, Artificial sequence
  SiRNA target sequence
gaagtatatcagaatattcatctt

SEQ ID NO: 7645 - DNA, 24 bp, Artificial sequence
  SiRNA target sequence
aagtatatcagaatattcatctta

SEQ ID NO: 7646 - DNA, 24 bp, Artificial sequence
  SiRNA target sequence
agtatatcagaatattcatcttat

SEQ ID NO: 7647 - DNA, 24 bp, Artificial sequence
  SiRNA target sequence
gtatatcagaatattcatcttatt

SEQ ID NO: 7648 - DNA, 24 bp, Artificial sequence
  SiRNA target sequence
tatatcagaatattcatcttattt

SEQ ID NO: 7649 - DNA, 24 bp, Artificial sequence
  SiRNA target sequence
atatcagaatattcatcttatttt

SEQ ID NO: 7650 - DNA, 24 bp, Artificial sequence
  SiRNA target sequence
tatcagaatattcatcttatttta

SEQ ID NO: 7651 - DNA, 24 bp, Artificial sequence
  SiRNA target sequence
atcagaatattcatcttattttaa

SEQ ID NO: 7652 - DNA, 24 bp, Artificial sequence
  SiRNA target sequence
tcagaatattcatcttattttaaa

SEQ ID NO: 7653 - DNA, 24 bp, Artificial sequence
  SiRNA target sequence
cagaatattcatcttattttaaat

SEQ ID NO: 7654 - DNA, 24 bp, Artificial sequence
  SiRNA target sequence
agaatattcatcttattttaaatc

SEQ ID NO: 7655 - DNA, 24 bp, Artificial sequence
  SiRNA target sequence
gaatattcatcttattttaaatct

SEQ ID NO: 7656 - DNA, 24 bp, Artificial sequence
  SiRNA target sequence
aatattcatcttattttaaatctt

SEQ ID NO: 7657 - DNA, 24 bp, Artificial sequence
  SiRNA target sequence
atattcatcttattttaaatctta

SEQ ID NO: 7658 - DNA, 24 bp, Artificial sequence
  SiRNA target sequence
tattcatcttattttaaatcttat

SEQ ID NO: 7659 - DNA, 24 bp, Artificial sequence
  SiRNA target sequence
attcatcttattttaaatcttatt

SEQ ID NO: 7660 - DNA, 24 bp, Artificial sequence
  SiRNA target sequence
ttcatcttattttaaatcttattt

SEQ ID NO: 7661 - DNA, 24 bp, Artificial sequence
  SiRNA target sequence
tcatcttattttaaatcttatttg

SEQ ID NO: 7662 - DNA, 24 bp, Artificial sequence
  SiRNA target sequence
catcttattttaaatcttatttgt

SEQ ID NO: 7663 - DNA, 24 bp, Artificial sequence
  SiRNA target sequence
atcttattttaaatcttatttgta

SEQ ID NO: 7664 - DNA, 24 bp, Artificial sequence
  SiRNA target sequence
tcttattttaaatcttatttgtat

SEQ ID NO: 7665 - DNA, 24 bp, Artificial sequence
  SiRNA target sequence
cttattttaaatcttatttgtatt

SEQ ID NO: 7666 - DNA, 24 bp, Artificial sequence
  SiRNA target sequence
ttattttaaatcttatttgtattt

SEQ ID NO: 7667 - DNA, 24 bp, Artificial sequence
  SiRNA target sequence
tattttaaatcttatttgtattta

SEQ ID NO: 7668 - DNA, 24 bp, Artificial sequence
  SiRNA target sequence
attttaaatcttatttgtatttag

SEQ ID NO: 7669 - DNA, 24 bp, Artificial sequence
  SiRNA target sequence
ttttaaatcttatttgtatttagg

SEQ ID NO: 7670 - DNA, 24 bp, Artificial sequence
  SiRNA target sequence
tttaaatcttatttgtatttagga

SEQ ID NO: 7671 - DNA, 24 bp, Artificial sequence
  SiRNA target sequence
ttaaatcttatttgtatttaggaa

SEQ ID NO: 7672 - DNA, 24 bp, Artificial sequence
  SiRNA target sequence
taaatcttatttgtatttaggaaa

SEQ ID NO: 7673 - DNA, 24 bp, Artificial sequence
  SiRNA target sequence
aaatcttatttgtatttaggaaat

SEQ ID NO: 7674 - DNA, 24 bp, Artificial sequence
  SiRNA target sequence
aatcttatttgtatttaggaaata

SEQ ID NO: 7675 - DNA, 24 bp, Artificial sequence
  SiRNA target sequence
atcttatttgtatttaggaaatat

SEQ ID NO: 7676 - DNA, 24 bp, Artificial sequence
  SiRNA target sequence
tcttatttgtatttaggaaatatt

SEQ ID NO: 7677 - DNA, 24 bp, Artificial sequence
  SiRNA target sequence
cttatttgtatttaggaaatattt

SEQ ID NO: 7678 - DNA, 24 bp, Artificial sequence
  SiRNA target sequence
ttatttgtatttaggaaatatttt

SEQ ID NO: 7679 - DNA, 24 bp, Artificial sequence
  SiRNA target sequence
tatttgtatttaggaaatatttta

SEQ ID NO: 7680 - DNA, 24 bp, Artificial sequence
  SiRNA target sequence
atttgtatttaggaaatattttaa

SEQ ID NO: 7681 - DNA, 24 bp, Artificial sequence
  SiRNA target sequence
tttgtatttaggaaatattttaat

SEQ ID NO: 7682 - DNA, 24 bp, Artificial sequence
  SiRNA target sequence
ttgtatttaggaaatattttaata

SEQ ID NO: 7683 - DNA, 24 bp, Artificial sequence
  SiRNA target sequence
tgtatttaggaaatattttaataa

SEQ ID NO: 7684 - DNA, 24 bp, Artificial sequence
  SiRNA target sequence
gtatttaggaaatattttaataaa

SEQ ID NO: 7685 - DNA, 24 bp, Artificial sequence
  SiRNA target sequence
tatttaggaaatattttaataaat

SEQ ID NO: 7686 - DNA, 24 bp, Artificial sequence
  SiRNA target sequence
atttaggaaatattttaataaatg

SEQ ID NO: 7687 - DNA, 24 bp, Artificial sequence
  SiRNA target sequence
tttaggaaatattttaataaatga

SEQ ID NO: 7688 - DNA, 24 bp, Artificial sequence
  SiRNA target sequence
ttaggaaatattttaataaatgat

SEQ ID NO: 7689 - DNA, 24 bp, Artificial sequence
  SiRNA target sequence
taggaaatattttaataaatgatg

SEQ ID NO: 7690 - DNA, 24 bp, Artificial sequence
  SiRNA target sequence
aggaaatattttaataaatgatga

SEQ ID NO: 7691 - DNA, 24 bp, Artificial sequence
  SiRNA target sequence
ggaaatattttaataaatgatgac

SEQ ID NO: 7692 - DNA, 24 bp, Artificial sequence
  SiRNA target sequence
gaaatattttaataaatgatgact

SEQ ID NO: 7693 - DNA, 24 bp, Artificial sequence
  SiRNA target sequence
aaatattttaataaatgatgactt

SEQ ID NO: 7694 - DNA, 24 bp, Artificial sequence
  SiRNA target sequence
aatattttaataaatgatgactta

SEQ ID NO: 7695 - DNA, 24 bp, Artificial sequence
  SiRNA target sequence
atattttaataaatgatgacttaa

SEQ ID NO: 7696 - DNA, 24 bp, Artificial sequence
  SiRNA target sequence
tattttaataaatgatgacttaaa

SEQ ID NO: 7697 - DNA, 24 bp, Artificial sequence
  SiRNA target sequence
attttaataaatgatgacttaaat

SEQ ID NO: 7698 - DNA, 24 bp, Artificial sequence
  SiRNA target sequence
ttttaataaatgatgacttaaatg

SEQ ID NO: 7699 - DNA, 24 bp, Artificial sequence
  SiRNA target sequence
tttaataaatgatgacttaaatga

SEQ ID NO: 7700 - DNA, 24 bp, Artificial sequence
  SiRNA target sequence
ttaataaatgatgacttaaatgaa

SEQ ID NO: 7701 - DNA, 24 bp, Artificial sequence
  SiRNA target sequence
taataaatgatgacttaaatgaat

SEQ ID NO: 7702 - DNA, 24 bp, Artificial sequence
  SiRNA target sequence
aataaatgatgacttaaatgaatg

SEQ ID NO: 7703 - DNA, 24 bp, Artificial sequence
  SiRNA target sequence
ataaatgatgacttaaatgaatgc

SEQ ID NO: 7704 - DNA, 24 bp, Artificial sequence
  SiRNA target sequence
taaatgatgacttaaatgaatgca

SEQ ID NO: 7705 - DNA, 24 bp, Artificial sequence
  SiRNA target sequence
aaatgatgacttaaatgaatgcag

SEQ ID NO: 7706 - DNA, 24 bp, Artificial sequence
  SiRNA target sequence
aatgatgacttaaatgaatgcagg

SEQ ID NO: 7707 - DNA, 24 bp, Artificial sequence
  SiRNA target sequence
atgatgacttaaatgaatgcagga

SEQ ID NO: 7708 - DNA, 24 bp, Artificial sequence
  SiRNA target sequence
tgatgacttaaatgaatgcaggaa

SEQ ID NO: 7709 - DNA, 24 bp, Artificial sequence
  SiRNA target sequence
gatgacttaaatgaatgcaggaaa

SEQ ID NO: 7710 - DNA, 24 bp, Artificial sequence
  SiRNA target sequence
atgacttaaatgaatgcaggaaat

SEQ ID NO: 7711 - DNA, 24 bp, Artificial sequence
  SiRNA target sequence
tgacttaaatgaatgcaggaaatt

SEQ ID NO: 7712 - DNA, 24 bp, Artificial sequence
  SiRNA target sequence
gacttaaatgaatgcaggaaattg

SEQ ID NO: 7713 - DNA, 24 bp, Artificial sequence
  SiRNA target sequence
acttaaatgaatgcaggaaattgt

SEQ ID NO: 7714 - DNA, 24 bp, Artificial sequence
  SiRNA target sequence
cttaaatgaatgcaggaaattgtt

SEQ ID NO: 7715 - DNA, 24 bp, Artificial sequence
  SiRNA target sequence
ttaaatgaatgcaggaaattgttt

SEQ ID NO: 7716 - DNA, 24 bp, Artificial sequence
  SiRNA target sequence
taaatgaatgcaggaaattgttta

SEQ ID NO: 7717 - DNA, 24 bp, Artificial sequence
  SiRNA target sequence
aaatgaatgcaggaaattgtttaa

SEQ ID NO: 7718 - DNA, 24 bp, Artificial sequence
  SiRNA target sequence
aatgaatgcaggaaattgtttaat

SEQ ID NO: 7719 - DNA, 24 bp, Artificial sequence
  SiRNA target sequence
atgaatgcaggaaattgtttaata

SEQ ID NO: 7720 - DNA, 24 bp, Artificial sequence
  SiRNA target sequence
tgaatgcaggaaattgtttaatac

SEQ ID NO: 7721 - DNA, 24 bp, Artificial sequence
  SiRNA target sequence
gaatgcaggaaattgtttaataca

SEQ ID NO: 7722 - DNA, 24 bp, Artificial sequence
  SiRNA target sequence
aatgcaggaaattgtttaatacat

SEQ ID NO: 7723 - DNA, 24 bp, Artificial sequence
  SiRNA target sequence
atgcaggaaattgtttaatacatc

SEQ ID NO: 7724 - DNA, 24 bp, Artificial sequence
  SiRNA target sequence
tgcaggaaattgtttaatacatca

SEQ ID NO: 7725 - DNA, 24 bp, Artificial sequence
  SiRNA target sequence
gcaggaaattgtttaatacatcac

SEQ ID NO: 7726 - DNA, 24 bp, Artificial sequence
  SiRNA target sequence
caggaaattgtttaatacatcact

SEQ ID NO: 7727 - DNA, 24 bp, Artificial sequence
  SiRNA target sequence
aggaaattgtttaatacatcactt

SEQ ID NO: 7728 - DNA, 24 bp, Artificial sequence
  SiRNA target sequence
ggaaattgtttaatacatcacttc

SEQ ID NO: 7729 - DNA, 24 bp, Artificial sequence
  SiRNA target sequence
gaaattgtttaatacatcacttca

SEQ ID NO: 7730 - DNA, 24 bp, Artificial sequence
  SiRNA target sequence
aaattgtttaatacatcacttcaa

SEQ ID NO: 7731 - DNA, 24 bp, Artificial sequence
  SiRNA target sequence
aattgtttaatacatcacttcaat

SEQ ID NO: 7732 - DNA, 24 bp, Artificial sequence
  SiRNA target sequence
attgtttaatacatcacttcaata

SEQ ID NO: 7733 - DNA, 24 bp, Artificial sequence
  SiRNA target sequence
ttgtttaatacatcacttcaatat

SEQ ID NO: 7734 - DNA, 24 bp, Artificial sequence
  SiRNA target sequence
tgtttaatacatcacttcaatatt

SEQ ID NO: 7735 - DNA, 24 bp, Artificial sequence
  SiRNA target sequence
gtttaatacatcacttcaatattg

SEQ ID NO: 7736 - DNA, 24 bp, Artificial sequence
  SiRNA target sequence
tttaatacatcacttcaatattgt

SEQ ID NO: 7737 - DNA, 24 bp, Artificial sequence
  SiRNA target sequence
ttaatacatcacttcaatattgtt

SEQ ID NO: 7738 - DNA, 24 bp, Artificial sequence
  SiRNA target sequence
taatacatcacttcaatattgttg

SEQ ID NO: 7739 - DNA, 24 bp, Artificial sequence
  SiRNA target sequence
aatacatcacttcaatattgttgt

SEQ ID NO: 7740 - DNA, 24 bp, Artificial sequence
  SiRNA target sequence
atacatcacttcaatattgttgta

SEQ ID NO: 7741 - DNA, 24 bp, Artificial sequence
  SiRNA target sequence
tacatcacttcaatattgttgtaa

SEQ ID NO: 7742 - DNA, 24 bp, Artificial sequence
  SiRNA target sequence
acatcacttcaatattgttgtaat

SEQ ID NO: 7743 - DNA, 24 bp, Artificial sequence
  SiRNA target sequence
catcacttcaatattgttgtaatt

SEQ ID NO: 7744 - DNA, 24 bp, Artificial sequence
  SiRNA target sequence
atcacttcaatattgttgtaattc

SEQ ID NO: 7745 - DNA, 24 bp, Artificial sequence
  SiRNA target sequence
tcacttcaatattgttgtaattct

SEQ ID NO: 7746 - DNA, 24 bp, Artificial sequence
  SiRNA target sequence
cacttcaatattgttgtaattctg

SEQ ID NO: 7747 - DNA, 24 bp, Artificial sequence
  SiRNA target sequence
acttcaatattgttgtaattctga

SEQ ID NO: 7748 - DNA, 24 bp, Artificial sequence
  SiRNA target sequence
cttcaatattgttgtaattctgat

SEQ ID NO: 7749 - DNA, 24 bp, Artificial sequence
  SiRNA target sequence
ttcaatattgttgtaattctgatg

SEQ ID NO: 7750 - DNA, 24 bp, Artificial sequence
  SiRNA target sequence
tcaatattgttgtaattctgatga

SEQ ID NO: 7751 - DNA, 24 bp, Artificial sequence
  SiRNA target sequence
caatattgttgtaattctgatgag

SEQ ID NO: 7752 - DNA, 24 bp, Artificial sequence
  SiRNA target sequence
aatattgttgtaattctgatgagg

SEQ ID NO: 7753 - DNA, 24 bp, Artificial sequence
  SiRNA target sequence
atattgttgtaattctgatgaggt

SEQ ID NO: 7754 - DNA, 24 bp, Artificial sequence
  SiRNA target sequence
tattgttgtaattctgatgaggtt

SEQ ID NO: 7755 - DNA, 24 bp, Artificial sequence
  SiRNA target sequence
attgttgtaattctgatgaggttt

SEQ ID NO: 7756 - DNA, 24 bp, Artificial sequence
  SiRNA target sequence
ttgttgtaattctgatgaggtttt

SEQ ID NO: 7757 - DNA, 24 bp, Artificial sequence
  SiRNA target sequence
tgttgtaattctgatgaggttttt

SEQ ID NO: 7758 - DNA, 24 bp, Artificial sequence
  SiRNA target sequence
gttgtaattctgatgaggttttta

SEQ ID NO: 7759 - DNA, 24 bp, Artificial sequence
  SiRNA target sequence
ttgtaattctgatgaggtttttat

SEQ ID NO: 7760 - DNA, 24 bp, Artificial sequence
  SiRNA target sequence
tgtaattctgatgaggtttttatt

SEQ ID NO: 7761 - DNA, 24 bp, Artificial sequence
  SiRNA target sequence
gtaattctgatgaggtttttattg

SEQ ID NO: 7762 - DNA, 24 bp, Artificial sequence
  SiRNA target sequence
taattctgatgaggtttttattgt

SEQ ID NO: 7763 - DNA, 24 bp, Artificial sequence
  SiRNA target sequence
aattctgatgaggtttttattgtt

SEQ ID NO: 7764 - DNA, 24 bp, Artificial sequence
  SiRNA target sequence
attctgatgaggtttttattgtta

SEQ ID NO: 7765 - DNA, 24 bp, Artificial sequence
  SiRNA target sequence
ttctgatgaggtttttattgttaa

SEQ ID NO: 7766 - DNA, 24 bp, Artificial sequence
  SiRNA target sequence
tctgatgaggtttttattgttaag

SEQ ID NO: 7767 - DNA, 24 bp, Artificial sequence
  SiRNA target sequence
ctgatgaggtttttattgttaagc

SEQ ID NO: 7768 - DNA, 24 bp, Artificial sequence
  SiRNA target sequence
tgatgaggtttttattgttaagca

SEQ ID NO: 7769 - DNA, 24 bp, Artificial sequence
  SiRNA target sequence
gatgaggtttttattgttaagcag

SEQ ID NO: 7770 - DNA, 24 bp, Artificial sequence
  SiRNA target sequence
atgaggtttttattgttaagcagt

SEQ ID NO: 7771 - DNA, 24 bp, Artificial sequence
  SiRNA target sequence
tgaggtttttattgttaagcagtc

SEQ ID NO: 7772 - DNA, 24 bp, Artificial sequence
  SiRNA target sequence
gaggtttttattgttaagcagtca

SEQ ID NO: 7773 - DNA, 24 bp, Artificial sequence
  SiRNA target sequence
aggtttttattgttaagcagtcac

SEQ ID NO: 7774 - DNA, 24 bp, Artificial sequence
  SiRNA target sequence
ggtttttattgttaagcagtcact

SEQ ID NO: 7775 - DNA, 24 bp, Artificial sequence
  SiRNA target sequence
gtttttattgttaagcagtcactt

SEQ ID NO: 7776 - DNA, 24 bp, Artificial sequence
  SiRNA target sequence
tttttattgttaagcagtcactta

SEQ ID NO: 7777 - DNA, 24 bp, Artificial sequence
  SiRNA target sequence
ttttattgttaagcagtcacttat

SEQ ID NO: 7778 - DNA, 24 bp, Artificial sequence
  SiRNA target sequence
tttattgttaagcagtcacttatt

SEQ ID NO: 7779 - DNA, 24 bp, Artificial sequence
  SiRNA target sequence
ttattgttaagcagtcacttattt

SEQ ID NO: 7780 - DNA, 24 bp, Artificial sequence
  SiRNA target sequence
tattgttaagcagtcacttatttt

SEQ ID NO: 7781 - DNA, 24 bp, Artificial sequence
  SiRNA target sequence
attgttaagcagtcacttatttta

SEQ ID NO: 7782 - DNA, 24 bp, Artificial sequence
  SiRNA target sequence
ttgttaagcagtcacttattttaa

SEQ ID NO: 7783 - DNA, 24 bp, Artificial sequence
  SiRNA target sequence
tgttaagcagtcacttattttaat

SEQ ID NO: 7784 - DNA, 24 bp, Artificial sequence
  SiRNA target sequence
gttaagcagtcacttattttaata

SEQ ID NO: 7785 - DNA, 24 bp, Artificial sequence
  SiRNA target sequence
ttaagcagtcacttattttaatag

SEQ ID NO: 7786 - DNA, 24 bp, Artificial sequence
  SiRNA target sequence
taagcagtcacttattttaataga

SEQ ID NO: 7787 - DNA, 24 bp, Artificial sequence
  SiRNA target sequence
aagcagtcacttattttaatagaa

SEQ ID NO: 7788 - DNA, 24 bp, Artificial sequence
  SiRNA target sequence
agcagtcacttattttaatagaag

SEQ ID NO: 7789 - DNA, 24 bp, Artificial sequence
  SiRNA target sequence
gcagtcacttattttaatagaagt

SEQ ID NO: 7790 - DNA, 24 bp, Artificial sequence
  SiRNA target sequence
cagtcacttattttaatagaagta

SEQ ID NO: 7791 - DNA, 24 bp, Artificial sequence
  SiRNA target sequence
agtcacttattttaatagaagtac

SEQ ID NO: 7792 - DNA, 24 bp, Artificial sequence
  SiRNA target sequence
gtcacttattttaatagaagtaca

SEQ ID NO: 7793 - DNA, 24 bp, Artificial sequence
  SiRNA target sequence
tcacttattttaatagaagtacat

SEQ ID NO: 7794 - DNA, 24 bp, Artificial sequence
  SiRNA target sequence
cacttattttaatagaagtacatg

SEQ ID NO: 7795 - DNA, 24 bp, Artificial sequence
  SiRNA target sequence
acttattttaatagaagtacatga

SEQ ID NO: 7796 - DNA, 24 bp, Artificial sequence
  SiRNA target sequence
cttattttaatagaagtacatgaa

SEQ ID NO: 7797 - DNA, 24 bp, Artificial sequence
  SiRNA target sequence
ttattttaatagaagtacatgaat

SEQ ID NO: 7798 - DNA, 24 bp, Artificial sequence
  SiRNA target sequence
tattttaatagaagtacatgaata

SEQ ID NO: 7799 - DNA, 24 bp, Artificial sequence
  SiRNA target sequence
attttaatagaagtacatgaatac

SEQ ID NO: 7800 - DNA, 24 bp, Artificial sequence
  SiRNA target sequence
ttttaatagaagtacatgaataca

SEQ ID NO: 7801 - DNA, 24 bp, Artificial sequence
  SiRNA target sequence
tttaatagaagtacatgaatacat

SEQ ID NO: 7802 - DNA, 24 bp, Artificial sequence
  SiRNA target sequence
ttaatagaagtacatgaatacatc

SEQ ID NO: 7803 - DNA, 24 bp, Artificial sequence
  SiRNA target sequence
taatagaagtacatgaatacatca

SEQ ID NO: 7804 - DNA, 24 bp, Artificial sequence
  SiRNA target sequence
aatagaagtacatgaatacatcaa

SEQ ID NO: 7805 - DNA, 24 bp, Artificial sequence
  SiRNA target sequence
atagaagtacatgaatacatcaaa

SEQ ID NO: 7806 - DNA, 24 bp, Artificial sequence
  SiRNA target sequence
tagaagtacatgaatacatcaaag

SEQ ID NO: 7807 - DNA, 24 bp, Artificial sequence
  SiRNA target sequence
agaagtacatgaatacatcaaaga

SEQ ID NO: 7808 - DNA, 24 bp, Artificial sequence
  SiRNA target sequence
gaagtacatgaatacatcaaagaa

SEQ ID NO: 7809 - DNA, 24 bp, Artificial sequence
  SiRNA target sequence
aagtacatgaatacatcaaagaaa

SEQ ID NO: 7810 - DNA, 24 bp, Artificial sequence
  SiRNA target sequence
agtacatgaatacatcaaagaaaa

SEQ ID NO: 7811 - DNA, 24 bp, Artificial sequence
  SiRNA target sequence
gtacatgaatacatcaaagaaaat

SEQ ID NO: 7812 - DNA, 24 bp, Artificial sequence
  SiRNA target sequence
tacatgaatacatcaaagaaaata

SEQ ID NO: 7813 - DNA, 24 bp, Artificial sequence
  SiRNA target sequence
acatgaatacatcaaagaaaataa

SEQ ID NO: 7814 - DNA, 24 bp, Artificial sequence
  SiRNA target sequence
catgaatacatcaaagaaaataaa

SEQ ID NO: 7815 - DNA, 24 bp, Artificial sequence
  SiRNA target sequence
atgaatacatcaaagaaaataaaa

SEQ ID NO: 7816 - DNA, 24 bp, Artificial sequence
  SiRNA target sequence
tgaatacatcaaagaaaataaaat

SEQ ID NO: 7817 - DNA, 24 bp, Artificial sequence
  SiRNA target sequence
gaatacatcaaagaaaataaaata

SEQ ID NO: 7818 - DNA, 24 bp, Artificial sequence
  SiRNA target sequence
aatacatcaaagaaaataaaatat

SEQ ID NO: 7819 - DNA, 24 bp, Artificial sequence
  SiRNA target sequence
atacatcaaagaaaataaaatata

SEQ ID NO: 7820 - DNA, 24 bp, Artificial sequence
  SiRNA target sequence
tacatcaaagaaaataaaatataa

SEQ ID NO: 7821 - DNA, 25 bp, Artificial sequence
  SiRNA target sequence
atgaaacgaaaaacagaaatattta

SEQ ID NO: 7822 - DNA, 25 bp, Artificial sequence
  SiRNA target sequence
tgaaacgaaaaacagaaatatttat

SEQ ID NO: 7823 - DNA, 25 bp, Artificial sequence
  SiRNA target sequence
gaaacgaaaaacagaaatatttatt

SEQ ID NO: 7824 - DNA, 25 bp, Artificial sequence
  SiRNA target sequence
aaacgaaaaacagaaatatttattg

SEQ ID NO: 7825 - DNA, 25 bp, Artificial sequence
  SiRNA target sequence
aacgaaaaacagaaatatttattgc

SEQ ID NO: 7826 - DNA, 25 bp, Artificial sequence
  SiRNA target sequence
acgaaaaacagaaatatttattgct

SEQ ID NO: 7827 - DNA, 25 bp, Artificial sequence
  SiRNA target sequence
cgaaaaacagaaatatttattgcta

SEQ ID NO: 7828 - DNA, 25 bp, Artificial sequence
  SiRNA target sequence
gaaaaacagaaatatttattgctat

SEQ ID NO: 7829 - DNA, 25 bp, Artificial sequence
  SiRNA target sequence
aaaaacagaaatatttattgctatt

SEQ ID NO: 7830 - DNA, 25 bp, Artificial sequence
  SiRNA target sequence
aaaacagaaatatttattgctatta

SEQ ID NO: 7831 - DNA, 25 bp, Artificial sequence
  SiRNA target sequence
aaacagaaatatttattgctattac

SEQ ID NO: 7832 - DNA, 25 bp, Artificial sequence
  SiRNA target sequence
aacagaaatatttattgctattaca

SEQ ID NO: 7833 - DNA, 25 bp, Artificial sequence
  SiRNA target sequence
acagaaatatttattgctattacag

SEQ ID NO: 7834 - DNA, 25 bp, Artificial sequence
  SiRNA target sequence
cagaaatatttattgctattacagt

SEQ ID NO: 7835 - DNA, 25 bp, Artificial sequence
  SiRNA target sequence
agaaatatttattgctattacagta

SEQ ID NO: 7836 - DNA, 25 bp, Artificial sequence
  SiRNA target sequence
gaaatatttattgctattacagtag

SEQ ID NO: 7837 - DNA, 25 bp, Artificial sequence
  SiRNA target sequence
aaatatttattgctattacagtagt

SEQ ID NO: 7838 - DNA, 25 bp, Artificial sequence
  SiRNA target sequence
aatatttattgctattacagtagtc

SEQ ID NO: 7839 - DNA, 25 bp, Artificial sequence
  SiRNA target sequence
atatttattgctattacagtagtca

SEQ ID NO: 7840 - DNA, 25 bp, Artificial sequence
  SiRNA target sequence
tatttattgctattacagtagtcac

SEQ ID NO: 7841 - DNA, 25 bp, Artificial sequence
  SiRNA target sequence
atttattgctattacagtagtcact

SEQ ID NO: 7842 - DNA, 25 bp, Artificial sequence
  SiRNA target sequence
tttattgctattacagtagtcactg

SEQ ID NO: 7843 - DNA, 25 bp, Artificial sequence
  SiRNA target sequence
ttattgctattacagtagtcactgc

SEQ ID NO: 7844 - DNA, 25 bp, Artificial sequence
  SiRNA target sequence
tattgctattacagtagtcactgca

SEQ ID NO: 7845 - DNA, 25 bp, Artificial sequence
  SiRNA target sequence
attgctattacagtagtcactgcag

SEQ ID NO: 7846 - DNA, 25 bp, Artificial sequence
  SiRNA target sequence
ttgctattacagtagtcactgcagt

SEQ ID NO: 7847 - DNA, 25 bp, Artificial sequence
  SiRNA target sequence
tgctattacagtagtcactgcagtg

SEQ ID NO: 7848 - DNA, 25 bp, Artificial sequence
  SiRNA target sequence
gctattacagtagtcactgcagtga

SEQ ID NO: 7849 - DNA, 25 bp, Artificial sequence
  SiRNA target sequence
ctattacagtagtcactgcagtgac

SEQ ID NO: 7850 - DNA, 25 bp, Artificial sequence
  SiRNA target sequence
tattacagtagtcactgcagtgaca

SEQ ID NO: 7851 - DNA, 25 bp, Artificial sequence
  SiRNA target sequence
attacagtagtcactgcagtgacat

SEQ ID NO: 7852 - DNA, 25 bp, Artificial sequence
  SiRNA target sequence
ttacagtagtcactgcagtgacatg

SEQ ID NO: 7853 - DNA, 25 bp, Artificial sequence
  SiRNA target sequence
tacagtagtcactgcagtgacatgt

SEQ ID NO: 7854 - DNA, 25 bp, Artificial sequence
  SiRNA target sequence
acagtagtcactgcagtgacatgtt

SEQ ID NO: 7855 - DNA, 25 bp, Artificial sequence
  SiRNA target sequence
cagtagtcactgcagtgacatgtta

SEQ ID NO: 7856 - DNA, 25 bp, Artificial sequence
  SiRNA target sequence
agtagtcactgcagtgacatgttac

SEQ ID NO: 7857 - DNA, 25 bp, Artificial sequence
  SiRNA target sequence
gtagtcactgcagtgacatgttact

SEQ ID NO: 7858 - DNA, 25 bp, Artificial sequence
  SiRNA target sequence
tagtcactgcagtgacatgttactt

SEQ ID NO: 7859 - DNA, 25 bp, Artificial sequence
  SiRNA target sequence
agtcactgcagtgacatgttactta

SEQ ID NO: 7860 - DNA, 25 bp, Artificial sequence
  SiRNA target sequence
gtcactgcagtgacatgttacttat

SEQ ID NO: 7861 - DNA, 25 bp, Artificial sequence
  SiRNA target sequence
tcactgcagtgacatgttacttatt

SEQ ID NO: 7862 - DNA, 25 bp, Artificial sequence
  SiRNA target sequence
cactgcagtgacatgttacttattt

SEQ ID NO: 7863 - DNA, 25 bp, Artificial sequence
  SiRNA target sequence
actgcagtgacatgttacttattta

SEQ ID NO: 7864 - DNA, 25 bp, Artificial sequence
  SiRNA target sequence
ctgcagtgacatgttacttatttaa

SEQ ID NO: 7865 - DNA, 25 bp, Artificial sequence
  SiRNA target sequence
tgcagtgacatgttacttatttaaa

SEQ ID NO: 7866 - DNA, 25 bp, Artificial sequence
  SiRNA target sequence
gcagtgacatgttacttatttaaaa

SEQ ID NO: 7867 - DNA, 25 bp, Artificial sequence
  SiRNA target sequence
cagtgacatgttacttatttaaaaa

SEQ ID NO: 7868 - DNA, 25 bp, Artificial sequence
  SiRNA target sequence
agtgacatgttacttatttaaaaaa

SEQ ID NO: 7869 - DNA, 25 bp, Artificial sequence
  SiRNA target sequence
gtgacatgttacttatttaaaaaaa

SEQ ID NO: 7870 - DNA, 25 bp, Artificial sequence
  SiRNA target sequence
tgacatgttacttatttaaaaaaat

SEQ ID NO: 7871 - DNA, 25 bp, Artificial sequence
  SiRNA target sequence
gacatgttacttatttaaaaaaata

SEQ ID NO: 7872 - DNA, 25 bp, Artificial sequence
  SiRNA target sequence
acatgttacttatttaaaaaaataa

SEQ ID NO: 7873 - DNA, 25 bp, Artificial sequence
  SiRNA target sequence
catgttacttatttaaaaaaataat

SEQ ID NO: 7874 - DNA, 25 bp, Artificial sequence
  SiRNA target sequence
atgttacttatttaaaaaaataata

SEQ ID NO: 7875 - DNA, 25 bp, Artificial sequence
  SiRNA target sequence
tgttacttatttaaaaaaataataa

SEQ ID NO: 7876 - DNA, 25 bp, Artificial sequence
  SiRNA target sequence
gttacttatttaaaaaaataataaa

SEQ ID NO: 7877 - DNA, 25 bp, Artificial sequence
  SiRNA target sequence
ttacttatttaaaaaaataataaat

SEQ ID NO: 7878 - DNA, 25 bp, Artificial sequence
  SiRNA target sequence
tacttatttaaaaaaataataaata

SEQ ID NO: 7879 - DNA, 25 bp, Artificial sequence
  SiRNA target sequence
acttatttaaaaaaataataaatag

SEQ ID NO: 7880 - DNA, 25 bp, Artificial sequence
  SiRNA target sequence
cttatttaaaaaaataataaataga

SEQ ID NO: 7881 - DNA, 25 bp, Artificial sequence
  SiRNA target sequence
ttatttaaaaaaataataaatagac

SEQ ID NO: 7882 - DNA, 25 bp, Artificial sequence
  SiRNA target sequence
tatttaaaaaaataataaatagaca

SEQ ID NO: 7883 - DNA, 25 bp, Artificial sequence
  SiRNA target sequence
atttaaaaaaataataaatagacaa

SEQ ID NO: 7884 - DNA, 25 bp, Artificial sequence
  SiRNA target sequence
tttaaaaaaataataaatagacaaa

SEQ ID NO: 7885 - DNA, 25 bp, Artificial sequence
  SiRNA target sequence
ttaaaaaaataataaatagacaaaa

SEQ ID NO: 7886 - DNA, 25 bp, Artificial sequence
  SiRNA target sequence
taaaaaaataataaatagacaaaag

SEQ ID NO: 7887 - DNA, 25 bp, Artificial sequence
  SiRNA target sequence
aaaaaaataataaatagacaaaagt

SEQ ID NO: 7888 - DNA, 25 bp, Artificial sequence
  SiRNA target sequence
aaaaaataataaatagacaaaagtc

SEQ ID NO: 7889 - DNA, 25 bp, Artificial sequence
  SiRNA target sequence
aaaaataataaatagacaaaagtct

SEQ ID NO: 7890 - DNA, 25 bp, Artificial sequence
  SiRNA target sequence
aaaataataaatagacaaaagtctg

SEQ ID NO: 7891 - DNA, 25 bp, Artificial sequence
  SiRNA target sequence
aaataataaatagacaaaagtctga

SEQ ID NO: 7892 - DNA, 25 bp, Artificial sequence
  SiRNA target sequence
aataataaatagacaaaagtctgat

SEQ ID NO: 7893 - DNA, 25 bp, Artificial sequence
  SiRNA target sequence
ataataaatagacaaaagtctgatt

SEQ ID NO: 7894 - DNA, 25 bp, Artificial sequence
  SiRNA target sequence
taataaatagacaaaagtctgatta

SEQ ID NO: 7895 - DNA, 25 bp, Artificial sequence
  SiRNA target sequence
aataaatagacaaaagtctgattat

SEQ ID NO: 7896 - DNA, 25 bp, Artificial sequence
  SiRNA target sequence
ataaatagacaaaagtctgattata

SEQ ID NO: 7897 - DNA, 25 bp, Artificial sequence
  SiRNA target sequence
taaatagacaaaagtctgattatac

SEQ ID NO: 7898 - DNA, 25 bp, Artificial sequence
  SiRNA target sequence
aaatagacaaaagtctgattataca

SEQ ID NO: 7899 - DNA, 25 bp, Artificial sequence
  SiRNA target sequence
aatagacaaaagtctgattatacat

SEQ ID NO: 7900 - DNA, 25 bp, Artificial sequence
  SiRNA target sequence
atagacaaaagtctgattatacatc

SEQ ID NO: 7901 - DNA, 25 bp, Artificial sequence
  SiRNA target sequence
tagacaaaagtctgattatacatca

SEQ ID NO: 7902 - DNA, 25 bp, Artificial sequence
  SiRNA target sequence
agacaaaagtctgattatacatcaa

SEQ ID NO: 7903 - DNA, 25 bp, Artificial sequence
  SiRNA target sequence
gacaaaagtctgattatacatcaat

SEQ ID NO: 7904 - DNA, 25 bp, Artificial sequence
  SiRNA target sequence
acaaaagtctgattatacatcaata

SEQ ID NO: 7905 - DNA, 25 bp, Artificial sequence
  SiRNA target sequence
caaaagtctgattatacatcaataa

SEQ ID NO: 7906 - DNA, 25 bp, Artificial sequence
  SiRNA target sequence
aaaagtctgattatacatcaataaa

SEQ ID NO: 7907 - DNA, 25 bp, Artificial sequence
  SiRNA target sequence
aaagtctgattatacatcaataaaa

SEQ ID NO: 7908 - DNA, 25 bp, Artificial sequence
  SiRNA target sequence
aagtctgattatacatcaataaaac

SEQ ID NO: 7909 - DNA, 25 bp, Artificial sequence
  SiRNA target sequence
agtctgattatacatcaataaaaca

SEQ ID NO: 7910 - DNA, 25 bp, Artificial sequence
  SiRNA target sequence
gtctgattatacatcaataaaacag

SEQ ID NO: 7911 - DNA, 25 bp, Artificial sequence
  SiRNA target sequence
tctgattatacatcaataaaacagg

SEQ ID NO: 7912 - DNA, 25 bp, Artificial sequence
  SiRNA target sequence
ctgattatacatcaataaaacagga

SEQ ID NO: 7913 - DNA, 25 bp, Artificial sequence
  SiRNA target sequence
tgattatacatcaataaaacaggaa

SEQ ID NO: 7914 - DNA, 25 bp, Artificial sequence
  SiRNA target sequence
gattatacatcaataaaacaggaag

SEQ ID NO: 7915 - DNA, 25 bp, Artificial sequence
  SiRNA target sequence
attatacatcaataaaacaggaagc

SEQ ID NO: 7916 - DNA, 25 bp, Artificial sequence
  SiRNA target sequence
ttatacatcaataaaacaggaagca

SEQ ID NO: 7917 - DNA, 25 bp, Artificial sequence
  SiRNA target sequence
tatacatcaataaaacaggaagcag

SEQ ID NO: 7918 - DNA, 25 bp, Artificial sequence
  SiRNA target sequence
atacatcaataaaacaggaagcaga

SEQ ID NO: 7919 - DNA, 25 bp, Artificial sequence
  SiRNA target sequence
tacatcaataaaacaggaagcagat

SEQ ID NO: 7920 - DNA, 25 bp, Artificial sequence
  SiRNA target sequence
acatcaataaaacaggaagcagata

SEQ ID NO: 7921 - DNA, 25 bp, Artificial sequence
  SiRNA target sequence
catcaataaaacaggaagcagataa

SEQ ID NO: 7922 - DNA, 25 bp, Artificial sequence
  SiRNA target sequence
atcaataaaacaggaagcagataaa

SEQ ID NO: 7923 - DNA, 25 bp, Artificial sequence
  SiRNA target sequence
tcaataaaacaggaagcagataaat

SEQ ID NO: 7924 - DNA, 25 bp, Artificial sequence
  SiRNA target sequence
caataaaacaggaagcagataaata

SEQ ID NO: 7925 - DNA, 25 bp, Artificial sequence
  SiRNA target sequence
aataaaacaggaagcagataaatat

SEQ ID NO: 7926 - DNA, 25 bp, Artificial sequence
  SiRNA target sequence
ataaaacaggaagcagataaatatt

SEQ ID NO: 7927 - DNA, 25 bp, Artificial sequence
  SiRNA target sequence
taaaacaggaagcagataaatattt

SEQ ID NO: 7928 - DNA, 25 bp, Artificial sequence
  SiRNA target sequence
aaaacaggaagcagataaatatttt

SEQ ID NO: 7929 - DNA, 25 bp, Artificial sequence
  SiRNA target sequence
aaacaggaagcagataaatatttta

SEQ ID NO: 7930 - DNA, 25 bp, Artificial sequence
  SiRNA target sequence
aacaggaagcagataaatattttat

SEQ ID NO: 7931 - DNA, 25 bp, Artificial sequence
  SiRNA target sequence
acaggaagcagataaatattttata

SEQ ID NO: 7932 - DNA, 25 bp, Artificial sequence
  SiRNA target sequence
caggaagcagataaatattttatac

SEQ ID NO: 7933 - DNA, 25 bp, Artificial sequence
  SiRNA target sequence
aggaagcagataaatattttataca

SEQ ID NO: 7934 - DNA, 25 bp, Artificial sequence
  SiRNA target sequence
ggaagcagataaatattttatacaa

SEQ ID NO: 7935 - DNA, 25 bp, Artificial sequence
  SiRNA target sequence
gaagcagataaatattttatacaag

SEQ ID NO: 7936 - DNA, 25 bp, Artificial sequence
  SiRNA target sequence
aagcagataaatattttatacaaga

SEQ ID NO: 7937 - DNA, 25 bp, Artificial sequence
  SiRNA target sequence
agcagataaatattttatacaagaa

SEQ ID NO: 7938 - DNA, 25 bp, Artificial sequence
  SiRNA target sequence
gcagataaatattttatacaagaag

SEQ ID NO: 7939 - DNA, 25 bp, Artificial sequence
  SiRNA target sequence
cagataaatattttatacaagaaga

SEQ ID NO: 7940 - DNA, 25 bp, Artificial sequence
  SiRNA target sequence
agataaatattttatacaagaagat

SEQ ID NO: 7941 - DNA, 25 bp, Artificial sequence
  SiRNA target sequence
gataaatattttatacaagaagatt

SEQ ID NO: 7942 - DNA, 25 bp, Artificial sequence
  SiRNA target sequence
ataaatattttatacaagaagatta

SEQ ID NO: 7943 - DNA, 25 bp, Artificial sequence
  SiRNA target sequence
taaatattttatacaagaagattat

SEQ ID NO: 7944 - DNA, 25 bp, Artificial sequence
  SiRNA target sequence
aaatattttatacaagaagattata

SEQ ID NO: 7945 - DNA, 25 bp, Artificial sequence
  SiRNA target sequence
aatattttatacaagaagattataa

SEQ ID NO: 7946 - DNA, 25 bp, Artificial sequence
  SiRNA target sequence
atattttatacaagaagattataaa

SEQ ID NO: 7947 - DNA, 25 bp, Artificial sequence
  SiRNA target sequence
tattttatacaagaagattataaaa

SEQ ID NO: 7948 - DNA, 25 bp, Artificial sequence
  SiRNA target sequence
attttatacaagaagattataaaaa

SEQ ID NO: 7949 - DNA, 25 bp, Artificial sequence
  SiRNA target sequence
ttttatacaagaagattataaaaat

SEQ ID NO: 7950 - DNA, 25 bp, Artificial sequence
  SiRNA target sequence
tttatacaagaagattataaaaatg

SEQ ID NO: 7951 - DNA, 25 bp, Artificial sequence
  SiRNA target sequence
ttatacaagaagattataaaaatgc

SEQ ID NO: 7952 - DNA, 25 bp, Artificial sequence
  SiRNA target sequence
tatacaagaagattataaaaatgct

SEQ ID NO: 7953 - DNA, 25 bp, Artificial sequence
  SiRNA target sequence
atacaagaagattataaaaatgcta

SEQ ID NO: 7954 - DNA, 25 bp, Artificial sequence
  SiRNA target sequence
tacaagaagattataaaaatgctat

SEQ ID NO: 7955 - DNA, 25 bp, Artificial sequence
  SiRNA target sequence
acaagaagattataaaaatgctatt

SEQ ID NO: 7956 - DNA, 25 bp, Artificial sequence
  SiRNA target sequence
caagaagattataaaaatgctattc

SEQ ID NO: 7957 - DNA, 25 bp, Artificial sequence
  SiRNA target sequence
aagaagattataaaaatgctattct

SEQ ID NO: 7958 - DNA, 25 bp, Artificial sequence
  SiRNA target sequence
agaagattataaaaatgctattctg

SEQ ID NO: 7959 - DNA, 25 bp, Artificial sequence
  SiRNA target sequence
gaagattataaaaatgctattctgt

SEQ ID NO: 7960 - DNA, 25 bp, Artificial sequence
  SiRNA target sequence
aagattataaaaatgctattctgtt

SEQ ID NO: 7961 - DNA, 25 bp, Artificial sequence
  SiRNA target sequence
agattataaaaatgctattctgttg

SEQ ID NO: 7962 - DNA, 25 bp, Artificial sequence
  SiRNA target sequence
gattataaaaatgctattctgttgt

SEQ ID NO: 7963 - DNA, 25 bp, Artificial sequence
  SiRNA target sequence
attataaaaatgctattctgttgta

SEQ ID NO: 7964 - DNA, 25 bp, Artificial sequence
  SiRNA target sequence
ttataaaaatgctattctgttgtac

SEQ ID NO: 7965 - DNA, 25 bp, Artificial sequence
  SiRNA target sequence
tataaaaatgctattctgttgtaca

SEQ ID NO: 7966 - DNA, 25 bp, Artificial sequence
  SiRNA target sequence
ataaaaatgctattctgttgtacac

SEQ ID NO: 7967 - DNA, 25 bp, Artificial sequence
  SiRNA target sequence
taaaaatgctattctgttgtacact

SEQ ID NO: 7968 - DNA, 25 bp, Artificial sequence
  SiRNA target sequence
aaaaatgctattctgttgtacacta

SEQ ID NO: 7969 - DNA, 25 bp, Artificial sequence
  SiRNA target sequence
aaaatgctattctgttgtacactaa

SEQ ID NO: 7970 - DNA, 25 bp, Artificial sequence
  SiRNA target sequence
aaatgctattctgttgtacactaaa

SEQ ID NO: 7971 - DNA, 25 bp, Artificial sequence
  SiRNA target sequence
aatgctattctgttgtacactaaat

SEQ ID NO: 7972 - DNA, 25 bp, Artificial sequence
  SiRNA target sequence
atgctattctgttgtacactaaatg

SEQ ID NO: 7973 - DNA, 25 bp, Artificial sequence
  SiRNA target sequence
tgctattctgttgtacactaaatgt

SEQ ID NO: 7974 - DNA, 25 bp, Artificial sequence
  SiRNA target sequence
gctattctgttgtacactaaatgta

SEQ ID NO: 7975 - DNA, 25 bp, Artificial sequence
  SiRNA target sequence
ctattctgttgtacactaaatgtaa

SEQ ID NO: 7976 - DNA, 25 bp, Artificial sequence
  SiRNA target sequence
tattctgttgtacactaaatgtaaa

SEQ ID NO: 7977 - DNA, 25 bp, Artificial sequence
  SiRNA target sequence
attctgttgtacactaaatgtaaat

SEQ ID NO: 7978 - DNA, 25 bp, Artificial sequence
  SiRNA target sequence
ttctgttgtacactaaatgtaaata

SEQ ID NO: 7979 - DNA, 25 bp, Artificial sequence
  SiRNA target sequence
tctgttgtacactaaatgtaaatat

SEQ ID NO: 7980 - DNA, 25 bp, Artificial sequence
  SiRNA target sequence
ctgttgtacactaaatgtaaatata

SEQ ID NO: 7981 - DNA, 25 bp, Artificial sequence
  SiRNA target sequence
tgttgtacactaaatgtaaatatat

SEQ ID NO: 7982 - DNA, 25 bp, Artificial sequence
  SiRNA target sequence
gttgtacactaaatgtaaatatatg

SEQ ID NO: 7983 - DNA, 25 bp, Artificial sequence
  SiRNA target sequence
ttgtacactaaatgtaaatatatga

SEQ ID NO: 7984 - DNA, 25 bp, Artificial sequence
  SiRNA target sequence
tgtacactaaatgtaaatatatgaa

SEQ ID NO: 7985 - DNA, 25 bp, Artificial sequence
  SiRNA target sequence
gtacactaaatgtaaatatatgaaa

SEQ ID NO: 7986 - DNA, 25 bp, Artificial sequence
  SiRNA target sequence
tacactaaatgtaaatatatgaaaa

SEQ ID NO: 7987 - DNA, 25 bp, Artificial sequence
  SiRNA target sequence
acactaaatgtaaatatatgaaaag

SEQ ID NO: 7988 - DNA, 25 bp, Artificial sequence
  SiRNA target sequence
cactaaatgtaaatatatgaaaagt

SEQ ID NO: 7989 - DNA, 25 bp, Artificial sequence
  SiRNA target sequence
actaaatgtaaatatatgaaaagtg

SEQ ID NO: 7990 - DNA, 25 bp, Artificial sequence
  SiRNA target sequence
ctaaatgtaaatatatgaaaagtga

SEQ ID NO: 7991 - DNA, 25 bp, Artificial sequence
  SiRNA target sequence
taaatgtaaatatatgaaaagtgat

SEQ ID NO: 7992 - DNA, 25 bp, Artificial sequence
  SiRNA target sequence
aaatgtaaatatatgaaaagtgatg

SEQ ID NO: 7993 - DNA, 25 bp, Artificial sequence
  SiRNA target sequence
aatgtaaatatatgaaaagtgatgc

SEQ ID NO: 7994 - DNA, 25 bp, Artificial sequence
  SiRNA target sequence
atgtaaatatatgaaaagtgatgct

SEQ ID NO: 7995 - DNA, 25 bp, Artificial sequence
  SiRNA target sequence
tgtaaatatatgaaaagtgatgctg

SEQ ID NO: 7996 - DNA, 25 bp, Artificial sequence
  SiRNA target sequence
gtaaatatatgaaaagtgatgctga

SEQ ID NO: 7997 - DNA, 25 bp, Artificial sequence
  SiRNA target sequence
taaatatatgaaaagtgatgctgaa

SEQ ID NO: 7998 - DNA, 25 bp, Artificial sequence
  SiRNA target sequence
aaatatatgaaaagtgatgctgaaa

SEQ ID NO: 7999 - DNA, 25 bp, Artificial sequence
  SiRNA target sequence
aatatatgaaaagtgatgctgaaat

SEQ ID NO: 8000 - DNA, 25 bp, Artificial sequence
  SiRNA target sequence
atatatgaaaagtgatgctgaaatt

SEQ ID NO: 8001 - DNA, 25 bp, Artificial sequence
  SiRNA target sequence
tatatgaaaagtgatgctgaaattc

SEQ ID NO: 8002 - DNA, 25 bp, Artificial sequence
  SiRNA target sequence
atatgaaaagtgatgctgaaattct

SEQ ID NO: 8003 - DNA, 25 bp, Artificial sequence
  SiRNA target sequence
tatgaaaagtgatgctgaaattctt

SEQ ID NO: 8004 - DNA, 25 bp, Artificial sequence
  SiRNA target sequence
atgaaaagtgatgctgaaattctta

SEQ ID NO: 8005 - DNA, 25 bp, Artificial sequence
  SiRNA target sequence
tgaaaagtgatgctgaaattcttac

SEQ ID NO: 8006 - DNA, 25 bp, Artificial sequence
  SiRNA target sequence
gaaaagtgatgctgaaattcttact

SEQ ID NO: 8007 - DNA, 25 bp, Artificial sequence
  SiRNA target sequence
aaaagtgatgctgaaattcttacta

SEQ ID NO: 8008 - DNA, 25 bp, Artificial sequence
  SiRNA target sequence
aaagtgatgctgaaattcttactaa

SEQ ID NO: 8009 - DNA, 25 bp, Artificial sequence
  SiRNA target sequence
aagtgatgctgaaattcttactaaa

SEQ ID NO: 8010 - DNA, 25 bp, Artificial sequence
  SiRNA target sequence
agtgatgctgaaattcttactaaaa

SEQ ID NO: 8011 - DNA, 25 bp, Artificial sequence
  SiRNA target sequence
gtgatgctgaaattcttactaaaat

SEQ ID NO: 8012 - DNA, 25 bp, Artificial sequence
  SiRNA target sequence
tgatgctgaaattcttactaaaatt

SEQ ID NO: 8013 - DNA, 25 bp, Artificial sequence
  SiRNA target sequence
gatgctgaaattcttactaaaatta

SEQ ID NO: 8014 - DNA, 25 bp, Artificial sequence
  SiRNA target sequence
atgctgaaattcttactaaaattag

SEQ ID NO: 8015 - DNA, 25 bp, Artificial sequence
  SiRNA target sequence
tgctgaaattcttactaaaattagt

SEQ ID NO: 8016 - DNA, 25 bp, Artificial sequence
  SiRNA target sequence
gctgaaattcttactaaaattagtc

SEQ ID NO: 8017 - DNA, 25 bp, Artificial sequence
  SiRNA target sequence
ctgaaattcttactaaaattagtct

SEQ ID NO: 8018 - DNA, 25 bp, Artificial sequence
  SiRNA target sequence
tgaaattcttactaaaattagtctc

SEQ ID NO: 8019 - DNA, 25 bp, Artificial sequence
  SiRNA target sequence
gaaattcttactaaaattagtctct

SEQ ID NO: 8020 - DNA, 25 bp, Artificial sequence
  SiRNA target sequence
aaattcttactaaaattagtctctg

SEQ ID NO: 8021 - DNA, 25 bp, Artificial sequence
  SiRNA target sequence
aattcttactaaaattagtctctgt

SEQ ID NO: 8022 - DNA, 25 bp, Artificial sequence
  SiRNA target sequence
attcttactaaaattagtctctgta

SEQ ID NO: 8023 - DNA, 25 bp, Artificial sequence
  SiRNA target sequence
ttcttactaaaattagtctctgtaa

SEQ ID NO: 8024 - DNA, 25 bp, Artificial sequence
  SiRNA target sequence
tcttactaaaattagtctctgtaat

SEQ ID NO: 8025 - DNA, 25 bp, Artificial sequence
  SiRNA target sequence
cttactaaaattagtctctgtaatt

SEQ ID NO: 8026 - DNA, 25 bp, Artificial sequence
  SiRNA target sequence
ttactaaaattagtctctgtaatta

SEQ ID NO: 8027 - DNA, 25 bp, Artificial sequence
  SiRNA target sequence
tactaaaattagtctctgtaattat

SEQ ID NO: 8028 - DNA, 25 bp, Artificial sequence
  SiRNA target sequence
actaaaattagtctctgtaattatt

SEQ ID NO: 8029 - DNA, 25 bp, Artificial sequence
  SiRNA target sequence
ctaaaattagtctctgtaattattt

SEQ ID NO: 8030 - DNA, 25 bp, Artificial sequence
  SiRNA target sequence
taaaattagtctctgtaattatttc

SEQ ID NO: 8031 - DNA, 25 bp, Artificial sequence
  SiRNA target sequence
aaaattagtctctgtaattatttct

SEQ ID NO: 8032 - DNA, 25 bp, Artificial sequence
  SiRNA target sequence
aaattagtctctgtaattatttctt

SEQ ID NO: 8033 - DNA, 25 bp, Artificial sequence
  SiRNA target sequence
aattagtctctgtaattatttctta

SEQ ID NO: 8034 - DNA, 25 bp, Artificial sequence
  SiRNA target sequence
attagtctctgtaattatttcttaa

SEQ ID NO: 8035 - DNA, 25 bp, Artificial sequence
  SiRNA target sequence
ttagtctctgtaattatttcttaaa

SEQ ID NO: 8036 - DNA, 25 bp, Artificial sequence
  SiRNA target sequence
tagtctctgtaattatttcttaaaa

SEQ ID NO: 8037 - DNA, 25 bp, Artificial sequence
  SiRNA target sequence
agtctctgtaattatttcttaaaaa

SEQ ID NO: 8038 - DNA, 25 bp, Artificial sequence
  SiRNA target sequence
gtctctgtaattatttcttaaaaaa

SEQ ID NO: 8039 - DNA, 25 bp, Artificial sequence
  SiRNA target sequence
tctctgtaattatttcttaaaaaat

SEQ ID NO: 8040 - DNA, 25 bp, Artificial sequence
  SiRNA target sequence
ctctgtaattatttcttaaaaaatt

SEQ ID NO: 8041 - DNA, 25 bp, Artificial sequence
  SiRNA target sequence
tctgtaattatttcttaaaaaatta

SEQ ID NO: 8042 - DNA, 25 bp, Artificial sequence
  SiRNA target sequence
ctgtaattatttcttaaaaaattat

SEQ ID NO: 8043 - DNA, 25 bp, Artificial sequence
  SiRNA target sequence
tgtaattatttcttaaaaaattatc

SEQ ID NO: 8044 - DNA, 25 bp, Artificial sequence
  SiRNA target sequence
gtaattatttcttaaaaaattatca

SEQ ID NO: 8045 - DNA, 25 bp, Artificial sequence
  SiRNA target sequence
taattatttcttaaaaaattatcaa

SEQ ID NO: 8046 - DNA, 25 bp, Artificial sequence
  SiRNA target sequence
aattatttcttaaaaaattatcaag

SEQ ID NO: 8047 - DNA, 25 bp, Artificial sequence
  SiRNA target sequence
attatttcttaaaaaattatcaaga

SEQ ID NO: 8048 - DNA, 25 bp, Artificial sequence
  SiRNA target sequence
ttatttcttaaaaaattatcaagaa

SEQ ID NO: 8049 - DNA, 25 bp, Artificial sequence
  SiRNA target sequence
tatttcttaaaaaattatcaagaag

SEQ ID NO: 8050 - DNA, 25 bp, Artificial sequence
  SiRNA target sequence
atttcttaaaaaattatcaagaagt

SEQ ID NO: 8051 - DNA, 25 bp, Artificial sequence
  SiRNA target sequence
tttcttaaaaaattatcaagaagtt

SEQ ID NO: 8052 - DNA, 25 bp, Artificial sequence
  SiRNA target sequence
ttcttaaaaaattatcaagaagtta

SEQ ID NO: 8053 - DNA, 25 bp, Artificial sequence
  SiRNA target sequence
tcttaaaaaattatcaagaagttat

SEQ ID NO: 8054 - DNA, 25 bp, Artificial sequence
  SiRNA target sequence
cttaaaaaattatcaagaagttata

SEQ ID NO: 8055 - DNA, 25 bp, Artificial sequence
  SiRNA target sequence
ttaaaaaattatcaagaagttataa

SEQ ID NO: 8056 - DNA, 25 bp, Artificial sequence
  SiRNA target sequence
taaaaaattatcaagaagttataaa

SEQ ID NO: 8057 - DNA, 25 bp, Artificial sequence
  SiRNA target sequence
aaaaaattatcaagaagttataaat

SEQ ID NO: 8058 - DNA, 25 bp, Artificial sequence
  SiRNA target sequence
aaaaattatcaagaagttataaata

SEQ ID NO: 8059 - DNA, 25 bp, Artificial sequence
  SiRNA target sequence
aaaattatcaagaagttataaataa

SEQ ID NO: 8060 - DNA, 25 bp, Artificial sequence
  SiRNA target sequence
aaattatcaagaagttataaataat

SEQ ID NO: 8061 - DNA, 25 bp, Artificial sequence
  SiRNA target sequence
aattatcaagaagttataaataatt

SEQ ID NO: 8062 - DNA, 25 bp, Artificial sequence
  SiRNA target sequence
attatcaagaagttataaataattc

SEQ ID NO: 8063 - DNA, 25 bp, Artificial sequence
  SiRNA target sequence
ttatcaagaagttataaataattct

SEQ ID NO: 8064 - DNA, 25 bp, Artificial sequence
  SiRNA target sequence
tatcaagaagttataaataattctt

SEQ ID NO: 8065 - DNA, 25 bp, Artificial sequence
  SiRNA target sequence
atcaagaagttataaataattcttt

SEQ ID NO: 8066 - DNA, 25 bp, Artificial sequence
  SiRNA target sequence
tcaagaagttataaataattcttta

SEQ ID NO: 8067 - DNA, 25 bp, Artificial sequence
  SiRNA target sequence
caagaagttataaataattctttat

SEQ ID NO: 8068 - DNA, 25 bp, Artificial sequence
  SiRNA target sequence
aagaagttataaataattctttatt

SEQ ID NO: 8069 - DNA, 25 bp, Artificial sequence
  SiRNA target sequence
agaagttataaataattctttattt

SEQ ID NO: 8070 - DNA, 25 bp, Artificial sequence
  SiRNA target sequence
gaagttataaataattctttattta

SEQ ID NO: 8071 - DNA, 25 bp, Artificial sequence
  SiRNA target sequence
aagttataaataattctttatttaa

SEQ ID NO: 8072 - DNA, 25 bp, Artificial sequence
  SiRNA target sequence
agttataaataattctttatttaag

SEQ ID NO: 8073 - DNA, 25 bp, Artificial sequence
  SiRNA target sequence
gttataaataattctttatttaaga

SEQ ID NO: 8074 - DNA, 25 bp, Artificial sequence
  SiRNA target sequence
ttataaataattctttatttaagac

SEQ ID NO: 8075 - DNA, 25 bp, Artificial sequence
  SiRNA target sequence
tataaataattctttatttaagaca

SEQ ID NO: 8076 - DNA, 25 bp, Artificial sequence
  SiRNA target sequence
ataaataattctttatttaagacaa

SEQ ID NO: 8077 - DNA, 25 bp, Artificial sequence
  SiRNA target sequence
taaataattctttatttaagacaaa

SEQ ID NO: 8078 - DNA, 25 bp, Artificial sequence
  SiRNA target sequence
aaataattctttatttaagacaaat

SEQ ID NO: 8079 - DNA, 25 bp, Artificial sequence
  SiRNA target sequence
aataattctttatttaagacaaata

SEQ ID NO: 8080 - DNA, 25 bp, Artificial sequence
  SiRNA target sequence
ataattctttatttaagacaaataa

SEQ ID NO: 8081 - DNA, 25 bp, Artificial sequence
  SiRNA target sequence
taattctttatttaagacaaataat

SEQ ID NO: 8082 - DNA, 25 bp, Artificial sequence
  SiRNA target sequence
aattctttatttaagacaaataata

SEQ ID NO: 8083 - DNA, 25 bp, Artificial sequence
  SiRNA target sequence
attctttatttaagacaaataataa

SEQ ID NO: 8084 - DNA, 25 bp, Artificial sequence
  SiRNA target sequence
ttctttatttaagacaaataataaa

SEQ ID NO: 8085 - DNA, 25 bp, Artificial sequence
  SiRNA target sequence
tctttatttaagacaaataataaag

SEQ ID NO: 8086 - DNA, 25 bp, Artificial sequence
  SiRNA target sequence
ctttatttaagacaaataataaaga

SEQ ID NO: 8087 - DNA, 25 bp, Artificial sequence
  SiRNA target sequence
tttatttaagacaaataataaagat

SEQ ID NO: 8088 - DNA, 25 bp, Artificial sequence
  SiRNA target sequence
ttatttaagacaaataataaagatc

SEQ ID NO: 8089 - DNA, 25 bp, Artificial sequence
  SiRNA target sequence
tatttaagacaaataataaagatct

SEQ ID NO: 8090 - DNA, 25 bp, Artificial sequence
  SiRNA target sequence
atttaagacaaataataaagatcta

SEQ ID NO: 8091 - DNA, 25 bp, Artificial sequence
  SiRNA target sequence
tttaagacaaataataaagatctaa

SEQ ID NO: 8092 - DNA, 25 bp, Artificial sequence
  SiRNA target sequence
ttaagacaaataataaagatctaat

SEQ ID NO: 8093 - DNA, 25 bp, Artificial sequence
  SiRNA target sequence
taagacaaataataaagatctaata

SEQ ID NO: 8094 - DNA, 25 bp, Artificial sequence
  SiRNA target sequence
aagacaaataataaagatctaataa

SEQ ID NO: 8095 - DNA, 25 bp, Artificial sequence
  SiRNA target sequence
agacaaataataaagatctaataaa

SEQ ID NO: 8096 - DNA, 25 bp, Artificial sequence
  SiRNA target sequence
gacaaataataaagatctaataaaa

SEQ ID NO: 8097 - DNA, 25 bp, Artificial sequence
  SiRNA target sequence
acaaataataaagatctaataaaaa

SEQ ID NO: 8098 - DNA, 25 bp, Artificial sequence
  SiRNA target sequence
caaataataaagatctaataaaaat

SEQ ID NO: 8099 - DNA, 25 bp, Artificial sequence
  SiRNA target sequence
aaataataaagatctaataaaaata

SEQ ID NO: 8100 - DNA, 25 bp, Artificial sequence
  SiRNA target sequence
aataataaagatctaataaaaataa

SEQ ID NO: 8101 - DNA, 25 bp, Artificial sequence
  SiRNA target sequence
ataataaagatctaataaaaataag

SEQ ID NO: 8102 - DNA, 25 bp, Artificial sequence
  SiRNA target sequence
taataaagatctaataaaaataaga

SEQ ID NO: 8103 - DNA, 25 bp, Artificial sequence
  SiRNA target sequence
aataaagatctaataaaaataagat

SEQ ID NO: 8104 - DNA, 25 bp, Artificial sequence
  SiRNA target sequence
ataaagatctaataaaaataagatc

SEQ ID NO: 8105 - DNA, 25 bp, Artificial sequence
  SiRNA target sequence
taaagatctaataaaaataagatct

SEQ ID NO: 8106 - DNA, 25 bp, Artificial sequence
  SiRNA target sequence
aaagatctaataaaaataagatctg

SEQ ID NO: 8107 - DNA, 25 bp, Artificial sequence
  SiRNA target sequence
aagatctaataaaaataagatctga

SEQ ID NO: 8108 - DNA, 25 bp, Artificial sequence
  SiRNA target sequence
agatctaataaaaataagatctgaa

SEQ ID NO: 8109 - DNA, 25 bp, Artificial sequence
  SiRNA target sequence
gatctaataaaaataagatctgaat

SEQ ID NO: 8110 - DNA, 25 bp, Artificial sequence
  SiRNA target sequence
atctaataaaaataagatctgaatg

SEQ ID NO: 8111 - DNA, 25 bp, Artificial sequence
  SiRNA target sequence
tctaataaaaataagatctgaatgt

SEQ ID NO: 8112 - DNA, 25 bp, Artificial sequence
  SiRNA target sequence
ctaataaaaataagatctgaatgtt

SEQ ID NO: 8113 - DNA, 25 bp, Artificial sequence
  SiRNA target sequence
taataaaaataagatctgaatgtta

SEQ ID NO: 8114 - DNA, 25 bp, Artificial sequence
  SiRNA target sequence
aataaaaataagatctgaatgttac

SEQ ID NO: 8115 - DNA, 25 bp, Artificial sequence
  SiRNA target sequence
ataaaaataagatctgaatgttaca

SEQ ID NO: 8116 - DNA, 25 bp, Artificial sequence
  SiRNA target sequence
taaaaataagatctgaatgttacaa

SEQ ID NO: 8117 - DNA, 25 bp, Artificial sequence
  SiRNA target sequence
aaaaataagatctgaatgttacaag

SEQ ID NO: 8118 - DNA, 25 bp, Artificial sequence
  SiRNA target sequence
aaaataagatctgaatgttacaagc

SEQ ID NO: 8119 - DNA, 25 bp, Artificial sequence
  SiRNA target sequence
aaataagatctgaatgttacaagca

SEQ ID NO: 8120 - DNA, 25 bp, Artificial sequence
  SiRNA target sequence
aataagatctgaatgttacaagcag

SEQ ID NO: 8121 - DNA, 25 bp, Artificial sequence
  SiRNA target sequence
ataagatctgaatgttacaagcaga

SEQ ID NO: 8122 - DNA, 25 bp, Artificial sequence
  SiRNA target sequence
taagatctgaatgttacaagcagat

SEQ ID NO: 8123 - DNA, 25 bp, Artificial sequence
  SiRNA target sequence
aagatctgaatgttacaagcagatg

SEQ ID NO: 8124 - DNA, 25 bp, Artificial sequence
  SiRNA target sequence
agatctgaatgttacaagcagatgg

SEQ ID NO: 8125 - DNA, 25 bp, Artificial sequence
  SiRNA target sequence
gatctgaatgttacaagcagatggg

SEQ ID NO: 8126 - DNA, 25 bp, Artificial sequence
  SiRNA target sequence
atctgaatgttacaagcagatggga

SEQ ID NO: 8127 - DNA, 25 bp, Artificial sequence
  SiRNA target sequence
tctgaatgttacaagcagatgggaa

SEQ ID NO: 8128 - DNA, 25 bp, Artificial sequence
  SiRNA target sequence
ctgaatgttacaagcagatgggaaa

SEQ ID NO: 8129 - DNA, 25 bp, Artificial sequence
  SiRNA target sequence
tgaatgttacaagcagatgggaaat

SEQ ID NO: 8130 - DNA, 25 bp, Artificial sequence
  SiRNA target sequence
gaatgttacaagcagatgggaaata

SEQ ID NO: 8131 - DNA, 25 bp, Artificial sequence
  SiRNA target sequence
aatgttacaagcagatgggaaataa

SEQ ID NO: 8132 - DNA, 25 bp, Artificial sequence
  SiRNA target sequence
atgttacaagcagatgggaaataaa

SEQ ID NO: 8133 - DNA, 25 bp, Artificial sequence
  SiRNA target sequence
tgttacaagcagatgggaaataaaa

SEQ ID NO: 8134 - DNA, 25 bp, Artificial sequence
  SiRNA target sequence
gttacaagcagatgggaaataaaaa

SEQ ID NO: 8135 - DNA, 25 bp, Artificial sequence
  SiRNA target sequence
ttacaagcagatgggaaataaaaaa

SEQ ID NO: 8136 - DNA, 25 bp, Artificial sequence
  SiRNA target sequence
tacaagcagatgggaaataaaaaaa

SEQ ID NO: 8137 - DNA, 25 bp, Artificial sequence
  SiRNA target sequence
acaagcagatgggaaataaaaaaaa

SEQ ID NO: 8138 - DNA, 25 bp, Artificial sequence
  SiRNA target sequence
caagcagatgggaaataaaaaaaaa

SEQ ID NO: 8139 - DNA, 25 bp, Artificial sequence
  SiRNA target sequence
aagcagatgggaaataaaaaaaaat

SEQ ID NO: 8140 - DNA, 25 bp, Artificial sequence
  SiRNA target sequence
agcagatgggaaataaaaaaaaatt

SEQ ID NO: 8141 - DNA, 25 bp, Artificial sequence
  SiRNA target sequence
gcagatgggaaataaaaaaaaattt

SEQ ID NO: 8142 - DNA, 25 bp, Artificial sequence
  SiRNA target sequence
cagatgggaaataaaaaaaaatttc

SEQ ID NO: 8143 - DNA, 25 bp, Artificial sequence
  SiRNA target sequence
agatgggaaataaaaaaaaatttct

SEQ ID NO: 8144 - DNA, 25 bp, Artificial sequence
  SiRNA target sequence
gatgggaaataaaaaaaaatttctt

SEQ ID NO: 8145 - DNA, 25 bp, Artificial sequence
  SiRNA target sequence
atgggaaataaaaaaaaatttctta

SEQ ID NO: 8146 - DNA, 25 bp, Artificial sequence
  SiRNA target sequence
tgggaaataaaaaaaaatttcttaa

SEQ ID NO: 8147 - DNA, 25 bp, Artificial sequence
  SiRNA target sequence
gggaaataaaaaaaaatttcttaag

SEQ ID NO: 8148 - DNA, 25 bp, Artificial sequence
  SiRNA target sequence
ggaaataaaaaaaaatttcttaagg

SEQ ID NO: 8149 - DNA, 25 bp, Artificial sequence
  SiRNA target sequence
gaaataaaaaaaaatttcttaagga

SEQ ID NO: 8150 - DNA, 25 bp, Artificial sequence
  SiRNA target sequence
aaataaaaaaaaatttcttaaggat

SEQ ID NO: 8151 - DNA, 25 bp, Artificial sequence
  SiRNA target sequence
aataaaaaaaaatttcttaaggatt

SEQ ID NO: 8152 - DNA, 25 bp, Artificial sequence
  SiRNA target sequence
ataaaaaaaaatttcttaaggattt

SEQ ID NO: 8153 - DNA, 25 bp, Artificial sequence
  SiRNA target sequence
taaaaaaaaatttcttaaggattta

SEQ ID NO: 8154 - DNA, 25 bp, Artificial sequence
  SiRNA target sequence
aaaaaaaaatttcttaaggatttag

SEQ ID NO: 8155 - DNA, 25 bp, Artificial sequence
  SiRNA target sequence
aaaaaaaatttcttaaggatttagc

SEQ ID NO: 8156 - DNA, 25 bp, Artificial sequence
  SiRNA target sequence
aaaaaaatttcttaaggatttagca

SEQ ID NO: 8157 - DNA, 25 bp, Artificial sequence
  SiRNA target sequence
aaaaaatttcttaaggatttagcac

SEQ ID NO: 8158 - DNA, 25 bp, Artificial sequence
  SiRNA target sequence
aaaaatttcttaaggatttagcact

SEQ ID NO: 8159 - DNA, 25 bp, Artificial sequence
  SiRNA target sequence
aaaatttcttaaggatttagcactt

SEQ ID NO: 8160 - DNA, 25 bp, Artificial sequence
  SiRNA target sequence
aaatttcttaaggatttagcacttt

SEQ ID NO: 8161 - DNA, 25 bp, Artificial sequence
  SiRNA target sequence
aatttcttaaggatttagcacttta

SEQ ID NO: 8162 - DNA, 25 bp, Artificial sequence
  SiRNA target sequence
atttcttaaggatttagcactttat

SEQ ID NO: 8163 - DNA, 25 bp, Artificial sequence
  SiRNA target sequence
tttcttaaggatttagcactttatg

SEQ ID NO: 8164 - DNA, 25 bp, Artificial sequence
  SiRNA target sequence
ttcttaaggatttagcactttatga

SEQ ID NO: 8165 - DNA, 25 bp, Artificial sequence
  SiRNA target sequence
tcttaaggatttagcactttatgaa

SEQ ID NO: 8166 - DNA, 25 bp, Artificial sequence
  SiRNA target sequence
cttaaggatttagcactttatgaaa

SEQ ID NO: 8167 - DNA, 25 bp, Artificial sequence
  SiRNA target sequence
ttaaggatttagcactttatgaaac

SEQ ID NO: 8168 - DNA, 25 bp, Artificial sequence
  SiRNA target sequence
taaggatttagcactttatgaaaca

SEQ ID NO: 8169 - DNA, 25 bp, Artificial sequence
  SiRNA target sequence
aaggatttagcactttatgaaacat

SEQ ID NO: 8170 - DNA, 25 bp, Artificial sequence
  SiRNA target sequence
aggatttagcactttatgaaacatt

SEQ ID NO: 8171 - DNA, 25 bp, Artificial sequence
  SiRNA target sequence
ggatttagcactttatgaaacattt

SEQ ID NO: 8172 - DNA, 25 bp, Artificial sequence
  SiRNA target sequence
gatttagcactttatgaaacatttg

SEQ ID NO: 8173 - DNA, 25 bp, Artificial sequence
  SiRNA target sequence
atttagcactttatgaaacatttgc

SEQ ID NO: 8174 - DNA, 25 bp, Artificial sequence
  SiRNA target sequence
tttagcactttatgaaacatttgct

SEQ ID NO: 8175 - DNA, 25 bp, Artificial sequence
  SiRNA target sequence
ttagcactttatgaaacatttgcta

SEQ ID NO: 8176 - DNA, 25 bp, Artificial sequence
  SiRNA target sequence
tagcactttatgaaacatttgctaa

SEQ ID NO: 8177 - DNA, 25 bp, Artificial sequence
  SiRNA target sequence
agcactttatgaaacatttgctaat

SEQ ID NO: 8178 - DNA, 25 bp, Artificial sequence
  SiRNA target sequence
gcactttatgaaacatttgctaata

SEQ ID NO: 8179 - DNA, 25 bp, Artificial sequence
  SiRNA target sequence
cactttatgaaacatttgctaataa

SEQ ID NO: 8180 - DNA, 25 bp, Artificial sequence
  SiRNA target sequence
actttatgaaacatttgctaataat

SEQ ID NO: 8181 - DNA, 25 bp, Artificial sequence
  SiRNA target sequence
ctttatgaaacatttgctaataata

SEQ ID NO: 8182 - DNA, 25 bp, Artificial sequence
  SiRNA target sequence
tttatgaaacatttgctaataataa

SEQ ID NO: 8183 - DNA, 25 bp, Artificial sequence
  SiRNA target sequence
ttatgaaacatttgctaataataaa

SEQ ID NO: 8184 - DNA, 25 bp, Artificial sequence
  SiRNA target sequence
tatgaaacatttgctaataataaag

SEQ ID NO: 8185 - DNA, 25 bp, Artificial sequence
  SiRNA target sequence
atgaaacatttgctaataataaaga

SEQ ID NO: 8186 - DNA, 25 bp, Artificial sequence
  SiRNA target sequence
tgaaacatttgctaataataaagaa

SEQ ID NO: 8187 - DNA, 25 bp, Artificial sequence
  SiRNA target sequence
gaaacatttgctaataataaagaag

SEQ ID NO: 8188 - DNA, 25 bp, Artificial sequence
  SiRNA target sequence
aaacatttgctaataataaagaagt

SEQ ID NO: 8189 - DNA, 25 bp, Artificial sequence
  SiRNA target sequence
aacatttgctaataataaagaagtc

SEQ ID NO: 8190 - DNA, 25 bp, Artificial sequence
  SiRNA target sequence
acatttgctaataataaagaagtcc

SEQ ID NO: 8191 - DNA, 25 bp, Artificial sequence
  SiRNA target sequence
catttgctaataataaagaagtcca

SEQ ID NO: 8192 - DNA, 25 bp, Artificial sequence
  SiRNA target sequence
atttgctaataataaagaagtccaa

SEQ ID NO: 8193 - DNA, 25 bp, Artificial sequence
  SiRNA target sequence
tttgctaataataaagaagtccaag

SEQ ID NO: 8194 - DNA, 25 bp, Artificial sequence
  SiRNA target sequence
ttgctaataataaagaagtccaaga

SEQ ID NO: 8195 - DNA, 25 bp, Artificial sequence
  SiRNA target sequence
tgctaataataaagaagtccaagat

SEQ ID NO: 8196 - DNA, 25 bp, Artificial sequence
  SiRNA target sequence
gctaataataaagaagtccaagatg

SEQ ID NO: 8197 - DNA, 25 bp, Artificial sequence
  SiRNA target sequence
ctaataataaagaagtccaagatga

SEQ ID NO: 8198 - DNA, 25 bp, Artificial sequence
  SiRNA target sequence
taataataaagaagtccaagatgaa

SEQ ID NO: 8199 - DNA, 25 bp, Artificial sequence
  SiRNA target sequence
aataataaagaagtccaagatgaaa

SEQ ID NO: 8200 - DNA, 25 bp, Artificial sequence
  SiRNA target sequence
ataataaagaagtccaagatgaaat

SEQ ID NO: 8201 - DNA, 25 bp, Artificial sequence
  SiRNA target sequence
taataaagaagtccaagatgaaatt

SEQ ID NO: 8202 - DNA, 25 bp, Artificial sequence
  SiRNA target sequence
aataaagaagtccaagatgaaatta

SEQ ID NO: 8203 - DNA, 25 bp, Artificial sequence
  SiRNA target sequence
ataaagaagtccaagatgaaattat

SEQ ID NO: 8204 - DNA, 25 bp, Artificial sequence
  SiRNA target sequence
taaagaagtccaagatgaaattatg

SEQ ID NO: 8205 - DNA, 25 bp, Artificial sequence
  SiRNA target sequence
aaagaagtccaagatgaaattatgc

SEQ ID NO: 8206 - DNA, 25 bp, Artificial sequence
  SiRNA target sequence
aagaagtccaagatgaaattatgca

SEQ ID NO: 8207 - DNA, 25 bp, Artificial sequence
  SiRNA target sequence
agaagtccaagatgaaattatgcag

SEQ ID NO: 8208 - DNA, 25 bp, Artificial sequence
  SiRNA target sequence
gaagtccaagatgaaattatgcaga

SEQ ID NO: 8209 - DNA, 25 bp, Artificial sequence
  SiRNA target sequence
aagtccaagatgaaattatgcagac

SEQ ID NO: 8210 - DNA, 25 bp, Artificial sequence
  SiRNA target sequence
agtccaagatgaaattatgcagact

SEQ ID NO: 8211 - DNA, 25 bp, Artificial sequence
  SiRNA target sequence
gtccaagatgaaattatgcagactg

SEQ ID NO: 8212 - DNA, 25 bp, Artificial sequence
  SiRNA target sequence
tccaagatgaaattatgcagactgt

SEQ ID NO: 8213 - DNA, 25 bp, Artificial sequence
  SiRNA target sequence
ccaagatgaaattatgcagactgtt

SEQ ID NO: 8214 - DNA, 25 bp, Artificial sequence
  SiRNA target sequence
caagatgaaattatgcagactgtta

SEQ ID NO: 8215 - DNA, 25 bp, Artificial sequence
  SiRNA target sequence
aagatgaaattatgcagactgttaa

SEQ ID NO: 8216 - DNA, 25 bp, Artificial sequence
  SiRNA target sequence
agatgaaattatgcagactgttaaa

SEQ ID NO: 8217 - DNA, 25 bp, Artificial sequence
  SiRNA target sequence
gatgaaattatgcagactgttaaag

SEQ ID NO: 8218 - DNA, 25 bp, Artificial sequence
  SiRNA target sequence
atgaaattatgcagactgttaaaga

SEQ ID NO: 8219 - DNA, 25 bp, Artificial sequence
  SiRNA target sequence
tgaaattatgcagactgttaaagaa

SEQ ID NO: 8220 - DNA, 25 bp, Artificial sequence
  SiRNA target sequence
gaaattatgcagactgttaaagaaa

SEQ ID NO: 8221 - DNA, 25 bp, Artificial sequence
  SiRNA target sequence
aaattatgcagactgttaaagaaat

SEQ ID NO: 8222 - DNA, 25 bp, Artificial sequence
  SiRNA target sequence
aattatgcagactgttaaagaaatt

SEQ ID NO: 8223 - DNA, 25 bp, Artificial sequence
  SiRNA target sequence
attatgcagactgttaaagaaattt

SEQ ID NO: 8224 - DNA, 25 bp, Artificial sequence
  SiRNA target sequence
ttatgcagactgttaaagaaatttg

SEQ ID NO: 8225 - DNA, 25 bp, Artificial sequence
  SiRNA target sequence
tatgcagactgttaaagaaatttgt

SEQ ID NO: 8226 - DNA, 25 bp, Artificial sequence
  SiRNA target sequence
atgcagactgttaaagaaatttgtg

SEQ ID NO: 8227 - DNA, 25 bp, Artificial sequence
  SiRNA target sequence
tgcagactgttaaagaaatttgtga

SEQ ID NO: 8228 - DNA, 25 bp, Artificial sequence
  SiRNA target sequence
gcagactgttaaagaaatttgtgaa

SEQ ID NO: 8229 - DNA, 25 bp, Artificial sequence
  SiRNA target sequence
cagactgttaaagaaatttgtgaag

SEQ ID NO: 8230 - DNA, 25 bp, Artificial sequence
  SiRNA target sequence
agactgttaaagaaatttgtgaaga

SEQ ID NO: 8231 - DNA, 25 bp, Artificial sequence
  SiRNA target sequence
gactgttaaagaaatttgtgaagaa

SEQ ID NO: 8232 - DNA, 25 bp, Artificial sequence
  SiRNA target sequence
actgttaaagaaatttgtgaagaag

SEQ ID NO: 8233 - DNA, 25 bp, Artificial sequence
  SiRNA target sequence
ctgttaaagaaatttgtgaagaaga

SEQ ID NO: 8234 - DNA, 25 bp, Artificial sequence
  SiRNA target sequence
tgttaaagaaatttgtgaagaagaa

SEQ ID NO: 8235 - DNA, 25 bp, Artificial sequence
  SiRNA target sequence
gttaaagaaatttgtgaagaagaag

SEQ ID NO: 8236 - DNA, 25 bp, Artificial sequence
  SiRNA target sequence
ttaaagaaatttgtgaagaagaagt

SEQ ID NO: 8237 - DNA, 25 bp, Artificial sequence
  SiRNA target sequence
taaagaaatttgtgaagaagaagtg

SEQ ID NO: 8238 - DNA, 25 bp, Artificial sequence
  SiRNA target sequence
aaagaaatttgtgaagaagaagtga

SEQ ID NO: 8239 - DNA, 25 bp, Artificial sequence
  SiRNA target sequence
aagaaatttgtgaagaagaagtgaa

SEQ ID NO: 8240 - DNA, 25 bp, Artificial sequence
  SiRNA target sequence
agaaatttgtgaagaagaagtgaat

SEQ ID NO: 8241 - DNA, 25 bp, Artificial sequence
  SiRNA target sequence
gaaatttgtgaagaagaagtgaatg

SEQ ID NO: 8242 - DNA, 25 bp, Artificial sequence
  SiRNA target sequence
aaatttgtgaagaagaagtgaatga

SEQ ID NO: 8243 - DNA, 25 bp, Artificial sequence
  SiRNA target sequence
aatttgtgaagaagaagtgaatgag

SEQ ID NO: 8244 - DNA, 25 bp, Artificial sequence
  SiRNA target sequence
atttgtgaagaagaagtgaatgagt

SEQ ID NO: 8245 - DNA, 25 bp, Artificial sequence
  SiRNA target sequence
tttgtgaagaagaagtgaatgagtt

SEQ ID NO: 8246 - DNA, 25 bp, Artificial sequence
  SiRNA target sequence
ttgtgaagaagaagtgaatgagttt

SEQ ID NO: 8247 - DNA, 25 bp, Artificial sequence
  SiRNA target sequence
tgtgaagaagaagtgaatgagttta

SEQ ID NO: 8248 - DNA, 25 bp, Artificial sequence
  SiRNA target sequence
gtgaagaagaagtgaatgagtttat

SEQ ID NO: 8249 - DNA, 25 bp, Artificial sequence
  SiRNA target sequence
tgaagaagaagtgaatgagtttatt

SEQ ID NO: 8250 - DNA, 25 bp, Artificial sequence
  SiRNA target sequence
gaagaagaagtgaatgagtttattg

SEQ ID NO: 8251 - DNA, 25 bp, Artificial sequence
  SiRNA target sequence
aagaagaagtgaatgagtttattga

SEQ ID NO: 8252 - DNA, 25 bp, Artificial sequence
  SiRNA target sequence
agaagaagtgaatgagtttattgaa

SEQ ID NO: 8253 - DNA, 25 bp, Artificial sequence
  SiRNA target sequence
gaagaagtgaatgagtttattgaac

SEQ ID NO: 8254 - DNA, 25 bp, Artificial sequence
  SiRNA target sequence
aagaagtgaatgagtttattgaaca

SEQ ID NO: 8255 - DNA, 25 bp, Artificial sequence
  SiRNA target sequence
agaagtgaatgagtttattgaacaa

SEQ ID NO: 8256 - DNA, 25 bp, Artificial sequence
  SiRNA target sequence
gaagtgaatgagtttattgaacaag

SEQ ID NO: 8257 - DNA, 25 bp, Artificial sequence
  SiRNA target sequence
aagtgaatgagtttattgaacaaga

SEQ ID NO: 8258 - DNA, 25 bp, Artificial sequence
  SiRNA target sequence
agtgaatgagtttattgaacaagaa

SEQ ID NO: 8259 - DNA, 25 bp, Artificial sequence
  SiRNA target sequence
gtgaatgagtttattgaacaagaag

SEQ ID NO: 8260 - DNA, 25 bp, Artificial sequence
  SiRNA target sequence
tgaatgagtttattgaacaagaagg

SEQ ID NO: 8261 - DNA, 25 bp, Artificial sequence
  SiRNA target sequence
gaatgagtttattgaacaagaaggt

SEQ ID NO: 8262 - DNA, 25 bp, Artificial sequence
  SiRNA target sequence
aatgagtttattgaacaagaaggtt

SEQ ID NO: 8263 - DNA, 25 bp, Artificial sequence
  SiRNA target sequence
atgagtttattgaacaagaaggttt

SEQ ID NO: 8264 - DNA, 25 bp, Artificial sequence
  SiRNA target sequence
tgagtttattgaacaagaaggttta

SEQ ID NO: 8265 - DNA, 25 bp, Artificial sequence
  SiRNA target sequence
gagtttattgaacaagaaggtttaa

SEQ ID NO: 8266 - DNA, 25 bp, Artificial sequence
  SiRNA target sequence
agtttattgaacaagaaggtttaaa

SEQ ID NO: 8267 - DNA, 25 bp, Artificial sequence
  SiRNA target sequence
gtttattgaacaagaaggtttaaaa

SEQ ID NO: 8268 - DNA, 25 bp, Artificial sequence
  SiRNA target sequence
tttattgaacaagaaggtttaaaaa

SEQ ID NO: 8269 - DNA, 25 bp, Artificial sequence
  SiRNA target sequence
ttattgaacaagaaggtttaaaaat

SEQ ID NO: 8270 - DNA, 25 bp, Artificial sequence
  SiRNA target sequence
tattgaacaagaaggtttaaaaatt

SEQ ID NO: 8271 - DNA, 25 bp, Artificial sequence
  SiRNA target sequence
attgaacaagaaggtttaaaaatta

SEQ ID NO: 8272 - DNA, 25 bp, Artificial sequence
  SiRNA target sequence
ttgaacaagaaggtttaaaaattaa

SEQ ID NO: 8273 - DNA, 25 bp, Artificial sequence
  SiRNA target sequence
tgaacaagaaggtttaaaaattaat

SEQ ID NO: 8274 - DNA, 25 bp, Artificial sequence
  SiRNA target sequence
gaacaagaaggtttaaaaattaata

SEQ ID NO: 8275 - DNA, 25 bp, Artificial sequence
  SiRNA target sequence
aacaagaaggtttaaaaattaataa

SEQ ID NO: 8276 - DNA, 25 bp, Artificial sequence
  SiRNA target sequence
acaagaaggtttaaaaattaataaa

SEQ ID NO: 8277 - DNA, 25 bp, Artificial sequence
  SiRNA target sequence
caagaaggtttaaaaattaataaag

SEQ ID NO: 8278 - DNA, 25 bp, Artificial sequence
  SiRNA target sequence
aagaaggtttaaaaattaataaaga

SEQ ID NO: 8279 - DNA, 25 bp, Artificial sequence
  SiRNA target sequence
agaaggtttaaaaattaataaagaa

SEQ ID NO: 8280 - DNA, 25 bp, Artificial sequence
  SiRNA target sequence
gaaggtttaaaaattaataaagaag

SEQ ID NO: 8281 - DNA, 25 bp, Artificial sequence
  SiRNA target sequence
aaggtttaaaaattaataaagaaga

SEQ ID NO: 8282 - DNA, 25 bp, Artificial sequence
  SiRNA target sequence
aggtttaaaaattaataaagaagat

SEQ ID NO: 8283 - DNA, 25 bp, Artificial sequence
  SiRNA target sequence
ggtttaaaaattaataaagaagatg

SEQ ID NO: 8284 - DNA, 25 bp, Artificial sequence
  SiRNA target sequence
gtttaaaaattaataaagaagatgt

SEQ ID NO: 8285 - DNA, 25 bp, Artificial sequence
  SiRNA target sequence
tttaaaaattaataaagaagatgtg

SEQ ID NO: 8286 - DNA, 25 bp, Artificial sequence
  SiRNA target sequence
ttaaaaattaataaagaagatgtgc

SEQ ID NO: 8287 - DNA, 25 bp, Artificial sequence
  SiRNA target sequence
taaaaattaataaagaagatgtgct

SEQ ID NO: 8288 - DNA, 25 bp, Artificial sequence
  SiRNA target sequence
aaaaattaataaagaagatgtgcta

SEQ ID NO: 8289 - DNA, 25 bp, Artificial sequence
  SiRNA target sequence
aaaattaataaagaagatgtgctaa

SEQ ID NO: 8290 - DNA, 25 bp, Artificial sequence
  SiRNA target sequence
aaattaataaagaagatgtgctaag

SEQ ID NO: 8291 - DNA, 25 bp, Artificial sequence
  SiRNA target sequence
aattaataaagaagatgtgctaaga

SEQ ID NO: 8292 - DNA, 25 bp, Artificial sequence
  SiRNA target sequence
attaataaagaagatgtgctaagag

SEQ ID NO: 8293 - DNA, 25 bp, Artificial sequence
  SiRNA target sequence
ttaataaagaagatgtgctaagagg

SEQ ID NO: 8294 - DNA, 25 bp, Artificial sequence
  SiRNA target sequence
taataaagaagatgtgctaagagga

SEQ ID NO: 8295 - DNA, 25 bp, Artificial sequence
  SiRNA target sequence
aataaagaagatgtgctaagaggac

SEQ ID NO: 8296 - DNA, 25 bp, Artificial sequence
  SiRNA target sequence
ataaagaagatgtgctaagaggact

SEQ ID NO: 8297 - DNA, 25 bp, Artificial sequence
  SiRNA target sequence
taaagaagatgtgctaagaggactt

SEQ ID NO: 8298 - DNA, 25 bp, Artificial sequence
  SiRNA target sequence
aaagaagatgtgctaagaggacttg

SEQ ID NO: 8299 - DNA, 25 bp, Artificial sequence
  SiRNA target sequence
aagaagatgtgctaagaggacttgt

SEQ ID NO: 8300 - DNA, 25 bp, Artificial sequence
  SiRNA target sequence
agaagatgtgctaagaggacttgtt

SEQ ID NO: 8301 - DNA, 25 bp, Artificial sequence
  SiRNA target sequence
gaagatgtgctaagaggacttgttt

SEQ ID NO: 8302 - DNA, 25 bp, Artificial sequence
  SiRNA target sequence
aagatgtgctaagaggacttgtttc

SEQ ID NO: 8303 - DNA, 25 bp, Artificial sequence
  SiRNA target sequence
agatgtgctaagaggacttgtttca

SEQ ID NO: 8304 - DNA, 25 bp, Artificial sequence
  SiRNA target sequence
gatgtgctaagaggacttgtttcaa

SEQ ID NO: 8305 - DNA, 25 bp, Artificial sequence
  SiRNA target sequence
atgtgctaagaggacttgtttcaat

SEQ ID NO: 8306 - DNA, 25 bp, Artificial sequence
  SiRNA target sequence
tgtgctaagaggacttgtttcaata

SEQ ID NO: 8307 - DNA, 25 bp, Artificial sequence
  SiRNA target sequence
gtgctaagaggacttgtttcaataa

SEQ ID NO: 8308 - DNA, 25 bp, Artificial sequence
  SiRNA target sequence
tgctaagaggacttgtttcaataaa

SEQ ID NO: 8309 - DNA, 25 bp, Artificial sequence
  SiRNA target sequence
gctaagaggacttgtttcaataaaa

SEQ ID NO: 8310 - DNA, 25 bp, Artificial sequence
  SiRNA target sequence
ctaagaggacttgtttcaataaaaa

SEQ ID NO: 8311 - DNA, 25 bp, Artificial sequence
  SiRNA target sequence
taagaggacttgtttcaataaaaaa

SEQ ID NO: 8312 - DNA, 25 bp, Artificial sequence
  SiRNA target sequence
aagaggacttgtttcaataaaaaat

SEQ ID NO: 8313 - DNA, 25 bp, Artificial sequence
  SiRNA target sequence
agaggacttgtttcaataaaaaata

SEQ ID NO: 8314 - DNA, 25 bp, Artificial sequence
  SiRNA target sequence
gaggacttgtttcaataaaaaatat

SEQ ID NO: 8315 - DNA, 25 bp, Artificial sequence
  SiRNA target sequence
aggacttgtttcaataaaaaatata

SEQ ID NO: 8316 - DNA, 25 bp, Artificial sequence
  SiRNA target sequence
ggacttgtttcaataaaaaatataa

SEQ ID NO: 8317 - DNA, 25 bp, Artificial sequence
  SiRNA target sequence
gacttgtttcaataaaaaatataaa

SEQ ID NO: 8318 - DNA, 25 bp, Artificial sequence
  SiRNA target sequence
acttgtttcaataaaaaatataaat

SEQ ID NO: 8319 - DNA, 25 bp, Artificial sequence
  SiRNA target sequence
cttgtttcaataaaaaatataaatg

SEQ ID NO: 8320 - DNA, 25 bp, Artificial sequence
  SiRNA target sequence
ttgtttcaataaaaaatataaatga

SEQ ID NO: 8321 - DNA, 25 bp, Artificial sequence
  SiRNA target sequence
tgtttcaataaaaaatataaatgag

SEQ ID NO: 8322 - DNA, 25 bp, Artificial sequence
  SiRNA target sequence
gtttcaataaaaaatataaatgaga

SEQ ID NO: 8323 - DNA, 25 bp, Artificial sequence
  SiRNA target sequence
tttcaataaaaaatataaatgagat

SEQ ID NO: 8324 - DNA, 25 bp, Artificial sequence
  SiRNA target sequence
ttcaataaaaaatataaatgagatt

SEQ ID NO: 8325 - DNA, 25 bp, Artificial sequence
  SiRNA target sequence
tcaataaaaaatataaatgagattt

SEQ ID NO: 8326 - DNA, 25 bp, Artificial sequence
  SiRNA target sequence
caataaaaaatataaatgagattta

SEQ ID NO: 8327 - DNA, 25 bp, Artificial sequence
  SiRNA target sequence
aataaaaaatataaatgagatttat

SEQ ID NO: 8328 - DNA, 25 bp, Artificial sequence
  SiRNA target sequence
ataaaaaatataaatgagatttatg

SEQ ID NO: 8329 - DNA, 25 bp, Artificial sequence
  SiRNA target sequence
taaaaaatataaatgagatttatga

SEQ ID NO: 8330 - DNA, 25 bp, Artificial sequence
  SiRNA target sequence
aaaaaatataaatgagatttatgat

SEQ ID NO: 8331 - DNA, 25 bp, Artificial sequence
  SiRNA target sequence
aaaaatataaatgagatttatgatg

SEQ ID NO: 8332 - DNA, 25 bp, Artificial sequence
  SiRNA target sequence
aaaatataaatgagatttatgatgc

SEQ ID NO: 8333 - DNA, 25 bp, Artificial sequence
  SiRNA target sequence
aaatataaatgagatttatgatgca

SEQ ID NO: 8334 - DNA, 25 bp, Artificial sequence
  SiRNA target sequence
aatataaatgagatttatgatgcat

SEQ ID NO: 8335 - DNA, 25 bp, Artificial sequence
  SiRNA target sequence
atataaatgagatttatgatgcatt

SEQ ID NO: 8336 - DNA, 25 bp, Artificial sequence
  SiRNA target sequence
tataaatgagatttatgatgcattt

SEQ ID NO: 8337 - DNA, 25 bp, Artificial sequence
  SiRNA target sequence
ataaatgagatttatgatgcatttg

SEQ ID NO: 8338 - DNA, 25 bp, Artificial sequence
  SiRNA target sequence
taaatgagatttatgatgcatttgg

SEQ ID NO: 8339 - DNA, 25 bp, Artificial sequence
  SiRNA target sequence
aaatgagatttatgatgcatttgga

SEQ ID NO: 8340 - DNA, 25 bp, Artificial sequence
  SiRNA target sequence
aatgagatttatgatgcatttggag

SEQ ID NO: 8341 - DNA, 25 bp, Artificial sequence
  SiRNA target sequence
atgagatttatgatgcatttggagg

SEQ ID NO: 8342 - DNA, 25 bp, Artificial sequence
  SiRNA target sequence
tgagatttatgatgcatttggaggt

SEQ ID NO: 8343 - DNA, 25 bp, Artificial sequence
  SiRNA target sequence
gagatttatgatgcatttggaggta

SEQ ID NO: 8344 - DNA, 25 bp, Artificial sequence
  SiRNA target sequence
agatttatgatgcatttggaggtaa

SEQ ID NO: 8345 - DNA, 25 bp, Artificial sequence
  SiRNA target sequence
gatttatgatgcatttggaggtaaa

SEQ ID NO: 8346 - DNA, 25 bp, Artificial sequence
  SiRNA target sequence
atttatgatgcatttggaggtaaat

SEQ ID NO: 8347 - DNA, 25 bp, Artificial sequence
  SiRNA target sequence
tttatgatgcatttggaggtaaatc

SEQ ID NO: 8348 - DNA, 25 bp, Artificial sequence
  SiRNA target sequence
ttatgatgcatttggaggtaaatct

SEQ ID NO: 8349 - DNA, 25 bp, Artificial sequence
  SiRNA target sequence
tatgatgcatttggaggtaaatcta

SEQ ID NO: 8350 - DNA, 25 bp, Artificial sequence
  SiRNA target sequence
atgatgcatttggaggtaaatctaa

SEQ ID NO: 8351 - DNA, 25 bp, Artificial sequence
  SiRNA target sequence
tgatgcatttggaggtaaatctaag

SEQ ID NO: 8352 - DNA, 25 bp, Artificial sequence
  SiRNA target sequence
gatgcatttggaggtaaatctaaga

SEQ ID NO: 8353 - DNA, 25 bp, Artificial sequence
  SiRNA target sequence
atgcatttggaggtaaatctaagaa

SEQ ID NO: 8354 - DNA, 25 bp, Artificial sequence
  SiRNA target sequence
tgcatttggaggtaaatctaagaag

SEQ ID NO: 8355 - DNA, 25 bp, Artificial sequence
  SiRNA target sequence
gcatttggaggtaaatctaagaagt

SEQ ID NO: 8356 - DNA, 25 bp, Artificial sequence
  SiRNA target sequence
catttggaggtaaatctaagaagtt

SEQ ID NO: 8357 - DNA, 25 bp, Artificial sequence
  SiRNA target sequence
atttggaggtaaatctaagaagttt

SEQ ID NO: 8358 - DNA, 25 bp, Artificial sequence
  SiRNA target sequence
tttggaggtaaatctaagaagttta

SEQ ID NO: 8359 - DNA, 25 bp, Artificial sequence
  SiRNA target sequence
ttggaggtaaatctaagaagtttaa

SEQ ID NO: 8360 - DNA, 25 bp, Artificial sequence
  SiRNA target sequence
tggaggtaaatctaagaagtttaaa

SEQ ID NO: 8361 - DNA, 25 bp, Artificial sequence
  SiRNA target sequence
ggaggtaaatctaagaagtttaaat

SEQ ID NO: 8362 - DNA, 25 bp, Artificial sequence
  SiRNA target sequence
gaggtaaatctaagaagtttaaatt

SEQ ID NO: 8363 - DNA, 25 bp, Artificial sequence
  SiRNA target sequence
aggtaaatctaagaagtttaaattt

SEQ ID NO: 8364 - DNA, 25 bp, Artificial sequence
  SiRNA target sequence
ggtaaatctaagaagtttaaatttt

SEQ ID NO: 8365 - DNA, 25 bp, Artificial sequence
  SiRNA target sequence
gtaaatctaagaagtttaaattttc

SEQ ID NO: 8366 - DNA, 25 bp, Artificial sequence
  SiRNA target sequence
taaatctaagaagtttaaattttct

SEQ ID NO: 8367 - DNA, 25 bp, Artificial sequence
  SiRNA target sequence
aaatctaagaagtttaaattttcta

SEQ ID NO: 8368 - DNA, 25 bp, Artificial sequence
  SiRNA target sequence
aatctaagaagtttaaattttctaa

SEQ ID NO: 8369 - DNA, 25 bp, Artificial sequence
  SiRNA target sequence
atctaagaagtttaaattttctaat

SEQ ID NO: 8370 - DNA, 25 bp, Artificial sequence
  SiRNA target sequence
tctaagaagtttaaattttctaatg

SEQ ID NO: 8371 - DNA, 25 bp, Artificial sequence
  SiRNA target sequence
ctaagaagtttaaattttctaatga

SEQ ID NO: 8372 - DNA, 25 bp, Artificial sequence
  SiRNA target sequence
taagaagtttaaattttctaatgat

SEQ ID NO: 8373 - DNA, 25 bp, Artificial sequence
  SiRNA target sequence
aagaagtttaaattttctaatgatg

SEQ ID NO: 8374 - DNA, 25 bp, Artificial sequence
  SiRNA target sequence
agaagtttaaattttctaatgatga

SEQ ID NO: 8375 - DNA, 25 bp, Artificial sequence
  SiRNA target sequence
gaagtttaaattttctaatgatgaa

SEQ ID NO: 8376 - DNA, 25 bp, Artificial sequence
  SiRNA target sequence
aagtttaaattttctaatgatgaaa

SEQ ID NO: 8377 - DNA, 25 bp, Artificial sequence
  SiRNA target sequence
agtttaaattttctaatgatgaaaa

SEQ ID NO: 8378 - DNA, 25 bp, Artificial sequence
  SiRNA target sequence
gtttaaattttctaatgatgaaaag

SEQ ID NO: 8379 - DNA, 25 bp, Artificial sequence
  SiRNA target sequence
tttaaattttctaatgatgaaaagg

SEQ ID NO: 8380 - DNA, 25 bp, Artificial sequence
  SiRNA target sequence
ttaaattttctaatgatgaaaagga

SEQ ID NO: 8381 - DNA, 25 bp, Artificial sequence
  SiRNA target sequence
taaattttctaatgatgaaaaggaa

SEQ ID NO: 8382 - DNA, 25 bp, Artificial sequence
  SiRNA target sequence
aaattttctaatgatgaaaaggaag

SEQ ID NO: 8383 - DNA, 25 bp, Artificial sequence
  SiRNA target sequence
aattttctaatgatgaaaaggaagt

SEQ ID NO: 8384 - DNA, 25 bp, Artificial sequence
  SiRNA target sequence
attttctaatgatgaaaaggaagtg

SEQ ID NO: 8385 - DNA, 25 bp, Artificial sequence
  SiRNA target sequence
ttttctaatgatgaaaaggaagtgt

SEQ ID NO: 8386 - DNA, 25 bp, Artificial sequence
  SiRNA target sequence
tttctaatgatgaaaaggaagtgtt

SEQ ID NO: 8387 - DNA, 25 bp, Artificial sequence
  SiRNA target sequence
ttctaatgatgaaaaggaagtgtta

SEQ ID NO: 8388 - DNA, 25 bp, Artificial sequence
  SiRNA target sequence
tctaatgatgaaaaggaagtgttaa

SEQ ID NO: 8389 - DNA, 25 bp, Artificial sequence
  SiRNA target sequence
ctaatgatgaaaaggaagtgttaaa

SEQ ID NO: 8390 - DNA, 25 bp, Artificial sequence
  SiRNA target sequence
taatgatgaaaaggaagtgttaaat

SEQ ID NO: 8391 - DNA, 25 bp, Artificial sequence
  SiRNA target sequence
aatgatgaaaaggaagtgttaaatc

SEQ ID NO: 8392 - DNA, 25 bp, Artificial sequence
  SiRNA target sequence
atgatgaaaaggaagtgttaaatct

SEQ ID NO: 8393 - DNA, 25 bp, Artificial sequence
  SiRNA target sequence
tgatgaaaaggaagtgttaaatctt

SEQ ID NO: 8394 - DNA, 25 bp, Artificial sequence
  SiRNA target sequence
gatgaaaaggaagtgttaaatcttc

SEQ ID NO: 8395 - DNA, 25 bp, Artificial sequence
  SiRNA target sequence
atgaaaaggaagtgttaaatcttct

SEQ ID NO: 8396 - DNA, 25 bp, Artificial sequence
  SiRNA target sequence
tgaaaaggaagtgttaaatcttctt

SEQ ID NO: 8397 - DNA, 25 bp, Artificial sequence
  SiRNA target sequence
gaaaaggaagtgttaaatcttctta

SEQ ID NO: 8398 - DNA, 25 bp, Artificial sequence
  SiRNA target sequence
aaaaggaagtgttaaatcttcttaa

SEQ ID NO: 8399 - DNA, 25 bp, Artificial sequence
  SiRNA target sequence
aaaggaagtgttaaatcttcttaat

SEQ ID NO: 8400 - DNA, 25 bp, Artificial sequence
  SiRNA target sequence
aaggaagtgttaaatcttcttaatg

SEQ ID NO: 8401 - DNA, 25 bp, Artificial sequence
  SiRNA target sequence
aggaagtgttaaatcttcttaatgc

SEQ ID NO: 8402 - DNA, 25 bp, Artificial sequence
  SiRNA target sequence
ggaagtgttaaatcttcttaatgcc

SEQ ID NO: 8403 - DNA, 25 bp, Artificial sequence
  SiRNA target sequence
gaagtgttaaatcttcttaatgcca

SEQ ID NO: 8404 - DNA, 25 bp, Artificial sequence
  SiRNA target sequence
aagtgttaaatcttcttaatgccat

SEQ ID NO: 8405 - DNA, 25 bp, Artificial sequence
  SiRNA target sequence
agtgttaaatcttcttaatgccatt

SEQ ID NO: 8406 - DNA, 25 bp, Artificial sequence
  SiRNA target sequence
gtgttaaatcttcttaatgccatta

SEQ ID NO: 8407 - DNA, 25 bp, Artificial sequence
  SiRNA target sequence
tgttaaatcttcttaatgccattat

SEQ ID NO: 8408 - DNA, 25 bp, Artificial sequence
  SiRNA target sequence
gttaaatcttcttaatgccattatt

SEQ ID NO: 8409 - DNA, 25 bp, Artificial sequence
  SiRNA target sequence
ttaaatcttcttaatgccattattt

SEQ ID NO: 8410 - DNA, 25 bp, Artificial sequence
  SiRNA target sequence
taaatcttcttaatgccattatttt

SEQ ID NO: 8411 - DNA, 25 bp, Artificial sequence
  SiRNA target sequence
aaatcttcttaatgccattatttta

SEQ ID NO: 8412 - DNA, 25 bp, Artificial sequence
  SiRNA target sequence
aatcttcttaatgccattattttac

SEQ ID NO: 8413 - DNA, 25 bp, Artificial sequence
  SiRNA target sequence
atcttcttaatgccattattttaca

SEQ ID NO: 8414 - DNA, 25 bp, Artificial sequence
  SiRNA target sequence
tcttcttaatgccattattttacac

SEQ ID NO: 8415 - DNA, 25 bp, Artificial sequence
  SiRNA target sequence
cttcttaatgccattattttacacc

SEQ ID NO: 8416 - DNA, 25 bp, Artificial sequence
  SiRNA target sequence
ttcttaatgccattattttacacct

SEQ ID NO: 8417 - DNA, 25 bp, Artificial sequence
  SiRNA target sequence
tcttaatgccattattttacaccta

SEQ ID NO: 8418 - DNA, 25 bp, Artificial sequence
  SiRNA target sequence
cttaatgccattattttacacctaa

SEQ ID NO: 8419 - DNA, 25 bp, Artificial sequence
  SiRNA target sequence
ttaatgccattattttacacctaaa

SEQ ID NO: 8420 - DNA, 25 bp, Artificial sequence
  SiRNA target sequence
taatgccattattttacacctaaaa

SEQ ID NO: 8421 - DNA, 25 bp, Artificial sequence
  SiRNA target sequence
aatgccattattttacacctaaaag

SEQ ID NO: 8422 - DNA, 25 bp, Artificial sequence
  SiRNA target sequence
atgccattattttacacctaaaagg

SEQ ID NO: 8423 - DNA, 25 bp, Artificial sequence
  SiRNA target sequence
tgccattattttacacctaaaagga

SEQ ID NO: 8424 - DNA, 25 bp, Artificial sequence
  SiRNA target sequence
gccattattttacacctaaaaggaa

SEQ ID NO: 8425 - DNA, 25 bp, Artificial sequence
  SiRNA target sequence
ccattattttacacctaaaaggaaa

SEQ ID NO: 8426 - DNA, 25 bp, Artificial sequence
  SiRNA target sequence
cattattttacacctaaaaggaaaa

SEQ ID NO: 8427 - DNA, 25 bp, Artificial sequence
  SiRNA target sequence
attattttacacctaaaaggaaaaa

SEQ ID NO: 8428 - DNA, 25 bp, Artificial sequence
  SiRNA target sequence
ttattttacacctaaaaggaaaaaa

SEQ ID NO: 8429 - DNA, 25 bp, Artificial sequence
  SiRNA target sequence
tattttacacctaaaaggaaaaaaa

SEQ ID NO: 8430 - DNA, 25 bp, Artificial sequence
  SiRNA target sequence
attttacacctaaaaggaaaaaaag

SEQ ID NO: 8431 - DNA, 25 bp, Artificial sequence
  SiRNA target sequence
ttttacacctaaaaggaaaaaaaga

SEQ ID NO: 8432 - DNA, 25 bp, Artificial sequence
  SiRNA target sequence
tttacacctaaaaggaaaaaaagaa

SEQ ID NO: 8433 - DNA, 25 bp, Artificial sequence
  SiRNA target sequence
ttacacctaaaaggaaaaaaagaac

SEQ ID NO: 8434 - DNA, 25 bp, Artificial sequence
  SiRNA target sequence
tacacctaaaaggaaaaaaagaaca

SEQ ID NO: 8435 - DNA, 25 bp, Artificial sequence
  SiRNA target sequence
acacctaaaaggaaaaaaagaacag

SEQ ID NO: 8436 - DNA, 25 bp, Artificial sequence
  SiRNA target sequence
cacctaaaaggaaaaaaagaacagg

SEQ ID NO: 8437 - DNA, 25 bp, Artificial sequence
  SiRNA target sequence
acctaaaaggaaaaaaagaacaggc

SEQ ID NO: 8438 - DNA, 25 bp, Artificial sequence
  SiRNA target sequence
cctaaaaggaaaaaaagaacaggca

SEQ ID NO: 8439 - DNA, 25 bp, Artificial sequence
  SiRNA target sequence
ctaaaaggaaaaaaagaacaggcaa

SEQ ID NO: 8440 - DNA, 25 bp, Artificial sequence
  SiRNA target sequence
taaaaggaaaaaaagaacaggcaat

SEQ ID NO: 8441 - DNA, 25 bp, Artificial sequence
  SiRNA target sequence
aaaaggaaaaaaagaacaggcaatt

SEQ ID NO: 8442 - DNA, 25 bp, Artificial sequence
  SiRNA target sequence
aaaggaaaaaaagaacaggcaattc

SEQ ID NO: 8443 - DNA, 25 bp, Artificial sequence
  SiRNA target sequence
aaggaaaaaaagaacaggcaattct

SEQ ID NO: 8444 - DNA, 25 bp, Artificial sequence
  SiRNA target sequence
aggaaaaaaagaacaggcaattctt

SEQ ID NO: 8445 - DNA, 25 bp, Artificial sequence
  SiRNA target sequence
ggaaaaaaagaacaggcaattcttt

SEQ ID NO: 8446 - DNA, 25 bp, Artificial sequence
  SiRNA target sequence
gaaaaaaagaacaggcaattctttt

SEQ ID NO: 8447 - DNA, 25 bp, Artificial sequence
  SiRNA target sequence
aaaaaaagaacaggcaattctttta

SEQ ID NO: 8448 - DNA, 25 bp, Artificial sequence
  SiRNA target sequence
aaaaaagaacaggcaattcttttat

SEQ ID NO: 8449 - DNA, 25 bp, Artificial sequence
  SiRNA target sequence
aaaaagaacaggcaattcttttatt

SEQ ID NO: 8450 - DNA, 25 bp, Artificial sequence
  SiRNA target sequence
aaaagaacaggcaattcttttatta

SEQ ID NO: 8451 - DNA, 25 bp, Artificial sequence
  SiRNA target sequence
aaagaacaggcaattcttttattag

SEQ ID NO: 8452 - DNA, 25 bp, Artificial sequence
  SiRNA target sequence
aagaacaggcaattcttttattaga

SEQ ID NO: 8453 - DNA, 25 bp, Artificial sequence
  SiRNA target sequence
agaacaggcaattcttttattagaa

SEQ ID NO: 8454 - DNA, 25 bp, Artificial sequence
  SiRNA target sequence
gaacaggcaattcttttattagaaa

SEQ ID NO: 8455 - DNA, 25 bp, Artificial sequence
  SiRNA target sequence
aacaggcaattcttttattagaaaa

SEQ ID NO: 8456 - DNA, 25 bp, Artificial sequence
  SiRNA target sequence
acaggcaattcttttattagaaaaa

SEQ ID NO: 8457 - DNA, 25 bp, Artificial sequence
  SiRNA target sequence
caggcaattcttttattagaaaaat

SEQ ID NO: 8458 - DNA, 25 bp, Artificial sequence
  SiRNA target sequence
aggcaattcttttattagaaaaatc

SEQ ID NO: 8459 - DNA, 25 bp, Artificial sequence
  SiRNA target sequence
ggcaattcttttattagaaaaatct

SEQ ID NO: 8460 - DNA, 25 bp, Artificial sequence
  SiRNA target sequence
gcaattcttttattagaaaaatcta

SEQ ID NO: 8461 - DNA, 25 bp, Artificial sequence
  SiRNA target sequence
caattcttttattagaaaaatctac

SEQ ID NO: 8462 - DNA, 25 bp, Artificial sequence
  SiRNA target sequence
aattcttttattagaaaaatctact

SEQ ID NO: 8463 - DNA, 25 bp, Artificial sequence
  SiRNA target sequence
attcttttattagaaaaatctactt

SEQ ID NO: 8464 - DNA, 25 bp, Artificial sequence
  SiRNA target sequence
ttcttttattagaaaaatctactta

SEQ ID NO: 8465 - DNA, 25 bp, Artificial sequence
  SiRNA target sequence
tcttttattagaaaaatctacttat

SEQ ID NO: 8466 - DNA, 25 bp, Artificial sequence
  SiRNA target sequence
cttttattagaaaaatctacttata

SEQ ID NO: 8467 - DNA, 25 bp, Artificial sequence
  SiRNA target sequence
ttttattagaaaaatctacttataa

SEQ ID NO: 8468 - DNA, 25 bp, Artificial sequence
  SiRNA target sequence
tttattagaaaaatctacttataaa

SEQ ID NO: 8469 - DNA, 25 bp, Artificial sequence
  SiRNA target sequence
ttattagaaaaatctacttataaat

SEQ ID NO: 8470 - DNA, 25 bp, Artificial sequence
  SiRNA target sequence
tattagaaaaatctacttataaata

SEQ ID NO: 8471 - DNA, 25 bp, Artificial sequence
  SiRNA target sequence
attagaaaaatctacttataaatac

SEQ ID NO: 8472 - DNA, 25 bp, Artificial sequence
  SiRNA target sequence
ttagaaaaatctacttataaataca

SEQ ID NO: 8473 - DNA, 25 bp, Artificial sequence
  SiRNA target sequence
tagaaaaatctacttataaatacag

SEQ ID NO: 8474 - DNA, 25 bp, Artificial sequence
  SiRNA target sequence
agaaaaatctacttataaatacagt

SEQ ID NO: 8475 - DNA, 25 bp, Artificial sequence
  SiRNA target sequence
gaaaaatctacttataaatacagta

SEQ ID NO: 8476 - DNA, 25 bp, Artificial sequence
  SiRNA target sequence
aaaaatctacttataaatacagtat

SEQ ID NO: 8477 - DNA, 25 bp, Artificial sequence
  SiRNA target sequence
aaaatctacttataaatacagtatc

SEQ ID NO: 8478 - DNA, 25 bp, Artificial sequence
  SiRNA target sequence
aaatctacttataaatacagtatct

SEQ ID NO: 8479 - DNA, 25 bp, Artificial sequence
  SiRNA target sequence
aatctacttataaatacagtatctt

SEQ ID NO: 8480 - DNA, 25 bp, Artificial sequence
  SiRNA target sequence
atctacttataaatacagtatcttg

SEQ ID NO: 8481 - DNA, 25 bp, Artificial sequence
  SiRNA target sequence
tctacttataaatacagtatcttgt

SEQ ID NO: 8482 - DNA, 25 bp, Artificial sequence
  SiRNA target sequence
ctacttataaatacagtatcttgta

SEQ ID NO: 8483 - DNA, 25 bp, Artificial sequence
  SiRNA target sequence
tacttataaatacagtatcttgtat

SEQ ID NO: 8484 - DNA, 25 bp, Artificial sequence
  SiRNA target sequence
acttataaatacagtatcttgtata

SEQ ID NO: 8485 - DNA, 25 bp, Artificial sequence
  SiRNA target sequence
cttataaatacagtatcttgtatag

SEQ ID NO: 8486 - DNA, 25 bp, Artificial sequence
  SiRNA target sequence
ttataaatacagtatcttgtataga

SEQ ID NO: 8487 - DNA, 25 bp, Artificial sequence
  SiRNA target sequence
tataaatacagtatcttgtatagag

SEQ ID NO: 8488 - DNA, 25 bp, Artificial sequence
  SiRNA target sequence
ataaatacagtatcttgtatagagc

SEQ ID NO: 8489 - DNA, 25 bp, Artificial sequence
  SiRNA target sequence
taaatacagtatcttgtatagagca

SEQ ID NO: 8490 - DNA, 25 bp, Artificial sequence
  SiRNA target sequence
aaatacagtatcttgtatagagcat

SEQ ID NO: 8491 - DNA, 25 bp, Artificial sequence
  SiRNA target sequence
aatacagtatcttgtatagagcata

SEQ ID NO: 8492 - DNA, 25 bp, Artificial sequence
  SiRNA target sequence
atacagtatcttgtatagagcatat

SEQ ID NO: 8493 - DNA, 25 bp, Artificial sequence
  SiRNA target sequence
tacagtatcttgtatagagcatatt

SEQ ID NO: 8494 - DNA, 25 bp, Artificial sequence
  SiRNA target sequence
acagtatcttgtatagagcatattt

SEQ ID NO: 8495 - DNA, 25 bp, Artificial sequence
  SiRNA target sequence
cagtatcttgtatagagcatatttt

SEQ ID NO: 8496 - DNA, 25 bp, Artificial sequence
  SiRNA target sequence
agtatcttgtatagagcatattttc

SEQ ID NO: 8497 - DNA, 25 bp, Artificial sequence
  SiRNA target sequence
gtatcttgtatagagcatattttct

SEQ ID NO: 8498 - DNA, 25 bp, Artificial sequence
  SiRNA target sequence
tatcttgtatagagcatattttctt

SEQ ID NO: 8499 - DNA, 25 bp, Artificial sequence
  SiRNA target sequence
atcttgtatagagcatattttctta

SEQ ID NO: 8500 - DNA, 25 bp, Artificial sequence
  SiRNA target sequence
tcttgtatagagcatattttcttac

SEQ ID NO: 8501 - DNA, 25 bp, Artificial sequence
  SiRNA target sequence
cttgtatagagcatattttcttaca

SEQ ID NO: 8502 - DNA, 25 bp, Artificial sequence
  SiRNA target sequence
ttgtatagagcatattttcttacat

SEQ ID NO: 8503 - DNA, 25 bp, Artificial sequence
  SiRNA target sequence
tgtatagagcatattttcttacatt

SEQ ID NO: 8504 - DNA, 25 bp, Artificial sequence
  SiRNA target sequence
gtatagagcatattttcttacattg

SEQ ID NO: 8505 - DNA, 25 bp, Artificial sequence
  SiRNA target sequence
tatagagcatattttcttacattga

SEQ ID NO: 8506 - DNA, 25 bp, Artificial sequence
  SiRNA target sequence
atagagcatattttcttacattgaa

SEQ ID NO: 8507 - DNA, 25 bp, Artificial sequence
  SiRNA target sequence
tagagcatattttcttacattgaag

SEQ ID NO: 8508 - DNA, 25 bp, Artificial sequence
  SiRNA target sequence
agagcatattttcttacattgaaga

SEQ ID NO: 8509 - DNA, 25 bp, Artificial sequence
  SiRNA target sequence
gagcatattttcttacattgaagaa

SEQ ID NO: 8510 - DNA, 25 bp, Artificial sequence
  SiRNA target sequence
agcatattttcttacattgaagaat

SEQ ID NO: 8511 - DNA, 25 bp, Artificial sequence
  SiRNA target sequence
gcatattttcttacattgaagaatg

SEQ ID NO: 8512 - DNA, 25 bp, Artificial sequence
  SiRNA target sequence
catattttcttacattgaagaatga

SEQ ID NO: 8513 - DNA, 25 bp, Artificial sequence
  SiRNA target sequence
atattttcttacattgaagaatgaa

SEQ ID NO: 8514 - DNA, 25 bp, Artificial sequence
  SiRNA target sequence
tattttcttacattgaagaatgaat

SEQ ID NO: 8515 - DNA, 25 bp, Artificial sequence
  SiRNA target sequence
attttcttacattgaagaatgaata

SEQ ID NO: 8516 - DNA, 25 bp, Artificial sequence
  SiRNA target sequence
ttttcttacattgaagaatgaatat

SEQ ID NO: 8517 - DNA, 25 bp, Artificial sequence
  SiRNA target sequence
tttcttacattgaagaatgaatata

SEQ ID NO: 8518 - DNA, 25 bp, Artificial sequence
  SiRNA target sequence
ttcttacattgaagaatgaatatat

SEQ ID NO: 8519 - DNA, 25 bp, Artificial sequence
  SiRNA target sequence
tcttacattgaagaatgaatatatt

SEQ ID NO: 8520 - DNA, 25 bp, Artificial sequence
  SiRNA target sequence
cttacattgaagaatgaatatattt

SEQ ID NO: 8521 - DNA, 25 bp, Artificial sequence
  SiRNA target sequence
ttacattgaagaatgaatatatttc

SEQ ID NO: 8522 - DNA, 25 bp, Artificial sequence
  SiRNA target sequence
tacattgaagaatgaatatatttca

SEQ ID NO: 8523 - DNA, 25 bp, Artificial sequence
  SiRNA target sequence
acattgaagaatgaatatatttcat

SEQ ID NO: 8524 - DNA, 25 bp, Artificial sequence
  SiRNA target sequence
cattgaagaatgaatatatttcatc

SEQ ID NO: 8525 - DNA, 25 bp, Artificial sequence
  SiRNA target sequence
attgaagaatgaatatatttcatct

SEQ ID NO: 8526 - DNA, 25 bp, Artificial sequence
  SiRNA target sequence
ttgaagaatgaatatatttcatctt

SEQ ID NO: 8527 - DNA, 25 bp, Artificial sequence
  SiRNA target sequence
tgaagaatgaatatatttcatcttc

SEQ ID NO: 8528 - DNA, 25 bp, Artificial sequence
  SiRNA target sequence
gaagaatgaatatatttcatcttca

SEQ ID NO: 8529 - DNA, 25 bp, Artificial sequence
  SiRNA target sequence
aagaatgaatatatttcatcttcat

SEQ ID NO: 8530 - DNA, 25 bp, Artificial sequence
  SiRNA target sequence
agaatgaatatatttcatcttcatt

SEQ ID NO: 8531 - DNA, 25 bp, Artificial sequence
  SiRNA target sequence
gaatgaatatatttcatcttcattg

SEQ ID NO: 8532 - DNA, 25 bp, Artificial sequence
  SiRNA target sequence
aatgaatatatttcatcttcattgc

SEQ ID NO: 8533 - DNA, 25 bp, Artificial sequence
  SiRNA target sequence
atgaatatatttcatcttcattgcc

SEQ ID NO: 8534 - DNA, 25 bp, Artificial sequence
  SiRNA target sequence
tgaatatatttcatcttcattgcct

SEQ ID NO: 8535 - DNA, 25 bp, Artificial sequence
  SiRNA target sequence
gaatatatttcatcttcattgcctt

SEQ ID NO: 8536 - DNA, 25 bp, Artificial sequence
  SiRNA target sequence
aatatatttcatcttcattgccttt

SEQ ID NO: 8537 - DNA, 25 bp, Artificial sequence
  SiRNA target sequence
atatatttcatcttcattgccttta

SEQ ID NO: 8538 - DNA, 25 bp, Artificial sequence
  SiRNA target sequence
tatatttcatcttcattgcctttag

SEQ ID NO: 8539 - DNA, 25 bp, Artificial sequence
  SiRNA target sequence
atatttcatcttcattgcctttaga

SEQ ID NO: 8540 - DNA, 25 bp, Artificial sequence
  SiRNA target sequence
tatttcatcttcattgcctttagat

SEQ ID NO: 8541 - DNA, 25 bp, Artificial sequence
  SiRNA target sequence
atttcatcttcattgcctttagatg

SEQ ID NO: 8542 - DNA, 25 bp, Artificial sequence
  SiRNA target sequence
tttcatcttcattgcctttagatga

SEQ ID NO: 8543 - DNA, 25 bp, Artificial sequence
  SiRNA target sequence
ttcatcttcattgcctttagatgac

SEQ ID NO: 8544 - DNA, 25 bp, Artificial sequence
  SiRNA target sequence
tcatcttcattgcctttagatgacg

SEQ ID NO: 8545 - DNA, 25 bp, Artificial sequence
  SiRNA target sequence
catcttcattgcctttagatgacga

SEQ ID NO: 8546 - DNA, 25 bp, Artificial sequence
  SiRNA target sequence
atcttcattgcctttagatgacgag

SEQ ID NO: 8547 - DNA, 25 bp, Artificial sequence
  SiRNA target sequence
tcttcattgcctttagatgacgaga

SEQ ID NO: 8548 - DNA, 25 bp, Artificial sequence
  SiRNA target sequence
cttcattgcctttagatgacgagat

SEQ ID NO: 8549 - DNA, 25 bp, Artificial sequence
  SiRNA target sequence
ttcattgcctttagatgacgagatt

SEQ ID NO: 8550 - DNA, 25 bp, Artificial sequence
  SiRNA target sequence
tcattgcctttagatgacgagatta

SEQ ID NO: 8551 - DNA, 25 bp, Artificial sequence
  SiRNA target sequence
cattgcctttagatgacgagattac

SEQ ID NO: 8552 - DNA, 25 bp, Artificial sequence
  SiRNA target sequence
attgcctttagatgacgagattact

SEQ ID NO: 8553 - DNA, 25 bp, Artificial sequence
  SiRNA target sequence
ttgcctttagatgacgagattacta

SEQ ID NO: 8554 - DNA, 25 bp, Artificial sequence
  SiRNA target sequence
tgcctttagatgacgagattactac

SEQ ID NO: 8555 - DNA, 25 bp, Artificial sequence
  SiRNA target sequence
gcctttagatgacgagattactacg

SEQ ID NO: 8556 - DNA, 25 bp, Artificial sequence
  SiRNA target sequence
cctttagatgacgagattactacgc

SEQ ID NO: 8557 - DNA, 25 bp, Artificial sequence
  SiRNA target sequence
ctttagatgacgagattactacgct

SEQ ID NO: 8558 - DNA, 25 bp, Artificial sequence
  SiRNA target sequence
tttagatgacgagattactacgctt

SEQ ID NO: 8559 - DNA, 25 bp, Artificial sequence
  SiRNA target sequence
ttagatgacgagattactacgcttt

SEQ ID NO: 8560 - DNA, 25 bp, Artificial sequence
  SiRNA target sequence
tagatgacgagattactacgcttta

SEQ ID NO: 8561 - DNA, 25 bp, Artificial sequence
  SiRNA target sequence
agatgacgagattactacgctttac

SEQ ID NO: 8562 - DNA, 25 bp, Artificial sequence
  SiRNA target sequence
gatgacgagattactacgctttact

SEQ ID NO: 8563 - DNA, 25 bp, Artificial sequence
  SiRNA target sequence
atgacgagattactacgctttactt

SEQ ID NO: 8564 - DNA, 25 bp, Artificial sequence
  SiRNA target sequence
tgacgagattactacgctttacttg

SEQ ID NO: 8565 - DNA, 25 bp, Artificial sequence
  SiRNA target sequence
gacgagattactacgctttacttgt

SEQ ID NO: 8566 - DNA, 25 bp, Artificial sequence
  SiRNA target sequence
acgagattactacgctttacttgta

SEQ ID NO: 8567 - DNA, 25 bp, Artificial sequence
  SiRNA target sequence
cgagattactacgctttacttgtat

SEQ ID NO: 8568 - DNA, 25 bp, Artificial sequence
  SiRNA target sequence
gagattactacgctttacttgtatt

SEQ ID NO: 8569 - DNA, 25 bp, Artificial sequence
  SiRNA target sequence
agattactacgctttacttgtattc

SEQ ID NO: 8570 - DNA, 25 bp, Artificial sequence
  SiRNA target sequence
gattactacgctttacttgtattct

SEQ ID NO: 8571 - DNA, 25 bp, Artificial sequence
  SiRNA target sequence
attactacgctttacttgtattcta

SEQ ID NO: 8572 - DNA, 25 bp, Artificial sequence
  SiRNA target sequence
ttactacgctttacttgtattctaa

SEQ ID NO: 8573 - DNA, 25 bp, Artificial sequence
  SiRNA target sequence
tactacgctttacttgtattctaag

SEQ ID NO: 8574 - DNA, 25 bp, Artificial sequence
  SiRNA target sequence
actacgctttacttgtattctaaga

SEQ ID NO: 8575 - DNA, 25 bp, Artificial sequence
  SiRNA target sequence
ctacgctttacttgtattctaagat

SEQ ID NO: 8576 - DNA, 25 bp, Artificial sequence
  SiRNA target sequence
tacgctttacttgtattctaagatt

SEQ ID NO: 8577 - DNA, 25 bp, Artificial sequence
  SiRNA target sequence
acgctttacttgtattctaagattt

SEQ ID NO: 8578 - DNA, 25 bp, Artificial sequence
  SiRNA target sequence
cgctttacttgtattctaagatttt

SEQ ID NO: 8579 - DNA, 25 bp, Artificial sequence
  SiRNA target sequence
gctttacttgtattctaagattttt

SEQ ID NO: 8580 - DNA, 25 bp, Artificial sequence
  SiRNA target sequence
ctttacttgtattctaagattttta

SEQ ID NO: 8581 - DNA, 25 bp, Artificial sequence
  SiRNA target sequence
tttacttgtattctaagatttttaa

SEQ ID NO: 8582 - DNA, 25 bp, Artificial sequence
  SiRNA target sequence
ttacttgtattctaagatttttaaa

SEQ ID NO: 8583 - DNA, 25 bp, Artificial sequence
  SiRNA target sequence
tacttgtattctaagatttttaaag

SEQ ID NO: 8584 - DNA, 25 bp, Artificial sequence
  SiRNA target sequence
acttgtattctaagatttttaaaga

SEQ ID NO: 8585 - DNA, 25 bp, Artificial sequence
  SiRNA target sequence
cttgtattctaagatttttaaagat

SEQ ID NO: 8586 - DNA, 25 bp, Artificial sequence
  SiRNA target sequence
ttgtattctaagatttttaaagata

SEQ ID NO: 8587 - DNA, 25 bp, Artificial sequence
  SiRNA target sequence
tgtattctaagatttttaaagataa

SEQ ID NO: 8588 - DNA, 25 bp, Artificial sequence
  SiRNA target sequence
gtattctaagatttttaaagataaa

SEQ ID NO: 8589 - DNA, 25 bp, Artificial sequence
  SiRNA target sequence
tattctaagatttttaaagataaat

SEQ ID NO: 8590 - DNA, 25 bp, Artificial sequence
  SiRNA target sequence
attctaagatttttaaagataaatc

SEQ ID NO: 8591 - DNA, 25 bp, Artificial sequence
  SiRNA target sequence
ttctaagatttttaaagataaatct

SEQ ID NO: 8592 - DNA, 25 bp, Artificial sequence
  SiRNA target sequence
tctaagatttttaaagataaatctg

SEQ ID NO: 8593 - DNA, 25 bp, Artificial sequence
  SiRNA target sequence
ctaagatttttaaagataaatctga

SEQ ID NO: 8594 - DNA, 25 bp, Artificial sequence
  SiRNA target sequence
taagatttttaaagataaatctgat

SEQ ID NO: 8595 - DNA, 25 bp, Artificial sequence
  SiRNA target sequence
aagatttttaaagataaatctgata

SEQ ID NO: 8596 - DNA, 25 bp, Artificial sequence
  SiRNA target sequence
agatttttaaagataaatctgatac

SEQ ID NO: 8597 - DNA, 25 bp, Artificial sequence
  SiRNA target sequence
gatttttaaagataaatctgatact

SEQ ID NO: 8598 - DNA, 25 bp, Artificial sequence
  SiRNA target sequence
atttttaaagataaatctgatactt

SEQ ID NO: 8599 - DNA, 25 bp, Artificial sequence
  SiRNA target sequence
tttttaaagataaatctgatactta

SEQ ID NO: 8600 - DNA, 25 bp, Artificial sequence
  SiRNA target sequence
ttttaaagataaatctgatacttac

SEQ ID NO: 8601 - DNA, 25 bp, Artificial sequence
  SiRNA target sequence
tttaaagataaatctgatacttacc

SEQ ID NO: 8602 - DNA, 25 bp, Artificial sequence
  SiRNA target sequence
ttaaagataaatctgatacttacct

SEQ ID NO: 8603 - DNA, 25 bp, Artificial sequence
  SiRNA target sequence
taaagataaatctgatacttacctt

SEQ ID NO: 8604 - DNA, 25 bp, Artificial sequence
  SiRNA target sequence
aaagataaatctgatacttacctta

SEQ ID NO: 8605 - DNA, 25 bp, Artificial sequence
  SiRNA target sequence
aagataaatctgatacttaccttaa

SEQ ID NO: 8606 - DNA, 25 bp, Artificial sequence
  SiRNA target sequence
agataaatctgatacttaccttaaa

SEQ ID NO: 8607 - DNA, 25 bp, Artificial sequence
  SiRNA target sequence
gataaatctgatacttaccttaaat

SEQ ID NO: 8608 - DNA, 25 bp, Artificial sequence
  SiRNA target sequence
ataaatctgatacttaccttaaatc

SEQ ID NO: 8609 - DNA, 25 bp, Artificial sequence
  SiRNA target sequence
taaatctgatacttaccttaaatct

SEQ ID NO: 8610 - DNA, 25 bp, Artificial sequence
  SiRNA target sequence
aaatctgatacttaccttaaatctg

SEQ ID NO: 8611 - DNA, 25 bp, Artificial sequence
  SiRNA target sequence
aatctgatacttaccttaaatctgc

SEQ ID NO: 8612 - DNA, 25 bp, Artificial sequence
  SiRNA target sequence
atctgatacttaccttaaatctgct

SEQ ID NO: 8613 - DNA, 25 bp, Artificial sequence
  SiRNA target sequence
tctgatacttaccttaaatctgcta

SEQ ID NO: 8614 - DNA, 25 bp, Artificial sequence
  SiRNA target sequence
ctgatacttaccttaaatctgctat

SEQ ID NO: 8615 - DNA, 25 bp, Artificial sequence
  SiRNA target sequence
tgatacttaccttaaatctgctata

SEQ ID NO: 8616 - DNA, 25 bp, Artificial sequence
  SiRNA target sequence
gatacttaccttaaatctgctatag

SEQ ID NO: 8617 - DNA, 25 bp, Artificial sequence
  SiRNA target sequence
atacttaccttaaatctgctataga

SEQ ID NO: 8618 - DNA, 25 bp, Artificial sequence
  SiRNA target sequence
tacttaccttaaatctgctatagat

SEQ ID NO: 8619 - DNA, 25 bp, Artificial sequence
  SiRNA target sequence
acttaccttaaatctgctatagata

SEQ ID NO: 8620 - DNA, 25 bp, Artificial sequence
  SiRNA target sequence
cttaccttaaatctgctatagataa

SEQ ID NO: 8621 - DNA, 25 bp, Artificial sequence
  SiRNA target sequence
ttaccttaaatctgctatagataaa

SEQ ID NO: 8622 - DNA, 25 bp, Artificial sequence
  SiRNA target sequence
taccttaaatctgctatagataaat

SEQ ID NO: 8623 - DNA, 25 bp, Artificial sequence
  SiRNA target sequence
accttaaatctgctatagataaatc

SEQ ID NO: 8624 - DNA, 25 bp, Artificial sequence
  SiRNA target sequence
ccttaaatctgctatagataaatca

SEQ ID NO: 8625 - DNA, 25 bp, Artificial sequence
  SiRNA target sequence
cttaaatctgctatagataaatcag

SEQ ID NO: 8626 - DNA, 25 bp, Artificial sequence
  SiRNA target sequence
ttaaatctgctatagataaatcagt

SEQ ID NO: 8627 - DNA, 25 bp, Artificial sequence
  SiRNA target sequence
taaatctgctatagataaatcagta

SEQ ID NO: 8628 - DNA, 25 bp, Artificial sequence
  SiRNA target sequence
aaatctgctatagataaatcagtag

SEQ ID NO: 8629 - DNA, 25 bp, Artificial sequence
  SiRNA target sequence
aatctgctatagataaatcagtaga

SEQ ID NO: 8630 - DNA, 25 bp, Artificial sequence
  SiRNA target sequence
atctgctatagataaatcagtagat

SEQ ID NO: 8631 - DNA, 25 bp, Artificial sequence
  SiRNA target sequence
tctgctatagataaatcagtagatc

SEQ ID NO: 8632 - DNA, 25 bp, Artificial sequence
  SiRNA target sequence
ctgctatagataaatcagtagatct

SEQ ID NO: 8633 - DNA, 25 bp, Artificial sequence
  SiRNA target sequence
tgctatagataaatcagtagatcta

SEQ ID NO: 8634 - DNA, 25 bp, Artificial sequence
  SiRNA target sequence
gctatagataaatcagtagatctac

SEQ ID NO: 8635 - DNA, 25 bp, Artificial sequence
  SiRNA target sequence
ctatagataaatcagtagatctacc

SEQ ID NO: 8636 - DNA, 25 bp, Artificial sequence
  SiRNA target sequence
tatagataaatcagtagatctacct

SEQ ID NO: 8637 - DNA, 25 bp, Artificial sequence
  SiRNA target sequence
atagataaatcagtagatctaccta

SEQ ID NO: 8638 - DNA, 25 bp, Artificial sequence
  SiRNA target sequence
tagataaatcagtagatctacctat

SEQ ID NO: 8639 - DNA, 25 bp, Artificial sequence
  SiRNA target sequence
agataaatcagtagatctacctatt

SEQ ID NO: 8640 - DNA, 25 bp, Artificial sequence
  SiRNA target sequence
gataaatcagtagatctacctattg

SEQ ID NO: 8641 - DNA, 25 bp, Artificial sequence
  SiRNA target sequence
ataaatcagtagatctacctattga

SEQ ID NO: 8642 - DNA, 25 bp, Artificial sequence
  SiRNA target sequence
taaatcagtagatctacctattgaa

SEQ ID NO: 8643 - DNA, 25 bp, Artificial sequence
  SiRNA target sequence
aaatcagtagatctacctattgaac

SEQ ID NO: 8644 - DNA, 25 bp, Artificial sequence
  SiRNA target sequence
aatcagtagatctacctattgaaca

SEQ ID NO: 8645 - DNA, 25 bp, Artificial sequence
  SiRNA target sequence
atcagtagatctacctattgaacag

SEQ ID NO: 8646 - DNA, 25 bp, Artificial sequence
  SiRNA target sequence
tcagtagatctacctattgaacaga

SEQ ID NO: 8647 - DNA, 25 bp, Artificial sequence
  SiRNA target sequence
cagtagatctacctattgaacagaa

SEQ ID NO: 8648 - DNA, 25 bp, Artificial sequence
  SiRNA target sequence
agtagatctacctattgaacagaaa

SEQ ID NO: 8649 - DNA, 25 bp, Artificial sequence
  SiRNA target sequence
gtagatctacctattgaacagaaag

SEQ ID NO: 8650 - DNA, 25 bp, Artificial sequence
  SiRNA target sequence
tagatctacctattgaacagaaaga

SEQ ID NO: 8651 - DNA, 25 bp, Artificial sequence
  SiRNA target sequence
agatctacctattgaacagaaagac

SEQ ID NO: 8652 - DNA, 25 bp, Artificial sequence
  SiRNA target sequence
gatctacctattgaacagaaagact

SEQ ID NO: 8653 - DNA, 25 bp, Artificial sequence
  SiRNA target sequence
atctacctattgaacagaaagactt

SEQ ID NO: 8654 - DNA, 25 bp, Artificial sequence
  SiRNA target sequence
tctacctattgaacagaaagacttt

SEQ ID NO: 8655 - DNA, 25 bp, Artificial sequence
  SiRNA target sequence
ctacctattgaacagaaagactttc

SEQ ID NO: 8656 - DNA, 25 bp, Artificial sequence
  SiRNA target sequence
tacctattgaacagaaagactttct

SEQ ID NO: 8657 - DNA, 25 bp, Artificial sequence
  SiRNA target sequence
acctattgaacagaaagactttctg

SEQ ID NO: 8658 - DNA, 25 bp, Artificial sequence
  SiRNA target sequence
cctattgaacagaaagactttctgt

SEQ ID NO: 8659 - DNA, 25 bp, Artificial sequence
  SiRNA target sequence
ctattgaacagaaagactttctgta

SEQ ID NO: 8660 - DNA, 25 bp, Artificial sequence
  SiRNA target sequence
tattgaacagaaagactttctgtac

SEQ ID NO: 8661 - DNA, 25 bp, Artificial sequence
  SiRNA target sequence
attgaacagaaagactttctgtacg

SEQ ID NO: 8662 - DNA, 25 bp, Artificial sequence
  SiRNA target sequence
ttgaacagaaagactttctgtacgt

SEQ ID NO: 8663 - DNA, 25 bp, Artificial sequence
  SiRNA target sequence
tgaacagaaagactttctgtacgta

SEQ ID NO: 8664 - DNA, 25 bp, Artificial sequence
  SiRNA target sequence
gaacagaaagactttctgtacgtag

SEQ ID NO: 8665 - DNA, 25 bp, Artificial sequence
  SiRNA target sequence
aacagaaagactttctgtacgtaga

SEQ ID NO: 8666 - DNA, 25 bp, Artificial sequence
  SiRNA target sequence
acagaaagactttctgtacgtagat

SEQ ID NO: 8667 - DNA, 25 bp, Artificial sequence
  SiRNA target sequence
cagaaagactttctgtacgtagatc

SEQ ID NO: 8668 - DNA, 25 bp, Artificial sequence
  SiRNA target sequence
agaaagactttctgtacgtagatct

SEQ ID NO: 8669 - DNA, 25 bp, Artificial sequence
  SiRNA target sequence
gaaagactttctgtacgtagatctt

SEQ ID NO: 8670 - DNA, 25 bp, Artificial sequence
  SiRNA target sequence
aaagactttctgtacgtagatcttc

SEQ ID NO: 8671 - DNA, 25 bp, Artificial sequence
  SiRNA target sequence
aagactttctgtacgtagatcttct

SEQ ID NO: 8672 - DNA, 25 bp, Artificial sequence
  SiRNA target sequence
agactttctgtacgtagatcttctt

SEQ ID NO: 8673 - DNA, 25 bp, Artificial sequence
  SiRNA target sequence
gactttctgtacgtagatcttcttg

SEQ ID NO: 8674 - DNA, 25 bp, Artificial sequence
  SiRNA target sequence
actttctgtacgtagatcttcttgt

SEQ ID NO: 8675 - DNA, 25 bp, Artificial sequence
  SiRNA target sequence
ctttctgtacgtagatcttcttgta

SEQ ID NO: 8676 - DNA, 25 bp, Artificial sequence
  SiRNA target sequence
tttctgtacgtagatcttcttgtat

SEQ ID NO: 8677 - DNA, 25 bp, Artificial sequence
  SiRNA target sequence
ttctgtacgtagatcttcttgtatt

SEQ ID NO: 8678 - DNA, 25 bp, Artificial sequence
  SiRNA target sequence
tctgtacgtagatcttcttgtattt

SEQ ID NO: 8679 - DNA, 25 bp, Artificial sequence
  SiRNA target sequence
ctgtacgtagatcttcttgtatttt

SEQ ID NO: 8680 - DNA, 25 bp, Artificial sequence
  SiRNA target sequence
tgtacgtagatcttcttgtatttta

SEQ ID NO: 8681 - DNA, 25 bp, Artificial sequence
  SiRNA target sequence
gtacgtagatcttcttgtattttac

SEQ ID NO: 8682 - DNA, 25 bp, Artificial sequence
  SiRNA target sequence
tacgtagatcttcttgtattttaca

SEQ ID NO: 8683 - DNA, 25 bp, Artificial sequence
  SiRNA target sequence
acgtagatcttcttgtattttacat

SEQ ID NO: 8684 - DNA, 25 bp, Artificial sequence
  SiRNA target sequence
cgtagatcttcttgtattttacatt

SEQ ID NO: 8685 - DNA, 25 bp, Artificial sequence
  SiRNA target sequence
gtagatcttcttgtattttacattt

SEQ ID NO: 8686 - DNA, 25 bp, Artificial sequence
  SiRNA target sequence
tagatcttcttgtattttacatttc

SEQ ID NO: 8687 - DNA, 25 bp, Artificial sequence
  SiRNA target sequence
agatcttcttgtattttacatttct

SEQ ID NO: 8688 - DNA, 25 bp, Artificial sequence
  SiRNA target sequence
gatcttcttgtattttacatttcta

SEQ ID NO: 8689 - DNA, 25 bp, Artificial sequence
  SiRNA target sequence
atcttcttgtattttacatttctaa

SEQ ID NO: 8690 - DNA, 25 bp, Artificial sequence
  SiRNA target sequence
tcttcttgtattttacatttctaaa

SEQ ID NO: 8691 - DNA, 25 bp, Artificial sequence
  SiRNA target sequence
cttcttgtattttacatttctaaaa

SEQ ID NO: 8692 - DNA, 25 bp, Artificial sequence
  SiRNA target sequence
ttcttgtattttacatttctaaaaa

SEQ ID NO: 8693 - DNA, 25 bp, Artificial sequence
  SiRNA target sequence
tcttgtattttacatttctaaaaag

SEQ ID NO: 8694 - DNA, 25 bp, Artificial sequence
  SiRNA target sequence
cttgtattttacatttctaaaaagg

SEQ ID NO: 8695 - DNA, 25 bp, Artificial sequence
  SiRNA target sequence
ttgtattttacatttctaaaaagga

SEQ ID NO: 8696 - DNA, 25 bp, Artificial sequence
  SiRNA target sequence
tgtattttacatttctaaaaaggat

SEQ ID NO: 8697 - DNA, 25 bp, Artificial sequence
  SiRNA target sequence
gtattttacatttctaaaaaggatg

SEQ ID NO: 8698 - DNA, 25 bp, Artificial sequence
  SiRNA target sequence
tattttacatttctaaaaaggatgt

SEQ ID NO: 8699 - DNA, 25 bp, Artificial sequence
  SiRNA target sequence
attttacatttctaaaaaggatgtt

SEQ ID NO: 8700 - DNA, 25 bp, Artificial sequence
  SiRNA target sequence
ttttacatttctaaaaaggatgttg

SEQ ID NO: 8701 - DNA, 25 bp, Artificial sequence
  SiRNA target sequence
tttacatttctaaaaaggatgttga

SEQ ID NO: 8702 - DNA, 25 bp, Artificial sequence
  SiRNA target sequence
ttacatttctaaaaaggatgttgaa

SEQ ID NO: 8703 - DNA, 25 bp, Artificial sequence
  SiRNA target sequence
tacatttctaaaaaggatgttgaaa

SEQ ID NO: 8704 - DNA, 25 bp, Artificial sequence
  SiRNA target sequence
acatttctaaaaaggatgttgaaaa

SEQ ID NO: 8705 - DNA, 25 bp, Artificial sequence
  SiRNA target sequence
catttctaaaaaggatgttgaaaaa

SEQ ID NO: 8706 - DNA, 25 bp, Artificial sequence
  SiRNA target sequence
atttctaaaaaggatgttgaaaaag

SEQ ID NO: 8707 - DNA, 25 bp, Artificial sequence
  SiRNA target sequence
tttctaaaaaggatgttgaaaaagt

SEQ ID NO: 8708 - DNA, 25 bp, Artificial sequence
  SiRNA target sequence
ttctaaaaaggatgttgaaaaagtt

SEQ ID NO: 8709 - DNA, 25 bp, Artificial sequence
  SiRNA target sequence
tctaaaaaggatgttgaaaaagtta

SEQ ID NO: 8710 - DNA, 25 bp, Artificial sequence
  SiRNA target sequence
ctaaaaaggatgttgaaaaagttaa

SEQ ID NO: 8711 - DNA, 25 bp, Artificial sequence
  SiRNA target sequence
taaaaaggatgttgaaaaagttaat

SEQ ID NO: 8712 - DNA, 25 bp, Artificial sequence
  SiRNA target sequence
aaaaaggatgttgaaaaagttaatg

SEQ ID NO: 8713 - DNA, 25 bp, Artificial sequence
  SiRNA target sequence
aaaaggatgttgaaaaagttaatga

SEQ ID NO: 8714 - DNA, 25 bp, Artificial sequence
  SiRNA target sequence
aaaggatgttgaaaaagttaatgaa

SEQ ID NO: 8715 - DNA, 25 bp, Artificial sequence
  SiRNA target sequence
aaggatgttgaaaaagttaatgaaa

SEQ ID NO: 8716 - DNA, 25 bp, Artificial sequence
  SiRNA target sequence
aggatgttgaaaaagttaatgaaac

SEQ ID NO: 8717 - DNA, 25 bp, Artificial sequence
  SiRNA target sequence
ggatgttgaaaaagttaatgaaaca

SEQ ID NO: 8718 - DNA, 25 bp, Artificial sequence
  SiRNA target sequence
gatgttgaaaaagttaatgaaacaa

SEQ ID NO: 8719 - DNA, 25 bp, Artificial sequence
  SiRNA target sequence
atgttgaaaaagttaatgaaacaat

SEQ ID NO: 8720 - DNA, 25 bp, Artificial sequence
  SiRNA target sequence
tgttgaaaaagttaatgaaacaatt

SEQ ID NO: 8721 - DNA, 25 bp, Artificial sequence
  SiRNA target sequence
gttgaaaaagttaatgaaacaatta

SEQ ID NO: 8722 - DNA, 25 bp, Artificial sequence
  SiRNA target sequence
ttgaaaaagttaatgaaacaattaa

SEQ ID NO: 8723 - DNA, 25 bp, Artificial sequence
  SiRNA target sequence
tgaaaaagttaatgaaacaattaat

SEQ ID NO: 8724 - DNA, 25 bp, Artificial sequence
  SiRNA target sequence
gaaaaagttaatgaaacaattaata

SEQ ID NO: 8725 - DNA, 25 bp, Artificial sequence
  SiRNA target sequence
aaaaagttaatgaaacaattaataa

SEQ ID NO: 8726 - DNA, 25 bp, Artificial sequence
  SiRNA target sequence
aaaagttaatgaaacaattaataat

SEQ ID NO: 8727 - DNA, 25 bp, Artificial sequence
  SiRNA target sequence
aaagttaatgaaacaattaataatt

SEQ ID NO: 8728 - DNA, 25 bp, Artificial sequence
  SiRNA target sequence
aagttaatgaaacaattaataattt

SEQ ID NO: 8729 - DNA, 25 bp, Artificial sequence
  SiRNA target sequence
agttaatgaaacaattaataattta

SEQ ID NO: 8730 - DNA, 25 bp, Artificial sequence
  SiRNA target sequence
gttaatgaaacaattaataatttaa

SEQ ID NO: 8731 - DNA, 25 bp, Artificial sequence
  SiRNA target sequence
ttaatgaaacaattaataatttaaa

SEQ ID NO: 8732 - DNA, 25 bp, Artificial sequence
  SiRNA target sequence
taatgaaacaattaataatttaaaa

SEQ ID NO: 8733 - DNA, 25 bp, Artificial sequence
  SiRNA target sequence
aatgaaacaattaataatttaaaag

SEQ ID NO: 8734 - DNA, 25 bp, Artificial sequence
  SiRNA target sequence
atgaaacaattaataatttaaaaga

SEQ ID NO: 8735 - DNA, 25 bp, Artificial sequence
  SiRNA target sequence
tgaaacaattaataatttaaaagag

SEQ ID NO: 8736 - DNA, 25 bp, Artificial sequence
  SiRNA target sequence
gaaacaattaataatttaaaagaga

SEQ ID NO: 8737 - DNA, 25 bp, Artificial sequence
  SiRNA target sequence
aaacaattaataatttaaaagagac

SEQ ID NO: 8738 - DNA, 25 bp, Artificial sequence
  SiRNA target sequence
aacaattaataatttaaaagagact

SEQ ID NO: 8739 - DNA, 25 bp, Artificial sequence
  SiRNA target sequence
acaattaataatttaaaagagactc

SEQ ID NO: 8740 - DNA, 25 bp, Artificial sequence
  SiRNA target sequence
caattaataatttaaaagagactct

SEQ ID NO: 8741 - DNA, 25 bp, Artificial sequence
  SiRNA target sequence
aattaataatttaaaagagactctt

SEQ ID NO: 8742 - DNA, 25 bp, Artificial sequence
  SiRNA target sequence
attaataatttaaaagagactctta

SEQ ID NO: 8743 - DNA, 25 bp, Artificial sequence
  SiRNA target sequence
ttaataatttaaaagagactcttac

SEQ ID NO: 8744 - DNA, 25 bp, Artificial sequence
  SiRNA target sequence
taataatttaaaagagactcttacc

SEQ ID NO: 8745 - DNA, 25 bp, Artificial sequence
  SiRNA target sequence
aataatttaaaagagactcttaccc

SEQ ID NO: 8746 - DNA, 25 bp, Artificial sequence
  SiRNA target sequence
ataatttaaaagagactcttacccc

SEQ ID NO: 8747 - DNA, 25 bp, Artificial sequence
  SiRNA target sequence
taatttaaaagagactcttaccccc

SEQ ID NO: 8748 - DNA, 25 bp, Artificial sequence
  SiRNA target sequence
aatttaaaagagactcttaccccca

SEQ ID NO: 8749 - DNA, 25 bp, Artificial sequence
  SiRNA target sequence
atttaaaagagactcttacccccac

SEQ ID NO: 8750 - DNA, 25 bp, Artificial sequence
  SiRNA target sequence
tttaaaagagactcttacccccact

SEQ ID NO: 8751 - DNA, 25 bp, Artificial sequence
  SiRNA target sequence
ttaaaagagactcttacccccactt

SEQ ID NO: 8752 - DNA, 25 bp, Artificial sequence
  SiRNA target sequence
taaaagagactcttacccccacttt

SEQ ID NO: 8753 - DNA, 25 bp, Artificial sequence
  SiRNA target sequence
aaaagagactcttacccccacttta

SEQ ID NO: 8754 - DNA, 25 bp, Artificial sequence
  SiRNA target sequence
aaagagactcttacccccactttat

SEQ ID NO: 8755 - DNA, 25 bp, Artificial sequence
  SiRNA target sequence
aagagactcttacccccactttatt

SEQ ID NO: 8756 - DNA, 25 bp, Artificial sequence
  SiRNA target sequence
agagactcttacccccactttattg

SEQ ID NO: 8757 - DNA, 25 bp, Artificial sequence
  SiRNA target sequence
gagactcttacccccactttattgg

SEQ ID NO: 8758 - DNA, 25 bp, Artificial sequence
  SiRNA target sequence
agactcttacccccactttattgga

SEQ ID NO: 8759 - DNA, 25 bp, Artificial sequence
  SiRNA target sequence
gactcttacccccactttattggaa

SEQ ID NO: 8760 - DNA, 25 bp, Artificial sequence
  SiRNA target sequence
actcttacccccactttattggaac

SEQ ID NO: 8761 - DNA, 25 bp, Artificial sequence
  SiRNA target sequence
ctcttacccccactttattggaact

SEQ ID NO: 8762 - DNA, 25 bp, Artificial sequence
  SiRNA target sequence
tcttacccccactttattggaactt

SEQ ID NO: 8763 - DNA, 25 bp, Artificial sequence
  SiRNA target sequence
cttacccccactttattggaactta

SEQ ID NO: 8764 - DNA, 25 bp, Artificial sequence
  SiRNA target sequence
ttacccccactttattggaacttat

SEQ ID NO: 8765 - DNA, 25 bp, Artificial sequence
  SiRNA target sequence
tacccccactttattggaacttatt

SEQ ID NO: 8766 - DNA, 25 bp, Artificial sequence
  SiRNA target sequence
acccccactttattggaacttattg

SEQ ID NO: 8767 - DNA, 25 bp, Artificial sequence
  SiRNA target sequence
cccccactttattggaacttattgg

SEQ ID NO: 8768 - DNA, 25 bp, Artificial sequence
  SiRNA target sequence
ccccactttattggaacttattgga

SEQ ID NO: 8769 - DNA, 25 bp, Artificial sequence
  SiRNA target sequence
cccactttattggaacttattggag

SEQ ID NO: 8770 - DNA, 25 bp, Artificial sequence
  SiRNA target sequence
ccactttattggaacttattggaga

SEQ ID NO: 8771 - DNA, 25 bp, Artificial sequence
  SiRNA target sequence
cactttattggaacttattggagaa

SEQ ID NO: 8772 - DNA, 25 bp, Artificial sequence
  SiRNA target sequence
actttattggaacttattggagaat

SEQ ID NO: 8773 - DNA, 25 bp, Artificial sequence
  SiRNA target sequence
ctttattggaacttattggagaata

SEQ ID NO: 8774 - DNA, 25 bp, Artificial sequence
  SiRNA target sequence
tttattggaacttattggagaatat

SEQ ID NO: 8775 - DNA, 25 bp, Artificial sequence
  SiRNA target sequence
ttattggaacttattggagaatatt

SEQ ID NO: 8776 - DNA, 25 bp, Artificial sequence
  SiRNA target sequence
tattggaacttattggagaatatta

SEQ ID NO: 8777 - DNA, 25 bp, Artificial sequence
  SiRNA target sequence
attggaacttattggagaatattat

SEQ ID NO: 8778 - DNA, 25 bp, Artificial sequence
  SiRNA target sequence
ttggaacttattggagaatattatt

SEQ ID NO: 8779 - DNA, 25 bp, Artificial sequence
  SiRNA target sequence
tggaacttattggagaatattattt

SEQ ID NO: 8780 - DNA, 25 bp, Artificial sequence
  SiRNA target sequence
ggaacttattggagaatattattta

SEQ ID NO: 8781 - DNA, 25 bp, Artificial sequence
  SiRNA target sequence
gaacttattggagaatattatttaa

SEQ ID NO: 8782 - DNA, 25 bp, Artificial sequence
  SiRNA target sequence
aacttattggagaatattatttaaa

SEQ ID NO: 8783 - DNA, 25 bp, Artificial sequence
  SiRNA target sequence
acttattggagaatattatttaaaa

SEQ ID NO: 8784 - DNA, 25 bp, Artificial sequence
  SiRNA target sequence
cttattggagaatattatttaaaaa

SEQ ID NO: 8785 - DNA, 25 bp, Artificial sequence
  SiRNA target sequence
ttattggagaatattatttaaaaag

SEQ ID NO: 8786 - DNA, 25 bp, Artificial sequence
  SiRNA target sequence
tattggagaatattatttaaaaagt

SEQ ID NO: 8787 - DNA, 25 bp, Artificial sequence
  SiRNA target sequence
attggagaatattatttaaaaagtg

SEQ ID NO: 8788 - DNA, 25 bp, Artificial sequence
  SiRNA target sequence
ttggagaatattatttaaaaagtgg

SEQ ID NO: 8789 - DNA, 25 bp, Artificial sequence
  SiRNA target sequence
tggagaatattatttaaaaagtgga

SEQ ID NO: 8790 - DNA, 25 bp, Artificial sequence
  SiRNA target sequence
ggagaatattatttaaaaagtggaa

SEQ ID NO: 8791 - DNA, 25 bp, Artificial sequence
  SiRNA target sequence
gagaatattatttaaaaagtggaaa

SEQ ID NO: 8792 - DNA, 25 bp, Artificial sequence
  SiRNA target sequence
agaatattatttaaaaagtggaaat

SEQ ID NO: 8793 - DNA, 25 bp, Artificial sequence
  SiRNA target sequence
gaatattatttaaaaagtggaaatc

SEQ ID NO: 8794 - DNA, 25 bp, Artificial sequence
  SiRNA target sequence
aatattatttaaaaagtggaaatca

SEQ ID NO: 8795 - DNA, 25 bp, Artificial sequence
  SiRNA target sequence
atattatttaaaaagtggaaatcac

SEQ ID NO: 8796 - DNA, 25 bp, Artificial sequence
  SiRNA target sequence
tattatttaaaaagtggaaatcact

SEQ ID NO: 8797 - DNA, 25 bp, Artificial sequence
  SiRNA target sequence
attatttaaaaagtggaaatcactc

SEQ ID NO: 8798 - DNA, 25 bp, Artificial sequence
  SiRNA target sequence
ttatttaaaaagtggaaatcactct

SEQ ID NO: 8799 - DNA, 25 bp, Artificial sequence
  SiRNA target sequence
tatttaaaaagtggaaatcactcta

SEQ ID NO: 8800 - DNA, 25 bp, Artificial sequence
  SiRNA target sequence
atttaaaaagtggaaatcactctaa

SEQ ID NO: 8801 - DNA, 25 bp, Artificial sequence
  SiRNA target sequence
tttaaaaagtggaaatcactctaaa

SEQ ID NO: 8802 - DNA, 25 bp, Artificial sequence
  SiRNA target sequence
ttaaaaagtggaaatcactctaaaa

SEQ ID NO: 8803 - DNA, 25 bp, Artificial sequence
  SiRNA target sequence
taaaaagtggaaatcactctaaaat

SEQ ID NO: 8804 - DNA, 25 bp, Artificial sequence
  SiRNA target sequence
aaaaagtggaaatcactctaaaatg

SEQ ID NO: 8805 - DNA, 25 bp, Artificial sequence
  SiRNA target sequence
aaaagtggaaatcactctaaaatgt

SEQ ID NO: 8806 - DNA, 25 bp, Artificial sequence
  SiRNA target sequence
aaagtggaaatcactctaaaatgtt

SEQ ID NO: 8807 - DNA, 25 bp, Artificial sequence
  SiRNA target sequence
aagtggaaatcactctaaaatgtta

SEQ ID NO: 8808 - DNA, 25 bp, Artificial sequence
  SiRNA target sequence
agtggaaatcactctaaaatgttag

SEQ ID NO: 8809 - DNA, 25 bp, Artificial sequence
  SiRNA target sequence
gtggaaatcactctaaaatgttaga

SEQ ID NO: 8810 - DNA, 25 bp, Artificial sequence
  SiRNA target sequence
tggaaatcactctaaaatgttagat

SEQ ID NO: 8811 - DNA, 25 bp, Artificial sequence
  SiRNA target sequence
ggaaatcactctaaaatgttagatc

SEQ ID NO: 8812 - DNA, 25 bp, Artificial sequence
  SiRNA target sequence
gaaatcactctaaaatgttagatct

SEQ ID NO: 8813 - DNA, 25 bp, Artificial sequence
  SiRNA target sequence
aaatcactctaaaatgttagatcta

SEQ ID NO: 8814 - DNA, 25 bp, Artificial sequence
  SiRNA target sequence
aatcactctaaaatgttagatctat

SEQ ID NO: 8815 - DNA, 25 bp, Artificial sequence
  SiRNA target sequence
atcactctaaaatgttagatctatt

SEQ ID NO: 8816 - DNA, 25 bp, Artificial sequence
  SiRNA target sequence
tcactctaaaatgttagatctatta

SEQ ID NO: 8817 - DNA, 25 bp, Artificial sequence
  SiRNA target sequence
cactctaaaatgttagatctattat

SEQ ID NO: 8818 - DNA, 25 bp, Artificial sequence
  SiRNA target sequence
actctaaaatgttagatctattatc

SEQ ID NO: 8819 - DNA, 25 bp, Artificial sequence
  SiRNA target sequence
ctctaaaatgttagatctattatct

SEQ ID NO: 8820 - DNA, 25 bp, Artificial sequence
  SiRNA target sequence
tctaaaatgttagatctattatcta

SEQ ID NO: 8821 - DNA, 25 bp, Artificial sequence
  SiRNA target sequence
ctaaaatgttagatctattatctag

SEQ ID NO: 8822 - DNA, 25 bp, Artificial sequence
  SiRNA target sequence
taaaatgttagatctattatctagt

SEQ ID NO: 8823 - DNA, 25 bp, Artificial sequence
  SiRNA target sequence
aaaatgttagatctattatctagtc

SEQ ID NO: 8824 - DNA, 25 bp, Artificial sequence
  SiRNA target sequence
aaatgttagatctattatctagtca

SEQ ID NO: 8825 - DNA, 25 bp, Artificial sequence
  SiRNA target sequence
aatgttagatctattatctagtcat

SEQ ID NO: 8826 - DNA, 25 bp, Artificial sequence
  SiRNA target sequence
atgttagatctattatctagtcatc

SEQ ID NO: 8827 - DNA, 25 bp, Artificial sequence
  SiRNA target sequence
tgttagatctattatctagtcatcc

SEQ ID NO: 8828 - DNA, 25 bp, Artificial sequence
  SiRNA target sequence
gttagatctattatctagtcatcca

SEQ ID NO: 8829 - DNA, 25 bp, Artificial sequence
  SiRNA target sequence
ttagatctattatctagtcatccag

SEQ ID NO: 8830 - DNA, 25 bp, Artificial sequence
  SiRNA target sequence
tagatctattatctagtcatccaga

SEQ ID NO: 8831 - DNA, 25 bp, Artificial sequence
  SiRNA target sequence
agatctattatctagtcatccagat

SEQ ID NO: 8832 - DNA, 25 bp, Artificial sequence
  SiRNA target sequence
gatctattatctagtcatccagata

SEQ ID NO: 8833 - DNA, 25 bp, Artificial sequence
  SiRNA target sequence
atctattatctagtcatccagatac

SEQ ID NO: 8834 - DNA, 25 bp, Artificial sequence
  SiRNA target sequence
tctattatctagtcatccagatact

SEQ ID NO: 8835 - DNA, 25 bp, Artificial sequence
  SiRNA target sequence
ctattatctagtcatccagatactc

SEQ ID NO: 8836 - DNA, 25 bp, Artificial sequence
  SiRNA target sequence
tattatctagtcatccagatactcc

SEQ ID NO: 8837 - DNA, 25 bp, Artificial sequence
  SiRNA target sequence
attatctagtcatccagatactcct

SEQ ID NO: 8838 - DNA, 25 bp, Artificial sequence
  SiRNA target sequence
ttatctagtcatccagatactcctg

SEQ ID NO: 8839 - DNA, 25 bp, Artificial sequence
  SiRNA target sequence
tatctagtcatccagatactcctgg

SEQ ID NO: 8840 - DNA, 25 bp, Artificial sequence
  SiRNA target sequence
atctagtcatccagatactcctggt

SEQ ID NO: 8841 - DNA, 25 bp, Artificial sequence
  SiRNA target sequence
tctagtcatccagatactcctggta

SEQ ID NO: 8842 - DNA, 25 bp, Artificial sequence
  SiRNA target sequence
ctagtcatccagatactcctggtaa

SEQ ID NO: 8843 - DNA, 25 bp, Artificial sequence
  SiRNA target sequence
tagtcatccagatactcctggtaaa

SEQ ID NO: 8844 - DNA, 25 bp, Artificial sequence
  SiRNA target sequence
agtcatccagatactcctggtaaat

SEQ ID NO: 8845 - DNA, 25 bp, Artificial sequence
  SiRNA target sequence
gtcatccagatactcctggtaaatt

SEQ ID NO: 8846 - DNA, 25 bp, Artificial sequence
  SiRNA target sequence
tcatccagatactcctggtaaatta

SEQ ID NO: 8847 - DNA, 25 bp, Artificial sequence
  SiRNA target sequence
catccagatactcctggtaaattac

SEQ ID NO: 8848 - DNA, 25 bp, Artificial sequence
  SiRNA target sequence
atccagatactcctggtaaattact

SEQ ID NO: 8849 - DNA, 25 bp, Artificial sequence
  SiRNA target sequence
tccagatactcctggtaaattactt

SEQ ID NO: 8850 - DNA, 25 bp, Artificial sequence
  SiRNA target sequence
ccagatactcctggtaaattacttt

SEQ ID NO: 8851 - DNA, 25 bp, Artificial sequence
  SiRNA target sequence
cagatactcctggtaaattactttt

SEQ ID NO: 8852 - DNA, 25 bp, Artificial sequence
  SiRNA target sequence
agatactcctggtaaattactttta

SEQ ID NO: 8853 - DNA, 25 bp, Artificial sequence
  SiRNA target sequence
gatactcctggtaaattacttttaa

SEQ ID NO: 8854 - DNA, 25 bp, Artificial sequence
  SiRNA target sequence
atactcctggtaaattacttttaac

SEQ ID NO: 8855 - DNA, 25 bp, Artificial sequence
  SiRNA target sequence
tactcctggtaaattacttttaacg

SEQ ID NO: 8856 - DNA, 25 bp, Artificial sequence
  SiRNA target sequence
actcctggtaaattacttttaacgg

SEQ ID NO: 8857 - DNA, 25 bp, Artificial sequence
  SiRNA target sequence
ctcctggtaaattacttttaacggc

SEQ ID NO: 8858 - DNA, 25 bp, Artificial sequence
  SiRNA target sequence
tcctggtaaattacttttaacggca

SEQ ID NO: 8859 - DNA, 25 bp, Artificial sequence
  SiRNA target sequence
cctggtaaattacttttaacggcac

SEQ ID NO: 8860 - DNA, 25 bp, Artificial sequence
  SiRNA target sequence
ctggtaaattacttttaacggcact

SEQ ID NO: 8861 - DNA, 25 bp, Artificial sequence
  SiRNA target sequence
tggtaaattacttttaacggcactt

SEQ ID NO: 8862 - DNA, 25 bp, Artificial sequence
  SiRNA target sequence
ggtaaattacttttaacggcacttt

SEQ ID NO: 8863 - DNA, 25 bp, Artificial sequence
  SiRNA target sequence
gtaaattacttttaacggcacttta

SEQ ID NO: 8864 - DNA, 25 bp, Artificial sequence
  SiRNA target sequence
taaattacttttaacggcactttat

SEQ ID NO: 8865 - DNA, 25 bp, Artificial sequence
  SiRNA target sequence
aaattacttttaacggcactttatg

SEQ ID NO: 8866 - DNA, 25 bp, Artificial sequence
  SiRNA target sequence
aattacttttaacggcactttatgc

SEQ ID NO: 8867 - DNA, 25 bp, Artificial sequence
  SiRNA target sequence
attacttttaacggcactttatgca

SEQ ID NO: 8868 - DNA, 25 bp, Artificial sequence
  SiRNA target sequence
ttacttttaacggcactttatgcaa

SEQ ID NO: 8869 - DNA, 25 bp, Artificial sequence
  SiRNA target sequence
tacttttaacggcactttatgcaat

SEQ ID NO: 8870 - DNA, 25 bp, Artificial sequence
  SiRNA target sequence
acttttaacggcactttatgcaata

SEQ ID NO: 8871 - DNA, 25 bp, Artificial sequence
  SiRNA target sequence
cttttaacggcactttatgcaataa

SEQ ID NO: 8872 - DNA, 25 bp, Artificial sequence
  SiRNA target sequence
ttttaacggcactttatgcaataag

SEQ ID NO: 8873 - DNA, 25 bp, Artificial sequence
  SiRNA target sequence
tttaacggcactttatgcaataagt

SEQ ID NO: 8874 - DNA, 25 bp, Artificial sequence
  SiRNA target sequence
ttaacggcactttatgcaataagta

SEQ ID NO: 8875 - DNA, 25 bp, Artificial sequence
  SiRNA target sequence
taacggcactttatgcaataagtat

SEQ ID NO: 8876 - DNA, 25 bp, Artificial sequence
  SiRNA target sequence
aacggcactttatgcaataagtatt

SEQ ID NO: 8877 - DNA, 25 bp, Artificial sequence
  SiRNA target sequence
acggcactttatgcaataagtattg

SEQ ID NO: 8878 - DNA, 25 bp, Artificial sequence
  SiRNA target sequence
cggcactttatgcaataagtattga

SEQ ID NO: 8879 - DNA, 25 bp, Artificial sequence
  SiRNA target sequence
ggcactttatgcaataagtattgat

SEQ ID NO: 8880 - DNA, 25 bp, Artificial sequence
  SiRNA target sequence
gcactttatgcaataagtattgata

SEQ ID NO: 8881 - DNA, 25 bp, Artificial sequence
  SiRNA target sequence
cactttatgcaataagtattgataa

SEQ ID NO: 8882 - DNA, 25 bp, Artificial sequence
  SiRNA target sequence
actttatgcaataagtattgataag

SEQ ID NO: 8883 - DNA, 25 bp, Artificial sequence
  SiRNA target sequence
ctttatgcaataagtattgataaga

SEQ ID NO: 8884 - DNA, 25 bp, Artificial sequence
  SiRNA target sequence
tttatgcaataagtattgataagaa

SEQ ID NO: 8885 - DNA, 25 bp, Artificial sequence
  SiRNA target sequence
ttatgcaataagtattgataagaaa

SEQ ID NO: 8886 - DNA, 25 bp, Artificial sequence
  SiRNA target sequence
tatgcaataagtattgataagaaaa

SEQ ID NO: 8887 - DNA, 25 bp, Artificial sequence
  SiRNA target sequence
atgcaataagtattgataagaaaaa

SEQ ID NO: 8888 - DNA, 25 bp, Artificial sequence
  SiRNA target sequence
tgcaataagtattgataagaaaaag

SEQ ID NO: 8889 - DNA, 25 bp, Artificial sequence
  SiRNA target sequence
gcaataagtattgataagaaaaagg

SEQ ID NO: 8890 - DNA, 25 bp, Artificial sequence
  SiRNA target sequence
caataagtattgataagaaaaagga

SEQ ID NO: 8891 - DNA, 25 bp, Artificial sequence
  SiRNA target sequence
aataagtattgataagaaaaaggat

SEQ ID NO: 8892 - DNA, 25 bp, Artificial sequence
  SiRNA target sequence
ataagtattgataagaaaaaggatg

SEQ ID NO: 8893 - DNA, 25 bp, Artificial sequence
  SiRNA target sequence
taagtattgataagaaaaaggatgc

SEQ ID NO: 8894 - DNA, 25 bp, Artificial sequence
  SiRNA target sequence
aagtattgataagaaaaaggatgct

SEQ ID NO: 8895 - DNA, 25 bp, Artificial sequence
  SiRNA target sequence
agtattgataagaaaaaggatgcta

SEQ ID NO: 8896 - DNA, 25 bp, Artificial sequence
  SiRNA target sequence
gtattgataagaaaaaggatgctat

SEQ ID NO: 8897 - DNA, 25 bp, Artificial sequence
  SiRNA target sequence
tattgataagaaaaaggatgctata

SEQ ID NO: 8898 - DNA, 25 bp, Artificial sequence
  SiRNA target sequence
attgataagaaaaaggatgctatag

SEQ ID NO: 8899 - DNA, 25 bp, Artificial sequence
  SiRNA target sequence
ttgataagaaaaaggatgctataga

SEQ ID NO: 8900 - DNA, 25 bp, Artificial sequence
  SiRNA target sequence
tgataagaaaaaggatgctatagaa

SEQ ID NO: 8901 - DNA, 25 bp, Artificial sequence
  SiRNA target sequence
gataagaaaaaggatgctatagaaa

SEQ ID NO: 8902 - DNA, 25 bp, Artificial sequence
  SiRNA target sequence
ataagaaaaaggatgctatagaaat

SEQ ID NO: 8903 - DNA, 25 bp, Artificial sequence
  SiRNA target sequence
taagaaaaaggatgctatagaaatt

SEQ ID NO: 8904 - DNA, 25 bp, Artificial sequence
  SiRNA target sequence
aagaaaaaggatgctatagaaattt

SEQ ID NO: 8905 - DNA, 25 bp, Artificial sequence
  SiRNA target sequence
agaaaaaggatgctatagaaatttt

SEQ ID NO: 8906 - DNA, 25 bp, Artificial sequence
  SiRNA target sequence
gaaaaaggatgctatagaaatttta

SEQ ID NO: 8907 - DNA, 25 bp, Artificial sequence
  SiRNA target sequence
aaaaaggatgctatagaaattttat

SEQ ID NO: 8908 - DNA, 25 bp, Artificial sequence
  SiRNA target sequence
aaaaggatgctatagaaattttata

SEQ ID NO: 8909 - DNA, 25 bp, Artificial sequence
  SiRNA target sequence
aaaggatgctatagaaattttatat

SEQ ID NO: 8910 - DNA, 25 bp, Artificial sequence
  SiRNA target sequence
aaggatgctatagaaattttatata

SEQ ID NO: 8911 - DNA, 25 bp, Artificial sequence
  SiRNA target sequence
aggatgctatagaaattttatatag

SEQ ID NO: 8912 - DNA, 25 bp, Artificial sequence
  SiRNA target sequence
ggatgctatagaaattttatataga

SEQ ID NO: 8913 - DNA, 25 bp, Artificial sequence
  SiRNA target sequence
gatgctatagaaattttatatagaa

SEQ ID NO: 8914 - DNA, 25 bp, Artificial sequence
  SiRNA target sequence
atgctatagaaattttatatagaag

SEQ ID NO: 8915 - DNA, 25 bp, Artificial sequence
  SiRNA target sequence
tgctatagaaattttatatagaagt

SEQ ID NO: 8916 - DNA, 25 bp, Artificial sequence
  SiRNA target sequence
gctatagaaattttatatagaagta

SEQ ID NO: 8917 - DNA, 25 bp, Artificial sequence
  SiRNA target sequence
ctatagaaattttatatagaagtat

SEQ ID NO: 8918 - DNA, 25 bp, Artificial sequence
  SiRNA target sequence
tatagaaattttatatagaagtata

SEQ ID NO: 8919 - DNA, 25 bp, Artificial sequence
  SiRNA target sequence
atagaaattttatatagaagtatat

SEQ ID NO: 8920 - DNA, 25 bp, Artificial sequence
  SiRNA target sequence
tagaaattttatatagaagtatatc

SEQ ID NO: 8921 - DNA, 25 bp, Artificial sequence
  SiRNA target sequence
agaaattttatatagaagtatatca

SEQ ID NO: 8922 - DNA, 25 bp, Artificial sequence
  SiRNA target sequence
gaaattttatatagaagtatatcag

SEQ ID NO: 8923 - DNA, 25 bp, Artificial sequence
  SiRNA target sequence
aaattttatatagaagtatatcaga

SEQ ID NO: 8924 - DNA, 25 bp, Artificial sequence
  SiRNA target sequence
aattttatatagaagtatatcagaa

SEQ ID NO: 8925 - DNA, 25 bp, Artificial sequence
  SiRNA target sequence
attttatatagaagtatatcagaat

SEQ ID NO: 8926 - DNA, 25 bp, Artificial sequence
  SiRNA target sequence
ttttatatagaagtatatcagaata

SEQ ID NO: 8927 - DNA, 25 bp, Artificial sequence
  SiRNA target sequence
tttatatagaagtatatcagaatat

SEQ ID NO: 8928 - DNA, 25 bp, Artificial sequence
  SiRNA target sequence
ttatatagaagtatatcagaatatt

SEQ ID NO: 8929 - DNA, 25 bp, Artificial sequence
  SiRNA target sequence
tatatagaagtatatcagaatattc

SEQ ID NO: 8930 - DNA, 25 bp, Artificial sequence
  SiRNA target sequence
atatagaagtatatcagaatattca

SEQ ID NO: 8931 - DNA, 25 bp, Artificial sequence
  SiRNA target sequence
tatagaagtatatcagaatattcat

SEQ ID NO: 8932 - DNA, 25 bp, Artificial sequence
  SiRNA target sequence
atagaagtatatcagaatattcatc

SEQ ID NO: 8933 - DNA, 25 bp, Artificial sequence
  SiRNA target sequence
tagaagtatatcagaatattcatct

SEQ ID NO: 8934 - DNA, 25 bp, Artificial sequence
  SiRNA target sequence
agaagtatatcagaatattcatctt

SEQ ID NO: 8935 - DNA, 25 bp, Artificial sequence
  SiRNA target sequence
gaagtatatcagaatattcatctta

SEQ ID NO: 8936 - DNA, 25 bp, Artificial sequence
  SiRNA target sequence
aagtatatcagaatattcatcttat

SEQ ID NO: 8937 - DNA, 25 bp, Artificial sequence
  SiRNA target sequence
agtatatcagaatattcatcttatt

SEQ ID NO: 8938 - DNA, 25 bp, Artificial sequence
  SiRNA target sequence
gtatatcagaatattcatcttattt

SEQ ID NO: 8939 - DNA, 25 bp, Artificial sequence
  SiRNA target sequence
tatatcagaatattcatcttatttt

SEQ ID NO: 8940 - DNA, 25 bp, Artificial sequence
  SiRNA target sequence
atatcagaatattcatcttatttta

SEQ ID NO: 8941 - DNA, 25 bp, Artificial sequence
  SiRNA target sequence
tatcagaatattcatcttattttaa

SEQ ID NO: 8942 - DNA, 25 bp, Artificial sequence
  SiRNA target sequence
atcagaatattcatcttattttaaa

SEQ ID NO: 8943 - DNA, 25 bp, Artificial sequence
  SiRNA target sequence
tcagaatattcatcttattttaaat

SEQ ID NO: 8944 - DNA, 25 bp, Artificial sequence
  SiRNA target sequence
cagaatattcatcttattttaaatc

SEQ ID NO: 8945 - DNA, 25 bp, Artificial sequence
  SiRNA target sequence
agaatattcatcttattttaaatct

SEQ ID NO: 8946 - DNA, 25 bp, Artificial sequence
  SiRNA target sequence
gaatattcatcttattttaaatctt

SEQ ID NO: 8947 - DNA, 25 bp, Artificial sequence
  SiRNA target sequence
aatattcatcttattttaaatctta

SEQ ID NO: 8948 - DNA, 25 bp, Artificial sequence
  SiRNA target sequence
atattcatcttattttaaatcttat

SEQ ID NO: 8949 - DNA, 25 bp, Artificial sequence
  SiRNA target sequence
tattcatcttattttaaatcttatt

SEQ ID NO: 8950 - DNA, 25 bp, Artificial sequence
  SiRNA target sequence
attcatcttattttaaatcttattt

SEQ ID NO: 8951 - DNA, 25 bp, Artificial sequence
  SiRNA target sequence
ttcatcttattttaaatcttatttg

SEQ ID NO: 8952 - DNA, 25 bp, Artificial sequence
  SiRNA target sequence
tcatcttattttaaatcttatttgt

SEQ ID NO: 8953 - DNA, 25 bp, Artificial sequence
  SiRNA target sequence
catcttattttaaatcttatttgta

SEQ ID NO: 8954 - DNA, 25 bp, Artificial sequence
  SiRNA target sequence
atcttattttaaatcttatttgtat

SEQ ID NO: 8955 - DNA, 25 bp, Artificial sequence
  SiRNA target sequence
tcttattttaaatcttatttgtatt

SEQ ID NO: 8956 - DNA, 25 bp, Artificial sequence
  SiRNA target sequence
cttattttaaatcttatttgtattt

SEQ ID NO: 8957 - DNA, 25 bp, Artificial sequence
  SiRNA target sequence
ttattttaaatcttatttgtattta

SEQ ID NO: 8958 - DNA, 25 bp, Artificial sequence
  SiRNA target sequence
tattttaaatcttatttgtatttag

SEQ ID NO: 8959 - DNA, 25 bp, Artificial sequence
  SiRNA target sequence
attttaaatcttatttgtatttagg

SEQ ID NO: 8960 - DNA, 25 bp, Artificial sequence
  SiRNA target sequence
ttttaaatcttatttgtatttagga

SEQ ID NO: 8961 - DNA, 25 bp, Artificial sequence
  SiRNA target sequence
tttaaatcttatttgtatttaggaa

SEQ ID NO: 8962 - DNA, 25 bp, Artificial sequence
  SiRNA target sequence
ttaaatcttatttgtatttaggaaa

SEQ ID NO: 8963 - DNA, 25 bp, Artificial sequence
  SiRNA target sequence
taaatcttatttgtatttaggaaat

SEQ ID NO: 8964 - DNA, 25 bp, Artificial sequence
  SiRNA target sequence
aaatcttatttgtatttaggaaata

SEQ ID NO: 8965 - DNA, 25 bp, Artificial sequence
  SiRNA target sequence
aatcttatttgtatttaggaaatat

SEQ ID NO: 8966 - DNA, 25 bp, Artificial sequence
  SiRNA target sequence
atcttatttgtatttaggaaatatt

SEQ ID NO: 8967 - DNA, 25 bp, Artificial sequence
  SiRNA target sequence
tcttatttgtatttaggaaatattt

SEQ ID NO: 8968 - DNA, 25 bp, Artificial sequence
  SiRNA target sequence
cttatttgtatttaggaaatatttt

SEQ ID NO: 8969 - DNA, 25 bp, Artificial sequence
  SiRNA target sequence
ttatttgtatttaggaaatatttta

SEQ ID NO: 8970 - DNA, 25 bp, Artificial sequence
  SiRNA target sequence
tatttgtatttaggaaatattttaa

SEQ ID NO: 8971 - DNA, 25 bp, Artificial sequence
  SiRNA target sequence
atttgtatttaggaaatattttaat

SEQ ID NO: 8972 - DNA, 25 bp, Artificial sequence
  SiRNA target sequence
tttgtatttaggaaatattttaata

SEQ ID NO: 8973 - DNA, 25 bp, Artificial sequence
  SiRNA target sequence
ttgtatttaggaaatattttaataa

SEQ ID NO: 8974 - DNA, 25 bp, Artificial sequence
  SiRNA target sequence
tgtatttaggaaatattttaataaa

SEQ ID NO: 8975 - DNA, 25 bp, Artificial sequence
  SiRNA target sequence
gtatttaggaaatattttaataaat

SEQ ID NO: 8976 - DNA, 25 bp, Artificial sequence
  SiRNA target sequence
tatttaggaaatattttaataaatg

SEQ ID NO: 8977 - DNA, 25 bp, Artificial sequence
  SiRNA target sequence
atttaggaaatattttaataaatga

SEQ ID NO: 8978 - DNA, 25 bp, Artificial sequence
  SiRNA target sequence
tttaggaaatattttaataaatgat

SEQ ID NO: 8979 - DNA, 25 bp, Artificial sequence
  SiRNA target sequence
ttaggaaatattttaataaatgatg

SEQ ID NO: 8980 - DNA, 25 bp, Artificial sequence
  SiRNA target sequence
taggaaatattttaataaatgatga

SEQ ID NO: 8981 - DNA, 25 bp, Artificial sequence
  SiRNA target sequence
aggaaatattttaataaatgatgac

SEQ ID NO: 8982 - DNA, 25 bp, Artificial sequence
  SiRNA target sequence
ggaaatattttaataaatgatgact

SEQ ID NO: 8983 - DNA, 25 bp, Artificial sequence
  SiRNA target sequence
gaaatattttaataaatgatgactt

SEQ ID NO: 8984 - DNA, 25 bp, Artificial sequence
  SiRNA target sequence
aaatattttaataaatgatgactta

SEQ ID NO: 8985 - DNA, 25 bp, Artificial sequence
  SiRNA target sequence
aatattttaataaatgatgacttaa

SEQ ID NO: 8986 - DNA, 25 bp, Artificial sequence
  SiRNA target sequence
atattttaataaatgatgacttaaa

SEQ ID NO: 8987 - DNA, 25 bp, Artificial sequence
  SiRNA target sequence
tattttaataaatgatgacttaaat

SEQ ID NO: 8988 - DNA, 25 bp, Artificial sequence
  SiRNA target sequence
attttaataaatgatgacttaaatg

SEQ ID NO: 8989 - DNA, 25 bp, Artificial sequence
  SiRNA target sequence
ttttaataaatgatgacttaaatga

SEQ ID NO: 8990 - DNA, 25 bp, Artificial sequence
  SiRNA target sequence
tttaataaatgatgacttaaatgaa

SEQ ID NO: 8991 - DNA, 25 bp, Artificial sequence
  SiRNA target sequence
ttaataaatgatgacttaaatgaat

SEQ ID NO: 8992 - DNA, 25 bp, Artificial sequence
  SiRNA target sequence
taataaatgatgacttaaatgaatg

SEQ ID NO: 8993 - DNA, 25 bp, Artificial sequence
  SiRNA target sequence
aataaatgatgacttaaatgaatgc

SEQ ID NO: 8994 - DNA, 25 bp, Artificial sequence
  SiRNA target sequence
ataaatgatgacttaaatgaatgca

SEQ ID NO: 8995 - DNA, 25 bp, Artificial sequence
  SiRNA target sequence
taaatgatgacttaaatgaatgcag

SEQ ID NO: 8996 - DNA, 25 bp, Artificial sequence
  SiRNA target sequence
aaatgatgacttaaatgaatgcagg

SEQ ID NO: 8997 - DNA, 25 bp, Artificial sequence
  SiRNA target sequence
aatgatgacttaaatgaatgcagga

SEQ ID NO: 8998 - DNA, 25 bp, Artificial sequence
  SiRNA target sequence
atgatgacttaaatgaatgcaggaa

SEQ ID NO: 8999 - DNA, 25 bp, Artificial sequence
  SiRNA target sequence
tgatgacttaaatgaatgcaggaaa

SEQ ID NO: 9000 - DNA, 25 bp, Artificial sequence
  SiRNA target sequence
gatgacttaaatgaatgcaggaaat

SEQ ID NO: 9001 - DNA, 25 bp, Artificial sequence
  SiRNA target sequence
atgacttaaatgaatgcaggaaatt

SEQ ID NO: 9002 - DNA, 25 bp, Artificial sequence
  SiRNA target sequence
tgacttaaatgaatgcaggaaattg

SEQ ID NO: 9003 - DNA, 25 bp, Artificial sequence
  SiRNA target sequence
gacttaaatgaatgcaggaaattgt

SEQ ID NO: 9004 - DNA, 25 bp, Artificial sequence
  SiRNA target sequence
acttaaatgaatgcaggaaattgtt

SEQ ID NO: 9005 - DNA, 25 bp, Artificial sequence
  SiRNA target sequence
cttaaatgaatgcaggaaattgttt

SEQ ID NO: 9006 - DNA, 25 bp, Artificial sequence
  SiRNA target sequence
ttaaatgaatgcaggaaattgttta

SEQ ID NO: 9007 - DNA, 25 bp, Artificial sequence
  SiRNA target sequence
taaatgaatgcaggaaattgtttaa

SEQ ID NO: 9008 - DNA, 25 bp, Artificial sequence
  SiRNA target sequence
aaatgaatgcaggaaattgtttaat

SEQ ID NO: 9009 - DNA, 25 bp, Artificial sequence
  SiRNA target sequence
aatgaatgcaggaaattgtttaata

SEQ ID NO: 9010 - DNA, 25 bp, Artificial sequence
  SiRNA target sequence
atgaatgcaggaaattgtttaatac

SEQ ID NO: 9011 - DNA, 25 bp, Artificial sequence
  SiRNA target sequence
tgaatgcaggaaattgtttaataca

SEQ ID NO: 9012 - DNA, 25 bp, Artificial sequence
  SiRNA target sequence
gaatgcaggaaattgtttaatacat

SEQ ID NO: 9013 - DNA, 25 bp, Artificial sequence
  SiRNA target sequence
aatgcaggaaattgtttaatacatc

SEQ ID NO: 9014 - DNA, 25 bp, Artificial sequence
  SiRNA target sequence
atgcaggaaattgtttaatacatca

SEQ ID NO: 9015 - DNA, 25 bp, Artificial sequence
  SiRNA target sequence
tgcaggaaattgtttaatacatcac

SEQ ID NO: 9016 - DNA, 25 bp, Artificial sequence
  SiRNA target sequence
gcaggaaattgtttaatacatcact

SEQ ID NO: 9017 - DNA, 25 bp, Artificial sequence
  SiRNA target sequence
caggaaattgtttaatacatcactt

SEQ ID NO: 9018 - DNA, 25 bp, Artificial sequence
  SiRNA target sequence
aggaaattgtttaatacatcacttc

SEQ ID NO: 9019 - DNA, 25 bp, Artificial sequence
  SiRNA target sequence
ggaaattgtttaatacatcacttca

SEQ ID NO: 9020 - DNA, 25 bp, Artificial sequence
  SiRNA target sequence
gaaattgtttaatacatcacttcaa

SEQ ID NO: 9021 - DNA, 25 bp, Artificial sequence
  SiRNA target sequence
aaattgtttaatacatcacttcaat

SEQ ID NO: 9022 - DNA, 25 bp, Artificial sequence
  SiRNA target sequence
aattgtttaatacatcacttcaata

SEQ ID NO: 9023 - DNA, 25 bp, Artificial sequence
  SiRNA target sequence
attgtttaatacatcacttcaatat

SEQ ID NO: 9024 - DNA, 25 bp, Artificial sequence
  SiRNA target sequence
ttgtttaatacatcacttcaatatt

SEQ ID NO: 9025 - DNA, 25 bp, Artificial sequence
  SiRNA target sequence
tgtttaatacatcacttcaatattg

SEQ ID NO: 9026 - DNA, 25 bp, Artificial sequence
  SiRNA target sequence
gtttaatacatcacttcaatattgt

SEQ ID NO: 9027 - DNA, 25 bp, Artificial sequence
  SiRNA target sequence
tttaatacatcacttcaatattgtt

SEQ ID NO: 9028 - DNA, 25 bp, Artificial sequence
  SiRNA target sequence
ttaatacatcacttcaatattgttg

SEQ ID NO: 9029 - DNA, 25 bp, Artificial sequence
  SiRNA target sequence
taatacatcacttcaatattgttgt

SEQ ID NO: 9030 - DNA, 25 bp, Artificial sequence
  SiRNA target sequence
aatacatcacttcaatattgttgta

SEQ ID NO: 9031 - DNA, 25 bp, Artificial sequence
  SiRNA target sequence
atacatcacttcaatattgttgtaa

SEQ ID NO: 9032 - DNA, 25 bp, Artificial sequence
  SiRNA target sequence
tacatcacttcaatattgttgtaat

SEQ ID NO: 9033 - DNA, 25 bp, Artificial sequence
  SiRNA target sequence
acatcacttcaatattgttgtaatt

SEQ ID NO: 9034 - DNA, 25 bp, Artificial sequence
  SiRNA target sequence
catcacttcaatattgttgtaattc

SEQ ID NO: 9035 - DNA, 25 bp, Artificial sequence
  SiRNA target sequence
atcacttcaatattgttgtaattct

SEQ ID NO: 9036 - DNA, 25 bp, Artificial sequence
  SiRNA target sequence
tcacttcaatattgttgtaattctg

SEQ ID NO: 9037 - DNA, 25 bp, Artificial sequence
  SiRNA target sequence
cacttcaatattgttgtaattctga

SEQ ID NO: 9038 - DNA, 25 bp, Artificial sequence
  SiRNA target sequence
acttcaatattgttgtaattctgat

SEQ ID NO: 9039 - DNA, 25 bp, Artificial sequence
  SiRNA target sequence
cttcaatattgttgtaattctgatg

SEQ ID NO: 9040 - DNA, 25 bp, Artificial sequence
  SiRNA target sequence
ttcaatattgttgtaattctgatga

SEQ ID NO: 9041 - DNA, 25 bp, Artificial sequence
  SiRNA target sequence
tcaatattgttgtaattctgatgag

SEQ ID NO: 9042 - DNA, 25 bp, Artificial sequence
  SiRNA target sequence
caatattgttgtaattctgatgagg

SEQ ID NO: 9043 - DNA, 25 bp, Artificial sequence
  SiRNA target sequence
aatattgttgtaattctgatgaggt

SEQ ID NO: 9044 - DNA, 25 bp, Artificial sequence
  SiRNA target sequence
atattgttgtaattctgatgaggtt

SEQ ID NO: 9045 - DNA, 25 bp, Artificial sequence
  SiRNA target sequence
tattgttgtaattctgatgaggttt

SEQ ID NO: 9046 - DNA, 25 bp, Artificial sequence
  SiRNA target sequence
attgttgtaattctgatgaggtttt

SEQ ID NO: 9047 - DNA, 25 bp, Artificial sequence
  SiRNA target sequence
ttgttgtaattctgatgaggttttt

SEQ ID NO: 9048 - DNA, 25 bp, Artificial sequence
  SiRNA target sequence
tgttgtaattctgatgaggttttta

SEQ ID NO: 9049 - DNA, 25 bp, Artificial sequence
  SiRNA target sequence
gttgtaattctgatgaggtttttat

SEQ ID NO: 9050 - DNA, 25 bp, Artificial sequence
  SiRNA target sequence
ttgtaattctgatgaggtttttatt

SEQ ID NO: 9051 - DNA, 25 bp, Artificial sequence
  SiRNA target sequence
tgtaattctgatgaggtttttattg

SEQ ID NO: 9052 - DNA, 25 bp, Artificial sequence
  SiRNA target sequence
gtaattctgatgaggtttttattgt

SEQ ID NO: 9053 - DNA, 25 bp, Artificial sequence
  SiRNA target sequence
taattctgatgaggtttttattgtt

SEQ ID NO: 9054 - DNA, 25 bp, Artificial sequence
  SiRNA target sequence
aattctgatgaggtttttattgtta

SEQ ID NO: 9055 - DNA, 25 bp, Artificial sequence
  SiRNA target sequence
attctgatgaggtttttattgttaa

SEQ ID NO: 9056 - DNA, 25 bp, Artificial sequence
  SiRNA target sequence
ttctgatgaggtttttattgttaag

SEQ ID NO: 9057 - DNA, 25 bp, Artificial sequence
  SiRNA target sequence
tctgatgaggtttttattgttaagc

SEQ ID NO: 9058 - DNA, 25 bp, Artificial sequence
  SiRNA target sequence
ctgatgaggtttttattgttaagca

SEQ ID NO: 9059 - DNA, 25 bp, Artificial sequence
  SiRNA target sequence
tgatgaggtttttattgttaagcag

SEQ ID NO: 9060 - DNA, 25 bp, Artificial sequence
  SiRNA target sequence
gatgaggtttttattgttaagcagt

SEQ ID NO: 9061 - DNA, 25 bp, Artificial sequence
  SiRNA target sequence
atgaggtttttattgttaagcagtc

SEQ ID NO: 9062 - DNA, 25 bp, Artificial sequence
  SiRNA target sequence
tgaggtttttattgttaagcagtca

SEQ ID NO: 9063 - DNA, 25 bp, Artificial sequence
  SiRNA target sequence
gaggtttttattgttaagcagtcac

SEQ ID NO: 9064 - DNA, 25 bp, Artificial sequence
  SiRNA target sequence
aggtttttattgttaagcagtcact

SEQ ID NO: 9065 - DNA, 25 bp, Artificial sequence
  SiRNA target sequence
ggtttttattgttaagcagtcactt

SEQ ID NO: 9066 - DNA, 25 bp, Artificial sequence
  SiRNA target sequence
gtttttattgttaagcagtcactta

SEQ ID NO: 9067 - DNA, 25 bp, Artificial sequence
  SiRNA target sequence
tttttattgttaagcagtcacttat

SEQ ID NO: 9068 - DNA, 25 bp, Artificial sequence
  SiRNA target sequence
ttttattgttaagcagtcacttatt

SEQ ID NO: 9069 - DNA, 25 bp, Artificial sequence
  SiRNA target sequence
tttattgttaagcagtcacttattt

SEQ ID NO: 9070 - DNA, 25 bp, Artificial sequence
  SiRNA target sequence
ttattgttaagcagtcacttatttt

SEQ ID NO: 9071 - DNA, 25 bp, Artificial sequence
  SiRNA target sequence
tattgttaagcagtcacttatttta

SEQ ID NO: 9072 - DNA, 25 bp, Artificial sequence
  SiRNA target sequence
attgttaagcagtcacttattttaa

SEQ ID NO: 9073 - DNA, 25 bp, Artificial sequence
  SiRNA target sequence
ttgttaagcagtcacttattttaat

SEQ ID NO: 9074 - DNA, 25 bp, Artificial sequence
  SiRNA target sequence
tgttaagcagtcacttattttaata

SEQ ID NO: 9075 - DNA, 25 bp, Artificial sequence
  SiRNA target sequence
gttaagcagtcacttattttaatag

SEQ ID NO: 9076 - DNA, 25 bp, Artificial sequence
  SiRNA target sequence
ttaagcagtcacttattttaataga

SEQ ID NO: 9077 - DNA, 25 bp, Artificial sequence
  SiRNA target sequence
taagcagtcacttattttaatagaa

SEQ ID NO: 9078 - DNA, 25 bp, Artificial sequence
  SiRNA target sequence
aagcagtcacttattttaatagaag

SEQ ID NO: 9079 - DNA, 25 bp, Artificial sequence
  SiRNA target sequence
agcagtcacttattttaatagaagt

SEQ ID NO: 9080 - DNA, 25 bp, Artificial sequence
  SiRNA target sequence
gcagtcacttattttaatagaagta

SEQ ID NO: 9081 - DNA, 25 bp, Artificial sequence
  SiRNA target sequence
cagtcacttattttaatagaagtac

SEQ ID NO: 9082 - DNA, 25 bp, Artificial sequence
  SiRNA target sequence
agtcacttattttaatagaagtaca

SEQ ID NO: 9083 - DNA, 25 bp, Artificial sequence
  SiRNA target sequence
gtcacttattttaatagaagtacat

SEQ ID NO: 9084 - DNA, 25 bp, Artificial sequence
  SiRNA target sequence
tcacttattttaatagaagtacatg

SEQ ID NO: 9085 - DNA, 25 bp, Artificial sequence
  SiRNA target sequence
cacttattttaatagaagtacatga

SEQ ID NO: 9086 - DNA, 25 bp, Artificial sequence
  SiRNA target sequence
acttattttaatagaagtacatgaa

SEQ ID NO: 9087 - DNA, 25 bp, Artificial sequence
  SiRNA target sequence
cttattttaatagaagtacatgaat

SEQ ID NO: 9088 - DNA, 25 bp, Artificial sequence
  SiRNA target sequence
ttattttaatagaagtacatgaata

SEQ ID NO: 9089 - DNA, 25 bp, Artificial sequence
  SiRNA target sequence
tattttaatagaagtacatgaatac

SEQ ID NO: 9090 - DNA, 25 bp, Artificial sequence
  SiRNA target sequence
attttaatagaagtacatgaataca

SEQ ID NO: 9091 - DNA, 25 bp, Artificial sequence
  SiRNA target sequence
ttttaatagaagtacatgaatacat

SEQ ID NO: 9092 - DNA, 25 bp, Artificial sequence
  SiRNA target sequence
tttaatagaagtacatgaatacatc

SEQ ID NO: 9093 - DNA, 25 bp, Artificial sequence
  SiRNA target sequence
ttaatagaagtacatgaatacatca

SEQ ID NO: 9094 - DNA, 25 bp, Artificial sequence
  SiRNA target sequence
taatagaagtacatgaatacatcaa

SEQ ID NO: 9095 - DNA, 25 bp, Artificial sequence
  SiRNA target sequence
aatagaagtacatgaatacatcaaa

SEQ ID NO: 9096 - DNA, 25 bp, Artificial sequence
  SiRNA target sequence
atagaagtacatgaatacatcaaag

SEQ ID NO: 9097 - DNA, 25 bp, Artificial sequence
  SiRNA target sequence
tagaagtacatgaatacatcaaaga

SEQ ID NO: 9098 - DNA, 25 bp, Artificial sequence
  SiRNA target sequence
agaagtacatgaatacatcaaagaa

SEQ ID NO: 9099 - DNA, 25 bp, Artificial sequence
  SiRNA target sequence
gaagtacatgaatacatcaaagaaa

SEQ ID NO: 9100 - DNA, 25 bp, Artificial sequence
  SiRNA target sequence
aagtacatgaatacatcaaagaaaa

SEQ ID NO: 9101 - DNA, 25 bp, Artificial sequence
  SiRNA target sequence
agtacatgaatacatcaaagaaaat

SEQ ID NO: 9102 - DNA, 25 bp, Artificial sequence
  SiRNA target sequence
gtacatgaatacatcaaagaaaata

SEQ ID NO: 9103 - DNA, 25 bp, Artificial sequence
  SiRNA target sequence
tacatgaatacatcaaagaaaataa

SEQ ID NO: 9104 - DNA, 25 bp, Artificial sequence
  SiRNA target sequence
acatgaatacatcaaagaaaataaa

SEQ ID NO: 9105 - DNA, 25 bp, Artificial sequence
  SiRNA target sequence
catgaatacatcaaagaaaataaaa

SEQ ID NO: 9106 - DNA, 25 bp, Artificial sequence
  SiRNA target sequence
atgaatacatcaaagaaaataaaat

SEQ ID NO: 9107 - DNA, 25 bp, Artificial sequence
  SiRNA target sequence
tgaatacatcaaagaaaataaaata

SEQ ID NO: 9108 - DNA, 25 bp, Artificial sequence
  SiRNA target sequence
gaatacatcaaagaaaataaaatat

SEQ ID NO: 9109 - DNA, 25 bp, Artificial sequence
  SiRNA target sequence
aatacatcaaagaaaataaaatata

SEQ ID NO: 9110 - DNA, 25 bp, Artificial sequence
  SiRNA target sequence
atacatcaaagaaaataaaatataa

SEQ ID NO: 9111 - DNA, 26 bp, Artificial sequence
  SiRNA target sequence
atgaaacgaaaaacagaaatatttat

SEQ ID NO: 9112 - DNA, 26 bp, Artificial sequence
  SiRNA target sequence
tgaaacgaaaaacagaaatatttatt

SEQ ID NO: 9113 - DNA, 26 bp, Artificial sequence
  SiRNA target sequence
gaaacgaaaaacagaaatatttattg

SEQ ID NO: 9114 - DNA, 26 bp, Artificial sequence
  SiRNA target sequence
aaacgaaaaacagaaatatttattgc

SEQ ID NO: 9115 - DNA, 26 bp, Artificial sequence
  SiRNA target sequence
aacgaaaaacagaaatatttattgct

SEQ ID NO: 9116 - DNA, 26 bp, Artificial sequence
  SiRNA target sequence
acgaaaaacagaaatatttattgcta

SEQ ID NO: 9117 - DNA, 26 bp, Artificial sequence
  SiRNA target sequence
cgaaaaacagaaatatttattgctat

SEQ ID NO: 9118 - DNA, 26 bp, Artificial sequence
  SiRNA target sequence
gaaaaacagaaatatttattgctatt

SEQ ID NO: 9119 - DNA, 26 bp, Artificial sequence
  SiRNA target sequence
aaaaacagaaatatttattgctatta

SEQ ID NO: 9120 - DNA, 26 bp, Artificial sequence
  SiRNA target sequence
aaaacagaaatatttattgctattac

SEQ ID NO: 9121 - DNA, 26 bp, Artificial sequence
  SiRNA target sequence
aaacagaaatatttattgctattaca

SEQ ID NO: 9122 - DNA, 26 bp, Artificial sequence
  SiRNA target sequence
aacagaaatatttattgctattacag

SEQ ID NO: 9123 - DNA, 26 bp, Artificial sequence
  SiRNA target sequence
acagaaatatttattgctattacagt

SEQ ID NO: 9124 - DNA, 26 bp, Artificial sequence
  SiRNA target sequence
cagaaatatttattgctattacagta

SEQ ID NO: 9125 - DNA, 26 bp, Artificial sequence
  SiRNA target sequence
agaaatatttattgctattacagtag

SEQ ID NO: 9126 - DNA, 26 bp, Artificial sequence
  SiRNA target sequence
gaaatatttattgctattacagtagt

SEQ ID NO: 9127 - DNA, 26 bp, Artificial sequence
  SiRNA target sequence
aaatatttattgctattacagtagtc

SEQ ID NO: 9128 - DNA, 26 bp, Artificial sequence
  SiRNA target sequence
aatatttattgctattacagtagtca

SEQ ID NO: 9129 - DNA, 26 bp, Artificial sequence
  SiRNA target sequence
atatttattgctattacagtagtcac

SEQ ID NO: 9130 - DNA, 26 bp, Artificial sequence
  SiRNA target sequence
tatttattgctattacagtagtcact

SEQ ID NO: 9131 - DNA, 26 bp, Artificial sequence
  SiRNA target sequence
atttattgctattacagtagtcactg

SEQ ID NO: 9132 - DNA, 26 bp, Artificial sequence
  SiRNA target sequence
tttattgctattacagtagtcactgc

SEQ ID NO: 9133 - DNA, 26 bp, Artificial sequence
  SiRNA target sequence
ttattgctattacagtagtcactgca

SEQ ID NO: 9134 - DNA, 26 bp, Artificial sequence
  SiRNA target sequence
tattgctattacagtagtcactgcag

SEQ ID NO: 9135 - DNA, 26 bp, Artificial sequence
  SiRNA target sequence
attgctattacagtagtcactgcagt

SEQ ID NO: 9136 - DNA, 26 bp, Artificial sequence
  SiRNA target sequence
ttgctattacagtagtcactgcagtg

SEQ ID NO: 9137 - DNA, 26 bp, Artificial sequence
  SiRNA target sequence
tgctattacagtagtcactgcagtga

SEQ ID NO: 9138 - DNA, 26 bp, Artificial sequence
  SiRNA target sequence
gctattacagtagtcactgcagtgac

SEQ ID NO: 9139 - DNA, 26 bp, Artificial sequence
  SiRNA target sequence
ctattacagtagtcactgcagtgaca

SEQ ID NO: 9140 - DNA, 26 bp, Artificial sequence
  SiRNA target sequence
tattacagtagtcactgcagtgacat

SEQ ID NO: 9141 - DNA, 26 bp, Artificial sequence
  SiRNA target sequence
attacagtagtcactgcagtgacatg

SEQ ID NO: 9142 - DNA, 26 bp, Artificial sequence
  SiRNA target sequence
ttacagtagtcactgcagtgacatgt

SEQ ID NO: 9143 - DNA, 26 bp, Artificial sequence
  SiRNA target sequence
tacagtagtcactgcagtgacatgtt

SEQ ID NO: 9144 - DNA, 26 bp, Artificial sequence
  SiRNA target sequence
acagtagtcactgcagtgacatgtta

SEQ ID NO: 9145 - DNA, 26 bp, Artificial sequence
  SiRNA target sequence
cagtagtcactgcagtgacatgttac

SEQ ID NO: 9146 - DNA, 26 bp, Artificial sequence
  SiRNA target sequence
agtagtcactgcagtgacatgttact

SEQ ID NO: 9147 - DNA, 26 bp, Artificial sequence
  SiRNA target sequence
gtagtcactgcagtgacatgttactt

SEQ ID NO: 9148 - DNA, 26 bp, Artificial sequence
  SiRNA target sequence
tagtcactgcagtgacatgttactta

SEQ ID NO: 9149 - DNA, 26 bp, Artificial sequence
  SiRNA target sequence
agtcactgcagtgacatgttacttat

SEQ ID NO: 9150 - DNA, 26 bp, Artificial sequence
  SiRNA target sequence
gtcactgcagtgacatgttacttatt

SEQ ID NO: 9151 - DNA, 26 bp, Artificial sequence
  SiRNA target sequence
tcactgcagtgacatgttacttattt

SEQ ID NO: 9152 - DNA, 26 bp, Artificial sequence
  SiRNA target sequence
cactgcagtgacatgttacttattta

SEQ ID NO: 9153 - DNA, 26 bp, Artificial sequence
  SiRNA target sequence
actgcagtgacatgttacttatttaa

SEQ ID NO: 9154 - DNA, 26 bp, Artificial sequence
  SiRNA target sequence
ctgcagtgacatgttacttatttaaa

SEQ ID NO: 9155 - DNA, 26 bp, Artificial sequence
  SiRNA target sequence
tgcagtgacatgttacttatttaaaa

SEQ ID NO: 9156 - DNA, 26 bp, Artificial sequence
  SiRNA target sequence
gcagtgacatgttacttatttaaaaa

SEQ ID NO: 9157 - DNA, 26 bp, Artificial sequence
  SiRNA target sequence
cagtgacatgttacttatttaaaaaa

SEQ ID NO: 9158 - DNA, 26 bp, Artificial sequence
  SiRNA target sequence
agtgacatgttacttatttaaaaaaa

SEQ ID NO: 9159 - DNA, 26 bp, Artificial sequence
  SiRNA target sequence
gtgacatgttacttatttaaaaaaat

SEQ ID NO: 9160 - DNA, 26 bp, Artificial sequence
  SiRNA target sequence
tgacatgttacttatttaaaaaaata

SEQ ID NO: 9161 - DNA, 26 bp, Artificial sequence
  SiRNA target sequence
gacatgttacttatttaaaaaaataa

SEQ ID NO: 9162 - DNA, 26 bp, Artificial sequence
  SiRNA target sequence
acatgttacttatttaaaaaaataat

SEQ ID NO: 9163 - DNA, 26 bp, Artificial sequence
  SiRNA target sequence
catgttacttatttaaaaaaataata

SEQ ID NO: 9164 - DNA, 26 bp, Artificial sequence
  SiRNA target sequence
atgttacttatttaaaaaaataataa

SEQ ID NO: 9165 - DNA, 26 bp, Artificial sequence
  SiRNA target sequence
tgttacttatttaaaaaaataataaa

SEQ ID NO: 9166 - DNA, 26 bp, Artificial sequence
  SiRNA target sequence
gttacttatttaaaaaaataataaat

SEQ ID NO: 9167 - DNA, 26 bp, Artificial sequence
  SiRNA target sequence
ttacttatttaaaaaaataataaata

SEQ ID NO: 9168 - DNA, 26 bp, Artificial sequence
  SiRNA target sequence
tacttatttaaaaaaataataaatag

SEQ ID NO: 9169 - DNA, 26 bp, Artificial sequence
  SiRNA target sequence
acttatttaaaaaaataataaataga

SEQ ID NO: 9170 - DNA, 26 bp, Artificial sequence
  SiRNA target sequence
cttatttaaaaaaataataaatagac

SEQ ID NO: 9171 - DNA, 26 bp, Artificial sequence
  SiRNA target sequence
ttatttaaaaaaataataaatagaca

SEQ ID NO: 9172 - DNA, 26 bp, Artificial sequence
  SiRNA target sequence
tatttaaaaaaataataaatagacaa

SEQ ID NO: 9173 - DNA, 26 bp, Artificial sequence
  SiRNA target sequence
atttaaaaaaataataaatagacaaa

SEQ ID NO: 9174 - DNA, 26 bp, Artificial sequence
  SiRNA target sequence
tttaaaaaaataataaatagacaaaa

SEQ ID NO: 9175 - DNA, 26 bp, Artificial sequence
  SiRNA target sequence
ttaaaaaaataataaatagacaaaag

SEQ ID NO: 9176 - DNA, 26 bp, Artificial sequence
  SiRNA target sequence
taaaaaaataataaatagacaaaagt

SEQ ID NO: 9177 - DNA, 26 bp, Artificial sequence
  SiRNA target sequence
aaaaaaataataaatagacaaaagtc

SEQ ID NO: 9178 - DNA, 26 bp, Artificial sequence
  SiRNA target sequence
aaaaaataataaatagacaaaagtct

SEQ ID NO: 9179 - DNA, 26 bp, Artificial sequence
  SiRNA target sequence
aaaaataataaatagacaaaagtctg

SEQ ID NO: 9180 - DNA, 26 bp, Artificial sequence
  SiRNA target sequence
aaaataataaatagacaaaagtctga

SEQ ID NO: 9181 - DNA, 26 bp, Artificial sequence
  SiRNA target sequence
aaataataaatagacaaaagtctgat

SEQ ID NO: 9182 - DNA, 26 bp, Artificial sequence
  SiRNA target sequence
aataataaatagacaaaagtctgatt

SEQ ID NO: 9183 - DNA, 26 bp, Artificial sequence
  SiRNA target sequence
ataataaatagacaaaagtctgatta

SEQ ID NO: 9184 - DNA, 26 bp, Artificial sequence
  SiRNA target sequence
taataaatagacaaaagtctgattat

SEQ ID NO: 9185 - DNA, 26 bp, Artificial sequence
  SiRNA target sequence
aataaatagacaaaagtctgattata

SEQ ID NO: 9186 - DNA, 26 bp, Artificial sequence
  SiRNA target sequence
ataaatagacaaaagtctgattatac

SEQ ID NO: 9187 - DNA, 26 bp, Artificial sequence
  SiRNA target sequence
taaatagacaaaagtctgattataca

SEQ ID NO: 9188 - DNA, 26 bp, Artificial sequence
  SiRNA target sequence
aaatagacaaaagtctgattatacat

SEQ ID NO: 9189 - DNA, 26 bp, Artificial sequence
  SiRNA target sequence
aatagacaaaagtctgattatacatc

SEQ ID NO: 9190 - DNA, 26 bp, Artificial sequence
  SiRNA target sequence
atagacaaaagtctgattatacatca

SEQ ID NO: 9191 - DNA, 26 bp, Artificial sequence
  SiRNA target sequence
tagacaaaagtctgattatacatcaa

SEQ ID NO: 9192 - DNA, 26 bp, Artificial sequence
  SiRNA target sequence
agacaaaagtctgattatacatcaat

SEQ ID NO: 9193 - DNA, 26 bp, Artificial sequence
  SiRNA target sequence
gacaaaagtctgattatacatcaata

SEQ ID NO: 9194 - DNA, 26 bp, Artificial sequence
  SiRNA target sequence
acaaaagtctgattatacatcaataa

SEQ ID NO: 9195 - DNA, 26 bp, Artificial sequence
  SiRNA target sequence
caaaagtctgattatacatcaataaa

SEQ ID NO: 9196 - DNA, 26 bp, Artificial sequence
  SiRNA target sequence
aaaagtctgattatacatcaataaaa

SEQ ID NO: 9197 - DNA, 26 bp, Artificial sequence
  SiRNA target sequence
aaagtctgattatacatcaataaaac

SEQ ID NO: 9198 - DNA, 26 bp, Artificial sequence
  SiRNA target sequence
aagtctgattatacatcaataaaaca

SEQ ID NO: 9199 - DNA, 26 bp, Artificial sequence
  SiRNA target sequence
agtctgattatacatcaataaaacag

SEQ ID NO: 9200 - DNA, 26 bp, Artificial sequence
  SiRNA target sequence
gtctgattatacatcaataaaacagg

SEQ ID NO: 9201 - DNA, 26 bp, Artificial sequence
  SiRNA target sequence
tctgattatacatcaataaaacagga

SEQ ID NO: 9202 - DNA, 26 bp, Artificial sequence
  SiRNA target sequence
ctgattatacatcaataaaacaggaa

SEQ ID NO: 9203 - DNA, 26 bp, Artificial sequence
  SiRNA target sequence
tgattatacatcaataaaacaggaag

SEQ ID NO: 9204 - DNA, 26 bp, Artificial sequence
  SiRNA target sequence
gattatacatcaataaaacaggaagc

SEQ ID NO: 9205 - DNA, 26 bp, Artificial sequence
  SiRNA target sequence
attatacatcaataaaacaggaagca

SEQ ID NO: 9206 - DNA, 26 bp, Artificial sequence
  SiRNA target sequence
ttatacatcaataaaacaggaagcag

SEQ ID NO: 9207 - DNA, 26 bp, Artificial sequence
  SiRNA target sequence
tatacatcaataaaacaggaagcaga

SEQ ID NO: 9208 - DNA, 26 bp, Artificial sequence
  SiRNA target sequence
atacatcaataaaacaggaagcagat

SEQ ID NO: 9209 - DNA, 26 bp, Artificial sequence
  SiRNA target sequence
tacatcaataaaacaggaagcagata

SEQ ID NO: 9210 - DNA, 26 bp, Artificial sequence
  SiRNA target sequence
acatcaataaaacaggaagcagataa

SEQ ID NO: 9211 - DNA, 26 bp, Artificial sequence
  SiRNA target sequence
catcaataaaacaggaagcagataaa

SEQ ID NO: 9212 - DNA, 26 bp, Artificial sequence
  SiRNA target sequence
atcaataaaacaggaagcagataaat

SEQ ID NO: 9213 - DNA, 26 bp, Artificial sequence
  SiRNA target sequence
tcaataaaacaggaagcagataaata

SEQ ID NO: 9214 - DNA, 26 bp, Artificial sequence
  SiRNA target sequence
caataaaacaggaagcagataaatat

SEQ ID NO: 9215 - DNA, 26 bp, Artificial sequence
  SiRNA target sequence
aataaaacaggaagcagataaatatt

SEQ ID NO: 9216 - DNA, 26 bp, Artificial sequence
  SiRNA target sequence
ataaaacaggaagcagataaatattt

SEQ ID NO: 9217 - DNA, 26 bp, Artificial sequence
  SiRNA target sequence
taaaacaggaagcagataaatatttt

SEQ ID NO: 9218 - DNA, 26 bp, Artificial sequence
  SiRNA target sequence
aaaacaggaagcagataaatatttta

SEQ ID NO: 9219 - DNA, 26 bp, Artificial sequence
  SiRNA target sequence
aaacaggaagcagataaatattttat

SEQ ID NO: 9220 - DNA, 26 bp, Artificial sequence
  SiRNA target sequence
aacaggaagcagataaatattttata

SEQ ID NO: 9221 - DNA, 26 bp, Artificial sequence
  SiRNA target sequence
acaggaagcagataaatattttatac

SEQ ID NO: 9222 - DNA, 26 bp, Artificial sequence
  SiRNA target sequence
caggaagcagataaatattttataca

SEQ ID NO: 9223 - DNA, 26 bp, Artificial sequence
  SiRNA target sequence
aggaagcagataaatattttatacaa

SEQ ID NO: 9224 - DNA, 26 bp, Artificial sequence
  SiRNA target sequence
ggaagcagataaatattttatacaag

SEQ ID NO: 9225 - DNA, 26 bp, Artificial sequence
  SiRNA target sequence
gaagcagataaatattttatacaaga

SEQ ID NO: 9226 - DNA, 26 bp, Artificial sequence
  SiRNA target sequence
aagcagataaatattttatacaagaa

SEQ ID NO: 9227 - DNA, 26 bp, Artificial sequence
  SiRNA target sequence
agcagataaatattttatacaagaag

SEQ ID NO: 9228 - DNA, 26 bp, Artificial sequence
  SiRNA target sequence
gcagataaatattttatacaagaaga

SEQ ID NO: 9229 - DNA, 26 bp, Artificial sequence
  SiRNA target sequence
cagataaatattttatacaagaagat

SEQ ID NO: 9230 - DNA, 26 bp, Artificial sequence
  SiRNA target sequence
agataaatattttatacaagaagatt

SEQ ID NO: 9231 - DNA, 26 bp, Artificial sequence
  SiRNA target sequence
gataaatattttatacaagaagatta

SEQ ID NO: 9232 - DNA, 26 bp, Artificial sequence
  SiRNA target sequence
ataaatattttatacaagaagattat

SEQ ID NO: 9233 - DNA, 26 bp, Artificial sequence
  SiRNA target sequence
taaatattttatacaagaagattata

SEQ ID NO: 9234 - DNA, 26 bp, Artificial sequence
  SiRNA target sequence
aaatattttatacaagaagattataa

SEQ ID NO: 9235 - DNA, 26 bp, Artificial sequence
  SiRNA target sequence
aatattttatacaagaagattataaa

SEQ ID NO: 9236 - DNA, 26 bp, Artificial sequence
  SiRNA target sequence
atattttatacaagaagattataaaa

SEQ ID NO: 9237 - DNA, 26 bp, Artificial sequence
  SiRNA target sequence
tattttatacaagaagattataaaaa

SEQ ID NO: 9238 - DNA, 26 bp, Artificial sequence
  SiRNA target sequence
attttatacaagaagattataaaaat

SEQ ID NO: 9239 - DNA, 26 bp, Artificial sequence
  SiRNA target sequence
ttttatacaagaagattataaaaatg

SEQ ID NO: 9240 - DNA, 26 bp, Artificial sequence
  SiRNA target sequence
tttatacaagaagattataaaaatgc

SEQ ID NO: 9241 - DNA, 26 bp, Artificial sequence
  SiRNA target sequence
ttatacaagaagattataaaaatgct

SEQ ID NO: 9242 - DNA, 26 bp, Artificial sequence
  SiRNA target sequence
tatacaagaagattataaaaatgcta

SEQ ID NO: 9243 - DNA, 26 bp, Artificial sequence
  SiRNA target sequence
atacaagaagattataaaaatgctat

SEQ ID NO: 9244 - DNA, 26 bp, Artificial sequence
  SiRNA target sequence
tacaagaagattataaaaatgctatt

SEQ ID NO: 9245 - DNA, 26 bp, Artificial sequence
  SiRNA target sequence
acaagaagattataaaaatgctattc

SEQ ID NO: 9246 - DNA, 26 bp, Artificial sequence
  SiRNA target sequence
caagaagattataaaaatgctattct

SEQ ID NO: 9247 - DNA, 26 bp, Artificial sequence
  SiRNA target sequence
aagaagattataaaaatgctattctg

SEQ ID NO: 9248 - DNA, 26 bp, Artificial sequence
  SiRNA target sequence
agaagattataaaaatgctattctgt

SEQ ID NO: 9249 - DNA, 26 bp, Artificial sequence
  SiRNA target sequence
gaagattataaaaatgctattctgtt

SEQ ID NO: 9250 - DNA, 26 bp, Artificial sequence
  SiRNA target sequence
aagattataaaaatgctattctgttg

SEQ ID NO: 9251 - DNA, 26 bp, Artificial sequence
  SiRNA target sequence
agattataaaaatgctattctgttgt

SEQ ID NO: 9252 - DNA, 26 bp, Artificial sequence
  SiRNA target sequence
gattataaaaatgctattctgttgta

SEQ ID NO: 9253 - DNA, 26 bp, Artificial sequence
  SiRNA target sequence
attataaaaatgctattctgttgtac

SEQ ID NO: 9254 - DNA, 26 bp, Artificial sequence
  SiRNA target sequence
ttataaaaatgctattctgttgtaca

SEQ ID NO: 9255 - DNA, 26 bp, Artificial sequence
  SiRNA target sequence
tataaaaatgctattctgttgtacac

SEQ ID NO: 9256 - DNA, 26 bp, Artificial sequence
  SiRNA target sequence
ataaaaatgctattctgttgtacact

SEQ ID NO: 9257 - DNA, 26 bp, Artificial sequence
  SiRNA target sequence
taaaaatgctattctgttgtacacta

SEQ ID NO: 9258 - DNA, 26 bp, Artificial sequence
  SiRNA target sequence
aaaaatgctattctgttgtacactaa

SEQ ID NO: 9259 - DNA, 26 bp, Artificial sequence
  SiRNA target sequence
aaaatgctattctgttgtacactaaa

SEQ ID NO: 9260 - DNA, 26 bp, Artificial sequence
  SiRNA target sequence
aaatgctattctgttgtacactaaat

SEQ ID NO: 9261 - DNA, 26 bp, Artificial sequence
  SiRNA target sequence
aatgctattctgttgtacactaaatg

SEQ ID NO: 9262 - DNA, 26 bp, Artificial sequence
  SiRNA target sequence
atgctattctgttgtacactaaatgt

SEQ ID NO: 9263 - DNA, 26 bp, Artificial sequence
  SiRNA target sequence
tgctattctgttgtacactaaatgta

SEQ ID NO: 9264 - DNA, 26 bp, Artificial sequence
  SiRNA target sequence
gctattctgttgtacactaaatgtaa

SEQ ID NO: 9265 - DNA, 26 bp, Artificial sequence
  SiRNA target sequence
ctattctgttgtacactaaatgtaaa

SEQ ID NO: 9266 - DNA, 26 bp, Artificial sequence
  SiRNA target sequence
tattctgttgtacactaaatgtaaat

SEQ ID NO: 9267 - DNA, 26 bp, Artificial sequence
  SiRNA target sequence
attctgttgtacactaaatgtaaata

SEQ ID NO: 9268 - DNA, 26 bp, Artificial sequence
  SiRNA target sequence
ttctgttgtacactaaatgtaaatat

SEQ ID NO: 9269 - DNA, 26 bp, Artificial sequence
  SiRNA target sequence
tctgttgtacactaaatgtaaatata

SEQ ID NO: 9270 - DNA, 26 bp, Artificial sequence
  SiRNA target sequence
ctgttgtacactaaatgtaaatatat

SEQ ID NO: 9271 - DNA, 26 bp, Artificial sequence
  SiRNA target sequence
tgttgtacactaaatgtaaatatatg

SEQ ID NO: 9272 - DNA, 26 bp, Artificial sequence
  SiRNA target sequence
gttgtacactaaatgtaaatatatga

SEQ ID NO: 9273 - DNA, 26 bp, Artificial sequence
  SiRNA target sequence
ttgtacactaaatgtaaatatatgaa

SEQ ID NO: 9274 - DNA, 26 bp, Artificial sequence
  SiRNA target sequence
tgtacactaaatgtaaatatatgaaa

SEQ ID NO: 9275 - DNA, 26 bp, Artificial sequence
  SiRNA target sequence
gtacactaaatgtaaatatatgaaaa

SEQ ID NO: 9276 - DNA, 26 bp, Artificial sequence
  SiRNA target sequence
tacactaaatgtaaatatatgaaaag

SEQ ID NO: 9277 - DNA, 26 bp, Artificial sequence
  SiRNA target sequence
acactaaatgtaaatatatgaaaagt

SEQ ID NO: 9278 - DNA, 26 bp, Artificial sequence
  SiRNA target sequence
cactaaatgtaaatatatgaaaagtg

SEQ ID NO: 9279 - DNA, 26 bp, Artificial sequence
  SiRNA target sequence
actaaatgtaaatatatgaaaagtga

SEQ ID NO: 9280 - DNA, 26 bp, Artificial sequence
  SiRNA target sequence
ctaaatgtaaatatatgaaaagtgat

SEQ ID NO: 9281 - DNA, 26 bp, Artificial sequence
  SiRNA target sequence
taaatgtaaatatatgaaaagtgatg

SEQ ID NO: 9282 - DNA, 26 bp, Artificial sequence
  SiRNA target sequence
aaatgtaaatatatgaaaagtgatgc

SEQ ID NO: 9283 - DNA, 26 bp, Artificial sequence
  SiRNA target sequence
aatgtaaatatatgaaaagtgatgct

SEQ ID NO: 9284 - DNA, 26 bp, Artificial sequence
  SiRNA target sequence
atgtaaatatatgaaaagtgatgctg

SEQ ID NO: 9285 - DNA, 26 bp, Artificial sequence
  SiRNA target sequence
tgtaaatatatgaaaagtgatgctga

SEQ ID NO: 9286 - DNA, 26 bp, Artificial sequence
  SiRNA target sequence
gtaaatatatgaaaagtgatgctgaa

SEQ ID NO: 9287 - DNA, 26 bp, Artificial sequence
  SiRNA target sequence
taaatatatgaaaagtgatgctgaaa

SEQ ID NO: 9288 - DNA, 26 bp, Artificial sequence
  SiRNA target sequence
aaatatatgaaaagtgatgctgaaat

SEQ ID NO: 9289 - DNA, 26 bp, Artificial sequence
  SiRNA target sequence
aatatatgaaaagtgatgctgaaatt

SEQ ID NO: 9290 - DNA, 26 bp, Artificial sequence
  SiRNA target sequence
atatatgaaaagtgatgctgaaattc

SEQ ID NO: 9291 - DNA, 26 bp, Artificial sequence
  SiRNA target sequence
tatatgaaaagtgatgctgaaattct

SEQ ID NO: 9292 - DNA, 26 bp, Artificial sequence
  SiRNA target sequence
atatgaaaagtgatgctgaaattctt

SEQ ID NO: 9293 - DNA, 26 bp, Artificial sequence
  SiRNA target sequence
tatgaaaagtgatgctgaaattctta

SEQ ID NO: 9294 - DNA, 26 bp, Artificial sequence
  SiRNA target sequence
atgaaaagtgatgctgaaattcttac

SEQ ID NO: 9295 - DNA, 26 bp, Artificial sequence
  SiRNA target sequence
tgaaaagtgatgctgaaattcttact

SEQ ID NO: 9296 - DNA, 26 bp, Artificial sequence
  SiRNA target sequence
gaaaagtgatgctgaaattcttacta

SEQ ID NO: 9297 - DNA, 26 bp, Artificial sequence
  SiRNA target sequence
aaaagtgatgctgaaattcttactaa

SEQ ID NO: 9298 - DNA, 26 bp, Artificial sequence
  SiRNA target sequence
aaagtgatgctgaaattcttactaaa

SEQ ID NO: 9299 - DNA, 26 bp, Artificial sequence
  SiRNA target sequence
aagtgatgctgaaattcttactaaaa

SEQ ID NO: 9300 - DNA, 26 bp, Artificial sequence
  SiRNA target sequence
agtgatgctgaaattcttactaaaat

SEQ ID NO: 9301 - DNA, 26 bp, Artificial sequence
  SiRNA target sequence
gtgatgctgaaattcttactaaaatt

SEQ ID NO: 9302 - DNA, 26 bp, Artificial sequence
  SiRNA target sequence
tgatgctgaaattcttactaaaatta

SEQ ID NO: 9303 - DNA, 26 bp, Artificial sequence
  SiRNA target sequence
gatgctgaaattcttactaaaattag

SEQ ID NO: 9304 - DNA, 26 bp, Artificial sequence
  SiRNA target sequence
atgctgaaattcttactaaaattagt

SEQ ID NO: 9305 - DNA, 26 bp, Artificial sequence
  SiRNA target sequence
tgctgaaattcttactaaaattagtc

SEQ ID NO: 9306 - DNA, 26 bp, Artificial sequence
  SiRNA target sequence
gctgaaattcttactaaaattagtct

SEQ ID NO: 9307 - DNA, 26 bp, Artificial sequence
  SiRNA target sequence
ctgaaattcttactaaaattagtctc

SEQ ID NO: 9308 - DNA, 26 bp, Artificial sequence
  SiRNA target sequence
tgaaattcttactaaaattagtctct

SEQ ID NO: 9309 - DNA, 26 bp, Artificial sequence
  SiRNA target sequence
gaaattcttactaaaattagtctctg

SEQ ID NO: 9310 - DNA, 26 bp, Artificial sequence
  SiRNA target sequence
aaattcttactaaaattagtctctgt

SEQ ID NO: 9311 - DNA, 26 bp, Artificial sequence
  SiRNA target sequence
aattcttactaaaattagtctctgta

SEQ ID NO: 9312 - DNA, 26 bp, Artificial sequence
  SiRNA target sequence
attcttactaaaattagtctctgtaa

SEQ ID NO: 9313 - DNA, 26 bp, Artificial sequence
  SiRNA target sequence
ttcttactaaaattagtctctgtaat

SEQ ID NO: 9314 - DNA, 26 bp, Artificial sequence
  SiRNA target sequence
tcttactaaaattagtctctgtaatt

SEQ ID NO: 9315 - DNA, 26 bp, Artificial sequence
  SiRNA target sequence
cttactaaaattagtctctgtaatta

SEQ ID NO: 9316 - DNA, 26 bp, Artificial sequence
  SiRNA target sequence
ttactaaaattagtctctgtaattat

SEQ ID NO: 9317 - DNA, 26 bp, Artificial sequence
  SiRNA target sequence
tactaaaattagtctctgtaattatt

SEQ ID NO: 9318 - DNA, 26 bp, Artificial sequence
  SiRNA target sequence
actaaaattagtctctgtaattattt

SEQ ID NO: 9319 - DNA, 26 bp, Artificial sequence
  SiRNA target sequence
ctaaaattagtctctgtaattatttc

SEQ ID NO: 9320 - DNA, 26 bp, Artificial sequence
  SiRNA target sequence
taaaattagtctctgtaattatttct

SEQ ID NO: 9321 - DNA, 26 bp, Artificial sequence
  SiRNA target sequence
aaaattagtctctgtaattatttctt

SEQ ID NO: 9322 - DNA, 26 bp, Artificial sequence
  SiRNA target sequence
aaattagtctctgtaattatttctta

SEQ ID NO: 9323 - DNA, 26 bp, Artificial sequence
  SiRNA target sequence
aattagtctctgtaattatttcttaa

SEQ ID NO: 9324 - DNA, 26 bp, Artificial sequence
  SiRNA target sequence
attagtctctgtaattatttcttaaa

SEQ ID NO: 9325 - DNA, 26 bp, Artificial sequence
  SiRNA target sequence
ttagtctctgtaattatttcttaaaa

SEQ ID NO: 9326 - DNA, 26 bp, Artificial sequence
  SiRNA target sequence
tagtctctgtaattatttcttaaaaa

SEQ ID NO: 9327 - DNA, 26 bp, Artificial sequence
  SiRNA target sequence
agtctctgtaattatttcttaaaaaa

SEQ ID NO: 9328 - DNA, 26 bp, Artificial sequence
  SiRNA target sequence
gtctctgtaattatttcttaaaaaat

SEQ ID NO: 9329 - DNA, 26 bp, Artificial sequence
  SiRNA target sequence
tctctgtaattatttcttaaaaaatt

SEQ ID NO: 9330 - DNA, 26 bp, Artificial sequence
  SiRNA target sequence
ctctgtaattatttcttaaaaaatta

SEQ ID NO: 9331 - DNA, 26 bp, Artificial sequence
  SiRNA target sequence
tctgtaattatttcttaaaaaattat

SEQ ID NO: 9332 - DNA, 26 bp, Artificial sequence
  SiRNA target sequence
ctgtaattatttcttaaaaaattatc

SEQ ID NO: 9333 - DNA, 26 bp, Artificial sequence
  SiRNA target sequence
tgtaattatttcttaaaaaattatca

SEQ ID NO: 9334 - DNA, 26 bp, Artificial sequence
  SiRNA target sequence
gtaattatttcttaaaaaattatcaa

SEQ ID NO: 9335 - DNA, 26 bp, Artificial sequence
  SiRNA target sequence
taattatttcttaaaaaattatcaag

SEQ ID NO: 9336 - DNA, 26 bp, Artificial sequence
  SiRNA target sequence
aattatttcttaaaaaattatcaaga

SEQ ID NO: 9337 - DNA, 26 bp, Artificial sequence
  SiRNA target sequence
attatttcttaaaaaattatcaagaa

SEQ ID NO: 9338 - DNA, 26 bp, Artificial sequence
  SiRNA target sequence
ttatttcttaaaaaattatcaagaag

SEQ ID NO: 9339 - DNA, 26 bp, Artificial sequence
  SiRNA target sequence
tatttcttaaaaaattatcaagaagt

SEQ ID NO: 9340 - DNA, 26 bp, Artificial sequence
  SiRNA target sequence
atttcttaaaaaattatcaagaagtt

SEQ ID NO: 9341 - DNA, 26 bp, Artificial sequence
  SiRNA target sequence
tttcttaaaaaattatcaagaagtta

SEQ ID NO: 9342 - DNA, 26 bp, Artificial sequence
  SiRNA target sequence
ttcttaaaaaattatcaagaagttat

SEQ ID NO: 9343 - DNA, 26 bp, Artificial sequence
  SiRNA target sequence
tcttaaaaaattatcaagaagttata

SEQ ID NO: 9344 - DNA, 26 bp, Artificial sequence
  SiRNA target sequence
cttaaaaaattatcaagaagttataa

SEQ ID NO: 9345 - DNA, 26 bp, Artificial sequence
  SiRNA target sequence
ttaaaaaattatcaagaagttataaa

SEQ ID NO: 9346 - DNA, 26 bp, Artificial sequence
  SiRNA target sequence
taaaaaattatcaagaagttataaat

SEQ ID NO: 9347 - DNA, 26 bp, Artificial sequence
  SiRNA target sequence
aaaaaattatcaagaagttataaata

SEQ ID NO: 9348 - DNA, 26 bp, Artificial sequence
  SiRNA target sequence
aaaaattatcaagaagttataaataa

SEQ ID NO: 9349 - DNA, 26 bp, Artificial sequence
  SiRNA target sequence
aaaattatcaagaagttataaataat

SEQ ID NO: 9350 - DNA, 26 bp, Artificial sequence
  SiRNA target sequence
aaattatcaagaagttataaataatt

SEQ ID NO: 9351 - DNA, 26 bp, Artificial sequence
  SiRNA target sequence
aattatcaagaagttataaataattc

SEQ ID NO: 9352 - DNA, 26 bp, Artificial sequence
  SiRNA target sequence
attatcaagaagttataaataattct

SEQ ID NO: 9353 - DNA, 26 bp, Artificial sequence
  SiRNA target sequence
ttatcaagaagttataaataattctt

SEQ ID NO: 9354 - DNA, 26 bp, Artificial sequence
  SiRNA target sequence
tatcaagaagttataaataattcttt

SEQ ID NO: 9355 - DNA, 26 bp, Artificial sequence
  SiRNA target sequence
atcaagaagttataaataattcttta

SEQ ID NO: 9356 - DNA, 26 bp, Artificial sequence
  SiRNA target sequence
tcaagaagttataaataattctttat

SEQ ID NO: 9357 - DNA, 26 bp, Artificial sequence
  SiRNA target sequence
caagaagttataaataattctttatt

SEQ ID NO: 9358 - DNA, 26 bp, Artificial sequence
  SiRNA target sequence
aagaagttataaataattctttattt

SEQ ID NO: 9359 - DNA, 26 bp, Artificial sequence
  SiRNA target sequence
agaagttataaataattctttattta

SEQ ID NO: 9360 - DNA, 26 bp, Artificial sequence
  SiRNA target sequence
gaagttataaataattctttatttaa

SEQ ID NO: 9361 - DNA, 26 bp, Artificial sequence
  SiRNA target sequence
aagttataaataattctttatttaag

SEQ ID NO: 9362 - DNA, 26 bp, Artificial sequence
  SiRNA target sequence
agttataaataattctttatttaaga

SEQ ID NO: 9363 - DNA, 26 bp, Artificial sequence
  SiRNA target sequence
gttataaataattctttatttaagac

SEQ ID NO: 9364 - DNA, 26 bp, Artificial sequence
  SiRNA target sequence
ttataaataattctttatttaagaca

SEQ ID NO: 9365 - DNA, 26 bp, Artificial sequence
  SiRNA target sequence
tataaataattctttatttaagacaa

SEQ ID NO: 9366 - DNA, 26 bp, Artificial sequence
  SiRNA target sequence
ataaataattctttatttaagacaaa

SEQ ID NO: 9367 - DNA, 26 bp, Artificial sequence
  SiRNA target sequence
taaataattctttatttaagacaaat

SEQ ID NO: 9368 - DNA, 26 bp, Artificial sequence
  SiRNA target sequence
aaataattctttatttaagacaaata

SEQ ID NO: 9369 - DNA, 26 bp, Artificial sequence
  SiRNA target sequence
aataattctttatttaagacaaataa

SEQ ID NO: 9370 - DNA, 26 bp, Artificial sequence
  SiRNA target sequence
ataattctttatttaagacaaataat

SEQ ID NO: 9371 - DNA, 26 bp, Artificial sequence
  SiRNA target sequence
taattctttatttaagacaaataata

SEQ ID NO: 9372 - DNA, 26 bp, Artificial sequence
  SiRNA target sequence
aattctttatttaagacaaataataa

SEQ ID NO: 9373 - DNA, 26 bp, Artificial sequence
  SiRNA target sequence
attctttatttaagacaaataataaa

SEQ ID NO: 9374 - DNA, 26 bp, Artificial sequence
  SiRNA target sequence
ttctttatttaagacaaataataaag

SEQ ID NO: 9375 - DNA, 26 bp, Artificial sequence
  SiRNA target sequence
tctttatttaagacaaataataaaga

SEQ ID NO: 9376 - DNA, 26 bp, Artificial sequence
  SiRNA target sequence
ctttatttaagacaaataataaagat

SEQ ID NO: 9377 - DNA, 26 bp, Artificial sequence
  SiRNA target sequence
tttatttaagacaaataataaagatc

SEQ ID NO: 9378 - DNA, 26 bp, Artificial sequence
  SiRNA target sequence
ttatttaagacaaataataaagatct

SEQ ID NO: 9379 - DNA, 26 bp, Artificial sequence
  SiRNA target sequence
tatttaagacaaataataaagatcta

SEQ ID NO: 9380 - DNA, 26 bp, Artificial sequence
  SiRNA target sequence
atttaagacaaataataaagatctaa

SEQ ID NO: 9381 - DNA, 26 bp, Artificial sequence
  SiRNA target sequence
tttaagacaaataataaagatctaat

SEQ ID NO: 9382 - DNA, 26 bp, Artificial sequence
  SiRNA target sequence
ttaagacaaataataaagatctaata

SEQ ID NO: 9383 - DNA, 26 bp, Artificial sequence
  SiRNA target sequence
taagacaaataataaagatctaataa

SEQ ID NO: 9384 - DNA, 26 bp, Artificial sequence
  SiRNA target sequence
aagacaaataataaagatctaataaa

SEQ ID NO: 9385 - DNA, 26 bp, Artificial sequence
  SiRNA target sequence
agacaaataataaagatctaataaaa

SEQ ID NO: 9386 - DNA, 26 bp, Artificial sequence
  SiRNA target sequence
gacaaataataaagatctaataaaaa

SEQ ID NO: 9387 - DNA, 26 bp, Artificial sequence
  SiRNA target sequence
acaaataataaagatctaataaaaat

SEQ ID NO: 9388 - DNA, 26 bp, Artificial sequence
  SiRNA target sequence
caaataataaagatctaataaaaata

SEQ ID NO: 9389 - DNA, 26 bp, Artificial sequence
  SiRNA target sequence
aaataataaagatctaataaaaataa

SEQ ID NO: 9390 - DNA, 26 bp, Artificial sequence
  SiRNA target sequence
aataataaagatctaataaaaataag

SEQ ID NO: 9391 - DNA, 26 bp, Artificial sequence
  SiRNA target sequence
ataataaagatctaataaaaataaga

SEQ ID NO: 9392 - DNA, 26 bp, Artificial sequence
  SiRNA target sequence
taataaagatctaataaaaataagat

SEQ ID NO: 9393 - DNA, 26 bp, Artificial sequence
  SiRNA target sequence
aataaagatctaataaaaataagatc

SEQ ID NO: 9394 - DNA, 26 bp, Artificial sequence
  SiRNA target sequence
ataaagatctaataaaaataagatct

SEQ ID NO: 9395 - DNA, 26 bp, Artificial sequence
  SiRNA target sequence
taaagatctaataaaaataagatctg

SEQ ID NO: 9396 - DNA, 26 bp, Artificial sequence
  SiRNA target sequence
aaagatctaataaaaataagatctga

SEQ ID NO: 9397 - DNA, 26 bp, Artificial sequence
  SiRNA target sequence
aagatctaataaaaataagatctgaa

SEQ ID NO: 9398 - DNA, 26 bp, Artificial sequence
  SiRNA target sequence
agatctaataaaaataagatctgaat

SEQ ID NO: 9399 - DNA, 26 bp, Artificial sequence
  SiRNA target sequence
gatctaataaaaataagatctgaatg

SEQ ID NO: 9400 - DNA, 26 bp, Artificial sequence
  SiRNA target sequence
atctaataaaaataagatctgaatgt

SEQ ID NO: 9401 - DNA, 26 bp, Artificial sequence
  SiRNA target sequence
tctaataaaaataagatctgaatgtt

SEQ ID NO: 9402 - DNA, 26 bp, Artificial sequence
  SiRNA target sequence
ctaataaaaataagatctgaatgtta

SEQ ID NO: 9403 - DNA, 26 bp, Artificial sequence
  SiRNA target sequence
taataaaaataagatctgaatgttac

SEQ ID NO: 9404 - DNA, 26 bp, Artificial sequence
  SiRNA target sequence
aataaaaataagatctgaatgttaca

SEQ ID NO: 9405 - DNA, 26 bp, Artificial sequence
  SiRNA target sequence
ataaaaataagatctgaatgttacaa

SEQ ID NO: 9406 - DNA, 26 bp, Artificial sequence
  SiRNA target sequence
taaaaataagatctgaatgttacaag

SEQ ID NO: 9407 - DNA, 26 bp, Artificial sequence
  SiRNA target sequence
aaaaataagatctgaatgttacaagc

SEQ ID NO: 9408 - DNA, 26 bp, Artificial sequence
  SiRNA target sequence
aaaataagatctgaatgttacaagca

SEQ ID NO: 9409 - DNA, 26 bp, Artificial sequence
  SiRNA target sequence
aaataagatctgaatgttacaagcag

SEQ ID NO: 9410 - DNA, 26 bp, Artificial sequence
  SiRNA target sequence
aataagatctgaatgttacaagcaga

SEQ ID NO: 9411 - DNA, 26 bp, Artificial sequence
  SiRNA target sequence
ataagatctgaatgttacaagcagat

SEQ ID NO: 9412 - DNA, 26 bp, Artificial sequence
  SiRNA target sequence
taagatctgaatgttacaagcagatg

SEQ ID NO: 9413 - DNA, 26 bp, Artificial sequence
  SiRNA target sequence
aagatctgaatgttacaagcagatgg

SEQ ID NO: 9414 - DNA, 26 bp, Artificial sequence
  SiRNA target sequence
agatctgaatgttacaagcagatggg

SEQ ID NO: 9415 - DNA, 26 bp, Artificial sequence
  SiRNA target sequence
gatctgaatgttacaagcagatggga

SEQ ID NO: 9416 - DNA, 26 bp, Artificial sequence
  SiRNA target sequence
atctgaatgttacaagcagatgggaa

SEQ ID NO: 9417 - DNA, 26 bp, Artificial sequence
  SiRNA target sequence
tctgaatgttacaagcagatgggaaa

SEQ ID NO: 9418 - DNA, 26 bp, Artificial sequence
  SiRNA target sequence
ctgaatgttacaagcagatgggaaat

SEQ ID NO: 9419 - DNA, 26 bp, Artificial sequence
  SiRNA target sequence
tgaatgttacaagcagatgggaaata

SEQ ID NO: 9420 - DNA, 26 bp, Artificial sequence
  SiRNA target sequence
gaatgttacaagcagatgggaaataa

SEQ ID NO: 9421 - DNA, 26 bp, Artificial sequence
  SiRNA target sequence
aatgttacaagcagatgggaaataaa

SEQ ID NO: 9422 - DNA, 26 bp, Artificial sequence
  SiRNA target sequence
atgttacaagcagatgggaaataaaa

SEQ ID NO: 9423 - DNA, 26 bp, Artificial sequence
  SiRNA target sequence
tgttacaagcagatgggaaataaaaa

SEQ ID NO: 9424 - DNA, 26 bp, Artificial sequence
  SiRNA target sequence
gttacaagcagatgggaaataaaaaa

SEQ ID NO: 9425 - DNA, 26 bp, Artificial sequence
  SiRNA target sequence
ttacaagcagatgggaaataaaaaaa

SEQ ID NO: 9426 - DNA, 26 bp, Artificial sequence
  SiRNA target sequence
tacaagcagatgggaaataaaaaaaa

SEQ ID NO: 9427 - DNA, 26 bp, Artificial sequence
  SiRNA target sequence
acaagcagatgggaaataaaaaaaaa

SEQ ID NO: 9428 - DNA, 26 bp, Artificial sequence
  SiRNA target sequence
caagcagatgggaaataaaaaaaaat

SEQ ID NO: 9429 - DNA, 26 bp, Artificial sequence
  SiRNA target sequence
aagcagatgggaaataaaaaaaaatt

SEQ ID NO: 9430 - DNA, 26 bp, Artificial sequence
  SiRNA target sequence
agcagatgggaaataaaaaaaaattt

SEQ ID NO: 9431 - DNA, 26 bp, Artificial sequence
  SiRNA target sequence
gcagatgggaaataaaaaaaaatttc

SEQ ID NO: 9432 - DNA, 26 bp, Artificial sequence
  SiRNA target sequence
cagatgggaaataaaaaaaaatttct

SEQ ID NO: 9433 - DNA, 26 bp, Artificial sequence
  SiRNA target sequence
agatgggaaataaaaaaaaatttctt

SEQ ID NO: 9434 - DNA, 26 bp, Artificial sequence
  SiRNA target sequence
gatgggaaataaaaaaaaatttctta

SEQ ID NO: 9435 - DNA, 26 bp, Artificial sequence
  SiRNA target sequence
atgggaaataaaaaaaaatttcttaa

SEQ ID NO: 9436 - DNA, 26 bp, Artificial sequence
  SiRNA target sequence
tgggaaataaaaaaaaatttcttaag

SEQ ID NO: 9437 - DNA, 26 bp, Artificial sequence
  SiRNA target sequence
gggaaataaaaaaaaatttcttaagg

SEQ ID NO: 9438 - DNA, 26 bp, Artificial sequence
  SiRNA target sequence
ggaaataaaaaaaaatttcttaagga

SEQ ID NO: 9439 - DNA, 26 bp, Artificial sequence
  SiRNA target sequence
gaaataaaaaaaaatttcttaaggat

SEQ ID NO: 9440 - DNA, 26 bp, Artificial sequence
  SiRNA target sequence
aaataaaaaaaaatttcttaaggatt

SEQ ID NO: 9441 - DNA, 26 bp, Artificial sequence
  SiRNA target sequence
aataaaaaaaaatttcttaaggattt

SEQ ID NO: 9442 - DNA, 26 bp, Artificial sequence
  SiRNA target sequence
ataaaaaaaaatttcttaaggattta

SEQ ID NO: 9443 - DNA, 26 bp, Artificial sequence
  SiRNA target sequence
taaaaaaaaatttcttaaggatttag

SEQ ID NO: 9444 - DNA, 26 bp, Artificial sequence
  SiRNA target sequence
aaaaaaaaatttcttaaggatttagc

SEQ ID NO: 9445 - DNA, 26 bp, Artificial sequence
  SiRNA target sequence
aaaaaaaatttcttaaggatttagca

SEQ ID NO: 9446 - DNA, 26 bp, Artificial sequence
  SiRNA target sequence
aaaaaaatttcttaaggatttagcac

SEQ ID NO: 9447 - DNA, 26 bp, Artificial sequence
  SiRNA target sequence
aaaaaatttcttaaggatttagcact

SEQ ID NO: 9448 - DNA, 26 bp, Artificial sequence
  SiRNA target sequence
aaaaatttcttaaggatttagcactt

SEQ ID NO: 9449 - DNA, 26 bp, Artificial sequence
  SiRNA target sequence
aaaatttcttaaggatttagcacttt

SEQ ID NO: 9450 - DNA, 26 bp, Artificial sequence
  SiRNA target sequence
aaatttcttaaggatttagcacttta

SEQ ID NO: 9451 - DNA, 26 bp, Artificial sequence
  SiRNA target sequence
aatttcttaaggatttagcactttat

SEQ ID NO: 9452 - DNA, 26 bp, Artificial sequence
  SiRNA target sequence
atttcttaaggatttagcactttatg

SEQ ID NO: 9453 - DNA, 26 bp, Artificial sequence
  SiRNA target sequence
tttcttaaggatttagcactttatga

SEQ ID NO: 9454 - DNA, 26 bp, Artificial sequence
  SiRNA target sequence
ttcttaaggatttagcactttatgaa

SEQ ID NO: 9455 - DNA, 26 bp, Artificial sequence
  SiRNA target sequence
tcttaaggatttagcactttatgaaa

SEQ ID NO: 9456 - DNA, 26 bp, Artificial sequence
  SiRNA target sequence
cttaaggatttagcactttatgaaac

SEQ ID NO: 9457 - DNA, 26 bp, Artificial sequence
  SiRNA target sequence
ttaaggatttagcactttatgaaaca

SEQ ID NO: 9458 - DNA, 26 bp, Artificial sequence
  SiRNA target sequence
taaggatttagcactttatgaaacat

SEQ ID NO: 9459 - DNA, 26 bp, Artificial sequence
  SiRNA target sequence
aaggatttagcactttatgaaacatt

SEQ ID NO: 9460 - DNA, 26 bp, Artificial sequence
  SiRNA target sequence
aggatttagcactttatgaaacattt

SEQ ID NO: 9461 - DNA, 26 bp, Artificial sequence
  SiRNA target sequence
ggatttagcactttatgaaacatttg

SEQ ID NO: 9462 - DNA, 26 bp, Artificial sequence
  SiRNA target sequence
gatttagcactttatgaaacatttgc

SEQ ID NO: 9463 - DNA, 26 bp, Artificial sequence
  SiRNA target sequence
atttagcactttatgaaacatttgct

SEQ ID NO: 9464 - DNA, 26 bp, Artificial sequence
  SiRNA target sequence
tttagcactttatgaaacatttgcta

SEQ ID NO: 9465 - DNA, 26 bp, Artificial sequence
  SiRNA target sequence
ttagcactttatgaaacatttgctaa

SEQ ID NO: 9466 - DNA, 26 bp, Artificial sequence
  SiRNA target sequence
tagcactttatgaaacatttgctaat

SEQ ID NO: 9467 - DNA, 26 bp, Artificial sequence
  SiRNA target sequence
agcactttatgaaacatttgctaata

SEQ ID NO: 9468 - DNA, 26 bp, Artificial sequence
  SiRNA target sequence
gcactttatgaaacatttgctaataa

SEQ ID NO: 9469 - DNA, 26 bp, Artificial sequence
  SiRNA target sequence
cactttatgaaacatttgctaataat

SEQ ID NO: 9470 - DNA, 26 bp, Artificial sequence
  SiRNA target sequence
actttatgaaacatttgctaataata

SEQ ID NO: 9471 - DNA, 26 bp, Artificial sequence
  SiRNA target sequence
ctttatgaaacatttgctaataataa

SEQ ID NO: 9472 - DNA, 26 bp, Artificial sequence
  SiRNA target sequence
tttatgaaacatttgctaataataaa

SEQ ID NO: 9473 - DNA, 26 bp, Artificial sequence
  SiRNA target sequence
ttatgaaacatttgctaataataaag

SEQ ID NO: 9474 - DNA, 26 bp, Artificial sequence
  SiRNA target sequence
tatgaaacatttgctaataataaaga

SEQ ID NO: 9475 - DNA, 26 bp, Artificial sequence
  SiRNA target sequence
atgaaacatttgctaataataaagaa

SEQ ID NO: 9476 - DNA, 26 bp, Artificial sequence
  SiRNA target sequence
tgaaacatttgctaataataaagaag

SEQ ID NO: 9477 - DNA, 26 bp, Artificial sequence
  SiRNA target sequence
gaaacatttgctaataataaagaagt

SEQ ID NO: 9478 - DNA, 26 bp, Artificial sequence
  SiRNA target sequence
aaacatttgctaataataaagaagtc

SEQ ID NO: 9479 - DNA, 26 bp, Artificial sequence
  SiRNA target sequence
aacatttgctaataataaagaagtcc

SEQ ID NO: 9480 - DNA, 26 bp, Artificial sequence
  SiRNA target sequence
acatttgctaataataaagaagtcca

SEQ ID NO: 9481 - DNA, 26 bp, Artificial sequence
  SiRNA target sequence
catttgctaataataaagaagtccaa

SEQ ID NO: 9482 - DNA, 26 bp, Artificial sequence
  SiRNA target sequence
atttgctaataataaagaagtccaag

SEQ ID NO: 9483 - DNA, 26 bp, Artificial sequence
  SiRNA target sequence
tttgctaataataaagaagtccaaga

SEQ ID NO: 9484 - DNA, 26 bp, Artificial sequence
  SiRNA target sequence
ttgctaataataaagaagtccaagat

SEQ ID NO: 9485 - DNA, 26 bp, Artificial sequence
  SiRNA target sequence
tgctaataataaagaagtccaagatg

SEQ ID NO: 9486 - DNA, 26 bp, Artificial sequence
  SiRNA target sequence
gctaataataaagaagtccaagatga

SEQ ID NO: 9487 - DNA, 26 bp, Artificial sequence
  SiRNA target sequence
ctaataataaagaagtccaagatgaa

SEQ ID NO: 9488 - DNA, 26 bp, Artificial sequence
  SiRNA target sequence
taataataaagaagtccaagatgaaa

SEQ ID NO: 9489 - DNA, 26 bp, Artificial sequence
  SiRNA target sequence
aataataaagaagtccaagatgaaat

SEQ ID NO: 9490 - DNA, 26 bp, Artificial sequence
  SiRNA target sequence
ataataaagaagtccaagatgaaatt

SEQ ID NO: 9491 - DNA, 26 bp, Artificial sequence
  SiRNA target sequence
taataaagaagtccaagatgaaatta

SEQ ID NO: 9492 - DNA, 26 bp, Artificial sequence
  SiRNA target sequence
aataaagaagtccaagatgaaattat

SEQ ID NO: 9493 - DNA, 26 bp, Artificial sequence
  SiRNA target sequence
ataaagaagtccaagatgaaattatg

SEQ ID NO: 9494 - DNA, 26 bp, Artificial sequence
  SiRNA target sequence
taaagaagtccaagatgaaattatgc

SEQ ID NO: 9495 - DNA, 26 bp, Artificial sequence
  SiRNA target sequence
aaagaagtccaagatgaaattatgca

SEQ ID NO: 9496 - DNA, 26 bp, Artificial sequence
  SiRNA target sequence
aagaagtccaagatgaaattatgcag

SEQ ID NO: 9497 - DNA, 26 bp, Artificial sequence
  SiRNA target sequence
agaagtccaagatgaaattatgcaga

SEQ ID NO: 9498 - DNA, 26 bp, Artificial sequence
  SiRNA target sequence
gaagtccaagatgaaattatgcagac

SEQ ID NO: 9499 - DNA, 26 bp, Artificial sequence
  SiRNA target sequence
aagtccaagatgaaattatgcagact

SEQ ID NO: 9500 - DNA, 26 bp, Artificial sequence
  SiRNA target sequence
agtccaagatgaaattatgcagactg

SEQ ID NO: 9501 - DNA, 26 bp, Artificial sequence
  SiRNA target sequence
gtccaagatgaaattatgcagactgt

SEQ ID NO: 9502 - DNA, 26 bp, Artificial sequence
  SiRNA target sequence
tccaagatgaaattatgcagactgtt

SEQ ID NO: 9503 - DNA, 26 bp, Artificial sequence
  SiRNA target sequence
ccaagatgaaattatgcagactgtta

SEQ ID NO: 9504 - DNA, 26 bp, Artificial sequence
  SiRNA target sequence
caagatgaaattatgcagactgttaa

SEQ ID NO: 9505 - DNA, 26 bp, Artificial sequence
  SiRNA target sequence
aagatgaaattatgcagactgttaaa

SEQ ID NO: 9506 - DNA, 26 bp, Artificial sequence
  SiRNA target sequence
agatgaaattatgcagactgttaaag

SEQ ID NO: 9507 - DNA, 26 bp, Artificial sequence
  SiRNA target sequence
gatgaaattatgcagactgttaaaga

SEQ ID NO: 9508 - DNA, 26 bp, Artificial sequence
  SiRNA target sequence
atgaaattatgcagactgttaaagaa

SEQ ID NO: 9509 - DNA, 26 bp, Artificial sequence
  SiRNA target sequence
tgaaattatgcagactgttaaagaaa

SEQ ID NO: 9510 - DNA, 26 bp, Artificial sequence
  SiRNA target sequence
gaaattatgcagactgttaaagaaat

SEQ ID NO: 9511 - DNA, 26 bp, Artificial sequence
  SiRNA target sequence
aaattatgcagactgttaaagaaatt

SEQ ID NO: 9512 - DNA, 26 bp, Artificial sequence
  SiRNA target sequence
aattatgcagactgttaaagaaattt

SEQ ID NO: 9513 - DNA, 26 bp, Artificial sequence
  SiRNA target sequence
attatgcagactgttaaagaaatttg

SEQ ID NO: 9514 - DNA, 26 bp, Artificial sequence
  SiRNA target sequence
ttatgcagactgttaaagaaatttgt

SEQ ID NO: 9515 - DNA, 26 bp, Artificial sequence
  SiRNA target sequence
tatgcagactgttaaagaaatttgtg

SEQ ID NO: 9516 - DNA, 26 bp, Artificial sequence
  SiRNA target sequence
atgcagactgttaaagaaatttgtga

SEQ ID NO: 9517 - DNA, 26 bp, Artificial sequence
  SiRNA target sequence
tgcagactgttaaagaaatttgtgaa

SEQ ID NO: 9518 - DNA, 26 bp, Artificial sequence
  SiRNA target sequence
gcagactgttaaagaaatttgtgaag

SEQ ID NO: 9519 - DNA, 26 bp, Artificial sequence
  SiRNA target sequence
cagactgttaaagaaatttgtgaaga

SEQ ID NO: 9520 - DNA, 26 bp, Artificial sequence
  SiRNA target sequence
agactgttaaagaaatttgtgaagaa

SEQ ID NO: 9521 - DNA, 26 bp, Artificial sequence
  SiRNA target sequence
gactgttaaagaaatttgtgaagaag

SEQ ID NO: 9522 - DNA, 26 bp, Artificial sequence
  SiRNA target sequence
actgttaaagaaatttgtgaagaaga

SEQ ID NO: 9523 - DNA, 26 bp, Artificial sequence
  SiRNA target sequence
ctgttaaagaaatttgtgaagaagaa

SEQ ID NO: 9524 - DNA, 26 bp, Artificial sequence
  SiRNA target sequence
tgttaaagaaatttgtgaagaagaag

SEQ ID NO: 9525 - DNA, 26 bp, Artificial sequence
  SiRNA target sequence
gttaaagaaatttgtgaagaagaagt

SEQ ID NO: 9526 - DNA, 26 bp, Artificial sequence
  SiRNA target sequence
ttaaagaaatttgtgaagaagaagtg

SEQ ID NO: 9527 - DNA, 26 bp, Artificial sequence
  SiRNA target sequence
taaagaaatttgtgaagaagaagtga

SEQ ID NO: 9528 - DNA, 26 bp, Artificial sequence
  SiRNA target sequence
aaagaaatttgtgaagaagaagtgaa

SEQ ID NO: 9529 - DNA, 26 bp, Artificial sequence
  SiRNA target sequence
aagaaatttgtgaagaagaagtgaat

SEQ ID NO: 9530 - DNA, 26 bp, Artificial sequence
  SiRNA target sequence
agaaatttgtgaagaagaagtgaatg

SEQ ID NO: 9531 - DNA, 26 bp, Artificial sequence
  SiRNA target sequence
gaaatttgtgaagaagaagtgaatga

SEQ ID NO: 9532 - DNA, 26 bp, Artificial sequence
  SiRNA target sequence
aaatttgtgaagaagaagtgaatgag

SEQ ID NO: 9533 - DNA, 26 bp, Artificial sequence
  SiRNA target sequence
aatttgtgaagaagaagtgaatgagt

SEQ ID NO: 9534 - DNA, 26 bp, Artificial sequence
  SiRNA target sequence
atttgtgaagaagaagtgaatgagtt

SEQ ID NO: 9535 - DNA, 26 bp, Artificial sequence
  SiRNA target sequence
tttgtgaagaagaagtgaatgagttt

SEQ ID NO: 9536 - DNA, 26 bp, Artificial sequence
  SiRNA target sequence
ttgtgaagaagaagtgaatgagttta

SEQ ID NO: 9537 - DNA, 26 bp, Artificial sequence
  SiRNA target sequence
tgtgaagaagaagtgaatgagtttat

SEQ ID NO: 9538 - DNA, 26 bp, Artificial sequence
  SiRNA target sequence
gtgaagaagaagtgaatgagtttatt

SEQ ID NO: 9539 - DNA, 26 bp, Artificial sequence
  SiRNA target sequence
tgaagaagaagtgaatgagtttattg

SEQ ID NO: 9540 - DNA, 26 bp, Artificial sequence
  SiRNA target sequence
gaagaagaagtgaatgagtttattga

SEQ ID NO: 9541 - DNA, 26 bp, Artificial sequence
  SiRNA target sequence
aagaagaagtgaatgagtttattgaa

SEQ ID NO: 9542 - DNA, 26 bp, Artificial sequence
  SiRNA target sequence
agaagaagtgaatgagtttattgaac

SEQ ID NO: 9543 - DNA, 26 bp, Artificial sequence
  SiRNA target sequence
gaagaagtgaatgagtttattgaaca

SEQ ID NO: 9544 - DNA, 26 bp, Artificial sequence
  SiRNA target sequence
aagaagtgaatgagtttattgaacaa

SEQ ID NO: 9545 - DNA, 26 bp, Artificial sequence
  SiRNA target sequence
agaagtgaatgagtttattgaacaag

SEQ ID NO: 9546 - DNA, 26 bp, Artificial sequence
  SiRNA target sequence
gaagtgaatgagtttattgaacaaga

SEQ ID NO: 9547 - DNA, 26 bp, Artificial sequence
  SiRNA target sequence
aagtgaatgagtttattgaacaagaa

SEQ ID NO: 9548 - DNA, 26 bp, Artificial sequence
  SiRNA target sequence
agtgaatgagtttattgaacaagaag

SEQ ID NO: 9549 - DNA, 26 bp, Artificial sequence
  SiRNA target sequence
gtgaatgagtttattgaacaagaagg

SEQ ID NO: 9550 - DNA, 26 bp, Artificial sequence
  SiRNA target sequence
tgaatgagtttattgaacaagaaggt

SEQ ID NO: 9551 - DNA, 26 bp, Artificial sequence
  SiRNA target sequence
gaatgagtttattgaacaagaaggtt

SEQ ID NO: 9552 - DNA, 26 bp, Artificial sequence
  SiRNA target sequence
aatgagtttattgaacaagaaggttt

SEQ ID NO: 9553 - DNA, 26 bp, Artificial sequence
  SiRNA target sequence
atgagtttattgaacaagaaggttta

SEQ ID NO: 9554 - DNA, 26 bp, Artificial sequence
  SiRNA target sequence
tgagtttattgaacaagaaggtttaa

SEQ ID NO: 9555 - DNA, 26 bp, Artificial sequence
  SiRNA target sequence
gagtttattgaacaagaaggtttaaa

SEQ ID NO: 9556 - DNA, 26 bp, Artificial sequence
  SiRNA target sequence
agtttattgaacaagaaggtttaaaa

SEQ ID NO: 9557 - DNA, 26 bp, Artificial sequence
  SiRNA target sequence
gtttattgaacaagaaggtttaaaaa

SEQ ID NO: 9558 - DNA, 26 bp, Artificial sequence
  SiRNA target sequence
tttattgaacaagaaggtttaaaaat

SEQ ID NO: 9559 - DNA, 26 bp, Artificial sequence
  SiRNA target sequence
ttattgaacaagaaggtttaaaaatt

SEQ ID NO: 9560 - DNA, 26 bp, Artificial sequence
  SiRNA target sequence
tattgaacaagaaggtttaaaaatta

SEQ ID NO: 9561 - DNA, 26 bp, Artificial sequence
  SiRNA target sequence
attgaacaagaaggtttaaaaattaa

SEQ ID NO: 9562 - DNA, 26 bp, Artificial sequence
  SiRNA target sequence
ttgaacaagaaggtttaaaaattaat

SEQ ID NO: 9563 - DNA, 26 bp, Artificial sequence
  SiRNA target sequence
tgaacaagaaggtttaaaaattaata

SEQ ID NO: 9564 - DNA, 26 bp, Artificial sequence
  SiRNA target sequence
gaacaagaaggtttaaaaattaataa

SEQ ID NO: 9565 - DNA, 26 bp, Artificial sequence
  SiRNA target sequence
aacaagaaggtttaaaaattaataaa

SEQ ID NO: 9566 - DNA, 26 bp, Artificial sequence
  SiRNA target sequence
acaagaaggtttaaaaattaataaag

SEQ ID NO: 9567 - DNA, 26 bp, Artificial sequence
  SiRNA target sequence
caagaaggtttaaaaattaataaaga

SEQ ID NO: 9568 - DNA, 26 bp, Artificial sequence
  SiRNA target sequence
aagaaggtttaaaaattaataaagaa

SEQ ID NO: 9569 - DNA, 26 bp, Artificial sequence
  SiRNA target sequence
agaaggtttaaaaattaataaagaag

SEQ ID NO: 9570 - DNA, 26 bp, Artificial sequence
  SiRNA target sequence
gaaggtttaaaaattaataaagaaga

SEQ ID NO: 9571 - DNA, 26 bp, Artificial sequence
  SiRNA target sequence
aaggtttaaaaattaataaagaagat

SEQ ID NO: 9572 - DNA, 26 bp, Artificial sequence
  SiRNA target sequence
aggtttaaaaattaataaagaagatg

SEQ ID NO: 9573 - DNA, 26 bp, Artificial sequence
  SiRNA target sequence
ggtttaaaaattaataaagaagatgt

SEQ ID NO: 9574 - DNA, 26 bp, Artificial sequence
  SiRNA target sequence
gtttaaaaattaataaagaagatgtg

SEQ ID NO: 9575 - DNA, 26 bp, Artificial sequence
  SiRNA target sequence
tttaaaaattaataaagaagatgtgc

SEQ ID NO: 9576 - DNA, 26 bp, Artificial sequence
  SiRNA target sequence
ttaaaaattaataaagaagatgtgct

SEQ ID NO: 9577 - DNA, 26 bp, Artificial sequence
  SiRNA target sequence
taaaaattaataaagaagatgtgcta

SEQ ID NO: 9578 - DNA, 26 bp, Artificial sequence
  SiRNA target sequence
aaaaattaataaagaagatgtgctaa

SEQ ID NO: 9579 - DNA, 26 bp, Artificial sequence
  SiRNA target sequence
aaaattaataaagaagatgtgctaag

SEQ ID NO: 9580 - DNA, 26 bp, Artificial sequence
  SiRNA target sequence
aaattaataaagaagatgtgctaaga

SEQ ID NO: 9581 - DNA, 26 bp, Artificial sequence
  SiRNA target sequence
aattaataaagaagatgtgctaagag

SEQ ID NO: 9582 - DNA, 26 bp, Artificial sequence
  SiRNA target sequence
attaataaagaagatgtgctaagagg

SEQ ID NO: 9583 - DNA, 26 bp, Artificial sequence
  SiRNA target sequence
ttaataaagaagatgtgctaagagga

SEQ ID NO: 9584 - DNA, 26 bp, Artificial sequence
  SiRNA target sequence
taataaagaagatgtgctaagaggac

SEQ ID NO: 9585 - DNA, 26 bp, Artificial sequence
  SiRNA target sequence
aataaagaagatgtgctaagaggact

SEQ ID NO: 9586 - DNA, 26 bp, Artificial sequence
  SiRNA target sequence
ataaagaagatgtgctaagaggactt

SEQ ID NO: 9587 - DNA, 26 bp, Artificial sequence
  SiRNA target sequence
taaagaagatgtgctaagaggacttg

SEQ ID NO: 9588 - DNA, 26 bp, Artificial sequence
  SiRNA target sequence
aaagaagatgtgctaagaggacttgt

SEQ ID NO: 9589 - DNA, 26 bp, Artificial sequence
  SiRNA target sequence
aagaagatgtgctaagaggacttgtt

SEQ ID NO: 9590 - DNA, 26 bp, Artificial sequence
  SiRNA target sequence
agaagatgtgctaagaggacttgttt

SEQ ID NO: 9591 - DNA, 26 bp, Artificial sequence
  SiRNA target sequence
gaagatgtgctaagaggacttgtttc

SEQ ID NO: 9592 - DNA, 26 bp, Artificial sequence
  SiRNA target sequence
aagatgtgctaagaggacttgtttca

SEQ ID NO: 9593 - DNA, 26 bp, Artificial sequence
  SiRNA target sequence
agatgtgctaagaggacttgtttcaa

SEQ ID NO: 9594 - DNA, 26 bp, Artificial sequence
  SiRNA target sequence
gatgtgctaagaggacttgtttcaat

SEQ ID NO: 9595 - DNA, 26 bp, Artificial sequence
  SiRNA target sequence
atgtgctaagaggacttgtttcaata

SEQ ID NO: 9596 - DNA, 26 bp, Artificial sequence
  SiRNA target sequence
tgtgctaagaggacttgtttcaataa

SEQ ID NO: 9597 - DNA, 26 bp, Artificial sequence
  SiRNA target sequence
gtgctaagaggacttgtttcaataaa

SEQ ID NO: 9598 - DNA, 26 bp, Artificial sequence
  SiRNA target sequence
tgctaagaggacttgtttcaataaaa

SEQ ID NO: 9599 - DNA, 26 bp, Artificial sequence
  SiRNA target sequence
gctaagaggacttgtttcaataaaaa

SEQ ID NO: 9600 - DNA, 26 bp, Artificial sequence
  SiRNA target sequence
ctaagaggacttgtttcaataaaaaa

SEQ ID NO: 9601 - DNA, 26 bp, Artificial sequence
  SiRNA target sequence
taagaggacttgtttcaataaaaaat

SEQ ID NO: 9602 - DNA, 26 bp, Artificial sequence
  SiRNA target sequence
aagaggacttgtttcaataaaaaata

SEQ ID NO: 9603 - DNA, 26 bp, Artificial sequence
  SiRNA target sequence
agaggacttgtttcaataaaaaatat

SEQ ID NO: 9604 - DNA, 26 bp, Artificial sequence
  SiRNA target sequence
gaggacttgtttcaataaaaaatata

SEQ ID NO: 9605 - DNA, 26 bp, Artificial sequence
  SiRNA target sequence
aggacttgtttcaataaaaaatataa

SEQ ID NO: 9606 - DNA, 26 bp, Artificial sequence
  SiRNA target sequence
ggacttgtttcaataaaaaatataaa

SEQ ID NO: 9607 - DNA, 26 bp, Artificial sequence
  SiRNA target sequence
gacttgtttcaataaaaaatataaat

SEQ ID NO: 9608 - DNA, 26 bp, Artificial sequence
  SiRNA target sequence
acttgtttcaataaaaaatataaatg

SEQ ID NO: 9609 - DNA, 26 bp, Artificial sequence
  SiRNA target sequence
cttgtttcaataaaaaatataaatga

SEQ ID NO: 9610 - DNA, 26 bp, Artificial sequence
  SiRNA target sequence
ttgtttcaataaaaaatataaatgag

SEQ ID NO: 9611 - DNA, 26 bp, Artificial sequence
  SiRNA target sequence
tgtttcaataaaaaatataaatgaga

SEQ ID NO: 9612 - DNA, 26 bp, Artificial sequence
  SiRNA target sequence
gtttcaataaaaaatataaatgagat

SEQ ID NO: 9613 - DNA, 26 bp, Artificial sequence
  SiRNA target sequence
tttcaataaaaaatataaatgagatt

SEQ ID NO: 9614 - DNA, 26 bp, Artificial sequence
  SiRNA target sequence
ttcaataaaaaatataaatgagattt

SEQ ID NO: 9615 - DNA, 26 bp, Artificial sequence
  SiRNA target sequence
tcaataaaaaatataaatgagattta

SEQ ID NO: 9616 - DNA, 26 bp, Artificial sequence
  SiRNA target sequence
caataaaaaatataaatgagatttat

SEQ ID NO: 9617 - DNA, 26 bp, Artificial sequence
  SiRNA target sequence
aataaaaaatataaatgagatttatg

SEQ ID NO: 9618 - DNA, 26 bp, Artificial sequence
  SiRNA target sequence
ataaaaaatataaatgagatttatga

SEQ ID NO: 9619 - DNA, 26 bp, Artificial sequence
  SiRNA target sequence
taaaaaatataaatgagatttatgat

SEQ ID NO: 9620 - DNA, 26 bp, Artificial sequence
  SiRNA target sequence
aaaaaatataaatgagatttatgatg

SEQ ID NO: 9621 - DNA, 26 bp, Artificial sequence
  SiRNA target sequence
aaaaatataaatgagatttatgatgc

SEQ ID NO: 9622 - DNA, 26 bp, Artificial sequence
  SiRNA target sequence
aaaatataaatgagatttatgatgca

SEQ ID NO: 9623 - DNA, 26 bp, Artificial sequence
  SiRNA target sequence
aaatataaatgagatttatgatgcat

SEQ ID NO: 9624 - DNA, 26 bp, Artificial sequence
  SiRNA target sequence
aatataaatgagatttatgatgcatt

SEQ ID NO: 9625 - DNA, 26 bp, Artificial sequence
  SiRNA target sequence
atataaatgagatttatgatgcattt

SEQ ID NO: 9626 - DNA, 26 bp, Artificial sequence
  SiRNA target sequence
tataaatgagatttatgatgcatttg

SEQ ID NO: 9627 - DNA, 26 bp, Artificial sequence
  SiRNA target sequence
ataaatgagatttatgatgcatttgg

SEQ ID NO: 9628 - DNA, 26 bp, Artificial sequence
  SiRNA target sequence
taaatgagatttatgatgcatttgga

SEQ ID NO: 9629 - DNA, 26 bp, Artificial sequence
  SiRNA target sequence
aaatgagatttatgatgcatttggag

SEQ ID NO: 9630 - DNA, 26 bp, Artificial sequence
  SiRNA target sequence
aatgagatttatgatgcatttggagg

SEQ ID NO: 9631 - DNA, 26 bp, Artificial sequence
  SiRNA target sequence
atgagatttatgatgcatttggaggt

SEQ ID NO: 9632 - DNA, 26 bp, Artificial sequence
  SiRNA target sequence
tgagatttatgatgcatttggaggta

SEQ ID NO: 9633 - DNA, 26 bp, Artificial sequence
  SiRNA target sequence
gagatttatgatgcatttggaggtaa

SEQ ID NO: 9634 - DNA, 26 bp, Artificial sequence
  SiRNA target sequence
agatttatgatgcatttggaggtaaa

SEQ ID NO: 9635 - DNA, 26 bp, Artificial sequence
  SiRNA target sequence
gatttatgatgcatttggaggtaaat

SEQ ID NO: 9636 - DNA, 26 bp, Artificial sequence
  SiRNA target sequence
atttatgatgcatttggaggtaaatc

SEQ ID NO: 9637 - DNA, 26 bp, Artificial sequence
  SiRNA target sequence
tttatgatgcatttggaggtaaatct

SEQ ID NO: 9638 - DNA, 26 bp, Artificial sequence
  SiRNA target sequence
ttatgatgcatttggaggtaaatcta

SEQ ID NO: 9639 - DNA, 26 bp, Artificial sequence
  SiRNA target sequence
tatgatgcatttggaggtaaatctaa

SEQ ID NO: 9640 - DNA, 26 bp, Artificial sequence
  SiRNA target sequence
atgatgcatttggaggtaaatctaag

SEQ ID NO: 9641 - DNA, 26 bp, Artificial sequence
  SiRNA target sequence
tgatgcatttggaggtaaatctaaga

SEQ ID NO: 9642 - DNA, 26 bp, Artificial sequence
  SiRNA target sequence
gatgcatttggaggtaaatctaagaa

SEQ ID NO: 9643 - DNA, 26 bp, Artificial sequence
  SiRNA target sequence
atgcatttggaggtaaatctaagaag

SEQ ID NO: 9644 - DNA, 26 bp, Artificial sequence
  SiRNA target sequence
tgcatttggaggtaaatctaagaagt

SEQ ID NO: 9645 - DNA, 26 bp, Artificial sequence
  SiRNA target sequence
gcatttggaggtaaatctaagaagtt

SEQ ID NO: 9646 - DNA, 26 bp, Artificial sequence
  SiRNA target sequence
catttggaggtaaatctaagaagttt

SEQ ID NO: 9647 - DNA, 26 bp, Artificial sequence
  SiRNA target sequence
atttggaggtaaatctaagaagttta

SEQ ID NO: 9648 - DNA, 26 bp, Artificial sequence
  SiRNA target sequence
tttggaggtaaatctaagaagtttaa

SEQ ID NO: 9649 - DNA, 26 bp, Artificial sequence
  SiRNA target sequence
ttggaggtaaatctaagaagtttaaa

SEQ ID NO: 9650 - DNA, 26 bp, Artificial sequence
  SiRNA target sequence
tggaggtaaatctaagaagtttaaat

SEQ ID NO: 9651 - DNA, 26 bp, Artificial sequence
  SiRNA target sequence
ggaggtaaatctaagaagtttaaatt

SEQ ID NO: 9652 - DNA, 26 bp, Artificial sequence
  SiRNA target sequence
gaggtaaatctaagaagtttaaattt

SEQ ID NO: 9653 - DNA, 26 bp, Artificial sequence
  SiRNA target sequence
aggtaaatctaagaagtttaaatttt

SEQ ID NO: 9654 - DNA, 26 bp, Artificial sequence
  SiRNA target sequence
ggtaaatctaagaagtttaaattttc

SEQ ID NO: 9655 - DNA, 26 bp, Artificial sequence
  SiRNA target sequence
gtaaatctaagaagtttaaattttct

SEQ ID NO: 9656 - DNA, 26 bp, Artificial sequence
  SiRNA target sequence
taaatctaagaagtttaaattttcta

SEQ ID NO: 9657 - DNA, 26 bp, Artificial sequence
  SiRNA target sequence
aaatctaagaagtttaaattttctaa

SEQ ID NO: 9658 - DNA, 26 bp, Artificial sequence
  SiRNA target sequence
aatctaagaagtttaaattttctaat

SEQ ID NO: 9659 - DNA, 26 bp, Artificial sequence
  SiRNA target sequence
atctaagaagtttaaattttctaatg

SEQ ID NO: 9660 - DNA, 26 bp, Artificial sequence
  SiRNA target sequence
tctaagaagtttaaattttctaatga

SEQ ID NO: 9661 - DNA, 26 bp, Artificial sequence
  SiRNA target sequence
ctaagaagtttaaattttctaatgat

SEQ ID NO: 9662 - DNA, 26 bp, Artificial sequence
  SiRNA target sequence
taagaagtttaaattttctaatgatg

SEQ ID NO: 9663 - DNA, 26 bp, Artificial sequence
  SiRNA target sequence
aagaagtttaaattttctaatgatga

SEQ ID NO: 9664 - DNA, 26 bp, Artificial sequence
  SiRNA target sequence
agaagtttaaattttctaatgatgaa

SEQ ID NO: 9665 - DNA, 26 bp, Artificial sequence
  SiRNA target sequence
gaagtttaaattttctaatgatgaaa

SEQ ID NO: 9666 - DNA, 26 bp, Artificial sequence
  SiRNA target sequence
aagtttaaattttctaatgatgaaaa

SEQ ID NO: 9667 - DNA, 26 bp, Artificial sequence
  SiRNA target sequence
agtttaaattttctaatgatgaaaag

SEQ ID NO: 9668 - DNA, 26 bp, Artificial sequence
  SiRNA target sequence
gtttaaattttctaatgatgaaaagg

SEQ ID NO: 9669 - DNA, 26 bp, Artificial sequence
  SiRNA target sequence
tttaaattttctaatgatgaaaagga

SEQ ID NO: 9670 - DNA, 26 bp, Artificial sequence
  SiRNA target sequence
ttaaattttctaatgatgaaaaggaa

SEQ ID NO: 9671 - DNA, 26 bp, Artificial sequence
  SiRNA target sequence
taaattttctaatgatgaaaaggaag

SEQ ID NO: 9672 - DNA, 26 bp, Artificial sequence
  SiRNA target sequence
aaattttctaatgatgaaaaggaagt

SEQ ID NO: 9673 - DNA, 26 bp, Artificial sequence
  SiRNA target sequence
aattttctaatgatgaaaaggaagtg

SEQ ID NO: 9674 - DNA, 26 bp, Artificial sequence
  SiRNA target sequence
attttctaatgatgaaaaggaagtgt

SEQ ID NO: 9675 - DNA, 26 bp, Artificial sequence
  SiRNA target sequence
ttttctaatgatgaaaaggaagtgtt

SEQ ID NO: 9676 - DNA, 26 bp, Artificial sequence
  SiRNA target sequence
tttctaatgatgaaaaggaagtgtta

SEQ ID NO: 9677 - DNA, 26 bp, Artificial sequence
  SiRNA target sequence
ttctaatgatgaaaaggaagtgttaa

SEQ ID NO: 9678 - DNA, 26 bp, Artificial sequence
  SiRNA target sequence
tctaatgatgaaaaggaagtgttaaa

SEQ ID NO: 9679 - DNA, 26 bp, Artificial sequence
  SiRNA target sequence
ctaatgatgaaaaggaagtgttaaat

SEQ ID NO: 9680 - DNA, 26 bp, Artificial sequence
  SiRNA target sequence
taatgatgaaaaggaagtgttaaatc

SEQ ID NO: 9681 - DNA, 26 bp, Artificial sequence
  SiRNA target sequence
aatgatgaaaaggaagtgttaaatct

SEQ ID NO: 9682 - DNA, 26 bp, Artificial sequence
  SiRNA target sequence
atgatgaaaaggaagtgttaaatctt

SEQ ID NO: 9683 - DNA, 26 bp, Artificial sequence
  SiRNA target sequence
tgatgaaaaggaagtgttaaatcttc

SEQ ID NO: 9684 - DNA, 26 bp, Artificial sequence
  SiRNA target sequence
gatgaaaaggaagtgttaaatcttct

SEQ ID NO: 9685 - DNA, 26 bp, Artificial sequence
  SiRNA target sequence
atgaaaaggaagtgttaaatcttctt

SEQ ID NO: 9686 - DNA, 26 bp, Artificial sequence
  SiRNA target sequence
tgaaaaggaagtgttaaatcttctta

SEQ ID NO: 9687 - DNA, 26 bp, Artificial sequence
  SiRNA target sequence
gaaaaggaagtgttaaatcttcttaa

SEQ ID NO: 9688 - DNA, 26 bp, Artificial sequence
  SiRNA target sequence
aaaaggaagtgttaaatcttcttaat

SEQ ID NO: 9689 - DNA, 26 bp, Artificial sequence
  SiRNA target sequence
aaaggaagtgttaaatcttcttaatg

SEQ ID NO: 9690 - DNA, 26 bp, Artificial sequence
  SiRNA target sequence
aaggaagtgttaaatcttcttaatgc

SEQ ID NO: 9691 - DNA, 26 bp, Artificial sequence
  SiRNA target sequence
aggaagtgttaaatcttcttaatgcc

SEQ ID NO: 9692 - DNA, 26 bp, Artificial sequence
  SiRNA target sequence
ggaagtgttaaatcttcttaatgcca

SEQ ID NO: 9693 - DNA, 26 bp, Artificial sequence
  SiRNA target sequence
gaagtgttaaatcttcttaatgccat

SEQ ID NO: 9694 - DNA, 26 bp, Artificial sequence
  SiRNA target sequence
aagtgttaaatcttcttaatgccatt

SEQ ID NO: 9695 - DNA, 26 bp, Artificial sequence
  SiRNA target sequence
agtgttaaatcttcttaatgccatta

SEQ ID NO: 9696 - DNA, 26 bp, Artificial sequence
  SiRNA target sequence
gtgttaaatcttcttaatgccattat

SEQ ID NO: 9697 - DNA, 26 bp, Artificial sequence
  SiRNA target sequence
tgttaaatcttcttaatgccattatt

SEQ ID NO: 9698 - DNA, 26 bp, Artificial sequence
  SiRNA target sequence
gttaaatcttcttaatgccattattt

SEQ ID NO: 9699 - DNA, 26 bp, Artificial sequence
  SiRNA target sequence
ttaaatcttcttaatgccattatttt

SEQ ID NO: 9700 - DNA, 26 bp, Artificial sequence
  SiRNA target sequence
taaatcttcttaatgccattatttta

SEQ ID NO: 9701 - DNA, 26 bp, Artificial sequence
  SiRNA target sequence
aaatcttcttaatgccattattttac

SEQ ID NO: 9702 - DNA, 26 bp, Artificial sequence
  SiRNA target sequence
aatcttcttaatgccattattttaca

SEQ ID NO: 9703 - DNA, 26 bp, Artificial sequence
  SiRNA target sequence
atcttcttaatgccattattttacac

SEQ ID NO: 9704 - DNA, 26 bp, Artificial sequence
  SiRNA target sequence
tcttcttaatgccattattttacacc

SEQ ID NO: 9705 - DNA, 26 bp, Artificial sequence
  SiRNA target sequence
cttcttaatgccattattttacacct

SEQ ID NO: 9706 - DNA, 26 bp, Artificial sequence
  SiRNA target sequence
ttcttaatgccattattttacaccta

SEQ ID NO: 9707 - DNA, 26 bp, Artificial sequence
  SiRNA target sequence
tcttaatgccattattttacacctaa

SEQ ID NO: 9708 - DNA, 26 bp, Artificial sequence
  SiRNA target sequence
cttaatgccattattttacacctaaa

SEQ ID NO: 9709 - DNA, 26 bp, Artificial sequence
  SiRNA target sequence
ttaatgccattattttacacctaaaa

SEQ ID NO: 9710 - DNA, 26 bp, Artificial sequence
  SiRNA target sequence
taatgccattattttacacctaaaag

SEQ ID NO: 9711 - DNA, 26 bp, Artificial sequence
  SiRNA target sequence
aatgccattattttacacctaaaagg

SEQ ID NO: 9712 - DNA, 26 bp, Artificial sequence
  SiRNA target sequence
atgccattattttacacctaaaagga

SEQ ID NO: 9713 - DNA, 26 bp, Artificial sequence
  SiRNA target sequence
tgccattattttacacctaaaaggaa

SEQ ID NO: 9714 - DNA, 26 bp, Artificial sequence
  SiRNA target sequence
gccattattttacacctaaaaggaaa

SEQ ID NO: 9715 - DNA, 26 bp, Artificial sequence
  SiRNA target sequence
ccattattttacacctaaaaggaaaa

SEQ ID NO: 9716 - DNA, 26 bp, Artificial sequence
  SiRNA target sequence
cattattttacacctaaaaggaaaaa

SEQ ID NO: 9717 - DNA, 26 bp, Artificial sequence
  SiRNA target sequence
attattttacacctaaaaggaaaaaa

SEQ ID NO: 9718 - DNA, 26 bp, Artificial sequence
  SiRNA target sequence
ttattttacacctaaaaggaaaaaaa

SEQ ID NO: 9719 - DNA, 26 bp, Artificial sequence
  SiRNA target sequence
tattttacacctaaaaggaaaaaaag

SEQ ID NO: 9720 - DNA, 26 bp, Artificial sequence
  SiRNA target sequence
attttacacctaaaaggaaaaaaaga

SEQ ID NO: 9721 - DNA, 26 bp, Artificial sequence
  SiRNA target sequence
ttttacacctaaaaggaaaaaaagaa

SEQ ID NO: 9722 - DNA, 26 bp, Artificial sequence
  SiRNA target sequence
tttacacctaaaaggaaaaaaagaac

SEQ ID NO: 9723 - DNA, 26 bp, Artificial sequence
  SiRNA target sequence
ttacacctaaaaggaaaaaaagaaca

SEQ ID NO: 9724 - DNA, 26 bp, Artificial sequence
  SiRNA target sequence
tacacctaaaaggaaaaaaagaacag

SEQ ID NO: 9725 - DNA, 26 bp, Artificial sequence
  SiRNA target sequence
acacctaaaaggaaaaaaagaacagg

SEQ ID NO: 9726 - DNA, 26 bp, Artificial sequence
  SiRNA target sequence
cacctaaaaggaaaaaaagaacaggc

SEQ ID NO: 9727 - DNA, 26 bp, Artificial sequence
  SiRNA target sequence
acctaaaaggaaaaaaagaacaggca

SEQ ID NO: 9728 - DNA, 26 bp, Artificial sequence
  SiRNA target sequence
cctaaaaggaaaaaaagaacaggcaa

SEQ ID NO: 9729 - DNA, 26 bp, Artificial sequence
  SiRNA target sequence
ctaaaaggaaaaaaagaacaggcaat

SEQ ID NO: 9730 - DNA, 26 bp, Artificial sequence
  SiRNA target sequence
taaaaggaaaaaaagaacaggcaatt

SEQ ID NO: 9731 - DNA, 26 bp, Artificial sequence
  SiRNA target sequence
aaaaggaaaaaaagaacaggcaattc

SEQ ID NO: 9732 - DNA, 26 bp, Artificial sequence
  SiRNA target sequence
aaaggaaaaaaagaacaggcaattct

SEQ ID NO: 9733 - DNA, 26 bp, Artificial sequence
  SiRNA target sequence
aaggaaaaaaagaacaggcaattctt

SEQ ID NO: 9734 - DNA, 26 bp, Artificial sequence
  SiRNA target sequence
aggaaaaaaagaacaggcaattcttt

SEQ ID NO: 9735 - DNA, 26 bp, Artificial sequence
  SiRNA target sequence
ggaaaaaaagaacaggcaattctttt

SEQ ID NO: 9736 - DNA, 26 bp, Artificial sequence
  SiRNA target sequence
gaaaaaaagaacaggcaattctttta

SEQ ID NO: 9737 - DNA, 26 bp, Artificial sequence
  SiRNA target sequence
aaaaaaagaacaggcaattcttttat

SEQ ID NO: 9738 - DNA, 26 bp, Artificial sequence
  SiRNA target sequence
aaaaaagaacaggcaattcttttatt

SEQ ID NO: 9739 - DNA, 26 bp, Artificial sequence
  SiRNA target sequence
aaaaagaacaggcaattcttttatta

SEQ ID NO: 9740 - DNA, 26 bp, Artificial sequence
  SiRNA target sequence
aaaagaacaggcaattcttttattag

SEQ ID NO: 9741 - DNA, 26 bp, Artificial sequence
  SiRNA target sequence
aaagaacaggcaattcttttattaga

SEQ ID NO: 9742 - DNA, 26 bp, Artificial sequence
  SiRNA target sequence
aagaacaggcaattcttttattagaa

SEQ ID NO: 9743 - DNA, 26 bp, Artificial sequence
  SiRNA target sequence
agaacaggcaattcttttattagaaa

SEQ ID NO: 9744 - DNA, 26 bp, Artificial sequence
  SiRNA target sequence
gaacaggcaattcttttattagaaaa

SEQ ID NO: 9745 - DNA, 26 bp, Artificial sequence
  SiRNA target sequence
aacaggcaattcttttattagaaaaa

SEQ ID NO: 9746 - DNA, 26 bp, Artificial sequence
  SiRNA target sequence
acaggcaattcttttattagaaaaat

SEQ ID NO: 9747 - DNA, 26 bp, Artificial sequence
  SiRNA target sequence
caggcaattcttttattagaaaaatc

SEQ ID NO: 9748 - DNA, 26 bp, Artificial sequence
  SiRNA target sequence
aggcaattcttttattagaaaaatct

SEQ ID NO: 9749 - DNA, 26 bp, Artificial sequence
  SiRNA target sequence
ggcaattcttttattagaaaaatcta

SEQ ID NO: 9750 - DNA, 26 bp, Artificial sequence
  SiRNA target sequence
gcaattcttttattagaaaaatctac

SEQ ID NO: 9751 - DNA, 26 bp, Artificial sequence
  SiRNA target sequence
caattcttttattagaaaaatctact

SEQ ID NO: 9752 - DNA, 26 bp, Artificial sequence
  SiRNA target sequence
aattcttttattagaaaaatctactt

SEQ ID NO: 9753 - DNA, 26 bp, Artificial sequence
  SiRNA target sequence
attcttttattagaaaaatctactta

SEQ ID NO: 9754 - DNA, 26 bp, Artificial sequence
  SiRNA target sequence
ttcttttattagaaaaatctacttat

SEQ ID NO: 9755 - DNA, 26 bp, Artificial sequence
  SiRNA target sequence
tcttttattagaaaaatctacttata

SEQ ID NO: 9756 - DNA, 26 bp, Artificial sequence
  SiRNA target sequence
cttttattagaaaaatctacttataa

SEQ ID NO: 9757 - DNA, 26 bp, Artificial sequence
  SiRNA target sequence
ttttattagaaaaatctacttataaa

SEQ ID NO: 9758 - DNA, 26 bp, Artificial sequence
  SiRNA target sequence
tttattagaaaaatctacttataaat

SEQ ID NO: 9759 - DNA, 26 bp, Artificial sequence
  SiRNA target sequence
ttattagaaaaatctacttataaata

SEQ ID NO: 9760 - DNA, 26 bp, Artificial sequence
  SiRNA target sequence
tattagaaaaatctacttataaatac

SEQ ID NO: 9761 - DNA, 26 bp, Artificial sequence
  SiRNA target sequence
attagaaaaatctacttataaataca

SEQ ID NO: 9762 - DNA, 26 bp, Artificial sequence
  SiRNA target sequence
ttagaaaaatctacttataaatacag

SEQ ID NO: 9763 - DNA, 26 bp, Artificial sequence
  SiRNA target sequence
tagaaaaatctacttataaatacagt

SEQ ID NO: 9764 - DNA, 26 bp, Artificial sequence
  SiRNA target sequence
agaaaaatctacttataaatacagta

SEQ ID NO: 9765 - DNA, 26 bp, Artificial sequence
  SiRNA target sequence
gaaaaatctacttataaatacagtat

SEQ ID NO: 9766 - DNA, 26 bp, Artificial sequence
  SiRNA target sequence
aaaaatctacttataaatacagtatc

SEQ ID NO: 9767 - DNA, 26 bp, Artificial sequence
  SiRNA target sequence
aaaatctacttataaatacagtatct

SEQ ID NO: 9768 - DNA, 26 bp, Artificial sequence
  SiRNA target sequence
aaatctacttataaatacagtatctt

SEQ ID NO: 9769 - DNA, 26 bp, Artificial sequence
  SiRNA target sequence
aatctacttataaatacagtatcttg

SEQ ID NO: 9770 - DNA, 26 bp, Artificial sequence
  SiRNA target sequence
atctacttataaatacagtatcttgt

SEQ ID NO: 9771 - DNA, 26 bp, Artificial sequence
  SiRNA target sequence
tctacttataaatacagtatcttgta

SEQ ID NO: 9772 - DNA, 26 bp, Artificial sequence
  SiRNA target sequence
ctacttataaatacagtatcttgtat

SEQ ID NO: 9773 - DNA, 26 bp, Artificial sequence
  SiRNA target sequence
tacttataaatacagtatcttgtata

SEQ ID NO: 9774 - DNA, 26 bp, Artificial sequence
  SiRNA target sequence
acttataaatacagtatcttgtatag

SEQ ID NO: 9775 - DNA, 26 bp, Artificial sequence
  SiRNA target sequence
cttataaatacagtatcttgtataga

SEQ ID NO: 9776 - DNA, 26 bp, Artificial sequence
  SiRNA target sequence
ttataaatacagtatcttgtatagag

SEQ ID NO: 9777 - DNA, 26 bp, Artificial sequence
  SiRNA target sequence
tataaatacagtatcttgtatagagc

SEQ ID NO: 9778 - DNA, 26 bp, Artificial sequence
  SiRNA target sequence
ataaatacagtatcttgtatagagca

SEQ ID NO: 9779 - DNA, 26 bp, Artificial sequence
  SiRNA target sequence
taaatacagtatcttgtatagagcat

SEQ ID NO: 9780 - DNA, 26 bp, Artificial sequence
  SiRNA target sequence
aaatacagtatcttgtatagagcata

SEQ ID NO: 9781 - DNA, 26 bp, Artificial sequence
  SiRNA target sequence
aatacagtatcttgtatagagcatat

SEQ ID NO: 9782 - DNA, 26 bp, Artificial sequence
  SiRNA target sequence
atacagtatcttgtatagagcatatt

SEQ ID NO: 9783 - DNA, 26 bp, Artificial sequence
  SiRNA target sequence
tacagtatcttgtatagagcatattt

SEQ ID NO: 9784 - DNA, 26 bp, Artificial sequence
  SiRNA target sequence
acagtatcttgtatagagcatatttt

SEQ ID NO: 9785 - DNA, 26 bp, Artificial sequence
  SiRNA target sequence
cagtatcttgtatagagcatattttc

SEQ ID NO: 9786 - DNA, 26 bp, Artificial sequence
  SiRNA target sequence
agtatcttgtatagagcatattttct

SEQ ID NO: 9787 - DNA, 26 bp, Artificial sequence
  SiRNA target sequence
gtatcttgtatagagcatattttctt

SEQ ID NO: 9788 - DNA, 26 bp, Artificial sequence
  SiRNA target sequence
tatcttgtatagagcatattttctta

SEQ ID NO: 9789 - DNA, 26 bp, Artificial sequence
  SiRNA target sequence
atcttgtatagagcatattttcttac

SEQ ID NO: 9790 - DNA, 26 bp, Artificial sequence
  SiRNA target sequence
tcttgtatagagcatattttcttaca

SEQ ID NO: 9791 - DNA, 26 bp, Artificial sequence
  SiRNA target sequence
cttgtatagagcatattttcttacat

SEQ ID NO: 9792 - DNA, 26 bp, Artificial sequence
  SiRNA target sequence
ttgtatagagcatattttcttacatt

SEQ ID NO: 9793 - DNA, 26 bp, Artificial sequence
  SiRNA target sequence
tgtatagagcatattttcttacattg

SEQ ID NO: 9794 - DNA, 26 bp, Artificial sequence
  SiRNA target sequence
gtatagagcatattttcttacattga

SEQ ID NO: 9795 - DNA, 26 bp, Artificial sequence
  SiRNA target sequence
tatagagcatattttcttacattgaa

SEQ ID NO: 9796 - DNA, 26 bp, Artificial sequence
  SiRNA target sequence
atagagcatattttcttacattgaag

SEQ ID NO: 9797 - DNA, 26 bp, Artificial sequence
  SiRNA target sequence
tagagcatattttcttacattgaaga

SEQ ID NO: 9798 - DNA, 26 bp, Artificial sequence
  SiRNA target sequence
agagcatattttcttacattgaagaa

SEQ ID NO: 9799 - DNA, 26 bp, Artificial sequence
  SiRNA target sequence
gagcatattttcttacattgaagaat

SEQ ID NO: 9800 - DNA, 26 bp, Artificial sequence
  SiRNA target sequence
agcatattttcttacattgaagaatg

SEQ ID NO: 9801 - DNA, 26 bp, Artificial sequence
  SiRNA target sequence
gcatattttcttacattgaagaatga

SEQ ID NO: 9802 - DNA, 26 bp, Artificial sequence
  SiRNA target sequence
catattttcttacattgaagaatgaa

SEQ ID NO: 9803 - DNA, 26 bp, Artificial sequence
  SiRNA target sequence
atattttcttacattgaagaatgaat

SEQ ID NO: 9804 - DNA, 26 bp, Artificial sequence
  SiRNA target sequence
tattttcttacattgaagaatgaata

SEQ ID NO: 9805 - DNA, 26 bp, Artificial sequence
  SiRNA target sequence
attttcttacattgaagaatgaatat

SEQ ID NO: 9806 - DNA, 26 bp, Artificial sequence
  SiRNA target sequence
ttttcttacattgaagaatgaatata

SEQ ID NO: 9807 - DNA, 26 bp, Artificial sequence
  SiRNA target sequence
tttcttacattgaagaatgaatatat

SEQ ID NO: 9808 - DNA, 26 bp, Artificial sequence
  SiRNA target sequence
ttcttacattgaagaatgaatatatt

SEQ ID NO: 9809 - DNA, 26 bp, Artificial sequence
  SiRNA target sequence
tcttacattgaagaatgaatatattt

SEQ ID NO: 9810 - DNA, 26 bp, Artificial sequence
  SiRNA target sequence
cttacattgaagaatgaatatatttc

SEQ ID NO: 9811 - DNA, 26 bp, Artificial sequence
  SiRNA target sequence
ttacattgaagaatgaatatatttca

SEQ ID NO: 9812 - DNA, 26 bp, Artificial sequence
  SiRNA target sequence
tacattgaagaatgaatatatttcat

SEQ ID NO: 9813 - DNA, 26 bp, Artificial sequence
  SiRNA target sequence
acattgaagaatgaatatatttcatc

SEQ ID NO: 9814 - DNA, 26 bp, Artificial sequence
  SiRNA target sequence
cattgaagaatgaatatatttcatct

SEQ ID NO: 9815 - DNA, 26 bp, Artificial sequence
  SiRNA target sequence
attgaagaatgaatatatttcatctt

SEQ ID NO: 9816 - DNA, 26 bp, Artificial sequence
  SiRNA target sequence
ttgaagaatgaatatatttcatcttc

SEQ ID NO: 9817 - DNA, 26 bp, Artificial sequence
  SiRNA target sequence
tgaagaatgaatatatttcatcttca

SEQ ID NO: 9818 - DNA, 26 bp, Artificial sequence
  SiRNA target sequence
gaagaatgaatatatttcatcttcat

SEQ ID NO: 9819 - DNA, 26 bp, Artificial sequence
  SiRNA target sequence
aagaatgaatatatttcatcttcatt

SEQ ID NO: 9820 - DNA, 26 bp, Artificial sequence
  SiRNA target sequence
agaatgaatatatttcatcttcattg

SEQ ID NO: 9821 - DNA, 26 bp, Artificial sequence
  SiRNA target sequence
gaatgaatatatttcatcttcattgc

SEQ ID NO: 9822 - DNA, 26 bp, Artificial sequence
  SiRNA target sequence
aatgaatatatttcatcttcattgcc

SEQ ID NO: 9823 - DNA, 26 bp, Artificial sequence
  SiRNA target sequence
atgaatatatttcatcttcattgcct

SEQ ID NO: 9824 - DNA, 26 bp, Artificial sequence
  SiRNA target sequence
tgaatatatttcatcttcattgcctt

SEQ ID NO: 9825 - DNA, 26 bp, Artificial sequence
  SiRNA target sequence
gaatatatttcatcttcattgccttt

SEQ ID NO: 9826 - DNA, 26 bp, Artificial sequence
  SiRNA target sequence
aatatatttcatcttcattgccttta

SEQ ID NO: 9827 - DNA, 26 bp, Artificial sequence
  SiRNA target sequence
atatatttcatcttcattgcctttag

SEQ ID NO: 9828 - DNA, 26 bp, Artificial sequence
  SiRNA target sequence
tatatttcatcttcattgcctttaga

SEQ ID NO: 9829 - DNA, 26 bp, Artificial sequence
  SiRNA target sequence
atatttcatcttcattgcctttagat

SEQ ID NO: 9830 - DNA, 26 bp, Artificial sequence
  SiRNA target sequence
tatttcatcttcattgcctttagatg

SEQ ID NO: 9831 - DNA, 26 bp, Artificial sequence
  SiRNA target sequence
atttcatcttcattgcctttagatga

SEQ ID NO: 9832 - DNA, 26 bp, Artificial sequence
  SiRNA target sequence
tttcatcttcattgcctttagatgac

SEQ ID NO: 9833 - DNA, 26 bp, Artificial sequence
  SiRNA target sequence
ttcatcttcattgcctttagatgacg

SEQ ID NO: 9834 - DNA, 26 bp, Artificial sequence
  SiRNA target sequence
tcatcttcattgcctttagatgacga

SEQ ID NO: 9835 - DNA, 26 bp, Artificial sequence
  SiRNA target sequence
catcttcattgcctttagatgacgag

SEQ ID NO: 9836 - DNA, 26 bp, Artificial sequence
  SiRNA target sequence
atcttcattgcctttagatgacgaga

SEQ ID NO: 9837 - DNA, 26 bp, Artificial sequence
  SiRNA target sequence
tcttcattgcctttagatgacgagat

SEQ ID NO: 9838 - DNA, 26 bp, Artificial sequence
  SiRNA target sequence
cttcattgcctttagatgacgagatt

SEQ ID NO: 9839 - DNA, 26 bp, Artificial sequence
  SiRNA target sequence
ttcattgcctttagatgacgagatta

SEQ ID NO: 9840 - DNA, 26 bp, Artificial sequence
  SiRNA target sequence
tcattgcctttagatgacgagattac

SEQ ID NO: 9841 - DNA, 26 bp, Artificial sequence
  SiRNA target sequence
cattgcctttagatgacgagattact

SEQ ID NO: 9842 - DNA, 26 bp, Artificial sequence
  SiRNA target sequence
attgcctttagatgacgagattacta

SEQ ID NO: 9843 - DNA, 26 bp, Artificial sequence
  SiRNA target sequence
ttgcctttagatgacgagattactac

SEQ ID NO: 9844 - DNA, 26 bp, Artificial sequence
  SiRNA target sequence
tgcctttagatgacgagattactacg

SEQ ID NO: 9845 - DNA, 26 bp, Artificial sequence
  SiRNA target sequence
gcctttagatgacgagattactacgc

SEQ ID NO: 9846 - DNA, 26 bp, Artificial sequence
  SiRNA target sequence
cctttagatgacgagattactacgct

SEQ ID NO: 9847 - DNA, 26 bp, Artificial sequence
  SiRNA target sequence
ctttagatgacgagattactacgctt

SEQ ID NO: 9848 - DNA, 26 bp, Artificial sequence
  SiRNA target sequence
tttagatgacgagattactacgcttt

SEQ ID NO: 9849 - DNA, 26 bp, Artificial sequence
  SiRNA target sequence
ttagatgacgagattactacgcttta

SEQ ID NO: 9850 - DNA, 26 bp, Artificial sequence
  SiRNA target sequence
tagatgacgagattactacgctttac

SEQ ID NO: 9851 - DNA, 26 bp, Artificial sequence
  SiRNA target sequence
agatgacgagattactacgctttact

SEQ ID NO: 9852 - DNA, 26 bp, Artificial sequence
  SiRNA target sequence
gatgacgagattactacgctttactt

SEQ ID NO: 9853 - DNA, 26 bp, Artificial sequence
  SiRNA target sequence
atgacgagattactacgctttacttg

SEQ ID NO: 9854 - DNA, 26 bp, Artificial sequence
  SiRNA target sequence
tgacgagattactacgctttacttgt

SEQ ID NO: 9855 - DNA, 26 bp, Artificial sequence
  SiRNA target sequence
gacgagattactacgctttacttgta

SEQ ID NO: 9856 - DNA, 26 bp, Artificial sequence
  SiRNA target sequence
acgagattactacgctttacttgtat

SEQ ID NO: 9857 - DNA, 26 bp, Artificial sequence
  SiRNA target sequence
cgagattactacgctttacttgtatt

SEQ ID NO: 9858 - DNA, 26 bp, Artificial sequence
  SiRNA target sequence
gagattactacgctttacttgtattc

SEQ ID NO: 9859 - DNA, 26 bp, Artificial sequence
  SiRNA target sequence
agattactacgctttacttgtattct

SEQ ID NO: 9860 - DNA, 26 bp, Artificial sequence
  SiRNA target sequence
gattactacgctttacttgtattcta

SEQ ID NO: 9861 - DNA, 26 bp, Artificial sequence
  SiRNA target sequence
attactacgctttacttgtattctaa

SEQ ID NO: 9862 - DNA, 26 bp, Artificial sequence
  SiRNA target sequence
ttactacgctttacttgtattctaag

SEQ ID NO: 9863 - DNA, 26 bp, Artificial sequence
  SiRNA target sequence
tactacgctttacttgtattctaaga

SEQ ID NO: 9864 - DNA, 26 bp, Artificial sequence
  SiRNA target sequence
actacgctttacttgtattctaagat

SEQ ID NO: 9865 - DNA, 26 bp, Artificial sequence
  SiRNA target sequence
ctacgctttacttgtattctaagatt

SEQ ID NO: 9866 - DNA, 26 bp, Artificial sequence
  SiRNA target sequence
tacgctttacttgtattctaagattt

SEQ ID NO: 9867 - DNA, 26 bp, Artificial sequence
  SiRNA target sequence
acgctttacttgtattctaagatttt

SEQ ID NO: 9868 - DNA, 26 bp, Artificial sequence
  SiRNA target sequence
cgctttacttgtattctaagattttt

SEQ ID NO: 9869 - DNA, 26 bp, Artificial sequence
  SiRNA target sequence
gctttacttgtattctaagattttta

SEQ ID NO: 9870 - DNA, 26 bp, Artificial sequence
  SiRNA target sequence
ctttacttgtattctaagatttttaa

SEQ ID NO: 9871 - DNA, 26 bp, Artificial sequence
  SiRNA target sequence
tttacttgtattctaagatttttaaa

SEQ ID NO: 9872 - DNA, 26 bp, Artificial sequence
  SiRNA target sequence
ttacttgtattctaagatttttaaag

SEQ ID NO: 9873 - DNA, 26 bp, Artificial sequence
  SiRNA target sequence
tacttgtattctaagatttttaaaga

SEQ ID NO: 9874 - DNA, 26 bp, Artificial sequence
  SiRNA target sequence
acttgtattctaagatttttaaagat

SEQ ID NO: 9875 - DNA, 26 bp, Artificial sequence
  SiRNA target sequence
cttgtattctaagatttttaaagata

SEQ ID NO: 9876 - DNA, 26 bp, Artificial sequence
  SiRNA target sequence
ttgtattctaagatttttaaagataa

SEQ ID NO: 9877 - DNA, 26 bp, Artificial sequence
  SiRNA target sequence
tgtattctaagatttttaaagataaa

SEQ ID NO: 9878 - DNA, 26 bp, Artificial sequence
  SiRNA target sequence
gtattctaagatttttaaagataaat

SEQ ID NO: 9879 - DNA, 26 bp, Artificial sequence
  SiRNA target sequence
tattctaagatttttaaagataaatc

SEQ ID NO: 9880 - DNA, 26 bp, Artificial sequence
  SiRNA target sequence
attctaagatttttaaagataaatct

SEQ ID NO: 9881 - DNA, 26 bp, Artificial sequence
  SiRNA target sequence
ttctaagatttttaaagataaatctg

SEQ ID NO: 9882 - DNA, 26 bp, Artificial sequence
  SiRNA target sequence
tctaagatttttaaagataaatctga

SEQ ID NO: 9883 - DNA, 26 bp, Artificial sequence
  SiRNA target sequence
ctaagatttttaaagataaatctgat

SEQ ID NO: 9884 - DNA, 26 bp, Artificial sequence
  SiRNA target sequence
taagatttttaaagataaatctgata

SEQ ID NO: 9885 - DNA, 26 bp, Artificial sequence
  SiRNA target sequence
aagatttttaaagataaatctgatac

SEQ ID NO: 9886 - DNA, 26 bp, Artificial sequence
  SiRNA target sequence
agatttttaaagataaatctgatact

SEQ ID NO: 9887 - DNA, 26 bp, Artificial sequence
  SiRNA target sequence
gatttttaaagataaatctgatactt

SEQ ID NO: 9888 - DNA, 26 bp, Artificial sequence
  SiRNA target sequence
atttttaaagataaatctgatactta

SEQ ID NO: 9889 - DNA, 26 bp, Artificial sequence
  SiRNA target sequence
tttttaaagataaatctgatacttac

SEQ ID NO: 9890 - DNA, 26 bp, Artificial sequence
  SiRNA target sequence
ttttaaagataaatctgatacttacc

SEQ ID NO: 9891 - DNA, 26 bp, Artificial sequence
  SiRNA target sequence
tttaaagataaatctgatacttacct

SEQ ID NO: 9892 - DNA, 26 bp, Artificial sequence
  SiRNA target sequence
ttaaagataaatctgatacttacctt

SEQ ID NO: 9893 - DNA, 26 bp, Artificial sequence
  SiRNA target sequence
taaagataaatctgatacttacctta

SEQ ID NO: 9894 - DNA, 26 bp, Artificial sequence
  SiRNA target sequence
aaagataaatctgatacttaccttaa

SEQ ID NO: 9895 - DNA, 26 bp, Artificial sequence
  SiRNA target sequence
aagataaatctgatacttaccttaaa

SEQ ID NO: 9896 - DNA, 26 bp, Artificial sequence
  SiRNA target sequence
agataaatctgatacttaccttaaat

SEQ ID NO: 9897 - DNA, 26 bp, Artificial sequence
  SiRNA target sequence
gataaatctgatacttaccttaaatc

SEQ ID NO: 9898 - DNA, 26 bp, Artificial sequence
  SiRNA target sequence
ataaatctgatacttaccttaaatct

SEQ ID NO: 9899 - DNA, 26 bp, Artificial sequence
  SiRNA target sequence
taaatctgatacttaccttaaatctg

SEQ ID NO: 9900 - DNA, 26 bp, Artificial sequence
  SiRNA target sequence
aaatctgatacttaccttaaatctgc

SEQ ID NO: 9901 - DNA, 26 bp, Artificial sequence
  SiRNA target sequence
aatctgatacttaccttaaatctgct

SEQ ID NO: 9902 - DNA, 26 bp, Artificial sequence
  SiRNA target sequence
atctgatacttaccttaaatctgcta

SEQ ID NO: 9903 - DNA, 26 bp, Artificial sequence
  SiRNA target sequence
tctgatacttaccttaaatctgctat

SEQ ID NO: 9904 - DNA, 26 bp, Artificial sequence
  SiRNA target sequence
ctgatacttaccttaaatctgctata

SEQ ID NO: 9905 - DNA, 26 bp, Artificial sequence
  SiRNA target sequence
tgatacttaccttaaatctgctatag

SEQ ID NO: 9906 - DNA, 26 bp, Artificial sequence
  SiRNA target sequence
gatacttaccttaaatctgctataga

SEQ ID NO: 9907 - DNA, 26 bp, Artificial sequence
  SiRNA target sequence
atacttaccttaaatctgctatagat

SEQ ID NO: 9908 - DNA, 26 bp, Artificial sequence
  SiRNA target sequence
tacttaccttaaatctgctatagata

SEQ ID NO: 9909 - DNA, 26 bp, Artificial sequence
  SiRNA target sequence
acttaccttaaatctgctatagataa

SEQ ID NO: 9910 - DNA, 26 bp, Artificial sequence
  SiRNA target sequence
cttaccttaaatctgctatagataaa

SEQ ID NO: 9911 - DNA, 26 bp, Artificial sequence
  SiRNA target sequence
ttaccttaaatctgctatagataaat

SEQ ID NO: 9912 - DNA, 26 bp, Artificial sequence
  SiRNA target sequence
taccttaaatctgctatagataaatc

SEQ ID NO: 9913 - DNA, 26 bp, Artificial sequence
  SiRNA target sequence
accttaaatctgctatagataaatca

SEQ ID NO: 9914 - DNA, 26 bp, Artificial sequence
  SiRNA target sequence
ccttaaatctgctatagataaatcag

SEQ ID NO: 9915 - DNA, 26 bp, Artificial sequence
  SiRNA target sequence
cttaaatctgctatagataaatcagt

SEQ ID NO: 9916 - DNA, 26 bp, Artificial sequence
  SiRNA target sequence
ttaaatctgctatagataaatcagta

SEQ ID NO: 9917 - DNA, 26 bp, Artificial sequence
  SiRNA target sequence
taaatctgctatagataaatcagtag

SEQ ID NO: 9918 - DNA, 26 bp, Artificial sequence
  SiRNA target sequence
aaatctgctatagataaatcagtaga

SEQ ID NO: 9919 - DNA, 26 bp, Artificial sequence
  SiRNA target sequence
aatctgctatagataaatcagtagat

SEQ ID NO: 9920 - DNA, 26 bp, Artificial sequence
  SiRNA target sequence
atctgctatagataaatcagtagatc

SEQ ID NO: 9921 - DNA, 26 bp, Artificial sequence
  SiRNA target sequence
tctgctatagataaatcagtagatct

SEQ ID NO: 9922 - DNA, 26 bp, Artificial sequence
  SiRNA target sequence
ctgctatagataaatcagtagatcta

SEQ ID NO: 9923 - DNA, 26 bp, Artificial sequence
  SiRNA target sequence
tgctatagataaatcagtagatctac

SEQ ID NO: 9924 - DNA, 26 bp, Artificial sequence
  SiRNA target sequence
gctatagataaatcagtagatctacc

SEQ ID NO: 9925 - DNA, 26 bp, Artificial sequence
  SiRNA target sequence
ctatagataaatcagtagatctacct

SEQ ID NO: 9926 - DNA, 26 bp, Artificial sequence
  SiRNA target sequence
tatagataaatcagtagatctaccta

SEQ ID NO: 9927 - DNA, 26 bp, Artificial sequence
  SiRNA target sequence
atagataaatcagtagatctacctat

SEQ ID NO: 9928 - DNA, 26 bp, Artificial sequence
  SiRNA target sequence
tagataaatcagtagatctacctatt

SEQ ID NO: 9929 - DNA, 26 bp, Artificial sequence
  SiRNA target sequence
agataaatcagtagatctacctattg

SEQ ID NO: 9930 - DNA, 26 bp, Artificial sequence
  SiRNA target sequence
gataaatcagtagatctacctattga

SEQ ID NO: 9931 - DNA, 26 bp, Artificial sequence
  SiRNA target sequence
ataaatcagtagatctacctattgaa

SEQ ID NO: 9932 - DNA, 26 bp, Artificial sequence
  SiRNA target sequence
taaatcagtagatctacctattgaac

SEQ ID NO: 9933 - DNA, 26 bp, Artificial sequence
  SiRNA target sequence
aaatcagtagatctacctattgaaca

SEQ ID NO: 9934 - DNA, 26 bp, Artificial sequence
  SiRNA target sequence
aatcagtagatctacctattgaacag

SEQ ID NO: 9935 - DNA, 26 bp, Artificial sequence
  SiRNA target sequence
atcagtagatctacctattgaacaga

SEQ ID NO: 9936 - DNA, 26 bp, Artificial sequence
  SiRNA target sequence
tcagtagatctacctattgaacagaa

SEQ ID NO: 9937 - DNA, 26 bp, Artificial sequence
  SiRNA target sequence
cagtagatctacctattgaacagaaa

SEQ ID NO: 9938 - DNA, 26 bp, Artificial sequence
  SiRNA target sequence
agtagatctacctattgaacagaaag

SEQ ID NO: 9939 - DNA, 26 bp, Artificial sequence
  SiRNA target sequence
gtagatctacctattgaacagaaaga

SEQ ID NO: 9940 - DNA, 26 bp, Artificial sequence
  SiRNA target sequence
tagatctacctattgaacagaaagac

SEQ ID NO: 9941 - DNA, 26 bp, Artificial sequence
  SiRNA target sequence
agatctacctattgaacagaaagact

SEQ ID NO: 9942 - DNA, 26 bp, Artificial sequence
  SiRNA target sequence
gatctacctattgaacagaaagactt

SEQ ID NO: 9943 - DNA, 26 bp, Artificial sequence
  SiRNA target sequence
atctacctattgaacagaaagacttt

SEQ ID NO: 9944 - DNA, 26 bp, Artificial sequence
  SiRNA target sequence
tctacctattgaacagaaagactttc

SEQ ID NO: 9945 - DNA, 26 bp, Artificial sequence
  SiRNA target sequence
ctacctattgaacagaaagactttct

SEQ ID NO: 9946 - DNA, 26 bp, Artificial sequence
  SiRNA target sequence
tacctattgaacagaaagactttctg

SEQ ID NO: 9947 - DNA, 26 bp, Artificial sequence
  SiRNA target sequence
acctattgaacagaaagactttctgt

SEQ ID NO: 9948 - DNA, 26 bp, Artificial sequence
  SiRNA target sequence
cctattgaacagaaagactttctgta

SEQ ID NO: 9949 - DNA, 26 bp, Artificial sequence
  SiRNA target sequence
ctattgaacagaaagactttctgtac

SEQ ID NO: 9950 - DNA, 26 bp, Artificial sequence
  SiRNA target sequence
tattgaacagaaagactttctgtacg

SEQ ID NO: 9951 - DNA, 26 bp, Artificial sequence
  SiRNA target sequence
attgaacagaaagactttctgtacgt

SEQ ID NO: 9952 - DNA, 26 bp, Artificial sequence
  SiRNA target sequence
ttgaacagaaagactttctgtacgta

SEQ ID NO: 9953 - DNA, 26 bp, Artificial sequence
  SiRNA target sequence
tgaacagaaagactttctgtacgtag

SEQ ID NO: 9954 - DNA, 26 bp, Artificial sequence
  SiRNA target sequence
gaacagaaagactttctgtacgtaga

SEQ ID NO: 9955 - DNA, 26 bp, Artificial sequence
  SiRNA target sequence
aacagaaagactttctgtacgtagat

SEQ ID NO: 9956 - DNA, 26 bp, Artificial sequence
  SiRNA target sequence
acagaaagactttctgtacgtagatc

SEQ ID NO: 9957 - DNA, 26 bp, Artificial sequence
  SiRNA target sequence
cagaaagactttctgtacgtagatct

SEQ ID NO: 9958 - DNA, 26 bp, Artificial sequence
  SiRNA target sequence
agaaagactttctgtacgtagatctt

SEQ ID NO: 9959 - DNA, 26 bp, Artificial sequence
  SiRNA target sequence
gaaagactttctgtacgtagatcttc

SEQ ID NO: 9960 - DNA, 26 bp, Artificial sequence
  SiRNA target sequence
aaagactttctgtacgtagatcttct

SEQ ID NO: 9961 - DNA, 26 bp, Artificial sequence
  SiRNA target sequence
aagactttctgtacgtagatcttctt

SEQ ID NO: 9962 - DNA, 26 bp, Artificial sequence
  SiRNA target sequence
agactttctgtacgtagatcttcttg

SEQ ID NO: 9963 - DNA, 26 bp, Artificial sequence
  SiRNA target sequence
gactttctgtacgtagatcttcttgt

SEQ ID NO: 9964 - DNA, 26 bp, Artificial sequence
  SiRNA target sequence
actttctgtacgtagatcttcttgta

SEQ ID NO: 9965 - DNA, 26 bp, Artificial sequence
  SiRNA target sequence
ctttctgtacgtagatcttcttgtat

SEQ ID NO: 9966 - DNA, 26 bp, Artificial sequence
  SiRNA target sequence
tttctgtacgtagatcttcttgtatt

SEQ ID NO: 9967 - DNA, 26 bp, Artificial sequence
  SiRNA target sequence
ttctgtacgtagatcttcttgtattt

SEQ ID NO: 9968 - DNA, 26 bp, Artificial sequence
  SiRNA target sequence
tctgtacgtagatcttcttgtatttt

SEQ ID NO: 9969 - DNA, 26 bp, Artificial sequence
  SiRNA target sequence
ctgtacgtagatcttcttgtatttta

SEQ ID NO: 9970 - DNA, 26 bp, Artificial sequence
  SiRNA target sequence
tgtacgtagatcttcttgtattttac

SEQ ID NO: 9971 - DNA, 26 bp, Artificial sequence
  SiRNA target sequence
gtacgtagatcttcttgtattttaca

SEQ ID NO: 9972 - DNA, 26 bp, Artificial sequence
  SiRNA target sequence
tacgtagatcttcttgtattttacat

SEQ ID NO: 9973 - DNA, 26 bp, Artificial sequence
  SiRNA target sequence
acgtagatcttcttgtattttacatt

SEQ ID NO: 9974 - DNA, 26 bp, Artificial sequence
  SiRNA target sequence
cgtagatcttcttgtattttacattt

SEQ ID NO: 9975 - DNA, 26 bp, Artificial sequence
  SiRNA target sequence
gtagatcttcttgtattttacatttc

SEQ ID NO: 9976 - DNA, 26 bp, Artificial sequence
  SiRNA target sequence
tagatcttcttgtattttacatttct

SEQ ID NO: 9977 - DNA, 26 bp, Artificial sequence
  SiRNA target sequence
agatcttcttgtattttacatttcta

SEQ ID NO: 9978 - DNA, 26 bp, Artificial sequence
  SiRNA target sequence
gatcttcttgtattttacatttctaa

SEQ ID NO: 9979 - DNA, 26 bp, Artificial sequence
  SiRNA target sequence
atcttcttgtattttacatttctaaa

SEQ ID NO: 9980 - DNA, 26 bp, Artificial sequence
  SiRNA target sequence
tcttcttgtattttacatttctaaaa

SEQ ID NO: 9981 - DNA, 26 bp, Artificial sequence
  SiRNA target sequence
cttcttgtattttacatttctaaaaa

SEQ ID NO: 9982 - DNA, 26 bp, Artificial sequence
  SiRNA target sequence
ttcttgtattttacatttctaaaaag

SEQ ID NO: 9983 - DNA, 26 bp, Artificial sequence
  SiRNA target sequence
tcttgtattttacatttctaaaaagg

SEQ ID NO: 9984 - DNA, 26 bp, Artificial sequence
  SiRNA target sequence
cttgtattttacatttctaaaaagga

SEQ ID NO: 9985 - DNA, 26 bp, Artificial sequence
  SiRNA target sequence
ttgtattttacatttctaaaaaggat

SEQ ID NO: 9986 - DNA, 26 bp, Artificial sequence
  SiRNA target sequence
tgtattttacatttctaaaaaggatg

SEQ ID NO: 9987 - DNA, 26 bp, Artificial sequence
  SiRNA target sequence
gtattttacatttctaaaaaggatgt

SEQ ID NO: 9988 - DNA, 26 bp, Artificial sequence
  SiRNA target sequence
tattttacatttctaaaaaggatgtt

SEQ ID NO: 9989 - DNA, 26 bp, Artificial sequence
  SiRNA target sequence
attttacatttctaaaaaggatgttg

SEQ ID NO: 9990 - DNA, 26 bp, Artificial sequence
  SiRNA target sequence
ttttacatttctaaaaaggatgttga

SEQ ID NO: 9991 - DNA, 26 bp, Artificial sequence
  SiRNA target sequence
tttacatttctaaaaaggatgttgaa

SEQ ID NO: 9992 - DNA, 26 bp, Artificial sequence
  SiRNA target sequence
ttacatttctaaaaaggatgttgaaa

SEQ ID NO: 9993 - DNA, 26 bp, Artificial sequence
  SiRNA target sequence
tacatttctaaaaaggatgttgaaaa

SEQ ID NO: 9994 - DNA, 26 bp, Artificial sequence
  SiRNA target sequence
acatttctaaaaaggatgttgaaaaa

SEQ ID NO: 9995 - DNA, 26 bp, Artificial sequence
  SiRNA target sequence
catttctaaaaaggatgttgaaaaag

SEQ ID NO: 9996 - DNA, 26 bp, Artificial sequence
  SiRNA target sequence
atttctaaaaaggatgttgaaaaagt

SEQ ID NO: 9997 - DNA, 26 bp, Artificial sequence
  SiRNA target sequence
tttctaaaaaggatgttgaaaaagtt

SEQ ID NO: 9998 - DNA, 26 bp, Artificial sequence
  SiRNA target sequence
ttctaaaaaggatgttgaaaaagtta

SEQ ID NO: 9999 - DNA, 26 bp, Artificial sequence
  SiRNA target sequence
tctaaaaaggatgttgaaaaagttaa

SEQ ID NO: 10000 - DNA, 26 bp, Artificial sequence
  SiRNA target sequence
ctaaaaaggatgttgaaaaagttaat

SEQ ID NO: 10001 - DNA, 26 bp, Artificial sequence
  SiRNA target sequence
taaaaaggatgttgaaaaagttaatg

SEQ ID NO: 10002 - DNA, 26 bp, Artificial sequence
  SiRNA target sequence
aaaaaggatgttgaaaaagttaatga

SEQ ID NO: 10003 - DNA, 26 bp, Artificial sequence
  SiRNA target sequence
aaaaggatgttgaaaaagttaatgaa

SEQ ID NO: 10004 - DNA, 26 bp, Artificial sequence
  SiRNA target sequence
aaaggatgttgaaaaagttaatgaaa

SEQ ID NO: 10005 - DNA, 26 bp, Artificial sequence
  SiRNA target sequence
aaggatgttgaaaaagttaatgaaac

SEQ ID NO: 10006 - DNA, 26 bp, Artificial sequence
  SiRNA target sequence
aggatgttgaaaaagttaatgaaaca

SEQ ID NO: 10007 - DNA, 26 bp, Artificial sequence
  SiRNA target sequence
ggatgttgaaaaagttaatgaaacaa

SEQ ID NO: 10008 - DNA, 26 bp, Artificial sequence
  SiRNA target sequence
gatgttgaaaaagttaatgaaacaat

SEQ ID NO: 10009 - DNA, 26 bp, Artificial sequence
  SiRNA target sequence
atgttgaaaaagttaatgaaacaatt

SEQ ID NO: 10010 - DNA, 26 bp, Artificial sequence
  SiRNA target sequence
tgttgaaaaagttaatgaaacaatta

SEQ ID NO: 10011 - DNA, 26 bp, Artificial sequence
  SiRNA target sequence
gttgaaaaagttaatgaaacaattaa

SEQ ID NO: 10012 - DNA, 26 bp, Artificial sequence
  SiRNA target sequence
ttgaaaaagttaatgaaacaattaat

SEQ ID NO: 10013 - DNA, 26 bp, Artificial sequence
  SiRNA target sequence
tgaaaaagttaatgaaacaattaata

SEQ ID NO: 10014 - DNA, 26 bp, Artificial sequence
  SiRNA target sequence
gaaaaagttaatgaaacaattaataa

SEQ ID NO: 10015 - DNA, 26 bp, Artificial sequence
  SiRNA target sequence
aaaaagttaatgaaacaattaataat

SEQ ID NO: 10016 - DNA, 26 bp, Artificial sequence
  SiRNA target sequence
aaaagttaatgaaacaattaataatt

SEQ ID NO: 10017 - DNA, 26 bp, Artificial sequence
  SiRNA target sequence
aaagttaatgaaacaattaataattt

SEQ ID NO: 10018 - DNA, 26 bp, Artificial sequence
  SiRNA target sequence
aagttaatgaaacaattaataattta

SEQ ID NO: 10019 - DNA, 26 bp, Artificial sequence
  SiRNA target sequence
agttaatgaaacaattaataatttaa

SEQ ID NO: 10020 - DNA, 26 bp, Artificial sequence
  SiRNA target sequence
gttaatgaaacaattaataatttaaa

SEQ ID NO: 10021 - DNA, 26 bp, Artificial sequence
  SiRNA target sequence
ttaatgaaacaattaataatttaaaa

SEQ ID NO: 10022 - DNA, 26 bp, Artificial sequence
  SiRNA target sequence
taatgaaacaattaataatttaaaag

SEQ ID NO: 10023 - DNA, 26 bp, Artificial sequence
  SiRNA target sequence
aatgaaacaattaataatttaaaaga

SEQ ID NO: 10024 - DNA, 26 bp, Artificial sequence
  SiRNA target sequence
atgaaacaattaataatttaaaagag

SEQ ID NO: 10025 - DNA, 26 bp, Artificial sequence
  SiRNA target sequence
tgaaacaattaataatttaaaagaga

SEQ ID NO: 10026 - DNA, 26 bp, Artificial sequence
  SiRNA target sequence
gaaacaattaataatttaaaagagac

SEQ ID NO: 10027 - DNA, 26 bp, Artificial sequence
  SiRNA target sequence
aaacaattaataatttaaaagagact

SEQ ID NO: 10028 - DNA, 26 bp, Artificial sequence
  SiRNA target sequence
aacaattaataatttaaaagagactc

SEQ ID NO: 10029 - DNA, 26 bp, Artificial sequence
  SiRNA target sequence
acaattaataatttaaaagagactct

SEQ ID NO: 10030 - DNA, 26 bp, Artificial sequence
  SiRNA target sequence
caattaataatttaaaagagactctt

SEQ ID NO: 10031 - DNA, 26 bp, Artificial sequence
  SiRNA target sequence
aattaataatttaaaagagactctta

SEQ ID NO: 10032 - DNA, 26 bp, Artificial sequence
  SiRNA target sequence
attaataatttaaaagagactcttac

SEQ ID NO: 10033 - DNA, 26 bp, Artificial sequence
  SiRNA target sequence
ttaataatttaaaagagactcttacc

SEQ ID NO: 10034 - DNA, 26 bp, Artificial sequence
  SiRNA target sequence
taataatttaaaagagactcttaccc

SEQ ID NO: 10035 - DNA, 26 bp, Artificial sequence
  SiRNA target sequence
aataatttaaaagagactcttacccc

SEQ ID NO: 10036 - DNA, 26 bp, Artificial sequence
  SiRNA target sequence
ataatttaaaagagactcttaccccc

SEQ ID NO: 10037 - DNA, 26 bp, Artificial sequence
  SiRNA target sequence
taatttaaaagagactcttaccccca

SEQ ID NO: 10038 - DNA, 26 bp, Artificial sequence
  SiRNA target sequence
aatttaaaagagactcttacccccac

SEQ ID NO: 10039 - DNA, 26 bp, Artificial sequence
  SiRNA target sequence
atttaaaagagactcttacccccact

SEQ ID NO: 10040 - DNA, 26 bp, Artificial sequence
  SiRNA target sequence
tttaaaagagactcttacccccactt

SEQ ID NO: 10041 - DNA, 26 bp, Artificial sequence
  SiRNA target sequence
ttaaaagagactcttacccccacttt

SEQ ID NO: 10042 - DNA, 26 bp, Artificial sequence
  SiRNA target sequence
taaaagagactcttacccccacttta

SEQ ID NO: 10043 - DNA, 26 bp, Artificial sequence
  SiRNA target sequence
aaaagagactcttacccccactttat

SEQ ID NO: 10044 - DNA, 26 bp, Artificial sequence
  SiRNA target sequence
aaagagactcttacccccactttatt

SEQ ID NO: 10045 - DNA, 26 bp, Artificial sequence
  SiRNA target sequence
aagagactcttacccccactttattg

SEQ ID NO: 10046 - DNA, 26 bp, Artificial sequence
  SiRNA target sequence
agagactcttacccccactttattgg

SEQ ID NO: 10047 - DNA, 26 bp, Artificial sequence
  SiRNA target sequence
gagactcttacccccactttattgga

SEQ ID NO: 10048 - DNA, 26 bp, Artificial sequence
  SiRNA target sequence
agactcttacccccactttattggaa

SEQ ID NO: 10049 - DNA, 26 bp, Artificial sequence
  SiRNA target sequence
gactcttacccccactttattggaac

SEQ ID NO: 10050 - DNA, 26 bp, Artificial sequence
  SiRNA target sequence
actcttacccccactttattggaact

SEQ ID NO: 10051 - DNA, 26 bp, Artificial sequence
  SiRNA target sequence
ctcttacccccactttattggaactt

SEQ ID NO: 10052 - DNA, 26 bp, Artificial sequence
  SiRNA target sequence
tcttacccccactttattggaactta

SEQ ID NO: 10053 - DNA, 26 bp, Artificial sequence
  SiRNA target sequence
cttacccccactttattggaacttat

SEQ ID NO: 10054 - DNA, 26 bp, Artificial sequence
  SiRNA target sequence
ttacccccactttattggaacttatt

SEQ ID NO: 10055 - DNA, 26 bp, Artificial sequence
  SiRNA target sequence
tacccccactttattggaacttattg

SEQ ID NO: 10056 - DNA, 26 bp, Artificial sequence
  SiRNA target sequence
acccccactttattggaacttattgg

SEQ ID NO: 10057 - DNA, 26 bp, Artificial sequence
  SiRNA target sequence
cccccactttattggaacttattgga

SEQ ID NO: 10058 - DNA, 26 bp, Artificial sequence
  SiRNA target sequence
ccccactttattggaacttattggag

SEQ ID NO: 10059 - DNA, 26 bp, Artificial sequence
  SiRNA target sequence
cccactttattggaacttattggaga

SEQ ID NO: 10060 - DNA, 26 bp, Artificial sequence
  SiRNA target sequence
ccactttattggaacttattggagaa

SEQ ID NO: 10061 - DNA, 26 bp, Artificial sequence
  SiRNA target sequence
cactttattggaacttattggagaat

SEQ ID NO: 10062 - DNA, 26 bp, Artificial sequence
  SiRNA target sequence
actttattggaacttattggagaata

SEQ ID NO: 10063 - DNA, 26 bp, Artificial sequence
  SiRNA target sequence
ctttattggaacttattggagaatat

SEQ ID NO: 10064 - DNA, 26 bp, Artificial sequence
  SiRNA target sequence
tttattggaacttattggagaatatt

SEQ ID NO: 10065 - DNA, 26 bp, Artificial sequence
  SiRNA target sequence
ttattggaacttattggagaatatta

SEQ ID NO: 10066 - DNA, 26 bp, Artificial sequence
  SiRNA target sequence
tattggaacttattggagaatattat

SEQ ID NO: 10067 - DNA, 26 bp, Artificial sequence
  SiRNA target sequence
attggaacttattggagaatattatt

SEQ ID NO: 10068 - DNA, 26 bp, Artificial sequence
  SiRNA target sequence
ttggaacttattggagaatattattt

SEQ ID NO: 10069 - DNA, 26 bp, Artificial sequence
  SiRNA target sequence
tggaacttattggagaatattattta

SEQ ID NO: 10070 - DNA, 26 bp, Artificial sequence
  SiRNA target sequence
ggaacttattggagaatattatttaa

SEQ ID NO: 10071 - DNA, 26 bp, Artificial sequence
  SiRNA target sequence
gaacttattggagaatattatttaaa

SEQ ID NO: 10072 - DNA, 26 bp, Artificial sequence
  SiRNA target sequence
aacttattggagaatattatttaaaa

SEQ ID NO: 10073 - DNA, 26 bp, Artificial sequence
  SiRNA target sequence
acttattggagaatattatttaaaaa

SEQ ID NO: 10074 - DNA, 26 bp, Artificial sequence
  SiRNA target sequence
cttattggagaatattatttaaaaag

SEQ ID NO: 10075 - DNA, 26 bp, Artificial sequence
  SiRNA target sequence
ttattggagaatattatttaaaaagt

SEQ ID NO: 10076 - DNA, 26 bp, Artificial sequence
  SiRNA target sequence
tattggagaatattatttaaaaagtg

SEQ ID NO: 10077 - DNA, 26 bp, Artificial sequence
  SiRNA target sequence
attggagaatattatttaaaaagtgg

SEQ ID NO: 10078 - DNA, 26 bp, Artificial sequence
  SiRNA target sequence
ttggagaatattatttaaaaagtgga

SEQ ID NO: 10079 - DNA, 26 bp, Artificial sequence
  SiRNA target sequence
tggagaatattatttaaaaagtggaa

SEQ ID NO: 10080 - DNA, 26 bp, Artificial sequence
  SiRNA target sequence
ggagaatattatttaaaaagtggaaa

SEQ ID NO: 10081 - DNA, 26 bp, Artificial sequence
  SiRNA target sequence
gagaatattatttaaaaagtggaaat

SEQ ID NO: 10082 - DNA, 26 bp, Artificial sequence
  SiRNA target sequence
agaatattatttaaaaagtggaaatc

SEQ ID NO: 10083 - DNA, 26 bp, Artificial sequence
  SiRNA target sequence
gaatattatttaaaaagtggaaatca

SEQ ID NO: 10084 - DNA, 26 bp, Artificial sequence
  SiRNA target sequence
aatattatttaaaaagtggaaatcac

SEQ ID NO: 10085 - DNA, 26 bp, Artificial sequence
  SiRNA target sequence
atattatttaaaaagtggaaatcact

SEQ ID NO: 10086 - DNA, 26 bp, Artificial sequence
  SiRNA target sequence
tattatttaaaaagtggaaatcactc

SEQ ID NO: 10087 - DNA, 26 bp, Artificial sequence
  SiRNA target sequence
attatttaaaaagtggaaatcactct

SEQ ID NO: 10088 - DNA, 26 bp, Artificial sequence
  SiRNA target sequence
ttatttaaaaagtggaaatcactcta

SEQ ID NO: 10089 - DNA, 26 bp, Artificial sequence
  SiRNA target sequence
tatttaaaaagtggaaatcactctaa

SEQ ID NO: 10090 - DNA, 26 bp, Artificial sequence
  SiRNA target sequence
atttaaaaagtggaaatcactctaaa

SEQ ID NO: 10091 - DNA, 26 bp, Artificial sequence
  SiRNA target sequence
tttaaaaagtggaaatcactctaaaa

SEQ ID NO: 10092 - DNA, 26 bp, Artificial sequence
  SiRNA target sequence
ttaaaaagtggaaatcactctaaaat

SEQ ID NO: 10093 - DNA, 26 bp, Artificial sequence
  SiRNA target sequence
taaaaagtggaaatcactctaaaatg

SEQ ID NO: 10094 - DNA, 26 bp, Artificial sequence
  SiRNA target sequence
aaaaagtggaaatcactctaaaatgt

SEQ ID NO: 10095 - DNA, 26 bp, Artificial sequence
  SiRNA target sequence
aaaagtggaaatcactctaaaatgtt

SEQ ID NO: 10096 - DNA, 26 bp, Artificial sequence
  SiRNA target sequence
aaagtggaaatcactctaaaatgtta

SEQ ID NO: 10097 - DNA, 26 bp, Artificial sequence
  SiRNA target sequence
aagtggaaatcactctaaaatgttag

SEQ ID NO: 10098 - DNA, 26 bp, Artificial sequence
  SiRNA target sequence
agtggaaatcactctaaaatgttaga

SEQ ID NO: 10099 - DNA, 26 bp, Artificial sequence
  SiRNA target sequence
gtggaaatcactctaaaatgttagat

SEQ ID NO: 10100 - DNA, 26 bp, Artificial sequence
  SiRNA target sequence
tggaaatcactctaaaatgttagatc

SEQ ID NO: 10101 - DNA, 26 bp, Artificial sequence
  SiRNA target sequence
ggaaatcactctaaaatgttagatct

SEQ ID NO: 10102 - DNA, 26 bp, Artificial sequence
  SiRNA target sequence
gaaatcactctaaaatgttagatcta

SEQ ID NO: 10103 - DNA, 26 bp, Artificial sequence
  SiRNA target sequence
aaatcactctaaaatgttagatctat

SEQ ID NO: 10104 - DNA, 26 bp, Artificial sequence
  SiRNA target sequence
aatcactctaaaatgttagatctatt

SEQ ID NO: 10105 - DNA, 26 bp, Artificial sequence
  SiRNA target sequence
atcactctaaaatgttagatctatta

SEQ ID NO: 10106 - DNA, 26 bp, Artificial sequence
  SiRNA target sequence
tcactctaaaatgttagatctattat

SEQ ID NO: 10107 - DNA, 26 bp, Artificial sequence
  SiRNA target sequence
cactctaaaatgttagatctattatc

SEQ ID NO: 10108 - DNA, 26 bp, Artificial sequence
  SiRNA target sequence
actctaaaatgttagatctattatct

SEQ ID NO: 10109 - DNA, 26 bp, Artificial sequence
  SiRNA target sequence
ctctaaaatgttagatctattatcta

SEQ ID NO: 10110 - DNA, 26 bp, Artificial sequence
  SiRNA target sequence
tctaaaatgttagatctattatctag

SEQ ID NO: 10111 - DNA, 26 bp, Artificial sequence
  SiRNA target sequence
ctaaaatgttagatctattatctagt

SEQ ID NO: 10112 - DNA, 26 bp, Artificial sequence
  SiRNA target sequence
taaaatgttagatctattatctagtc

SEQ ID NO: 10113 - DNA, 26 bp, Artificial sequence
  SiRNA target sequence
aaaatgttagatctattatctagtca

SEQ ID NO: 10114 - DNA, 26 bp, Artificial sequence
  SiRNA target sequence
aaatgttagatctattatctagtcat

SEQ ID NO: 10115 - DNA, 26 bp, Artificial sequence
  SiRNA target sequence
aatgttagatctattatctagtcatc

SEQ ID NO: 10116 - DNA, 26 bp, Artificial sequence
  SiRNA target sequence
atgttagatctattatctagtcatcc

SEQ ID NO: 10117 - DNA, 26 bp, Artificial sequence
  SiRNA target sequence
tgttagatctattatctagtcatcca

SEQ ID NO: 10118 - DNA, 26 bp, Artificial sequence
  SiRNA target sequence
gttagatctattatctagtcatccag

SEQ ID NO: 10119 - DNA, 26 bp, Artificial sequence
  SiRNA target sequence
ttagatctattatctagtcatccaga

SEQ ID NO: 10120 - DNA, 26 bp, Artificial sequence
  SiRNA target sequence
tagatctattatctagtcatccagat

SEQ ID NO: 10121 - DNA, 26 bp, Artificial sequence
  SiRNA target sequence
agatctattatctagtcatccagata

SEQ ID NO: 10122 - DNA, 26 bp, Artificial sequence
  SiRNA target sequence
gatctattatctagtcatccagatac

SEQ ID NO: 10123 - DNA, 26 bp, Artificial sequence
  SiRNA target sequence
atctattatctagtcatccagatact

SEQ ID NO: 10124 - DNA, 26 bp, Artificial sequence
  SiRNA target sequence
tctattatctagtcatccagatactc

SEQ ID NO: 10125 - DNA, 26 bp, Artificial sequence
  SiRNA target sequence
ctattatctagtcatccagatactcc

SEQ ID NO: 10126 - DNA, 26 bp, Artificial sequence
  SiRNA target sequence
tattatctagtcatccagatactcct

SEQ ID NO: 10127 - DNA, 26 bp, Artificial sequence
  SiRNA target sequence
attatctagtcatccagatactcctg

SEQ ID NO: 10128 - DNA, 26 bp, Artificial sequence
  SiRNA target sequence
ttatctagtcatccagatactcctgg

SEQ ID NO: 10129 - DNA, 26 bp, Artificial sequence
  SiRNA target sequence
tatctagtcatccagatactcctggt

SEQ ID NO: 10130 - DNA, 26 bp, Artificial sequence
  SiRNA target sequence
atctagtcatccagatactcctggta

SEQ ID NO: 10131 - DNA, 26 bp, Artificial sequence
  SiRNA target sequence
tctagtcatccagatactcctggtaa

SEQ ID NO: 10132 - DNA, 26 bp, Artificial sequence
  SiRNA target sequence
ctagtcatccagatactcctggtaaa

SEQ ID NO: 10133 - DNA, 26 bp, Artificial sequence
  SiRNA target sequence
tagtcatccagatactcctggtaaat

SEQ ID NO: 10134 - DNA, 26 bp, Artificial sequence
  SiRNA target sequence
agtcatccagatactcctggtaaatt

SEQ ID NO: 10135 - DNA, 26 bp, Artificial sequence
  SiRNA target sequence
gtcatccagatactcctggtaaatta

SEQ ID NO: 10136 - DNA, 26 bp, Artificial sequence
  SiRNA target sequence
tcatccagatactcctggtaaattac

SEQ ID NO: 10137 - DNA, 26 bp, Artificial sequence
  SiRNA target sequence
catccagatactcctggtaaattact

SEQ ID NO: 10138 - DNA, 26 bp, Artificial sequence
  SiRNA target sequence
atccagatactcctggtaaattactt

SEQ ID NO: 10139 - DNA, 26 bp, Artificial sequence
  SiRNA target sequence
tccagatactcctggtaaattacttt

SEQ ID NO: 10140 - DNA, 26 bp, Artificial sequence
  SiRNA target sequence
ccagatactcctggtaaattactttt

SEQ ID NO: 10141 - DNA, 26 bp, Artificial sequence
  SiRNA target sequence
cagatactcctggtaaattactttta

SEQ ID NO: 10142 - DNA, 26 bp, Artificial sequence
  SiRNA target sequence
agatactcctggtaaattacttttaa

SEQ ID NO: 10143 - DNA, 26 bp, Artificial sequence
  SiRNA target sequence
gatactcctggtaaattacttttaac

SEQ ID NO: 10144 - DNA, 26 bp, Artificial sequence
  SiRNA target sequence
atactcctggtaaattacttttaacg

SEQ ID NO: 10145 - DNA, 26 bp, Artificial sequence
  SiRNA target sequence
tactcctggtaaattacttttaacgg

SEQ ID NO: 10146 - DNA, 26 bp, Artificial sequence
  SiRNA target sequence
actcctggtaaattacttttaacggc

SEQ ID NO: 10147 - DNA, 26 bp, Artificial sequence
  SiRNA target sequence
ctcctggtaaattacttttaacggca

SEQ ID NO: 10148 - DNA, 26 bp, Artificial sequence
  SiRNA target sequence
tcctggtaaattacttttaacggcac

SEQ ID NO: 10149 - DNA, 26 bp, Artificial sequence
  SiRNA target sequence
cctggtaaattacttttaacggcact

SEQ ID NO: 10150 - DNA, 26 bp, Artificial sequence
  SiRNA target sequence
ctggtaaattacttttaacggcactt

SEQ ID NO: 10151 - DNA, 26 bp, Artificial sequence
  SiRNA target sequence
tggtaaattacttttaacggcacttt

SEQ ID NO: 10152 - DNA, 26 bp, Artificial sequence
  SiRNA target sequence
ggtaaattacttttaacggcacttta

SEQ ID NO: 10153 - DNA, 26 bp, Artificial sequence
  SiRNA target sequence
gtaaattacttttaacggcactttat

SEQ ID NO: 10154 - DNA, 26 bp, Artificial sequence
  SiRNA target sequence
taaattacttttaacggcactttatg

SEQ ID NO: 10155 - DNA, 26 bp, Artificial sequence
  SiRNA target sequence
aaattacttttaacggcactttatgc

SEQ ID NO: 10156 - DNA, 26 bp, Artificial sequence
  SiRNA target sequence
aattacttttaacggcactttatgca

SEQ ID NO: 10157 - DNA, 26 bp, Artificial sequence
  SiRNA target sequence
attacttttaacggcactttatgcaa

SEQ ID NO: 10158 - DNA, 26 bp, Artificial sequence
  SiRNA target sequence
ttacttttaacggcactttatgcaat

SEQ ID NO: 10159 - DNA, 26 bp, Artificial sequence
  SiRNA target sequence
tacttttaacggcactttatgcaata

SEQ ID NO: 10160 - DNA, 26 bp, Artificial sequence
  SiRNA target sequence
acttttaacggcactttatgcaataa

SEQ ID NO: 10161 - DNA, 26 bp, Artificial sequence
  SiRNA target sequence
cttttaacggcactttatgcaataag

SEQ ID NO: 10162 - DNA, 26 bp, Artificial sequence
  SiRNA target sequence
ttttaacggcactttatgcaataagt

SEQ ID NO: 10163 - DNA, 26 bp, Artificial sequence
  SiRNA target sequence
tttaacggcactttatgcaataagta

SEQ ID NO: 10164 - DNA, 26 bp, Artificial sequence
  SiRNA target sequence
ttaacggcactttatgcaataagtat

SEQ ID NO: 10165 - DNA, 26 bp, Artificial sequence
  SiRNA target sequence
taacggcactttatgcaataagtatt

SEQ ID NO: 10166 - DNA, 26 bp, Artificial sequence
  SiRNA target sequence
aacggcactttatgcaataagtattg

SEQ ID NO: 10167 - DNA, 26 bp, Artificial sequence
  SiRNA target sequence
acggcactttatgcaataagtattga

SEQ ID NO: 10168 - DNA, 26 bp, Artificial sequence
  SiRNA target sequence
cggcactttatgcaataagtattgat

SEQ ID NO: 10169 - DNA, 26 bp, Artificial sequence
  SiRNA target sequence
ggcactttatgcaataagtattgata

SEQ ID NO: 10170 - DNA, 26 bp, Artificial sequence
  SiRNA target sequence
gcactttatgcaataagtattgataa

SEQ ID NO: 10171 - DNA, 26 bp, Artificial sequence
  SiRNA target sequence
cactttatgcaataagtattgataag

SEQ ID NO: 10172 - DNA, 26 bp, Artificial sequence
  SiRNA target sequence
actttatgcaataagtattgataaga

SEQ ID NO: 10173 - DNA, 26 bp, Artificial sequence
  SiRNA target sequence
ctttatgcaataagtattgataagaa

SEQ ID NO: 10174 - DNA, 26 bp, Artificial sequence
  SiRNA target sequence
tttatgcaataagtattgataagaaa

SEQ ID NO: 10175 - DNA, 26 bp, Artificial sequence
  SiRNA target sequence
ttatgcaataagtattgataagaaaa

SEQ ID NO: 10176 - DNA, 26 bp, Artificial sequence
  SiRNA target sequence
tatgcaataagtattgataagaaaaa

SEQ ID NO: 10177 - DNA, 26 bp, Artificial sequence
  SiRNA target sequence
atgcaataagtattgataagaaaaag

SEQ ID NO: 10178 - DNA, 26 bp, Artificial sequence
  SiRNA target sequence
tgcaataagtattgataagaaaaagg

SEQ ID NO: 10179 - DNA, 26 bp, Artificial sequence
  SiRNA target sequence
gcaataagtattgataagaaaaagga

SEQ ID NO: 10180 - DNA, 26 bp, Artificial sequence
  SiRNA target sequence
caataagtattgataagaaaaaggat

SEQ ID NO: 10181 - DNA, 26 bp, Artificial sequence
  SiRNA target sequence
aataagtattgataagaaaaaggatg

SEQ ID NO: 10182 - DNA, 26 bp, Artificial sequence
  SiRNA target sequence
ataagtattgataagaaaaaggatgc

SEQ ID NO: 10183 - DNA, 26 bp, Artificial sequence
  SiRNA target sequence
taagtattgataagaaaaaggatgct

SEQ ID NO: 10184 - DNA, 26 bp, Artificial sequence
  SiRNA target sequence
aagtattgataagaaaaaggatgcta

SEQ ID NO: 10185 - DNA, 26 bp, Artificial sequence
  SiRNA target sequence
agtattgataagaaaaaggatgctat

SEQ ID NO: 10186 - DNA, 26 bp, Artificial sequence
  SiRNA target sequence
gtattgataagaaaaaggatgctata

SEQ ID NO: 10187 - DNA, 26 bp, Artificial sequence
  SiRNA target sequence
tattgataagaaaaaggatgctatag

SEQ ID NO: 10188 - DNA, 26 bp, Artificial sequence
  SiRNA target sequence
attgataagaaaaaggatgctataga

SEQ ID NO: 10189 - DNA, 26 bp, Artificial sequence
  SiRNA target sequence
ttgataagaaaaaggatgctatagaa

SEQ ID NO: 10190 - DNA, 26 bp, Artificial sequence
  SiRNA target sequence
tgataagaaaaaggatgctatagaaa

SEQ ID NO: 10191 - DNA, 26 bp, Artificial sequence
  SiRNA target sequence
gataagaaaaaggatgctatagaaat

SEQ ID NO: 10192 - DNA, 26 bp, Artificial sequence
  SiRNA target sequence
ataagaaaaaggatgctatagaaatt

SEQ ID NO: 10193 - DNA, 26 bp, Artificial sequence
  SiRNA target sequence
taagaaaaaggatgctatagaaattt

SEQ ID NO: 10194 - DNA, 26 bp, Artificial sequence
  SiRNA target sequence
aagaaaaaggatgctatagaaatttt

SEQ ID NO: 10195 - DNA, 26 bp, Artificial sequence
  SiRNA target sequence
agaaaaaggatgctatagaaatttta

SEQ ID NO: 10196 - DNA, 26 bp, Artificial sequence
  SiRNA target sequence
gaaaaaggatgctatagaaattttat

SEQ ID NO: 10197 - DNA, 26 bp, Artificial sequence
  SiRNA target sequence
aaaaaggatgctatagaaattttata

SEQ ID NO: 10198 - DNA, 26 bp, Artificial sequence
  SiRNA target sequence
aaaaggatgctatagaaattttatat

SEQ ID NO: 10199 - DNA, 26 bp, Artificial sequence
  SiRNA target sequence
aaaggatgctatagaaattttatata

SEQ ID NO: 10200 - DNA, 26 bp, Artificial sequence
  SiRNA target sequence
aaggatgctatagaaattttatatag

SEQ ID NO: 10201 - DNA, 26 bp, Artificial sequence
  SiRNA target sequence
aggatgctatagaaattttatataga

SEQ ID NO: 10202 - DNA, 26 bp, Artificial sequence
  SiRNA target sequence
ggatgctatagaaattttatatagaa

SEQ ID NO: 10203 - DNA, 26 bp, Artificial sequence
  SiRNA target sequence
gatgctatagaaattttatatagaag

SEQ ID NO: 10204 - DNA, 26 bp, Artificial sequence
  SiRNA target sequence
atgctatagaaattttatatagaagt

SEQ ID NO: 10205 - DNA, 26 bp, Artificial sequence
  SiRNA target sequence
tgctatagaaattttatatagaagta

SEQ ID NO: 10206 - DNA, 26 bp, Artificial sequence
  SiRNA target sequence
gctatagaaattttatatagaagtat

SEQ ID NO: 10207 - DNA, 26 bp, Artificial sequence
  SiRNA target sequence
ctatagaaattttatatagaagtata

SEQ ID NO: 10208 - DNA, 26 bp, Artificial sequence
  SiRNA target sequence
tatagaaattttatatagaagtatat

SEQ ID NO: 10209 - DNA, 26 bp, Artificial sequence
  SiRNA target sequence
atagaaattttatatagaagtatatc

SEQ ID NO: 10210 - DNA, 26 bp, Artificial sequence
  SiRNA target sequence
tagaaattttatatagaagtatatca

SEQ ID NO: 10211 - DNA, 26 bp, Artificial sequence
  SiRNA target sequence
agaaattttatatagaagtatatcag

SEQ ID NO: 10212 - DNA, 26 bp, Artificial sequence
  SiRNA target sequence
gaaattttatatagaagtatatcaga

SEQ ID NO: 10213 - DNA, 26 bp, Artificial sequence
  SiRNA target sequence
aaattttatatagaagtatatcagaa

SEQ ID NO: 10214 - DNA, 26 bp, Artificial sequence
  SiRNA target sequence
aattttatatagaagtatatcagaat

SEQ ID NO: 10215 - DNA, 26 bp, Artificial sequence
  SiRNA target sequence
attttatatagaagtatatcagaata

SEQ ID NO: 10216 - DNA, 26 bp, Artificial sequence
  SiRNA target sequence
ttttatatagaagtatatcagaatat

SEQ ID NO: 10217 - DNA, 26 bp, Artificial sequence
  SiRNA target sequence
tttatatagaagtatatcagaatatt

SEQ ID NO: 10218 - DNA, 26 bp, Artificial sequence
  SiRNA target sequence
ttatatagaagtatatcagaatattc

SEQ ID NO: 10219 - DNA, 26 bp, Artificial sequence
  SiRNA target sequence
tatatagaagtatatcagaatattca

SEQ ID NO: 10220 - DNA, 26 bp, Artificial sequence
  SiRNA target sequence
atatagaagtatatcagaatattcat

SEQ ID NO: 10221 - DNA, 26 bp, Artificial sequence
  SiRNA target sequence
tatagaagtatatcagaatattcatc

SEQ ID NO: 10222 - DNA, 26 bp, Artificial sequence
  SiRNA target sequence
atagaagtatatcagaatattcatct

SEQ ID NO: 10223 - DNA, 26 bp, Artificial sequence
  SiRNA target sequence
tagaagtatatcagaatattcatctt

SEQ ID NO: 10224 - DNA, 26 bp, Artificial sequence
  SiRNA target sequence
agaagtatatcagaatattcatctta

SEQ ID NO: 10225 - DNA, 26 bp, Artificial sequence
  SiRNA target sequence
gaagtatatcagaatattcatcttat

SEQ ID NO: 10226 - DNA, 26 bp, Artificial sequence
  SiRNA target sequence
aagtatatcagaatattcatcttatt

SEQ ID NO: 10227 - DNA, 26 bp, Artificial sequence
  SiRNA target sequence
agtatatcagaatattcatcttattt

SEQ ID NO: 10228 - DNA, 26 bp, Artificial sequence
  SiRNA target sequence
gtatatcagaatattcatcttatttt

SEQ ID NO: 10229 - DNA, 26 bp, Artificial sequence
  SiRNA target sequence
tatatcagaatattcatcttatttta

SEQ ID NO: 10230 - DNA, 26 bp, Artificial sequence
  SiRNA target sequence
atatcagaatattcatcttattttaa

SEQ ID NO: 10231 - DNA, 26 bp, Artificial sequence
  SiRNA target sequence
tatcagaatattcatcttattttaaa

SEQ ID NO: 10232 - DNA, 26 bp, Artificial sequence
  SiRNA target sequence
atcagaatattcatcttattttaaat

SEQ ID NO: 10233 - DNA, 26 bp, Artificial sequence
  SiRNA target sequence
tcagaatattcatcttattttaaatc

SEQ ID NO: 10234 - DNA, 26 bp, Artificial sequence
  SiRNA target sequence
cagaatattcatcttattttaaatct

SEQ ID NO: 10235 - DNA, 26 bp, Artificial sequence
  SiRNA target sequence
agaatattcatcttattttaaatctt

SEQ ID NO: 10236 - DNA, 26 bp, Artificial sequence
  SiRNA target sequence
gaatattcatcttattttaaatctta

SEQ ID NO: 10237 - DNA, 26 bp, Artificial sequence
  SiRNA target sequence
aatattcatcttattttaaatcttat

SEQ ID NO: 10238 - DNA, 26 bp, Artificial sequence
  SiRNA target sequence
atattcatcttattttaaatcttatt

SEQ ID NO: 10239 - DNA, 26 bp, Artificial sequence
  SiRNA target sequence
tattcatcttattttaaatcttattt

SEQ ID NO: 10240 - DNA, 26 bp, Artificial sequence
  SiRNA target sequence
attcatcttattttaaatcttatttg

SEQ ID NO: 10241 - DNA, 26 bp, Artificial sequence
  SiRNA target sequence
ttcatcttattttaaatcttatttgt

SEQ ID NO: 10242 - DNA, 26 bp, Artificial sequence
  SiRNA target sequence
tcatcttattttaaatcttatttgta

SEQ ID NO: 10243 - DNA, 26 bp, Artificial sequence
  SiRNA target sequence
catcttattttaaatcttatttgtat

SEQ ID NO: 10244 - DNA, 26 bp, Artificial sequence
  SiRNA target sequence
atcttattttaaatcttatttgtatt

SEQ ID NO: 10245 - DNA, 26 bp, Artificial sequence
  SiRNA target sequence
tcttattttaaatcttatttgtattt

SEQ ID NO: 10246 - DNA, 26 bp, Artificial sequence
  SiRNA target sequence
cttattttaaatcttatttgtattta

SEQ ID NO: 10247 - DNA, 26 bp, Artificial sequence
  SiRNA target sequence
ttattttaaatcttatttgtatttag

SEQ ID NO: 10248 - DNA, 26 bp, Artificial sequence
  SiRNA target sequence
tattttaaatcttatttgtatttagg

SEQ ID NO: 10249 - DNA, 26 bp, Artificial sequence
  SiRNA target sequence
attttaaatcttatttgtatttagga

SEQ ID NO: 10250 - DNA, 26 bp, Artificial sequence
  SiRNA target sequence
ttttaaatcttatttgtatttaggaa

SEQ ID NO: 10251 - DNA, 26 bp, Artificial sequence
  SiRNA target sequence
tttaaatcttatttgtatttaggaaa

SEQ ID NO: 10252 - DNA, 26 bp, Artificial sequence
  SiRNA target sequence
ttaaatcttatttgtatttaggaaat

SEQ ID NO: 10253 - DNA, 26 bp, Artificial sequence
  SiRNA target sequence
taaatcttatttgtatttaggaaata

SEQ ID NO: 10254 - DNA, 26 bp, Artificial sequence
  SiRNA target sequence
aaatcttatttgtatttaggaaatat

SEQ ID NO: 10255 - DNA, 26 bp, Artificial sequence
  SiRNA target sequence
aatcttatttgtatttaggaaatatt

SEQ ID NO: 10256 - DNA, 26 bp, Artificial sequence
  SiRNA target sequence
atcttatttgtatttaggaaatattt

SEQ ID NO: 10257 - DNA, 26 bp, Artificial sequence
  SiRNA target sequence
tcttatttgtatttaggaaatatttt

SEQ ID NO: 10258 - DNA, 26 bp, Artificial sequence
  SiRNA target sequence
cttatttgtatttaggaaatatttta

SEQ ID NO: 10259 - DNA, 26 bp, Artificial sequence
  SiRNA target sequence
ttatttgtatttaggaaatattttaa

SEQ ID NO: 10260 - DNA, 26 bp, Artificial sequence
  SiRNA target sequence
tatttgtatttaggaaatattttaat

SEQ ID NO: 10261 - DNA, 26 bp, Artificial sequence
  SiRNA target sequence
atttgtatttaggaaatattttaata

SEQ ID NO: 10262 - DNA, 26 bp, Artificial sequence
  SiRNA target sequence
tttgtatttaggaaatattttaataa

SEQ ID NO: 10263 - DNA, 26 bp, Artificial sequence
  SiRNA target sequence
ttgtatttaggaaatattttaataaa

SEQ ID NO: 10264 - DNA, 26 bp, Artificial sequence
  SiRNA target sequence
tgtatttaggaaatattttaataaat

SEQ ID NO: 10265 - DNA, 26 bp, Artificial sequence
  SiRNA target sequence
gtatttaggaaatattttaataaatg

SEQ ID NO: 10266 - DNA, 26 bp, Artificial sequence
  SiRNA target sequence
tatttaggaaatattttaataaatga

SEQ ID NO: 10267 - DNA, 26 bp, Artificial sequence
  SiRNA target sequence
atttaggaaatattttaataaatgat

SEQ ID NO: 10268 - DNA, 26 bp, Artificial sequence
  SiRNA target sequence
tttaggaaatattttaataaatgatg

SEQ ID NO: 10269 - DNA, 26 bp, Artificial sequence
  SiRNA target sequence
ttaggaaatattttaataaatgatga

SEQ ID NO: 10270 - DNA, 26 bp, Artificial sequence
  SiRNA target sequence
taggaaatattttaataaatgatgac

SEQ ID NO: 10271 - DNA, 26 bp, Artificial sequence
  SiRNA target sequence
aggaaatattttaataaatgatgact

SEQ ID NO: 10272 - DNA, 26 bp, Artificial sequence
  SiRNA target sequence
ggaaatattttaataaatgatgactt

SEQ ID NO: 10273 - DNA, 26 bp, Artificial sequence
  SiRNA target sequence
gaaatattttaataaatgatgactta

SEQ ID NO: 10274 - DNA, 26 bp, Artificial sequence
  SiRNA target sequence
aaatattttaataaatgatgacttaa

SEQ ID NO: 10275 - DNA, 26 bp, Artificial sequence
  SiRNA target sequence
aatattttaataaatgatgacttaaa

SEQ ID NO: 10276 - DNA, 26 bp, Artificial sequence
  SiRNA target sequence
atattttaataaatgatgacttaaat

SEQ ID NO: 10277 - DNA, 26 bp, Artificial sequence
  SiRNA target sequence
tattttaataaatgatgacttaaatg

SEQ ID NO: 10278 - DNA, 26 bp, Artificial sequence
  SiRNA target sequence
attttaataaatgatgacttaaatga

SEQ ID NO: 10279 - DNA, 26 bp, Artificial sequence
  SiRNA target sequence
ttttaataaatgatgacttaaatgaa

SEQ ID NO: 10280 - DNA, 26 bp, Artificial sequence
  SiRNA target sequence
tttaataaatgatgacttaaatgaat

SEQ ID NO: 10281 - DNA, 26 bp, Artificial sequence
  SiRNA target sequence
ttaataaatgatgacttaaatgaatg

SEQ ID NO: 10282 - DNA, 26 bp, Artificial sequence
  SiRNA target sequence
taataaatgatgacttaaatgaatgc

SEQ ID NO: 10283 - DNA, 26 bp, Artificial sequence
  SiRNA target sequence
aataaatgatgacttaaatgaatgca

SEQ ID NO: 10284 - DNA, 26 bp, Artificial sequence
  SiRNA target sequence
ataaatgatgacttaaatgaatgcag

SEQ ID NO: 10285 - DNA, 26 bp, Artificial sequence
  SiRNA target sequence
taaatgatgacttaaatgaatgcagg

SEQ ID NO: 10286 - DNA, 26 bp, Artificial sequence
  SiRNA target sequence
aaatgatgacttaaatgaatgcagga

SEQ ID NO: 10287 - DNA, 26 bp, Artificial sequence
  SiRNA target sequence
aatgatgacttaaatgaatgcaggaa

SEQ ID NO: 10288 - DNA, 26 bp, Artificial sequence
  SiRNA target sequence
atgatgacttaaatgaatgcaggaaa

SEQ ID NO: 10289 - DNA, 26 bp, Artificial sequence
  SiRNA target sequence
tgatgacttaaatgaatgcaggaaat

SEQ ID NO: 10290 - DNA, 26 bp, Artificial sequence
  SiRNA target sequence
gatgacttaaatgaatgcaggaaatt

SEQ ID NO: 10291 - DNA, 26 bp, Artificial sequence
  SiRNA target sequence
atgacttaaatgaatgcaggaaattg

SEQ ID NO: 10292 - DNA, 26 bp, Artificial sequence
  SiRNA target sequence
tgacttaaatgaatgcaggaaattgt

SEQ ID NO: 10293 - DNA, 26 bp, Artificial sequence
  SiRNA target sequence
gacttaaatgaatgcaggaaattgtt

SEQ ID NO: 10294 - DNA, 26 bp, Artificial sequence
  SiRNA target sequence
acttaaatgaatgcaggaaattgttt

SEQ ID NO: 10295 - DNA, 26 bp, Artificial sequence
  SiRNA target sequence
cttaaatgaatgcaggaaattgttta

SEQ ID NO: 10296 - DNA, 26 bp, Artificial sequence
  SiRNA target sequence
ttaaatgaatgcaggaaattgtttaa

SEQ ID NO: 10297 - DNA, 26 bp, Artificial sequence
  SiRNA target sequence
taaatgaatgcaggaaattgtttaat

SEQ ID NO: 10298 - DNA, 26 bp, Artificial sequence
  SiRNA target sequence
aaatgaatgcaggaaattgtttaata

SEQ ID NO: 10299 - DNA, 26 bp, Artificial sequence
  SiRNA target sequence
aatgaatgcaggaaattgtttaatac

SEQ ID NO: 10300 - DNA, 26 bp, Artificial sequence
  SiRNA target sequence
atgaatgcaggaaattgtttaataca

SEQ ID NO: 10301 - DNA, 26 bp, Artificial sequence
  SiRNA target sequence
tgaatgcaggaaattgtttaatacat

SEQ ID NO: 10302 - DNA, 26 bp, Artificial sequence
  SiRNA target sequence
gaatgcaggaaattgtttaatacatc

SEQ ID NO: 10303 - DNA, 26 bp, Artificial sequence
  SiRNA target sequence
aatgcaggaaattgtttaatacatca

SEQ ID NO: 10304 - DNA, 26 bp, Artificial sequence
  SiRNA target sequence
atgcaggaaattgtttaatacatcac

SEQ ID NO: 10305 - DNA, 26 bp, Artificial sequence
  SiRNA target sequence
tgcaggaaattgtttaatacatcact

SEQ ID NO: 10306 - DNA, 26 bp, Artificial sequence
  SiRNA target sequence
gcaggaaattgtttaatacatcactt

SEQ ID NO: 10307 - DNA, 26 bp, Artificial sequence
  SiRNA target sequence
caggaaattgtttaatacatcacttc

SEQ ID NO: 10308 - DNA, 26 bp, Artificial sequence
  SiRNA target sequence
aggaaattgtttaatacatcacttca

SEQ ID NO: 10309 - DNA, 26 bp, Artificial sequence
  SiRNA target sequence
ggaaattgtttaatacatcacttcaa

SEQ ID NO: 10310 - DNA, 26 bp, Artificial sequence
  SiRNA target sequence
gaaattgtttaatacatcacttcaat

SEQ ID NO: 10311 - DNA, 26 bp, Artificial sequence
  SiRNA target sequence
aaattgtttaatacatcacttcaata

SEQ ID NO: 10312 - DNA, 26 bp, Artificial sequence
  SiRNA target sequence
aattgtttaatacatcacttcaatat

SEQ ID NO: 10313 - DNA, 26 bp, Artificial sequence
  SiRNA target sequence
attgtttaatacatcacttcaatatt

SEQ ID NO: 10314 - DNA, 26 bp, Artificial sequence
  SiRNA target sequence
ttgtttaatacatcacttcaatattg

SEQ ID NO: 10315 - DNA, 26 bp, Artificial sequence
  SiRNA target sequence
tgtttaatacatcacttcaatattgt

SEQ ID NO: 10316 - DNA, 26 bp, Artificial sequence
  SiRNA target sequence
gtttaatacatcacttcaatattgtt

SEQ ID NO: 10317 - DNA, 26 bp, Artificial sequence
  SiRNA target sequence
tttaatacatcacttcaatattgttg

SEQ ID NO: 10318 - DNA, 26 bp, Artificial sequence
  SiRNA target sequence
ttaatacatcacttcaatattgttgt

SEQ ID NO: 10319 - DNA, 26 bp, Artificial sequence
  SiRNA target sequence
taatacatcacttcaatattgttgta

SEQ ID NO: 10320 - DNA, 26 bp, Artificial sequence
  SiRNA target sequence
aatacatcacttcaatattgttgtaa

SEQ ID NO: 10321 - DNA, 26 bp, Artificial sequence
  SiRNA target sequence
atacatcacttcaatattgttgtaat

SEQ ID NO: 10322 - DNA, 26 bp, Artificial sequence
  SiRNA target sequence
tacatcacttcaatattgttgtaatt

SEQ ID NO: 10323 - DNA, 26 bp, Artificial sequence
  SiRNA target sequence
acatcacttcaatattgttgtaattc

SEQ ID NO: 10324 - DNA, 26 bp, Artificial sequence
  SiRNA target sequence
catcacttcaatattgttgtaattct

SEQ ID NO: 10325 - DNA, 26 bp, Artificial sequence
  SiRNA target sequence
atcacttcaatattgttgtaattctg

SEQ ID NO: 10326 - DNA, 26 bp, Artificial sequence
  SiRNA target sequence
tcacttcaatattgttgtaattctga

SEQ ID NO: 10327 - DNA, 26 bp, Artificial sequence
  SiRNA target sequence
cacttcaatattgttgtaattctgat

SEQ ID NO: 10328 - DNA, 26 bp, Artificial sequence
  SiRNA target sequence
acttcaatattgttgtaattctgatg

SEQ ID NO: 10329 - DNA, 26 bp, Artificial sequence
  SiRNA target sequence
cttcaatattgttgtaattctgatga

SEQ ID NO: 10330 - DNA, 26 bp, Artificial sequence
  SiRNA target sequence
ttcaatattgttgtaattctgatgag

SEQ ID NO: 10331 - DNA, 26 bp, Artificial sequence
  SiRNA target sequence
tcaatattgttgtaattctgatgagg

SEQ ID NO: 10332 - DNA, 26 bp, Artificial sequence
  SiRNA target sequence
caatattgttgtaattctgatgaggt

SEQ ID NO: 10333 - DNA, 26 bp, Artificial sequence
  SiRNA target sequence
aatattgttgtaattctgatgaggtt

SEQ ID NO: 10334 - DNA, 26 bp, Artificial sequence
  SiRNA target sequence
atattgttgtaattctgatgaggttt

SEQ ID NO: 10335 - DNA, 26 bp, Artificial sequence
  SiRNA target sequence
tattgttgtaattctgatgaggtttt

SEQ ID NO: 10336 - DNA, 26 bp, Artificial sequence
  SiRNA target sequence
attgttgtaattctgatgaggttttt

SEQ ID NO: 10337 - DNA, 26 bp, Artificial sequence
  SiRNA target sequence
ttgttgtaattctgatgaggttttta

SEQ ID NO: 10338 - DNA, 26 bp, Artificial sequence
  SiRNA target sequence
tgttgtaattctgatgaggtttttat

SEQ ID NO: 10339 - DNA, 26 bp, Artificial sequence
  SiRNA target sequence
gttgtaattctgatgaggtttttatt

SEQ ID NO: 10340 - DNA, 26 bp, Artificial sequence
  SiRNA target sequence
ttgtaattctgatgaggtttttattg

SEQ ID NO: 10341 - DNA, 26 bp, Artificial sequence
  SiRNA target sequence
tgtaattctgatgaggtttttattgt

SEQ ID NO: 10342 - DNA, 26 bp, Artificial sequence
  SiRNA target sequence
gtaattctgatgaggtttttattgtt

SEQ ID NO: 10343 - DNA, 26 bp, Artificial sequence
  SiRNA target sequence
taattctgatgaggtttttattgtta

SEQ ID NO: 10344 - DNA, 26 bp, Artificial sequence
  SiRNA target sequence
aattctgatgaggtttttattgttaa

SEQ ID NO: 10345 - DNA, 26 bp, Artificial sequence
  SiRNA target sequence
attctgatgaggtttttattgttaag

SEQ ID NO: 10346 - DNA, 26 bp, Artificial sequence
  SiRNA target sequence
ttctgatgaggtttttattgttaagc

SEQ ID NO: 10347 - DNA, 26 bp, Artificial sequence
  SiRNA target sequence
tctgatgaggtttttattgttaagca

SEQ ID NO: 10348 - DNA, 26 bp, Artificial sequence
  SiRNA target sequence
ctgatgaggtttttattgttaagcag

SEQ ID NO: 10349 - DNA, 26 bp, Artificial sequence
  SiRNA target sequence
tgatgaggtttttattgttaagcagt

SEQ ID NO: 10350 - DNA, 26 bp, Artificial sequence
  SiRNA target sequence
gatgaggtttttattgttaagcagtc

SEQ ID NO: 10351 - DNA, 26 bp, Artificial sequence
  SiRNA target sequence
atgaggtttttattgttaagcagtca

SEQ ID NO: 10352 - DNA, 26 bp, Artificial sequence
  SiRNA target sequence
tgaggtttttattgttaagcagtcac

SEQ ID NO: 10353 - DNA, 26 bp, Artificial sequence
  SiRNA target sequence
gaggtttttattgttaagcagtcact

SEQ ID NO: 10354 - DNA, 26 bp, Artificial sequence
  SiRNA target sequence
aggtttttattgttaagcagtcactt

SEQ ID NO: 10355 - DNA, 26 bp, Artificial sequence
  SiRNA target sequence
ggtttttattgttaagcagtcactta

SEQ ID NO: 10356 - DNA, 26 bp, Artificial sequence
  SiRNA target sequence
gtttttattgttaagcagtcacttat

SEQ ID NO: 10357 - DNA, 26 bp, Artificial sequence
  SiRNA target sequence
tttttattgttaagcagtcacttatt

SEQ ID NO: 10358 - DNA, 26 bp, Artificial sequence
  SiRNA target sequence
ttttattgttaagcagtcacttattt

SEQ ID NO: 10359 - DNA, 26 bp, Artificial sequence
  SiRNA target sequence
tttattgttaagcagtcacttatttt

SEQ ID NO: 10360 - DNA, 26 bp, Artificial sequence
  SiRNA target sequence
ttattgttaagcagtcacttatttta

SEQ ID NO: 10361 - DNA, 26 bp, Artificial sequence
  SiRNA target sequence
tattgttaagcagtcacttattttaa

SEQ ID NO: 10362 - DNA, 26 bp, Artificial sequence
  SiRNA target sequence
attgttaagcagtcacttattttaat

SEQ ID NO: 10363 - DNA, 26 bp, Artificial sequence
  SiRNA target sequence
ttgttaagcagtcacttattttaata

SEQ ID NO: 10364 - DNA, 26 bp, Artificial sequence
  SiRNA target sequence
tgttaagcagtcacttattttaatag

SEQ ID NO: 10365 - DNA, 26 bp, Artificial sequence
  SiRNA target sequence
gttaagcagtcacttattttaataga

SEQ ID NO: 10366 - DNA, 26 bp, Artificial sequence
  SiRNA target sequence
ttaagcagtcacttattttaatagaa

SEQ ID NO: 10367 - DNA, 26 bp, Artificial sequence
  SiRNA target sequence
taagcagtcacttattttaatagaag

SEQ ID NO: 10368 - DNA, 26 bp, Artificial sequence
  SiRNA target sequence
aagcagtcacttattttaatagaagt

SEQ ID NO: 10369 - DNA, 26 bp, Artificial sequence
  SiRNA target sequence
agcagtcacttattttaatagaagta

SEQ ID NO: 10370 - DNA, 26 bp, Artificial sequence
  SiRNA target sequence
gcagtcacttattttaatagaagtac

SEQ ID NO: 10371 - DNA, 26 bp, Artificial sequence
  SiRNA target sequence
cagtcacttattttaatagaagtaca

SEQ ID NO: 10372 - DNA, 26 bp, Artificial sequence
  SiRNA target sequence
agtcacttattttaatagaagtacat

SEQ ID NO: 10373 - DNA, 26 bp, Artificial sequence
  SiRNA target sequence
gtcacttattttaatagaagtacatg

SEQ ID NO: 10374 - DNA, 26 bp, Artificial sequence
  SiRNA target sequence
tcacttattttaatagaagtacatga

SEQ ID NO: 10375 - DNA, 26 bp, Artificial sequence
  SiRNA target sequence
cacttattttaatagaagtacatgaa

SEQ ID NO: 10376 - DNA, 26 bp, Artificial sequence
  SiRNA target sequence
acttattttaatagaagtacatgaat

SEQ ID NO: 10377 - DNA, 26 bp, Artificial sequence
  SiRNA target sequence
cttattttaatagaagtacatgaata

SEQ ID NO: 10378 - DNA, 26 bp, Artificial sequence
  SiRNA target sequence
ttattttaatagaagtacatgaatac

SEQ ID NO: 10379 - DNA, 26 bp, Artificial sequence
  SiRNA target sequence
tattttaatagaagtacatgaataca

SEQ ID NO: 10380 - DNA, 26 bp, Artificial sequence
  SiRNA target sequence
attttaatagaagtacatgaatacat

SEQ ID NO: 10381 - DNA, 26 bp, Artificial sequence
  SiRNA target sequence
ttttaatagaagtacatgaatacatc

SEQ ID NO: 10382 - DNA, 26 bp, Artificial sequence
  SiRNA target sequence
tttaatagaagtacatgaatacatca

SEQ ID NO: 10383 - DNA, 26 bp, Artificial sequence
  SiRNA target sequence
ttaatagaagtacatgaatacatcaa

SEQ ID NO: 10384 - DNA, 26 bp, Artificial sequence
  SiRNA target sequence
taatagaagtacatgaatacatcaaa

SEQ ID NO: 10385 - DNA, 26 bp, Artificial sequence
  SiRNA target sequence
aatagaagtacatgaatacatcaaag

SEQ ID NO: 10386 - DNA, 26 bp, Artificial sequence
  SiRNA target sequence
atagaagtacatgaatacatcaaaga

SEQ ID NO: 10387 - DNA, 26 bp, Artificial sequence
  SiRNA target sequence
tagaagtacatgaatacatcaaagaa

SEQ ID NO: 10388 - DNA, 26 bp, Artificial sequence
  SiRNA target sequence
agaagtacatgaatacatcaaagaaa

SEQ ID NO: 10389 - DNA, 26 bp, Artificial sequence
  SiRNA target sequence
gaagtacatgaatacatcaaagaaaa

SEQ ID NO: 10390 - DNA, 26 bp, Artificial sequence
  SiRNA target sequence
aagtacatgaatacatcaaagaaaat

SEQ ID NO: 10391 - DNA, 26 bp, Artificial sequence
  SiRNA target sequence
agtacatgaatacatcaaagaaaata

SEQ ID NO: 10392 - DNA, 26 bp, Artificial sequence
  SiRNA target sequence
gtacatgaatacatcaaagaaaataa

SEQ ID NO: 10393 - DNA, 26 bp, Artificial sequence
  SiRNA target sequence
tacatgaatacatcaaagaaaataaa

SEQ ID NO: 10394 - DNA, 26 bp, Artificial sequence
  SiRNA target sequence
acatgaatacatcaaagaaaataaaa

SEQ ID NO: 10395 - DNA, 26 bp, Artificial sequence
  SiRNA target sequence
catgaatacatcaaagaaaataaaat

SEQ ID NO: 10396 - DNA, 26 bp, Artificial sequence
  SiRNA target sequence
atgaatacatcaaagaaaataaaata

SEQ ID NO: 10397 - DNA, 26 bp, Artificial sequence
  SiRNA target sequence
tgaatacatcaaagaaaataaaatat

SEQ ID NO: 10398 - DNA, 26 bp, Artificial sequence
  SiRNA target sequence
gaatacatcaaagaaaataaaatata

SEQ ID NO: 10399 - DNA, 26 bp, Artificial sequence
  SiRNA target sequence
aatacatcaaagaaaataaaatataa

SEQ ID NO: 10400 - DNA, 27 bp, Artificial sequence
  SiRNA target sequence
atgaaacgaaaaacagaaatatttatt

SEQ ID NO: 10401 - DNA, 27 bp, Artificial sequence
  SiRNA target sequence
tgaaacgaaaaacagaaatatttattg

SEQ ID NO: 10402 - DNA, 27 bp, Artificial sequence
  SiRNA target sequence
gaaacgaaaaacagaaatatttattgc

SEQ ID NO: 10403 - DNA, 27 bp, Artificial sequence
  SiRNA target sequence
aaacgaaaaacagaaatatttattgct

SEQ ID NO: 10404 - DNA, 27 bp, Artificial sequence
  SiRNA target sequence
aacgaaaaacagaaatatttattgcta

SEQ ID NO: 10405 - DNA, 27 bp, Artificial sequence
  SiRNA target sequence
acgaaaaacagaaatatttattgctat

SEQ ID NO: 10406 - DNA, 27 bp, Artificial sequence
  SiRNA target sequence
cgaaaaacagaaatatttattgctatt

SEQ ID NO: 10407 - DNA, 27 bp, Artificial sequence
  SiRNA target sequence
gaaaaacagaaatatttattgctatta

SEQ ID NO: 10408 - DNA, 27 bp, Artificial sequence
  SiRNA target sequence
aaaaacagaaatatttattgctattac

SEQ ID NO: 10409 - DNA, 27 bp, Artificial sequence
  SiRNA target sequence
aaaacagaaatatttattgctattaca

SEQ ID NO: 10410 - DNA, 27 bp, Artificial sequence
  SiRNA target sequence
aaacagaaatatttattgctattacag

SEQ ID NO: 10411 - DNA, 27 bp, Artificial sequence
  SiRNA target sequence
aacagaaatatttattgctattacagt

SEQ ID NO: 10412 - DNA, 27 bp, Artificial sequence
  SiRNA target sequence
acagaaatatttattgctattacagta

SEQ ID NO: 10413 - DNA, 27 bp, Artificial sequence
  SiRNA target sequence
cagaaatatttattgctattacagtag

SEQ ID NO: 10414 - DNA, 27 bp, Artificial sequence
  SiRNA target sequence
agaaatatttattgctattacagtagt

SEQ ID NO: 10415 - DNA, 27 bp, Artificial sequence
  SiRNA target sequence
gaaatatttattgctattacagtagtc

SEQ ID NO: 10416 - DNA, 27 bp, Artificial sequence
  SiRNA target sequence
aaatatttattgctattacagtagtca

SEQ ID NO: 10417 - DNA, 27 bp, Artificial sequence
  SiRNA target sequence
aatatttattgctattacagtagtcac

SEQ ID NO: 10418 - DNA, 27 bp, Artificial sequence
  SiRNA target sequence
atatttattgctattacagtagtcact

SEQ ID NO: 10419 - DNA, 27 bp, Artificial sequence
  SiRNA target sequence
tatttattgctattacagtagtcactg

SEQ ID NO: 10420 - DNA, 27 bp, Artificial sequence
  SiRNA target sequence
atttattgctattacagtagtcactgc

SEQ ID NO: 10421 - DNA, 27 bp, Artificial sequence
  SiRNA target sequence
tttattgctattacagtagtcactgca

SEQ ID NO: 10422 - DNA, 27 bp, Artificial sequence
  SiRNA target sequence
ttattgctattacagtagtcactgcag

SEQ ID NO: 10423 - DNA, 27 bp, Artificial sequence
  SiRNA target sequence
tattgctattacagtagtcactgcagt

SEQ ID NO: 10424 - DNA, 27 bp, Artificial sequence
  SiRNA target sequence
attgctattacagtagtcactgcagtg

SEQ ID NO: 10425 - DNA, 27 bp, Artificial sequence
  SiRNA target sequence
ttgctattacagtagtcactgcagtga

SEQ ID NO: 10426 - DNA, 27 bp, Artificial sequence
  SiRNA target sequence
tgctattacagtagtcactgcagtgac

SEQ ID NO: 10427 - DNA, 27 bp, Artificial sequence
  SiRNA target sequence
gctattacagtagtcactgcagtgaca

SEQ ID NO: 10428 - DNA, 27 bp, Artificial sequence
  SiRNA target sequence
ctattacagtagtcactgcagtgacat

SEQ ID NO: 10429 - DNA, 27 bp, Artificial sequence
  SiRNA target sequence
tattacagtagtcactgcagtgacatg

SEQ ID NO: 10430 - DNA, 27 bp, Artificial sequence
  SiRNA target sequence
attacagtagtcactgcagtgacatgt

SEQ ID NO: 10431 - DNA, 27 bp, Artificial sequence
  SiRNA target sequence
ttacagtagtcactgcagtgacatgtt

SEQ ID NO: 10432 - DNA, 27 bp, Artificial sequence
  SiRNA target sequence
tacagtagtcactgcagtgacatgtta

SEQ ID NO: 10433 - DNA, 27 bp, Artificial sequence
  SiRNA target sequence
acagtagtcactgcagtgacatgttac

SEQ ID NO: 10434 - DNA, 27 bp, Artificial sequence
  SiRNA target sequence
cagtagtcactgcagtgacatgttact

SEQ ID NO: 10435 - DNA, 27 bp, Artificial sequence
  SiRNA target sequence
agtagtcactgcagtgacatgttactt

SEQ ID NO: 10436 - DNA, 27 bp, Artificial sequence
  SiRNA target sequence
gtagtcactgcagtgacatgttactta

SEQ ID NO: 10437 - DNA, 27 bp, Artificial sequence
  SiRNA target sequence
tagtcactgcagtgacatgttacttat

SEQ ID NO: 10438 - DNA, 27 bp, Artificial sequence
  SiRNA target sequence
agtcactgcagtgacatgttacttatt

SEQ ID NO: 10439 - DNA, 27 bp, Artificial sequence
  SiRNA target sequence
gtcactgcagtgacatgttacttattt

SEQ ID NO: 10440 - DNA, 27 bp, Artificial sequence
  SiRNA target sequence
tcactgcagtgacatgttacttattta

SEQ ID NO: 10441 - DNA, 27 bp, Artificial sequence
  SiRNA target sequence
cactgcagtgacatgttacttatttaa

SEQ ID NO: 10442 - DNA, 27 bp, Artificial sequence
  SiRNA target sequence
actgcagtgacatgttacttatttaaa

SEQ ID NO: 10443 - DNA, 27 bp, Artificial sequence
  SiRNA target sequence
ctgcagtgacatgttacttatttaaaa

SEQ ID NO: 10444 - DNA, 27 bp, Artificial sequence
  SiRNA target sequence
tgcagtgacatgttacttatttaaaaa

SEQ ID NO: 10445 - DNA, 27 bp, Artificial sequence
  SiRNA target sequence
gcagtgacatgttacttatttaaaaaa

SEQ ID NO: 10446 - DNA, 27 bp, Artificial sequence
  SiRNA target sequence
cagtgacatgttacttatttaaaaaaa

SEQ ID NO: 10447 - DNA, 27 bp, Artificial sequence
  SiRNA target sequence
agtgacatgttacttatttaaaaaaat

SEQ ID NO: 10448 - DNA, 27 bp, Artificial sequence
  SiRNA target sequence
gtgacatgttacttatttaaaaaaata

SEQ ID NO: 10449 - DNA, 27 bp, Artificial sequence
  SiRNA target sequence
tgacatgttacttatttaaaaaaataa

SEQ ID NO: 10450 - DNA, 27 bp, Artificial sequence
  SiRNA target sequence
gacatgttacttatttaaaaaaataat

SEQ ID NO: 10451 - DNA, 27 bp, Artificial sequence
  SiRNA target sequence
acatgttacttatttaaaaaaataata

SEQ ID NO: 10452 - DNA, 27 bp, Artificial sequence
  SiRNA target sequence
catgttacttatttaaaaaaataataa

SEQ ID NO: 10453 - DNA, 27 bp, Artificial sequence
  SiRNA target sequence
atgttacttatttaaaaaaataataaa

SEQ ID NO: 10454 - DNA, 27 bp, Artificial sequence
  SiRNA target sequence
tgttacttatttaaaaaaataataaat

SEQ ID NO: 10455 - DNA, 27 bp, Artificial sequence
  SiRNA target sequence
gttacttatttaaaaaaataataaata

SEQ ID NO: 10456 - DNA, 27 bp, Artificial sequence
  SiRNA target sequence
ttacttatttaaaaaaataataaatag

SEQ ID NO: 10457 - DNA, 27 bp, Artificial sequence
  SiRNA target sequence
tacttatttaaaaaaataataaataga

SEQ ID NO: 10458 - DNA, 27 bp, Artificial sequence
  SiRNA target sequence
acttatttaaaaaaataataaatagac

SEQ ID NO: 10459 - DNA, 27 bp, Artificial sequence
  SiRNA target sequence
cttatttaaaaaaataataaatagaca

SEQ ID NO: 10460 - DNA, 27 bp, Artificial sequence
  SiRNA target sequence
ttatttaaaaaaataataaatagacaa

SEQ ID NO: 10461 - DNA, 27 bp, Artificial sequence
  SiRNA target sequence
tatttaaaaaaataataaatagacaaa

SEQ ID NO: 10462 - DNA, 27 bp, Artificial sequence
  SiRNA target sequence
atttaaaaaaataataaatagacaaaa

SEQ ID NO: 10463 - DNA, 27 bp, Artificial sequence
  SiRNA target sequence
tttaaaaaaataataaatagacaaaag

SEQ ID NO: 10464 - DNA, 27 bp, Artificial sequence
  SiRNA target sequence
ttaaaaaaataataaatagacaaaagt

SEQ ID NO: 10465 - DNA, 27 bp, Artificial sequence
  SiRNA target sequence
taaaaaaataataaatagacaaaagtc

SEQ ID NO: 10466 - DNA, 27 bp, Artificial sequence
  SiRNA target sequence
aaaaaaataataaatagacaaaagtct

SEQ ID NO: 10467 - DNA, 27 bp, Artificial sequence
  SiRNA target sequence
aaaaaataataaatagacaaaagtctg

SEQ ID NO: 10468 - DNA, 27 bp, Artificial sequence
  SiRNA target sequence
aaaaataataaatagacaaaagtctga

SEQ ID NO: 10469 - DNA, 27 bp, Artificial sequence
  SiRNA target sequence
aaaataataaatagacaaaagtctgat

SEQ ID NO: 10470 - DNA, 27 bp, Artificial sequence
  SiRNA target sequence
aaataataaatagacaaaagtctgatt

SEQ ID NO: 10471 - DNA, 27 bp, Artificial sequence
  SiRNA target sequence
aataataaatagacaaaagtctgatta

SEQ ID NO: 10472 - DNA, 27 bp, Artificial sequence
  SiRNA target sequence
ataataaatagacaaaagtctgattat

SEQ ID NO: 10473 - DNA, 27 bp, Artificial sequence
  SiRNA target sequence
taataaatagacaaaagtctgattata

SEQ ID NO: 10474 - DNA, 27 bp, Artificial sequence
  SiRNA target sequence
aataaatagacaaaagtctgattatac

SEQ ID NO: 10475 - DNA, 27 bp, Artificial sequence
  SiRNA target sequence
ataaatagacaaaagtctgattataca

SEQ ID NO: 10476 - DNA, 27 bp, Artificial sequence
  SiRNA target sequence
taaatagacaaaagtctgattatacat

SEQ ID NO: 10477 - DNA, 27 bp, Artificial sequence
  SiRNA target sequence
aaatagacaaaagtctgattatacatc

SEQ ID NO: 10478 - DNA, 27 bp, Artificial sequence
  SiRNA target sequence
aatagacaaaagtctgattatacatca

SEQ ID NO: 10479 - DNA, 27 bp, Artificial sequence
  SiRNA target sequence
atagacaaaagtctgattatacatcaa

SEQ ID NO: 10480 - DNA, 27 bp, Artificial sequence
  SiRNA target sequence
tagacaaaagtctgattatacatcaat

SEQ ID NO: 10481 - DNA, 27 bp, Artificial sequence
  SiRNA target sequence
agacaaaagtctgattatacatcaata

SEQ ID NO: 10482 - DNA, 27 bp, Artificial sequence
  SiRNA target sequence
gacaaaagtctgattatacatcaataa

SEQ ID NO: 10483 - DNA, 27 bp, Artificial sequence
  SiRNA target sequence
acaaaagtctgattatacatcaataaa

SEQ ID NO: 10484 - DNA, 27 bp, Artificial sequence
  SiRNA target sequence
caaaagtctgattatacatcaataaaa

SEQ ID NO: 10485 - DNA, 27 bp, Artificial sequence
  SiRNA target sequence
aaaagtctgattatacatcaataaaac

SEQ ID NO: 10486 - DNA, 27 bp, Artificial sequence
  SiRNA target sequence
aaagtctgattatacatcaataaaaca

SEQ ID NO: 10487 - DNA, 27 bp, Artificial sequence
  SiRNA target sequence
aagtctgattatacatcaataaaacag

SEQ ID NO: 10488 - DNA, 27 bp, Artificial sequence
  SiRNA target sequence
agtctgattatacatcaataaaacagg

SEQ ID NO: 10489 - DNA, 27 bp, Artificial sequence
  SiRNA target sequence
gtctgattatacatcaataaaacagga

SEQ ID NO: 10490 - DNA, 27 bp, Artificial sequence
  SiRNA target sequence
tctgattatacatcaataaaacaggaa

SEQ ID NO: 10491 - DNA, 27 bp, Artificial sequence
  SiRNA target sequence
ctgattatacatcaataaaacaggaag

SEQ ID NO: 10492 - DNA, 27 bp, Artificial sequence
  SiRNA target sequence
tgattatacatcaataaaacaggaagc

SEQ ID NO: 10493 - DNA, 27 bp, Artificial sequence
  SiRNA target sequence
gattatacatcaataaaacaggaagca

SEQ ID NO: 10494 - DNA, 27 bp, Artificial sequence
  SiRNA target sequence
attatacatcaataaaacaggaagcag

SEQ ID NO: 10495 - DNA, 27 bp, Artificial sequence
  SiRNA target sequence
ttatacatcaataaaacaggaagcaga

SEQ ID NO: 10496 - DNA, 27 bp, Artificial sequence
  SiRNA target sequence
tatacatcaataaaacaggaagcagat

SEQ ID NO: 10497 - DNA, 27 bp, Artificial sequence
  SiRNA target sequence
atacatcaataaaacaggaagcagata

SEQ ID NO: 10498 - DNA, 27 bp, Artificial sequence
  SiRNA target sequence
tacatcaataaaacaggaagcagataa

SEQ ID NO: 10499 - DNA, 27 bp, Artificial sequence
  SiRNA target sequence
acatcaataaaacaggaagcagataaa

SEQ ID NO: 10500 - DNA, 27 bp, Artificial sequence
  SiRNA target sequence
catcaataaaacaggaagcagataaat

SEQ ID NO: 10501 - DNA, 27 bp, Artificial sequence
  SiRNA target sequence
atcaataaaacaggaagcagataaata

SEQ ID NO: 10502 - DNA, 27 bp, Artificial sequence
  SiRNA target sequence
tcaataaaacaggaagcagataaatat

SEQ ID NO: 10503 - DNA, 27 bp, Artificial sequence
  SiRNA target sequence
caataaaacaggaagcagataaatatt

SEQ ID NO: 10504 - DNA, 27 bp, Artificial sequence
  SiRNA target sequence
aataaaacaggaagcagataaatattt

SEQ ID NO: 10505 - DNA, 27 bp, Artificial sequence
  SiRNA target sequence
ataaaacaggaagcagataaatatttt

SEQ ID NO: 10506 - DNA, 27 bp, Artificial sequence
  SiRNA target sequence
taaaacaggaagcagataaatatttta

SEQ ID NO: 10507 - DNA, 27 bp, Artificial sequence
  SiRNA target sequence
aaaacaggaagcagataaatattttat

SEQ ID NO: 10508 - DNA, 27 bp, Artificial sequence
  SiRNA target sequence
aaacaggaagcagataaatattttata

SEQ ID NO: 10509 - DNA, 27 bp, Artificial sequence
  SiRNA target sequence
aacaggaagcagataaatattttatac

SEQ ID NO: 10510 - DNA, 27 bp, Artificial sequence
  SiRNA target sequence
acaggaagcagataaatattttataca

SEQ ID NO: 10511 - DNA, 27 bp, Artificial sequence
  SiRNA target sequence
caggaagcagataaatattttatacaa

SEQ ID NO: 10512 - DNA, 27 bp, Artificial sequence
  SiRNA target sequence
aggaagcagataaatattttatacaag

SEQ ID NO: 10513 - DNA, 27 bp, Artificial sequence
  SiRNA target sequence
ggaagcagataaatattttatacaaga

SEQ ID NO: 10514 - DNA, 27 bp, Artificial sequence
  SiRNA target sequence
gaagcagataaatattttatacaagaa

SEQ ID NO: 10515 - DNA, 27 bp, Artificial sequence
  SiRNA target sequence
aagcagataaatattttatacaagaag

SEQ ID NO: 10516 - DNA, 27 bp, Artificial sequence
  SiRNA target sequence
agcagataaatattttatacaagaaga

SEQ ID NO: 10517 - DNA, 27 bp, Artificial sequence
  SiRNA target sequence
gcagataaatattttatacaagaagat

SEQ ID NO: 10518 - DNA, 27 bp, Artificial sequence
  SiRNA target sequence
cagataaatattttatacaagaagatt

SEQ ID NO: 10519 - DNA, 27 bp, Artificial sequence
  SiRNA target sequence
agataaatattttatacaagaagatta

SEQ ID NO: 10520 - DNA, 27 bp, Artificial sequence
  SiRNA target sequence
gataaatattttatacaagaagattat

SEQ ID NO: 10521 - DNA, 27 bp, Artificial sequence
  SiRNA target sequence
ataaatattttatacaagaagattata

SEQ ID NO: 10522 - DNA, 27 bp, Artificial sequence
  SiRNA target sequence
taaatattttatacaagaagattataa

SEQ ID NO: 10523 - DNA, 27 bp, Artificial sequence
  SiRNA target sequence
aaatattttatacaagaagattataaa

SEQ ID NO: 10524 - DNA, 27 bp, Artificial sequence
  SiRNA target sequence
aatattttatacaagaagattataaaa

SEQ ID NO: 10525 - DNA, 27 bp, Artificial sequence
  SiRNA target sequence
atattttatacaagaagattataaaaa

SEQ ID NO: 10526 - DNA, 27 bp, Artificial sequence
  SiRNA target sequence
tattttatacaagaagattataaaaat

SEQ ID NO: 10527 - DNA, 27 bp, Artificial sequence
  SiRNA target sequence
attttatacaagaagattataaaaatg

SEQ ID NO: 10528 - DNA, 27 bp, Artificial sequence
  SiRNA target sequence
ttttatacaagaagattataaaaatgc

SEQ ID NO: 10529 - DNA, 27 bp, Artificial sequence
  SiRNA target sequence
tttatacaagaagattataaaaatgct

SEQ ID NO: 10530 - DNA, 27 bp, Artificial sequence
  SiRNA target sequence
ttatacaagaagattataaaaatgcta

SEQ ID NO: 10531 - DNA, 27 bp, Artificial sequence
  SiRNA target sequence
tatacaagaagattataaaaatgctat

SEQ ID NO: 10532 - DNA, 27 bp, Artificial sequence
  SiRNA target sequence
atacaagaagattataaaaatgctatt

SEQ ID NO: 10533 - DNA, 27 bp, Artificial sequence
  SiRNA target sequence
tacaagaagattataaaaatgctattc

SEQ ID NO: 10534 - DNA, 27 bp, Artificial sequence
  SiRNA target sequence
acaagaagattataaaaatgctattct

SEQ ID NO: 10535 - DNA, 27 bp, Artificial sequence
  SiRNA target sequence
caagaagattataaaaatgctattctg

SEQ ID NO: 10536 - DNA, 27 bp, Artificial sequence
  SiRNA target sequence
aagaagattataaaaatgctattctgt

SEQ ID NO: 10537 - DNA, 27 bp, Artificial sequence
  SiRNA target sequence
agaagattataaaaatgctattctgtt

SEQ ID NO: 10538 - DNA, 27 bp, Artificial sequence
  SiRNA target sequence
gaagattataaaaatgctattctgttg

SEQ ID NO: 10539 - DNA, 27 bp, Artificial sequence
  SiRNA target sequence
aagattataaaaatgctattctgttgt

SEQ ID NO: 10540 - DNA, 27 bp, Artificial sequence
  SiRNA target sequence
agattataaaaatgctattctgttgta

SEQ ID NO: 10541 - DNA, 27 bp, Artificial sequence
  SiRNA target sequence
gattataaaaatgctattctgttgtac

SEQ ID NO: 10542 - DNA, 27 bp, Artificial sequence
  SiRNA target sequence
attataaaaatgctattctgttgtaca

SEQ ID NO: 10543 - DNA, 27 bp, Artificial sequence
  SiRNA target sequence
ttataaaaatgctattctgttgtacac

SEQ ID NO: 10544 - DNA, 27 bp, Artificial sequence
  SiRNA target sequence
tataaaaatgctattctgttgtacact

SEQ ID NO: 10545 - DNA, 27 bp, Artificial sequence
  SiRNA target sequence
ataaaaatgctattctgttgtacacta

SEQ ID NO: 10546 - DNA, 27 bp, Artificial sequence
  SiRNA target sequence
taaaaatgctattctgttgtacactaa

SEQ ID NO: 10547 - DNA, 27 bp, Artificial sequence
  SiRNA target sequence
aaaaatgctattctgttgtacactaaa

SEQ ID NO: 10548 - DNA, 27 bp, Artificial sequence
  SiRNA target sequence
aaaatgctattctgttgtacactaaat

SEQ ID NO: 10549 - DNA, 27 bp, Artificial sequence
  SiRNA target sequence
aaatgctattctgttgtacactaaatg

SEQ ID NO: 10550 - DNA, 27 bp, Artificial sequence
  SiRNA target sequence
aatgctattctgttgtacactaaatgt

SEQ ID NO: 10551 - DNA, 27 bp, Artificial sequence
  SiRNA target sequence
atgctattctgttgtacactaaatgta

SEQ ID NO: 10552 - DNA, 27 bp, Artificial sequence
  SiRNA target sequence
tgctattctgttgtacactaaatgtaa

SEQ ID NO: 10553 - DNA, 27 bp, Artificial sequence
  SiRNA target sequence
gctattctgttgtacactaaatgtaaa

SEQ ID NO: 10554 - DNA, 27 bp, Artificial sequence
  SiRNA target sequence
ctattctgttgtacactaaatgtaaat

SEQ ID NO: 10555 - DNA, 27 bp, Artificial sequence
  SiRNA target sequence
tattctgttgtacactaaatgtaaata

SEQ ID NO: 10556 - DNA, 27 bp, Artificial sequence
  SiRNA target sequence
attctgttgtacactaaatgtaaatat

SEQ ID NO: 10557 - DNA, 27 bp, Artificial sequence
  SiRNA target sequence
ttctgttgtacactaaatgtaaatata

SEQ ID NO: 10558 - DNA, 27 bp, Artificial sequence
  SiRNA target sequence
tctgttgtacactaaatgtaaatatat

SEQ ID NO: 10559 - DNA, 27 bp, Artificial sequence
  SiRNA target sequence
ctgttgtacactaaatgtaaatatatg

SEQ ID NO: 10560 - DNA, 27 bp, Artificial sequence
  SiRNA target sequence
tgttgtacactaaatgtaaatatatga

SEQ ID NO: 10561 - DNA, 27 bp, Artificial sequence
  SiRNA target sequence
gttgtacactaaatgtaaatatatgaa

SEQ ID NO: 10562 - DNA, 27 bp, Artificial sequence
  SiRNA target sequence
ttgtacactaaatgtaaatatatgaaa

SEQ ID NO: 10563 - DNA, 27 bp, Artificial sequence
  SiRNA target sequence
tgtacactaaatgtaaatatatgaaaa

SEQ ID NO: 10564 - DNA, 27 bp, Artificial sequence
  SiRNA target sequence
gtacactaaatgtaaatatatgaaaag

SEQ ID NO: 10565 - DNA, 27 bp, Artificial sequence
  SiRNA target sequence
tacactaaatgtaaatatatgaaaagt

SEQ ID NO: 10566 - DNA, 27 bp, Artificial sequence
  SiRNA target sequence
acactaaatgtaaatatatgaaaagtg

SEQ ID NO: 10567 - DNA, 27 bp, Artificial sequence
  SiRNA target sequence
cactaaatgtaaatatatgaaaagtga

SEQ ID NO: 10568 - DNA, 27 bp, Artificial sequence
  SiRNA target sequence
actaaatgtaaatatatgaaaagtgat

SEQ ID NO: 10569 - DNA, 27 bp, Artificial sequence
  SiRNA target sequence
ctaaatgtaaatatatgaaaagtgatg

SEQ ID NO: 10570 - DNA, 27 bp, Artificial sequence
  SiRNA target sequence
taaatgtaaatatatgaaaagtgatgc

SEQ ID NO: 10571 - DNA, 27 bp, Artificial sequence
  SiRNA target sequence
aaatgtaaatatatgaaaagtgatgct

SEQ ID NO: 10572 - DNA, 27 bp, Artificial sequence
  SiRNA target sequence
aatgtaaatatatgaaaagtgatgctg

SEQ ID NO: 10573 - DNA, 27 bp, Artificial sequence
  SiRNA target sequence
atgtaaatatatgaaaagtgatgctga

SEQ ID NO: 10574 - DNA, 27 bp, Artificial sequence
  SiRNA target sequence
tgtaaatatatgaaaagtgatgctgaa

SEQ ID NO: 10575 - DNA, 27 bp, Artificial sequence
  SiRNA target sequence
gtaaatatatgaaaagtgatgctgaaa

SEQ ID NO: 10576 - DNA, 27 bp, Artificial sequence
  SiRNA target sequence
taaatatatgaaaagtgatgctgaaat

SEQ ID NO: 10577 - DNA, 27 bp, Artificial sequence
  SiRNA target sequence
aaatatatgaaaagtgatgctgaaatt

SEQ ID NO: 10578 - DNA, 27 bp, Artificial sequence
  SiRNA target sequence
aatatatgaaaagtgatgctgaaattc

SEQ ID NO: 10579 - DNA, 27 bp, Artificial sequence
  SiRNA target sequence
atatatgaaaagtgatgctgaaattct

SEQ ID NO: 10580 - DNA, 27 bp, Artificial sequence
  SiRNA target sequence
tatatgaaaagtgatgctgaaattctt

SEQ ID NO: 10581 - DNA, 27 bp, Artificial sequence
  SiRNA target sequence
atatgaaaagtgatgctgaaattctta

SEQ ID NO: 10582 - DNA, 27 bp, Artificial sequence
  SiRNA target sequence
tatgaaaagtgatgctgaaattcttac

SEQ ID NO: 10583 - DNA, 27 bp, Artificial sequence
  SiRNA target sequence
atgaaaagtgatgctgaaattcttact

SEQ ID NO: 10584 - DNA, 27 bp, Artificial sequence
  SiRNA target sequence
tgaaaagtgatgctgaaattcttacta

SEQ ID NO: 10585 - DNA, 27 bp, Artificial sequence
  SiRNA target sequence
gaaaagtgatgctgaaattcttactaa

SEQ ID NO: 10586 - DNA, 27 bp, Artificial sequence
  SiRNA target sequence
aaaagtgatgctgaaattcttactaaa

SEQ ID NO: 10587 - DNA, 27 bp, Artificial sequence
  SiRNA target sequence
aaagtgatgctgaaattcttactaaaa

SEQ ID NO: 10588 - DNA, 27 bp, Artificial sequence
  SiRNA target sequence
aagtgatgctgaaattcttactaaaat

SEQ ID NO: 10589 - DNA, 27 bp, Artificial sequence
  SiRNA target sequence
agtgatgctgaaattcttactaaaatt

SEQ ID NO: 10590 - DNA, 27 bp, Artificial sequence
  SiRNA target sequence
gtgatgctgaaattcttactaaaatta

SEQ ID NO: 10591 - DNA, 27 bp, Artificial sequence
  SiRNA target sequence
tgatgctgaaattcttactaaaattag

SEQ ID NO: 10592 - DNA, 27 bp, Artificial sequence
  SiRNA target sequence
gatgctgaaattcttactaaaattagt

SEQ ID NO: 10593 - DNA, 27 bp, Artificial sequence
  SiRNA target sequence
atgctgaaattcttactaaaattagtc

SEQ ID NO: 10594 - DNA, 27 bp, Artificial sequence
  SiRNA target sequence
tgctgaaattcttactaaaattagtct

SEQ ID NO: 10595 - DNA, 27 bp, Artificial sequence
  SiRNA target sequence
gctgaaattcttactaaaattagtctc

SEQ ID NO: 10596 - DNA, 27 bp, Artificial sequence
  SiRNA target sequence
ctgaaattcttactaaaattagtctct

SEQ ID NO: 10597 - DNA, 27 bp, Artificial sequence
  SiRNA target sequence
tgaaattcttactaaaattagtctctg

SEQ ID NO: 10598 - DNA, 27 bp, Artificial sequence
  SiRNA target sequence
gaaattcttactaaaattagtctctgt

SEQ ID NO: 10599 - DNA, 27 bp, Artificial sequence
  SiRNA target sequence
aaattcttactaaaattagtctctgta

SEQ ID NO: 10600 - DNA, 27 bp, Artificial sequence
  SiRNA target sequence
aattcttactaaaattagtctctgtaa

SEQ ID NO: 10601 - DNA, 27 bp, Artificial sequence
  SiRNA target sequence
attcttactaaaattagtctctgtaat

SEQ ID NO: 10602 - DNA, 27 bp, Artificial sequence
  SiRNA target sequence
ttcttactaaaattagtctctgtaatt

SEQ ID NO: 10603 - DNA, 27 bp, Artificial sequence
  SiRNA target sequence
tcttactaaaattagtctctgtaatta

SEQ ID NO: 10604 - DNA, 27 bp, Artificial sequence
  SiRNA target sequence
cttactaaaattagtctctgtaattat

SEQ ID NO: 10605 - DNA, 27 bp, Artificial sequence
  SiRNA target sequence
ttactaaaattagtctctgtaattatt

SEQ ID NO: 10606 - DNA, 27 bp, Artificial sequence
  SiRNA target sequence
tactaaaattagtctctgtaattattt

SEQ ID NO: 10607 - DNA, 27 bp, Artificial sequence
  SiRNA target sequence
actaaaattagtctctgtaattatttc

SEQ ID NO: 10608 - DNA, 27 bp, Artificial sequence
  SiRNA target sequence
ctaaaattagtctctgtaattatttct

SEQ ID NO: 10609 - DNA, 27 bp, Artificial sequence
  SiRNA target sequence
taaaattagtctctgtaattatttctt

SEQ ID NO: 10610 - DNA, 27 bp, Artificial sequence
  SiRNA target sequence
aaaattagtctctgtaattatttctta

SEQ ID NO: 10611 - DNA, 27 bp, Artificial sequence
  SiRNA target sequence
aaattagtctctgtaattatttcttaa

SEQ ID NO: 10612 - DNA, 27 bp, Artificial sequence
  SiRNA target sequence
aattagtctctgtaattatttcttaaa

SEQ ID NO: 10613 - DNA, 27 bp, Artificial sequence
  SiRNA target sequence
attagtctctgtaattatttcttaaaa

SEQ ID NO: 10614 - DNA, 27 bp, Artificial sequence
  SiRNA target sequence
ttagtctctgtaattatttcttaaaaa

SEQ ID NO: 10615 - DNA, 27 bp, Artificial sequence
  SiRNA target sequence
tagtctctgtaattatttcttaaaaaa

SEQ ID NO: 10616 - DNA, 27 bp, Artificial sequence
  SiRNA target sequence
agtctctgtaattatttcttaaaaaat

SEQ ID NO: 10617 - DNA, 27 bp, Artificial sequence
  SiRNA target sequence
gtctctgtaattatttcttaaaaaatt

SEQ ID NO: 10618 - DNA, 27 bp, Artificial sequence
  SiRNA target sequence
tctctgtaattatttcttaaaaaatta

SEQ ID NO: 10619 - DNA, 27 bp, Artificial sequence
  SiRNA target sequence
ctctgtaattatttcttaaaaaattat

SEQ ID NO: 10620 - DNA, 27 bp, Artificial sequence
  SiRNA target sequence
tctgtaattatttcttaaaaaattatc

SEQ ID NO: 10621 - DNA, 27 bp, Artificial sequence
  SiRNA target sequence
ctgtaattatttcttaaaaaattatca

SEQ ID NO: 10622 - DNA, 27 bp, Artificial sequence
  SiRNA target sequence
tgtaattatttcttaaaaaattatcaa

SEQ ID NO: 10623 - DNA, 27 bp, Artificial sequence
  SiRNA target sequence
gtaattatttcttaaaaaattatcaag

SEQ ID NO: 10624 - DNA, 27 bp, Artificial sequence
  SiRNA target sequence
taattatttcttaaaaaattatcaaga

SEQ ID NO: 10625 - DNA, 27 bp, Artificial sequence
  SiRNA target sequence
aattatttcttaaaaaattatcaagaa

SEQ ID NO: 10626 - DNA, 27 bp, Artificial sequence
  SiRNA target sequence
attatttcttaaaaaattatcaagaag

SEQ ID NO: 10627 - DNA, 27 bp, Artificial sequence
  SiRNA target sequence
ttatttcttaaaaaattatcaagaagt

SEQ ID NO: 10628 - DNA, 27 bp, Artificial sequence
  SiRNA target sequence
tatttcttaaaaaattatcaagaagtt

SEQ ID NO: 10629 - DNA, 27 bp, Artificial sequence
  SiRNA target sequence
atttcttaaaaaattatcaagaagtta

SEQ ID NO: 10630 - DNA, 27 bp, Artificial sequence
  SiRNA target sequence
tttcttaaaaaattatcaagaagttat

SEQ ID NO: 10631 - DNA, 27 bp, Artificial sequence
  SiRNA target sequence
ttcttaaaaaattatcaagaagttata

SEQ ID NO: 10632 - DNA, 27 bp, Artificial sequence
  SiRNA target sequence
tcttaaaaaattatcaagaagttataa

SEQ ID NO: 10633 - DNA, 27 bp, Artificial sequence
  SiRNA target sequence
cttaaaaaattatcaagaagttataaa

SEQ ID NO: 10634 - DNA, 27 bp, Artificial sequence
  SiRNA target sequence
ttaaaaaattatcaagaagttataaat

SEQ ID NO: 10635 - DNA, 27 bp, Artificial sequence
  SiRNA target sequence
taaaaaattatcaagaagttataaata

SEQ ID NO: 10636 - DNA, 27 bp, Artificial sequence
  SiRNA target sequence
aaaaaattatcaagaagttataaataa

SEQ ID NO: 10637 - DNA, 27 bp, Artificial sequence
  SiRNA target sequence
aaaaattatcaagaagttataaataat

SEQ ID NO: 10638 - DNA, 27 bp, Artificial sequence
  SiRNA target sequence
aaaattatcaagaagttataaataatt

SEQ ID NO: 10639 - DNA, 27 bp, Artificial sequence
  SiRNA target sequence
aaattatcaagaagttataaataattc

SEQ ID NO: 10640 - DNA, 27 bp, Artificial sequence
  SiRNA target sequence
aattatcaagaagttataaataattct

SEQ ID NO: 10641 - DNA, 27 bp, Artificial sequence
  SiRNA target sequence
attatcaagaagttataaataattctt

SEQ ID NO: 10642 - DNA, 27 bp, Artificial sequence
  SiRNA target sequence
ttatcaagaagttataaataattcttt

SEQ ID NO: 10643 - DNA, 27 bp, Artificial sequence
  SiRNA target sequence
tatcaagaagttataaataattcttta

SEQ ID NO: 10644 - DNA, 27 bp, Artificial sequence
  SiRNA target sequence
atcaagaagttataaataattctttat

SEQ ID NO: 10645 - DNA, 27 bp, Artificial sequence
  SiRNA target sequence
tcaagaagttataaataattctttatt

SEQ ID NO: 10646 - DNA, 27 bp, Artificial sequence
  SiRNA target sequence
caagaagttataaataattctttattt

SEQ ID NO: 10647 - DNA, 27 bp, Artificial sequence
  SiRNA target sequence
aagaagttataaataattctttattta

SEQ ID NO: 10648 - DNA, 27 bp, Artificial sequence
  SiRNA target sequence
agaagttataaataattctttatttaa

SEQ ID NO: 10649 - DNA, 27 bp, Artificial sequence
  SiRNA target sequence
gaagttataaataattctttatttaag

SEQ ID NO: 10650 - DNA, 27 bp, Artificial sequence
  SiRNA target sequence
aagttataaataattctttatttaaga

SEQ ID NO: 10651 - DNA, 27 bp, Artificial sequence
  SiRNA target sequence
agttataaataattctttatttaagac

SEQ ID NO: 10652 - DNA, 27 bp, Artificial sequence
  SiRNA target sequence
gttataaataattctttatttaagaca

SEQ ID NO: 10653 - DNA, 27 bp, Artificial sequence
  SiRNA target sequence
ttataaataattctttatttaagacaa

SEQ ID NO: 10654 - DNA, 27 bp, Artificial sequence
  SiRNA target sequence
tataaataattctttatttaagacaaa

SEQ ID NO: 10655 - DNA, 27 bp, Artificial sequence
  SiRNA target sequence
ataaataattctttatttaagacaaat

SEQ ID NO: 10656 - DNA, 27 bp, Artificial sequence
  SiRNA target sequence
taaataattctttatttaagacaaata

SEQ ID NO: 10657 - DNA, 27 bp, Artificial sequence
  SiRNA target sequence
aaataattctttatttaagacaaataa

SEQ ID NO: 10658 - DNA, 27 bp, Artificial sequence
  SiRNA target sequence
aataattctttatttaagacaaataat

SEQ ID NO: 10659 - DNA, 27 bp, Artificial sequence
  SiRNA target sequence
ataattctttatttaagacaaataata

SEQ ID NO: 10660 - DNA, 27 bp, Artificial sequence
  SiRNA target sequence
taattctttatttaagacaaataataa

SEQ ID NO: 10661 - DNA, 27 bp, Artificial sequence
  SiRNA target sequence
aattctttatttaagacaaataataaa

SEQ ID NO: 10662 - DNA, 27 bp, Artificial sequence
  SiRNA target sequence
attctttatttaagacaaataataaag

SEQ ID NO: 10663 - DNA, 27 bp, Artificial sequence
  SiRNA target sequence
ttctttatttaagacaaataataaaga

SEQ ID NO: 10664 - DNA, 27 bp, Artificial sequence
  SiRNA target sequence
tctttatttaagacaaataataaagat

SEQ ID NO: 10665 - DNA, 27 bp, Artificial sequence
  SiRNA target sequence
ctttatttaagacaaataataaagatc

SEQ ID NO: 10666 - DNA, 27 bp, Artificial sequence
  SiRNA target sequence
tttatttaagacaaataataaagatct

SEQ ID NO: 10667 - DNA, 27 bp, Artificial sequence
  SiRNA target sequence
ttatttaagacaaataataaagatcta

SEQ ID NO: 10668 - DNA, 27 bp, Artificial sequence
  SiRNA target sequence
tatttaagacaaataataaagatctaa

SEQ ID NO: 10669 - DNA, 27 bp, Artificial sequence
  SiRNA target sequence
atttaagacaaataataaagatctaat

SEQ ID NO: 10670 - DNA, 27 bp, Artificial sequence
  SiRNA target sequence
tttaagacaaataataaagatctaata

SEQ ID NO: 10671 - DNA, 27 bp, Artificial sequence
  SiRNA target sequence
ttaagacaaataataaagatctaataa

SEQ ID NO: 10672 - DNA, 27 bp, Artificial sequence
  SiRNA target sequence
taagacaaataataaagatctaataaa

SEQ ID NO: 10673 - DNA, 27 bp, Artificial sequence
  SiRNA target sequence
aagacaaataataaagatctaataaaa

SEQ ID NO: 10674 - DNA, 27 bp, Artificial sequence
  SiRNA target sequence
agacaaataataaagatctaataaaaa

SEQ ID NO: 10675 - DNA, 27 bp, Artificial sequence
  SiRNA target sequence
gacaaataataaagatctaataaaaat

SEQ ID NO: 10676 - DNA, 27 bp, Artificial sequence
  SiRNA target sequence
acaaataataaagatctaataaaaata

SEQ ID NO: 10677 - DNA, 27 bp, Artificial sequence
  SiRNA target sequence
caaataataaagatctaataaaaataa

SEQ ID NO: 10678 - DNA, 27 bp, Artificial sequence
  SiRNA target sequence
aaataataaagatctaataaaaataag

SEQ ID NO: 10679 - DNA, 27 bp, Artificial sequence
  SiRNA target sequence
aataataaagatctaataaaaataaga

SEQ ID NO: 10680 - DNA, 27 bp, Artificial sequence
  SiRNA target sequence
ataataaagatctaataaaaataagat

SEQ ID NO: 10681 - DNA, 27 bp, Artificial sequence
  SiRNA target sequence
taataaagatctaataaaaataagatc

SEQ ID NO: 10682 - DNA, 27 bp, Artificial sequence
  SiRNA target sequence
aataaagatctaataaaaataagatct

SEQ ID NO: 10683 - DNA, 27 bp, Artificial sequence
  SiRNA target sequence
ataaagatctaataaaaataagatctg

SEQ ID NO: 10684 - DNA, 27 bp, Artificial sequence
  SiRNA target sequence
taaagatctaataaaaataagatctga

SEQ ID NO: 10685 - DNA, 27 bp, Artificial sequence
  SiRNA target sequence
aaagatctaataaaaataagatctgaa

SEQ ID NO: 10686 - DNA, 27 bp, Artificial sequence
  SiRNA target sequence
aagatctaataaaaataagatctgaat

SEQ ID NO: 10687 - DNA, 27 bp, Artificial sequence
  SiRNA target sequence
agatctaataaaaataagatctgaatg

SEQ ID NO: 10688 - DNA, 27 bp, Artificial sequence
  SiRNA target sequence
gatctaataaaaataagatctgaatgt

SEQ ID NO: 10689 - DNA, 27 bp, Artificial sequence
  SiRNA target sequence
atctaataaaaataagatctgaatgtt

SEQ ID NO: 10690 - DNA, 27 bp, Artificial sequence
  SiRNA target sequence
tctaataaaaataagatctgaatgtta

SEQ ID NO: 10691 - DNA, 27 bp, Artificial sequence
  SiRNA target sequence
ctaataaaaataagatctgaatgttac

SEQ ID NO: 10692 - DNA, 27 bp, Artificial sequence
  SiRNA target sequence
taataaaaataagatctgaatgttaca

SEQ ID NO: 10693 - DNA, 27 bp, Artificial sequence
  SiRNA target sequence
aataaaaataagatctgaatgttacaa

SEQ ID NO: 10694 - DNA, 27 bp, Artificial sequence
  SiRNA target sequence
ataaaaataagatctgaatgttacaag

SEQ ID NO: 10695 - DNA, 27 bp, Artificial sequence
  SiRNA target sequence
taaaaataagatctgaatgttacaagc

SEQ ID NO: 10696 - DNA, 27 bp, Artificial sequence
  SiRNA target sequence
aaaaataagatctgaatgttacaagca

SEQ ID NO: 10697 - DNA, 27 bp, Artificial sequence
  SiRNA target sequence
aaaataagatctgaatgttacaagcag

SEQ ID NO: 10698 - DNA, 27 bp, Artificial sequence
  SiRNA target sequence
aaataagatctgaatgttacaagcaga

SEQ ID NO: 10699 - DNA, 27 bp, Artificial sequence
  SiRNA target sequence
aataagatctgaatgttacaagcagat

SEQ ID NO: 10700 - DNA, 27 bp, Artificial sequence
  SiRNA target sequence
ataagatctgaatgttacaagcagatg

SEQ ID NO: 10701 - DNA, 27 bp, Artificial sequence
  SiRNA target sequence
taagatctgaatgttacaagcagatgg

SEQ ID NO: 10702 - DNA, 27 bp, Artificial sequence
  SiRNA target sequence
aagatctgaatgttacaagcagatggg

SEQ ID NO: 10703 - DNA, 27 bp, Artificial sequence
  SiRNA target sequence
agatctgaatgttacaagcagatggga

SEQ ID NO: 10704 - DNA, 27 bp, Artificial sequence
  SiRNA target sequence
gatctgaatgttacaagcagatgggaa

SEQ ID NO: 10705 - DNA, 27 bp, Artificial sequence
  SiRNA target sequence
atctgaatgttacaagcagatgggaaa

SEQ ID NO: 10706 - DNA, 27 bp, Artificial sequence
  SiRNA target sequence
tctgaatgttacaagcagatgggaaat

SEQ ID NO: 10707 - DNA, 27 bp, Artificial sequence
  SiRNA target sequence
ctgaatgttacaagcagatgggaaata

SEQ ID NO: 10708 - DNA, 27 bp, Artificial sequence
  SiRNA target sequence
tgaatgttacaagcagatgggaaataa

SEQ ID NO: 10709 - DNA, 27 bp, Artificial sequence
  SiRNA target sequence
gaatgttacaagcagatgggaaataaa

SEQ ID NO: 10710 - DNA, 27 bp, Artificial sequence
  SiRNA target sequence
aatgttacaagcagatgggaaataaaa

SEQ ID NO: 10711 - DNA, 27 bp, Artificial sequence
  SiRNA target sequence
atgttacaagcagatgggaaataaaaa

SEQ ID NO: 10712 - DNA, 27 bp, Artificial sequence
  SiRNA target sequence
tgttacaagcagatgggaaataaaaaa

SEQ ID NO: 10713 - DNA, 27 bp, Artificial sequence
  SiRNA target sequence
gttacaagcagatgggaaataaaaaaa

SEQ ID NO: 10714 - DNA, 27 bp, Artificial sequence
  SiRNA target sequence
ttacaagcagatgggaaataaaaaaaa

SEQ ID NO: 10715 - DNA, 27 bp, Artificial sequence
  SiRNA target sequence
tacaagcagatgggaaataaaaaaaaa

SEQ ID NO: 10716 - DNA, 27 bp, Artificial sequence
  SiRNA target sequence
acaagcagatgggaaataaaaaaaaat

SEQ ID NO: 10717 - DNA, 27 bp, Artificial sequence
  SiRNA target sequence
caagcagatgggaaataaaaaaaaatt

SEQ ID NO: 10718 - DNA, 27 bp, Artificial sequence
  SiRNA target sequence
aagcagatgggaaataaaaaaaaattt

SEQ ID NO: 10719 - DNA, 27 bp, Artificial sequence
  SiRNA target sequence
agcagatgggaaataaaaaaaaatttc

SEQ ID NO: 10720 - DNA, 27 bp, Artificial sequence
  SiRNA target sequence
gcagatgggaaataaaaaaaaatttct

SEQ ID NO: 10721 - DNA, 27 bp, Artificial sequence
  SiRNA target sequence
cagatgggaaataaaaaaaaatttctt

SEQ ID NO: 10722 - DNA, 27 bp, Artificial sequence
  SiRNA target sequence
agatgggaaataaaaaaaaatttctta

SEQ ID NO: 10723 - DNA, 27 bp, Artificial sequence
  SiRNA target sequence
gatgggaaataaaaaaaaatttcttaa

SEQ ID NO: 10724 - DNA, 27 bp, Artificial sequence
  SiRNA target sequence
atgggaaataaaaaaaaatttcttaag

SEQ ID NO: 10725 - DNA, 27 bp, Artificial sequence
  SiRNA target sequence
tgggaaataaaaaaaaatttcttaagg

SEQ ID NO: 10726 - DNA, 27 bp, Artificial sequence
  SiRNA target sequence
gggaaataaaaaaaaatttcttaagga

SEQ ID NO: 10727 - DNA, 27 bp, Artificial sequence
  SiRNA target sequence
ggaaataaaaaaaaatttcttaaggat

SEQ ID NO: 10728 - DNA, 27 bp, Artificial sequence
  SiRNA target sequence
gaaataaaaaaaaatttcttaaggatt

SEQ ID NO: 10729 - DNA, 27 bp, Artificial sequence
  SiRNA target sequence
aaataaaaaaaaatttcttaaggattt

SEQ ID NO: 10730 - DNA, 27 bp, Artificial sequence
  SiRNA target sequence
aataaaaaaaaatttcttaaggattta

SEQ ID NO: 10731 - DNA, 27 bp, Artificial sequence
  SiRNA target sequence
ataaaaaaaaatttcttaaggatttag

SEQ ID NO: 10732 - DNA, 27 bp, Artificial sequence
  SiRNA target sequence
taaaaaaaaatttcttaaggatttagc

SEQ ID NO: 10733 - DNA, 27 bp, Artificial sequence
  SiRNA target sequence
aaaaaaaaatttcttaaggatttagca

SEQ ID NO: 10734 - DNA, 27 bp, Artificial sequence
  SiRNA target sequence
aaaaaaaatttcttaaggatttagcac

SEQ ID NO: 10735 - DNA, 27 bp, Artificial sequence
  SiRNA target sequence
aaaaaaatttcttaaggatttagcact

SEQ ID NO: 10736 - DNA, 27 bp, Artificial sequence
  SiRNA target sequence
aaaaaatttcttaaggatttagcactt

SEQ ID NO: 10737 - DNA, 27 bp, Artificial sequence
  SiRNA target sequence
aaaaatttcttaaggatttagcacttt

SEQ ID NO: 10738 - DNA, 27 bp, Artificial sequence
  SiRNA target sequence
aaaatttcttaaggatttagcacttta

SEQ ID NO: 10739 - DNA, 27 bp, Artificial sequence
  SiRNA target sequence
aaatttcttaaggatttagcactttat

SEQ ID NO: 10740 - DNA, 27 bp, Artificial sequence
  SiRNA target sequence
aatttcttaaggatttagcactttatg

SEQ ID NO: 10741 - DNA, 27 bp, Artificial sequence
  SiRNA target sequence
atttcttaaggatttagcactttatga

SEQ ID NO: 10742 - DNA, 27 bp, Artificial sequence
  SiRNA target sequence
tttcttaaggatttagcactttatgaa

SEQ ID NO: 10743 - DNA, 27 bp, Artificial sequence
  SiRNA target sequence
ttcttaaggatttagcactttatgaaa

SEQ ID NO: 10744 - DNA, 27 bp, Artificial sequence
  SiRNA target sequence
tcttaaggatttagcactttatgaaac

SEQ ID NO: 10745 - DNA, 27 bp, Artificial sequence
  SiRNA target sequence
cttaaggatttagcactttatgaaaca

SEQ ID NO: 10746 - DNA, 27 bp, Artificial sequence
  SiRNA target sequence
ttaaggatttagcactttatgaaacat

SEQ ID NO: 10747 - DNA, 27 bp, Artificial sequence
  SiRNA target sequence
taaggatttagcactttatgaaacatt

SEQ ID NO: 10748 - DNA, 27 bp, Artificial sequence
  SiRNA target sequence
aaggatttagcactttatgaaacattt

SEQ ID NO: 10749 - DNA, 27 bp, Artificial sequence
  SiRNA target sequence
aggatttagcactttatgaaacatttg

SEQ ID NO: 10750 - DNA, 27 bp, Artificial sequence
  SiRNA target sequence
ggatttagcactttatgaaacatttgc

SEQ ID NO: 10751 - DNA, 27 bp, Artificial sequence
  SiRNA target sequence
gatttagcactttatgaaacatttgct

SEQ ID NO: 10752 - DNA, 27 bp, Artificial sequence
  SiRNA target sequence
atttagcactttatgaaacatttgcta

SEQ ID NO: 10753 - DNA, 27 bp, Artificial sequence
  SiRNA target sequence
tttagcactttatgaaacatttgctaa

SEQ ID NO: 10754 - DNA, 27 bp, Artificial sequence
  SiRNA target sequence
ttagcactttatgaaacatttgctaat

SEQ ID NO: 10755 - DNA, 27 bp, Artificial sequence
  SiRNA target sequence
tagcactttatgaaacatttgctaata

SEQ ID NO: 10756 - DNA, 27 bp, Artificial sequence
  SiRNA target sequence
agcactttatgaaacatttgctaataa

SEQ ID NO: 10757 - DNA, 27 bp, Artificial sequence
  SiRNA target sequence
gcactttatgaaacatttgctaataat

SEQ ID NO: 10758 - DNA, 27 bp, Artificial sequence
  SiRNA target sequence
cactttatgaaacatttgctaataata

SEQ ID NO: 10759 - DNA, 27 bp, Artificial sequence
  SiRNA target sequence
actttatgaaacatttgctaataataa

SEQ ID NO: 10760 - DNA, 27 bp, Artificial sequence
  SiRNA target sequence
ctttatgaaacatttgctaataataaa

SEQ ID NO: 10761 - DNA, 27 bp, Artificial sequence
  SiRNA target sequence
tttatgaaacatttgctaataataaag

SEQ ID NO: 10762 - DNA, 27 bp, Artificial sequence
  SiRNA target sequence
ttatgaaacatttgctaataataaaga

SEQ ID NO: 10763 - DNA, 27 bp, Artificial sequence
  SiRNA target sequence
tatgaaacatttgctaataataaagaa

SEQ ID NO: 10764 - DNA, 27 bp, Artificial sequence
  SiRNA target sequence
atgaaacatttgctaataataaagaag

SEQ ID NO: 10765 - DNA, 27 bp, Artificial sequence
  SiRNA target sequence
tgaaacatttgctaataataaagaagt

SEQ ID NO: 10766 - DNA, 27 bp, Artificial sequence
  SiRNA target sequence
gaaacatttgctaataataaagaagtc

SEQ ID NO: 10767 - DNA, 27 bp, Artificial sequence
  SiRNA target sequence
aaacatttgctaataataaagaagtcc

SEQ ID NO: 10768 - DNA, 27 bp, Artificial sequence
  SiRNA target sequence
aacatttgctaataataaagaagtcca

SEQ ID NO: 10769 - DNA, 27 bp, Artificial sequence
  SiRNA target sequence
acatttgctaataataaagaagtccaa

SEQ ID NO: 10770 - DNA, 27 bp, Artificial sequence
  SiRNA target sequence
catttgctaataataaagaagtccaag

SEQ ID NO: 10771 - DNA, 27 bp, Artificial sequence
  SiRNA target sequence
atttgctaataataaagaagtccaaga

SEQ ID NO: 10772 - DNA, 27 bp, Artificial sequence
  SiRNA target sequence
tttgctaataataaagaagtccaagat

SEQ ID NO: 10773 - DNA, 27 bp, Artificial sequence
  SiRNA target sequence
ttgctaataataaagaagtccaagatg

SEQ ID NO: 10774 - DNA, 27 bp, Artificial sequence
  SiRNA target sequence
tgctaataataaagaagtccaagatga

SEQ ID NO: 10775 - DNA, 27 bp, Artificial sequence
  SiRNA target sequence
gctaataataaagaagtccaagatgaa

SEQ ID NO: 10776 - DNA, 27 bp, Artificial sequence
  SiRNA target sequence
ctaataataaagaagtccaagatgaaa

SEQ ID NO: 10777 - DNA, 27 bp, Artificial sequence
  SiRNA target sequence
taataataaagaagtccaagatgaaat

SEQ ID NO: 10778 - DNA, 27 bp, Artificial sequence
  SiRNA target sequence
aataataaagaagtccaagatgaaatt

SEQ ID NO: 10779 - DNA, 27 bp, Artificial sequence
  SiRNA target sequence
ataataaagaagtccaagatgaaatta

SEQ ID NO: 10780 - DNA, 27 bp, Artificial sequence
  SiRNA target sequence
taataaagaagtccaagatgaaattat

SEQ ID NO: 10781 - DNA, 27 bp, Artificial sequence
  SiRNA target sequence
aataaagaagtccaagatgaaattatg

SEQ ID NO: 10782 - DNA, 27 bp, Artificial sequence
  SiRNA target sequence
ataaagaagtccaagatgaaattatgc

SEQ ID NO: 10783 - DNA, 27 bp, Artificial sequence
  SiRNA target sequence
taaagaagtccaagatgaaattatgca

SEQ ID NO: 10784 - DNA, 27 bp, Artificial sequence
  SiRNA target sequence
aaagaagtccaagatgaaattatgcag

SEQ ID NO: 10785 - DNA, 27 bp, Artificial sequence
  SiRNA target sequence
aagaagtccaagatgaaattatgcaga

SEQ ID NO: 10786 - DNA, 27 bp, Artificial sequence
  SiRNA target sequence
agaagtccaagatgaaattatgcagac

SEQ ID NO: 10787 - DNA, 27 bp, Artificial sequence
  SiRNA target sequence
gaagtccaagatgaaattatgcagact

SEQ ID NO: 10788 - DNA, 27 bp, Artificial sequence
  SiRNA target sequence
aagtccaagatgaaattatgcagactg

SEQ ID NO: 10789 - DNA, 27 bp, Artificial sequence
  SiRNA target sequence
agtccaagatgaaattatgcagactgt

SEQ ID NO: 10790 - DNA, 27 bp, Artificial sequence
  SiRNA target sequence
gtccaagatgaaattatgcagactgtt

SEQ ID NO: 10791 - DNA, 27 bp, Artificial sequence
  SiRNA target sequence
tccaagatgaaattatgcagactgtta

SEQ ID NO: 10792 - DNA, 27 bp, Artificial sequence
  SiRNA target sequence
ccaagatgaaattatgcagactgttaa

SEQ ID NO: 10793 - DNA, 27 bp, Artificial sequence
  SiRNA target sequence
caagatgaaattatgcagactgttaaa

SEQ ID NO: 10794 - DNA, 27 bp, Artificial sequence
  SiRNA target sequence
aagatgaaattatgcagactgttaaag

SEQ ID NO: 10795 - DNA, 27 bp, Artificial sequence
  SiRNA target sequence
agatgaaattatgcagactgttaaaga

SEQ ID NO: 10796 - DNA, 27 bp, Artificial sequence
  SiRNA target sequence
gatgaaattatgcagactgttaaagaa

SEQ ID NO: 10797 - DNA, 27 bp, Artificial sequence
  SiRNA target sequence
atgaaattatgcagactgttaaagaaa

SEQ ID NO: 10798 - DNA, 27 bp, Artificial sequence
  SiRNA target sequence
tgaaattatgcagactgttaaagaaat

SEQ ID NO: 10799 - DNA, 27 bp, Artificial sequence
  SiRNA target sequence
gaaattatgcagactgttaaagaaatt

SEQ ID NO: 10800 - DNA, 27 bp, Artificial sequence
  SiRNA target sequence
aaattatgcagactgttaaagaaattt

SEQ ID NO: 10801 - DNA, 27 bp, Artificial sequence
  SiRNA target sequence
aattatgcagactgttaaagaaatttg

SEQ ID NO: 10802 - DNA, 27 bp, Artificial sequence
  SiRNA target sequence
attatgcagactgttaaagaaatttgt

SEQ ID NO: 10803 - DNA, 27 bp, Artificial sequence
  SiRNA target sequence
ttatgcagactgttaaagaaatttgtg

SEQ ID NO: 10804 - DNA, 27 bp, Artificial sequence
  SiRNA target sequence
tatgcagactgttaaagaaatttgtga

SEQ ID NO: 10805 - DNA, 27 bp, Artificial sequence
  SiRNA target sequence
atgcagactgttaaagaaatttgtgaa

SEQ ID NO: 10806 - DNA, 27 bp, Artificial sequence
  SiRNA target sequence
tgcagactgttaaagaaatttgtgaag

SEQ ID NO: 10807 - DNA, 27 bp, Artificial sequence
  SiRNA target sequence
gcagactgttaaagaaatttgtgaaga

SEQ ID NO: 10808 - DNA, 27 bp, Artificial sequence
  SiRNA target sequence
cagactgttaaagaaatttgtgaagaa

SEQ ID NO: 10809 - DNA, 27 bp, Artificial sequence
  SiRNA target sequence
agactgttaaagaaatttgtgaagaag

SEQ ID NO: 10810 - DNA, 27 bp, Artificial sequence
  SiRNA target sequence
gactgttaaagaaatttgtgaagaaga

SEQ ID NO: 10811 - DNA, 27 bp, Artificial sequence
  SiRNA target sequence
actgttaaagaaatttgtgaagaagaa

SEQ ID NO: 10812 - DNA, 27 bp, Artificial sequence
  SiRNA target sequence
ctgttaaagaaatttgtgaagaagaag

SEQ ID NO: 10813 - DNA, 27 bp, Artificial sequence
  SiRNA target sequence
tgttaaagaaatttgtgaagaagaagt

SEQ ID NO: 10814 - DNA, 27 bp, Artificial sequence
  SiRNA target sequence
gttaaagaaatttgtgaagaagaagtg

SEQ ID NO: 10815 - DNA, 27 bp, Artificial sequence
  SiRNA target sequence
ttaaagaaatttgtgaagaagaagtga

SEQ ID NO: 10816 - DNA, 27 bp, Artificial sequence
  SiRNA target sequence
taaagaaatttgtgaagaagaagtgaa

SEQ ID NO: 10817 - DNA, 27 bp, Artificial sequence
  SiRNA target sequence
aaagaaatttgtgaagaagaagtgaat

SEQ ID NO: 10818 - DNA, 27 bp, Artificial sequence
  SiRNA target sequence
aagaaatttgtgaagaagaagtgaatg

SEQ ID NO: 10819 - DNA, 27 bp, Artificial sequence
  SiRNA target sequence
agaaatttgtgaagaagaagtgaatga

SEQ ID NO: 10820 - DNA, 27 bp, Artificial sequence
  SiRNA target sequence
gaaatttgtgaagaagaagtgaatgag

SEQ ID NO: 10821 - DNA, 27 bp, Artificial sequence
  SiRNA target sequence
aaatttgtgaagaagaagtgaatgagt

SEQ ID NO: 10822 - DNA, 27 bp, Artificial sequence
  SiRNA target sequence
aatttgtgaagaagaagtgaatgagtt

SEQ ID NO: 10823 - DNA, 27 bp, Artificial sequence
  SiRNA target sequence
atttgtgaagaagaagtgaatgagttt

SEQ ID NO: 10824 - DNA, 27 bp, Artificial sequence
  SiRNA target sequence
tttgtgaagaagaagtgaatgagttta

SEQ ID NO: 10825 - DNA, 27 bp, Artificial sequence
  SiRNA target sequence
ttgtgaagaagaagtgaatgagtttat

SEQ ID NO: 10826 - DNA, 27 bp, Artificial sequence
  SiRNA target sequence
tgtgaagaagaagtgaatgagtttatt

SEQ ID NO: 10827 - DNA, 27 bp, Artificial sequence
  SiRNA target sequence
gtgaagaagaagtgaatgagtttattg

SEQ ID NO: 10828 - DNA, 27 bp, Artificial sequence
  SiRNA target sequence
tgaagaagaagtgaatgagtttattga

SEQ ID NO: 10829 - DNA, 27 bp, Artificial sequence
  SiRNA target sequence
gaagaagaagtgaatgagtttattgaa

SEQ ID NO: 10830 - DNA, 27 bp, Artificial sequence
  SiRNA target sequence
aagaagaagtgaatgagtttattgaac

SEQ ID NO: 10831 - DNA, 27 bp, Artificial sequence
  SiRNA target sequence
agaagaagtgaatgagtttattgaaca

SEQ ID NO: 10832 - DNA, 27 bp, Artificial sequence
  SiRNA target sequence
gaagaagtgaatgagtttattgaacaa

SEQ ID NO: 10833 - DNA, 27 bp, Artificial sequence
  SiRNA target sequence
aagaagtgaatgagtttattgaacaag

SEQ ID NO: 10834 - DNA, 27 bp, Artificial sequence
  SiRNA target sequence
agaagtgaatgagtttattgaacaaga

SEQ ID NO: 10835 - DNA, 27 bp, Artificial sequence
  SiRNA target sequence
gaagtgaatgagtttattgaacaagaa

SEQ ID NO: 10836 - DNA, 27 bp, Artificial sequence
  SiRNA target sequence
aagtgaatgagtttattgaacaagaag

SEQ ID NO: 10837 - DNA, 27 bp, Artificial sequence
  SiRNA target sequence
agtgaatgagtttattgaacaagaagg

SEQ ID NO: 10838 - DNA, 27 bp, Artificial sequence
  SiRNA target sequence
gtgaatgagtttattgaacaagaaggt

SEQ ID NO: 10839 - DNA, 27 bp, Artificial sequence
  SiRNA target sequence
tgaatgagtttattgaacaagaaggtt

SEQ ID NO: 10840 - DNA, 27 bp, Artificial sequence
  SiRNA target sequence
gaatgagtttattgaacaagaaggttt

SEQ ID NO: 10841 - DNA, 27 bp, Artificial sequence
  SiRNA target sequence
aatgagtttattgaacaagaaggttta

SEQ ID NO: 10842 - DNA, 27 bp, Artificial sequence
  SiRNA target sequence
atgagtttattgaacaagaaggtttaa

SEQ ID NO: 10843 - DNA, 27 bp, Artificial sequence
  SiRNA target sequence
tgagtttattgaacaagaaggtttaaa

SEQ ID NO: 10844 - DNA, 27 bp, Artificial sequence
  SiRNA target sequence
gagtttattgaacaagaaggtttaaaa

SEQ ID NO: 10845 - DNA, 27 bp, Artificial sequence
  SiRNA target sequence
agtttattgaacaagaaggtttaaaaa

SEQ ID NO: 10846 - DNA, 27 bp, Artificial sequence
  SiRNA target sequence
gtttattgaacaagaaggtttaaaaat

SEQ ID NO: 10847 - DNA, 27 bp, Artificial sequence
  SiRNA target sequence
tttattgaacaagaaggtttaaaaatt

SEQ ID NO: 10848 - DNA, 27 bp, Artificial sequence
  SiRNA target sequence
ttattgaacaagaaggtttaaaaatta

SEQ ID NO: 10849 - DNA, 27 bp, Artificial sequence
  SiRNA target sequence
tattgaacaagaaggtttaaaaattaa

SEQ ID NO: 10850 - DNA, 27 bp, Artificial sequence
  SiRNA target sequence
attgaacaagaaggtttaaaaattaat

SEQ ID NO: 10851 - DNA, 27 bp, Artificial sequence
  SiRNA target sequence
ttgaacaagaaggtttaaaaattaata

SEQ ID NO: 10852 - DNA, 27 bp, Artificial sequence
  SiRNA target sequence
tgaacaagaaggtttaaaaattaataa

SEQ ID NO: 10853 - DNA, 27 bp, Artificial sequence
  SiRNA target sequence
gaacaagaaggtttaaaaattaataaa

SEQ ID NO: 10854 - DNA, 27 bp, Artificial sequence
  SiRNA target sequence
aacaagaaggtttaaaaattaataaag

SEQ ID NO: 10855 - DNA, 27 bp, Artificial sequence
  SiRNA target sequence
acaagaaggtttaaaaattaataaaga

SEQ ID NO: 10856 - DNA, 27 bp, Artificial sequence
  SiRNA target sequence
caagaaggtttaaaaattaataaagaa

SEQ ID NO: 10857 - DNA, 27 bp, Artificial sequence
  SiRNA target sequence
aagaaggtttaaaaattaataaagaag

SEQ ID NO: 10858 - DNA, 27 bp, Artificial sequence
  SiRNA target sequence
agaaggtttaaaaattaataaagaaga

SEQ ID NO: 10859 - DNA, 27 bp, Artificial sequence
  SiRNA target sequence
gaaggtttaaaaattaataaagaagat

SEQ ID NO: 10860 - DNA, 27 bp, Artificial sequence
  SiRNA target sequence
aaggtttaaaaattaataaagaagatg

SEQ ID NO: 10861 - DNA, 27 bp, Artificial sequence
  SiRNA target sequence
aggtttaaaaattaataaagaagatgt

SEQ ID NO: 10862 - DNA, 27 bp, Artificial sequence
  SiRNA target sequence
ggtttaaaaattaataaagaagatgtg

SEQ ID NO: 10863 - DNA, 27 bp, Artificial sequence
  SiRNA target sequence
gtttaaaaattaataaagaagatgtgc

SEQ ID NO: 10864 - DNA, 27 bp, Artificial sequence
  SiRNA target sequence
tttaaaaattaataaagaagatgtgct

SEQ ID NO: 10865 - DNA, 27 bp, Artificial sequence
  SiRNA target sequence
ttaaaaattaataaagaagatgtgcta

SEQ ID NO: 10866 - DNA, 27 bp, Artificial sequence
  SiRNA target sequence
taaaaattaataaagaagatgtgctaa

SEQ ID NO: 10867 - DNA, 27 bp, Artificial sequence
  SiRNA target sequence
aaaaattaataaagaagatgtgctaag

SEQ ID NO: 10868 - DNA, 27 bp, Artificial sequence
  SiRNA target sequence
aaaattaataaagaagatgtgctaaga

SEQ ID NO: 10869 - DNA, 27 bp, Artificial sequence
  SiRNA target sequence
aaattaataaagaagatgtgctaagag

SEQ ID NO: 10870 - DNA, 27 bp, Artificial sequence
  SiRNA target sequence
aattaataaagaagatgtgctaagagg

SEQ ID NO: 10871 - DNA, 27 bp, Artificial sequence
  SiRNA target sequence
attaataaagaagatgtgctaagagga

SEQ ID NO: 10872 - DNA, 27 bp, Artificial sequence
  SiRNA target sequence
ttaataaagaagatgtgctaagaggac

SEQ ID NO: 10873 - DNA, 27 bp, Artificial sequence
  SiRNA target sequence
taataaagaagatgtgctaagaggact

SEQ ID NO: 10874 - DNA, 27 bp, Artificial sequence
  SiRNA target sequence
aataaagaagatgtgctaagaggactt

SEQ ID NO: 10875 - DNA, 27 bp, Artificial sequence
  SiRNA target sequence
ataaagaagatgtgctaagaggacttg

SEQ ID NO: 10876 - DNA, 27 bp, Artificial sequence
  SiRNA target sequence
taaagaagatgtgctaagaggacttgt

SEQ ID NO: 10877 - DNA, 27 bp, Artificial sequence
  SiRNA target sequence
aaagaagatgtgctaagaggacttgtt

SEQ ID NO: 10878 - DNA, 27 bp, Artificial sequence
  SiRNA target sequence
aagaagatgtgctaagaggacttgttt

SEQ ID NO: 10879 - DNA, 27 bp, Artificial sequence
  SiRNA target sequence
agaagatgtgctaagaggacttgtttc

SEQ ID NO: 10880 - DNA, 27 bp, Artificial sequence
  SiRNA target sequence
gaagatgtgctaagaggacttgtttca

SEQ ID NO: 10881 - DNA, 27 bp, Artificial sequence
  SiRNA target sequence
aagatgtgctaagaggacttgtttcaa

SEQ ID NO: 10882 - DNA, 27 bp, Artificial sequence
  SiRNA target sequence
agatgtgctaagaggacttgtttcaat

SEQ ID NO: 10883 - DNA, 27 bp, Artificial sequence
  SiRNA target sequence
gatgtgctaagaggacttgtttcaata

SEQ ID NO: 10884 - DNA, 27 bp, Artificial sequence
  SiRNA target sequence
atgtgctaagaggacttgtttcaataa

SEQ ID NO: 10885 - DNA, 27 bp, Artificial sequence
  SiRNA target sequence
tgtgctaagaggacttgtttcaataaa

SEQ ID NO: 10886 - DNA, 27 bp, Artificial sequence
  SiRNA target sequence
gtgctaagaggacttgtttcaataaaa

SEQ ID NO: 10887 - DNA, 27 bp, Artificial sequence
  SiRNA target sequence
tgctaagaggacttgtttcaataaaaa

SEQ ID NO: 10888 - DNA, 27 bp, Artificial sequence
  SiRNA target sequence
gctaagaggacttgtttcaataaaaaa

SEQ ID NO: 10889 - DNA, 27 bp, Artificial sequence
  SiRNA target sequence
ctaagaggacttgtttcaataaaaaat

SEQ ID NO: 10890 - DNA, 27 bp, Artificial sequence
  SiRNA target sequence
taagaggacttgtttcaataaaaaata

SEQ ID NO: 10891 - DNA, 27 bp, Artificial sequence
  SiRNA target sequence
aagaggacttgtttcaataaaaaatat

SEQ ID NO: 10892 - DNA, 27 bp, Artificial sequence
  SiRNA target sequence
agaggacttgtttcaataaaaaatata

SEQ ID NO: 10893 - DNA, 27 bp, Artificial sequence
  SiRNA target sequence
gaggacttgtttcaataaaaaatataa

SEQ ID NO: 10894 - DNA, 27 bp, Artificial sequence
  SiRNA target sequence
aggacttgtttcaataaaaaatataaa

SEQ ID NO: 10895 - DNA, 27 bp, Artificial sequence
  SiRNA target sequence
ggacttgtttcaataaaaaatataaat

SEQ ID NO: 10896 - DNA, 27 bp, Artificial sequence
  SiRNA target sequence
gacttgtttcaataaaaaatataaatg

SEQ ID NO: 10897 - DNA, 27 bp, Artificial sequence
  SiRNA target sequence
acttgtttcaataaaaaatataaatga

SEQ ID NO: 10898 - DNA, 27 bp, Artificial sequence
  SiRNA target sequence
cttgtttcaataaaaaatataaatgag

SEQ ID NO: 10899 - DNA, 27 bp, Artificial sequence
  SiRNA target sequence
ttgtttcaataaaaaatataaatgaga

SEQ ID NO: 10900 - DNA, 27 bp, Artificial sequence
  SiRNA target sequence
tgtttcaataaaaaatataaatgagat

SEQ ID NO: 10901 - DNA, 27 bp, Artificial sequence
  SiRNA target sequence
gtttcaataaaaaatataaatgagatt

SEQ ID NO: 10902 - DNA, 27 bp, Artificial sequence
  SiRNA target sequence
tttcaataaaaaatataaatgagattt

SEQ ID NO: 10903 - DNA, 27 bp, Artificial sequence
  SiRNA target sequence
ttcaataaaaaatataaatgagattta

SEQ ID NO: 10904 - DNA, 27 bp, Artificial sequence
  SiRNA target sequence
tcaataaaaaatataaatgagatttat

SEQ ID NO: 10905 - DNA, 27 bp, Artificial sequence
  SiRNA target sequence
caataaaaaatataaatgagatttatg

SEQ ID NO: 10906 - DNA, 27 bp, Artificial sequence
  SiRNA target sequence
aataaaaaatataaatgagatttatga

SEQ ID NO: 10907 - DNA, 27 bp, Artificial sequence
  SiRNA target sequence
ataaaaaatataaatgagatttatgat

SEQ ID NO: 10908 - DNA, 27 bp, Artificial sequence
  SiRNA target sequence
taaaaaatataaatgagatttatgatg

SEQ ID NO: 10909 - DNA, 27 bp, Artificial sequence
  SiRNA target sequence
aaaaaatataaatgagatttatgatgc

SEQ ID NO: 10910 - DNA, 27 bp, Artificial sequence
  SiRNA target sequence
aaaaatataaatgagatttatgatgca

SEQ ID NO: 10911 - DNA, 27 bp, Artificial sequence
  SiRNA target sequence
aaaatataaatgagatttatgatgcat

SEQ ID NO: 10912 - DNA, 27 bp, Artificial sequence
  SiRNA target sequence
aaatataaatgagatttatgatgcatt

SEQ ID NO: 10913 - DNA, 27 bp, Artificial sequence
  SiRNA target sequence
aatataaatgagatttatgatgcattt

SEQ ID NO: 10914 - DNA, 27 bp, Artificial sequence
  SiRNA target sequence
atataaatgagatttatgatgcatttg

SEQ ID NO: 10915 - DNA, 27 bp, Artificial sequence
  SiRNA target sequence
tataaatgagatttatgatgcatttgg

SEQ ID NO: 10916 - DNA, 27 bp, Artificial sequence
  SiRNA target sequence
ataaatgagatttatgatgcatttgga

SEQ ID NO: 10917 - DNA, 27 bp, Artificial sequence
  SiRNA target sequence
taaatgagatttatgatgcatttggag

SEQ ID NO: 10918 - DNA, 27 bp, Artificial sequence
  SiRNA target sequence
aaatgagatttatgatgcatttggagg

SEQ ID NO: 10919 - DNA, 27 bp, Artificial sequence
  SiRNA target sequence
aatgagatttatgatgcatttggaggt

SEQ ID NO: 10920 - DNA, 27 bp, Artificial sequence
  SiRNA target sequence
atgagatttatgatgcatttggaggta

SEQ ID NO: 10921 - DNA, 27 bp, Artificial sequence
  SiRNA target sequence
tgagatttatgatgcatttggaggtaa

SEQ ID NO: 10922 - DNA, 27 bp, Artificial sequence
  SiRNA target sequence
gagatttatgatgcatttggaggtaaa

SEQ ID NO: 10923 - DNA, 27 bp, Artificial sequence
  SiRNA target sequence
agatttatgatgcatttggaggtaaat

SEQ ID NO: 10924 - DNA, 27 bp, Artificial sequence
  SiRNA target sequence
gatttatgatgcatttggaggtaaatc

SEQ ID NO: 10925 - DNA, 27 bp, Artificial sequence
  SiRNA target sequence
atttatgatgcatttggaggtaaatct

SEQ ID NO: 10926 - DNA, 27 bp, Artificial sequence
  SiRNA target sequence
tttatgatgcatttggaggtaaatcta

SEQ ID NO: 10927 - DNA, 27 bp, Artificial sequence
  SiRNA target sequence
ttatgatgcatttggaggtaaatctaa

SEQ ID NO: 10928 - DNA, 27 bp, Artificial sequence
  SiRNA target sequence
tatgatgcatttggaggtaaatctaag

SEQ ID NO: 10929 - DNA, 27 bp, Artificial sequence
  SiRNA target sequence
atgatgcatttggaggtaaatctaaga

SEQ ID NO: 10930 - DNA, 27 bp, Artificial sequence
  SiRNA target sequence
tgatgcatttggaggtaaatctaagaa

SEQ ID NO: 10931 - DNA, 27 bp, Artificial sequence
  SiRNA target sequence
gatgcatttggaggtaaatctaagaag

SEQ ID NO: 10932 - DNA, 27 bp, Artificial sequence
  SiRNA target sequence
atgcatttggaggtaaatctaagaagt

SEQ ID NO: 10933 - DNA, 27 bp, Artificial sequence
  SiRNA target sequence
tgcatttggaggtaaatctaagaagtt

SEQ ID NO: 10934 - DNA, 27 bp, Artificial sequence
  SiRNA target sequence
gcatttggaggtaaatctaagaagttt

SEQ ID NO: 10935 - DNA, 27 bp, Artificial sequence
  SiRNA target sequence
catttggaggtaaatctaagaagttta

SEQ ID NO: 10936 - DNA, 27 bp, Artificial sequence
  SiRNA target sequence
atttggaggtaaatctaagaagtttaa

SEQ ID NO: 10937 - DNA, 27 bp, Artificial sequence
  SiRNA target sequence
tttggaggtaaatctaagaagtttaaa

SEQ ID NO: 10938 - DNA, 27 bp, Artificial sequence
  SiRNA target sequence
ttggaggtaaatctaagaagtttaaat

SEQ ID NO: 10939 - DNA, 27 bp, Artificial sequence
  SiRNA target sequence
tggaggtaaatctaagaagtttaaatt

SEQ ID NO: 10940 - DNA, 27 bp, Artificial sequence
  SiRNA target sequence
ggaggtaaatctaagaagtttaaattt

SEQ ID NO: 10941 - DNA, 27 bp, Artificial sequence
  SiRNA target sequence
gaggtaaatctaagaagtttaaatttt

SEQ ID NO: 10942 - DNA, 27 bp, Artificial sequence
  SiRNA target sequence
aggtaaatctaagaagtttaaattttc

SEQ ID NO: 10943 - DNA, 27 bp, Artificial sequence
  SiRNA target sequence
ggtaaatctaagaagtttaaattttct

SEQ ID NO: 10944 - DNA, 27 bp, Artificial sequence
  SiRNA target sequence
gtaaatctaagaagtttaaattttcta

SEQ ID NO: 10945 - DNA, 27 bp, Artificial sequence
  SiRNA target sequence
taaatctaagaagtttaaattttctaa

SEQ ID NO: 10946 - DNA, 27 bp, Artificial sequence
  SiRNA target sequence
aaatctaagaagtttaaattttctaat

SEQ ID NO: 10947 - DNA, 27 bp, Artificial sequence
  SiRNA target sequence
aatctaagaagtttaaattttctaatg

SEQ ID NO: 10948 - DNA, 27 bp, Artificial sequence
  SiRNA target sequence
atctaagaagtttaaattttctaatga

SEQ ID NO: 10949 - DNA, 27 bp, Artificial sequence
  SiRNA target sequence
tctaagaagtttaaattttctaatgat

SEQ ID NO: 10950 - DNA, 27 bp, Artificial sequence
  SiRNA target sequence
ctaagaagtttaaattttctaatgatg

SEQ ID NO: 10951 - DNA, 27 bp, Artificial sequence
  SiRNA target sequence
taagaagtttaaattttctaatgatga

SEQ ID NO: 10952 - DNA, 27 bp, Artificial sequence
  SiRNA target sequence
aagaagtttaaattttctaatgatgaa

SEQ ID NO: 10953 - DNA, 27 bp, Artificial sequence
  SiRNA target sequence
agaagtttaaattttctaatgatgaaa

SEQ ID NO: 10954 - DNA, 27 bp, Artificial sequence
  SiRNA target sequence
gaagtttaaattttctaatgatgaaaa

SEQ ID NO: 10955 - DNA, 27 bp, Artificial sequence
  SiRNA target sequence
aagtttaaattttctaatgatgaaaag

SEQ ID NO: 10956 - DNA, 27 bp, Artificial sequence
  SiRNA target sequence
agtttaaattttctaatgatgaaaagg

SEQ ID NO: 10957 - DNA, 27 bp, Artificial sequence
  SiRNA target sequence
gtttaaattttctaatgatgaaaagga

SEQ ID NO: 10958 - DNA, 27 bp, Artificial sequence
  SiRNA target sequence
tttaaattttctaatgatgaaaaggaa

SEQ ID NO: 10959 - DNA, 27 bp, Artificial sequence
  SiRNA target sequence
ttaaattttctaatgatgaaaaggaag

SEQ ID NO: 10960 - DNA, 27 bp, Artificial sequence
  SiRNA target sequence
taaattttctaatgatgaaaaggaagt

SEQ ID NO: 10961 - DNA, 27 bp, Artificial sequence
  SiRNA target sequence
aaattttctaatgatgaaaaggaagtg

SEQ ID NO: 10962 - DNA, 27 bp, Artificial sequence
  SiRNA target sequence
aattttctaatgatgaaaaggaagtgt

SEQ ID NO: 10963 - DNA, 27 bp, Artificial sequence
  SiRNA target sequence
attttctaatgatgaaaaggaagtgtt

SEQ ID NO: 10964 - DNA, 27 bp, Artificial sequence
  SiRNA target sequence
ttttctaatgatgaaaaggaagtgtta

SEQ ID NO: 10965 - DNA, 27 bp, Artificial sequence
  SiRNA target sequence
tttctaatgatgaaaaggaagtgttaa

SEQ ID NO: 10966 - DNA, 27 bp, Artificial sequence
  SiRNA target sequence
ttctaatgatgaaaaggaagtgttaaa

SEQ ID NO: 10967 - DNA, 27 bp, Artificial sequence
  SiRNA target sequence
tctaatgatgaaaaggaagtgttaaat

SEQ ID NO: 10968 - DNA, 27 bp, Artificial sequence
  SiRNA target sequence
ctaatgatgaaaaggaagtgttaaatc

SEQ ID NO: 10969 - DNA, 27 bp, Artificial sequence
  SiRNA target sequence
taatgatgaaaaggaagtgttaaatct

SEQ ID NO: 10970 - DNA, 27 bp, Artificial sequence
  SiRNA target sequence
aatgatgaaaaggaagtgttaaatctt

SEQ ID NO: 10971 - DNA, 27 bp, Artificial sequence
  SiRNA target sequence
atgatgaaaaggaagtgttaaatcttc

SEQ ID NO: 10972 - DNA, 27 bp, Artificial sequence
  SiRNA target sequence
tgatgaaaaggaagtgttaaatcttct

SEQ ID NO: 10973 - DNA, 27 bp, Artificial sequence
  SiRNA target sequence
gatgaaaaggaagtgttaaatcttctt

SEQ ID NO: 10974 - DNA, 27 bp, Artificial sequence
  SiRNA target sequence
atgaaaaggaagtgttaaatcttctta

SEQ ID NO: 10975 - DNA, 27 bp, Artificial sequence
  SiRNA target sequence
tgaaaaggaagtgttaaatcttcttaa

SEQ ID NO: 10976 - DNA, 27 bp, Artificial sequence
  SiRNA target sequence
gaaaaggaagtgttaaatcttcttaat

SEQ ID NO: 10977 - DNA, 27 bp, Artificial sequence
  SiRNA target sequence
aaaaggaagtgttaaatcttcttaatg

SEQ ID NO: 10978 - DNA, 27 bp, Artificial sequence
  SiRNA target sequence
aaaggaagtgttaaatcttcttaatgc

SEQ ID NO: 10979 - DNA, 27 bp, Artificial sequence
  SiRNA target sequence
aaggaagtgttaaatcttcttaatgcc

SEQ ID NO: 10980 - DNA, 27 bp, Artificial sequence
  SiRNA target sequence
aggaagtgttaaatcttcttaatgcca

SEQ ID NO: 10981 - DNA, 27 bp, Artificial sequence
  SiRNA target sequence
ggaagtgttaaatcttcttaatgccat

SEQ ID NO: 10982 - DNA, 27 bp, Artificial sequence
  SiRNA target sequence
gaagtgttaaatcttcttaatgccatt

SEQ ID NO: 10983 - DNA, 27 bp, Artificial sequence
  SiRNA target sequence
aagtgttaaatcttcttaatgccatta

SEQ ID NO: 10984 - DNA, 27 bp, Artificial sequence
  SiRNA target sequence
agtgttaaatcttcttaatgccattat

SEQ ID NO: 10985 - DNA, 27 bp, Artificial sequence
  SiRNA target sequence
gtgttaaatcttcttaatgccattatt

SEQ ID NO: 10986 - DNA, 27 bp, Artificial sequence
  SiRNA target sequence
tgttaaatcttcttaatgccattattt

SEQ ID NO: 10987 - DNA, 27 bp, Artificial sequence
  SiRNA target sequence
gttaaatcttcttaatgccattatttt

SEQ ID NO: 10988 - DNA, 27 bp, Artificial sequence
  SiRNA target sequence
ttaaatcttcttaatgccattatttta

SEQ ID NO: 10989 - DNA, 27 bp, Artificial sequence
  SiRNA target sequence
taaatcttcttaatgccattattttac

SEQ ID NO: 10990 - DNA, 27 bp, Artificial sequence
  SiRNA target sequence
aaatcttcttaatgccattattttaca

SEQ ID NO: 10991 - DNA, 27 bp, Artificial sequence
  SiRNA target sequence
aatcttcttaatgccattattttacac

SEQ ID NO: 10992 - DNA, 27 bp, Artificial sequence
  SiRNA target sequence
atcttcttaatgccattattttacacc

SEQ ID NO: 10993 - DNA, 27 bp, Artificial sequence
  SiRNA target sequence
tcttcttaatgccattattttacacct

SEQ ID NO: 10994 - DNA, 27 bp, Artificial sequence
  SiRNA target sequence
cttcttaatgccattattttacaccta

SEQ ID NO: 10995 - DNA, 27 bp, Artificial sequence
  SiRNA target sequence
ttcttaatgccattattttacacctaa

SEQ ID NO: 10996 - DNA, 27 bp, Artificial sequence
  SiRNA target sequence
tcttaatgccattattttacacctaaa

SEQ ID NO: 10997 - DNA, 27 bp, Artificial sequence
  SiRNA target sequence
cttaatgccattattttacacctaaaa

SEQ ID NO: 10998 - DNA, 27 bp, Artificial sequence
  SiRNA target sequence
ttaatgccattattttacacctaaaag

SEQ ID NO: 10999 - DNA, 27 bp, Artificial sequence
  SiRNA target sequence
taatgccattattttacacctaaaagg

SEQ ID NO: 11000 - DNA, 27 bp, Artificial sequence
  SiRNA target sequence
aatgccattattttacacctaaaagga

SEQ ID NO: 11001 - DNA, 27 bp, Artificial sequence
  SiRNA target sequence
atgccattattttacacctaaaaggaa

SEQ ID NO: 11002 - DNA, 27 bp, Artificial sequence
  SiRNA target sequence
tgccattattttacacctaaaaggaaa

SEQ ID NO: 11003 - DNA, 27 bp, Artificial sequence
  SiRNA target sequence
gccattattttacacctaaaaggaaaa

SEQ ID NO: 11004 - DNA, 27 bp, Artificial sequence
  SiRNA target sequence
ccattattttacacctaaaaggaaaaa

SEQ ID NO: 11005 - DNA, 27 bp, Artificial sequence
  SiRNA target sequence
cattattttacacctaaaaggaaaaaa

SEQ ID NO: 11006 - DNA, 27 bp, Artificial sequence
  SiRNA target sequence
attattttacacctaaaaggaaaaaaa

SEQ ID NO: 11007 - DNA, 27 bp, Artificial sequence
  SiRNA target sequence
ttattttacacctaaaaggaaaaaaag

SEQ ID NO: 11008 - DNA, 27 bp, Artificial sequence
  SiRNA target sequence
tattttacacctaaaaggaaaaaaaga

SEQ ID NO: 11009 - DNA, 27 bp, Artificial sequence
  SiRNA target sequence
attttacacctaaaaggaaaaaaagaa

SEQ ID NO: 11010 - DNA, 27 bp, Artificial sequence
  SiRNA target sequence
ttttacacctaaaaggaaaaaaagaac

SEQ ID NO: 11011 - DNA, 27 bp, Artificial sequence
  SiRNA target sequence
tttacacctaaaaggaaaaaaagaaca

SEQ ID NO: 11012 - DNA, 27 bp, Artificial sequence
  SiRNA target sequence
ttacacctaaaaggaaaaaaagaacag

SEQ ID NO: 11013 - DNA, 27 bp, Artificial sequence
  SiRNA target sequence
tacacctaaaaggaaaaaaagaacagg

SEQ ID NO: 11014 - DNA, 27 bp, Artificial sequence
  SiRNA target sequence
acacctaaaaggaaaaaaagaacaggc

SEQ ID NO: 11015 - DNA, 27 bp, Artificial sequence
  SiRNA target sequence
cacctaaaaggaaaaaaagaacaggca

SEQ ID NO: 11016 - DNA, 27 bp, Artificial sequence
  SiRNA target sequence
acctaaaaggaaaaaaagaacaggcaa

SEQ ID NO: 11017 - DNA, 27 bp, Artificial sequence
  SiRNA target sequence
cctaaaaggaaaaaaagaacaggcaat

SEQ ID NO: 11018 - DNA, 27 bp, Artificial sequence
  SiRNA target sequence
ctaaaaggaaaaaaagaacaggcaatt

SEQ ID NO: 11019 - DNA, 27 bp, Artificial sequence
  SiRNA target sequence
taaaaggaaaaaaagaacaggcaattc

SEQ ID NO: 11020 - DNA, 27 bp, Artificial sequence
  SiRNA target sequence
aaaaggaaaaaaagaacaggcaattct

SEQ ID NO: 11021 - DNA, 27 bp, Artificial sequence
  SiRNA target sequence
aaaggaaaaaaagaacaggcaattctt

SEQ ID NO: 11022 - DNA, 27 bp, Artificial sequence
  SiRNA target sequence
aaggaaaaaaagaacaggcaattcttt

SEQ ID NO: 11023 - DNA, 27 bp, Artificial sequence
  SiRNA target sequence
aggaaaaaaagaacaggcaattctttt

SEQ ID NO: 11024 - DNA, 27 bp, Artificial sequence
  SiRNA target sequence
ggaaaaaaagaacaggcaattctttta

SEQ ID NO: 11025 - DNA, 27 bp, Artificial sequence
  SiRNA target sequence
gaaaaaaagaacaggcaattcttttat

SEQ ID NO: 11026 - DNA, 27 bp, Artificial sequence
  SiRNA target sequence
aaaaaaagaacaggcaattcttttatt

SEQ ID NO: 11027 - DNA, 27 bp, Artificial sequence
  SiRNA target sequence
aaaaaagaacaggcaattcttttatta

SEQ ID NO: 11028 - DNA, 27 bp, Artificial sequence
  SiRNA target sequence
aaaaagaacaggcaattcttttattag

SEQ ID NO: 11029 - DNA, 27 bp, Artificial sequence
  SiRNA target sequence
aaaagaacaggcaattcttttattaga

SEQ ID NO: 11030 - DNA, 27 bp, Artificial sequence
  SiRNA target sequence
aaagaacaggcaattcttttattagaa

SEQ ID NO: 11031 - DNA, 27 bp, Artificial sequence
  SiRNA target sequence
aagaacaggcaattcttttattagaaa

SEQ ID NO: 11032 - DNA, 27 bp, Artificial sequence
  SiRNA target sequence
agaacaggcaattcttttattagaaaa

SEQ ID NO: 11033 - DNA, 27 bp, Artificial sequence
  SiRNA target sequence
gaacaggcaattcttttattagaaaaa

SEQ ID NO: 11034 - DNA, 27 bp, Artificial sequence
  SiRNA target sequence
aacaggcaattcttttattagaaaaat

SEQ ID NO: 11035 - DNA, 27 bp, Artificial sequence
  SiRNA target sequence
acaggcaattcttttattagaaaaatc

SEQ ID NO: 11036 - DNA, 27 bp, Artificial sequence
  SiRNA target sequence
caggcaattcttttattagaaaaatct

SEQ ID NO: 11037 - DNA, 27 bp, Artificial sequence
  SiRNA target sequence
aggcaattcttttattagaaaaatcta

SEQ ID NO: 11038 - DNA, 27 bp, Artificial sequence
  SiRNA target sequence
ggcaattcttttattagaaaaatctac

SEQ ID NO: 11039 - DNA, 27 bp, Artificial sequence
  SiRNA target sequence
gcaattcttttattagaaaaatctact

SEQ ID NO: 11040 - DNA, 27 bp, Artificial sequence
  SiRNA target sequence
caattcttttattagaaaaatctactt

SEQ ID NO: 11041 - DNA, 27 bp, Artificial sequence
  SiRNA target sequence
aattcttttattagaaaaatctactta

SEQ ID NO: 11042 - DNA, 27 bp, Artificial sequence
  SiRNA target sequence
attcttttattagaaaaatctacttat

SEQ ID NO: 11043 - DNA, 27 bp, Artificial sequence
  SiRNA target sequence
ttcttttattagaaaaatctacttata

SEQ ID NO: 11044 - DNA, 27 bp, Artificial sequence
  SiRNA target sequence
tcttttattagaaaaatctacttataa

SEQ ID NO: 11045 - DNA, 27 bp, Artificial sequence
  SiRNA target sequence
cttttattagaaaaatctacttataaa

SEQ ID NO: 11046 - DNA, 27 bp, Artificial sequence
  SiRNA target sequence
ttttattagaaaaatctacttataaat

SEQ ID NO: 11047 - DNA, 27 bp, Artificial sequence
  SiRNA target sequence
tttattagaaaaatctacttataaata

SEQ ID NO: 11048 - DNA, 27 bp, Artificial sequence
  SiRNA target sequence
ttattagaaaaatctacttataaatac

SEQ ID NO: 11049 - DNA, 27 bp, Artificial sequence
  SiRNA target sequence
tattagaaaaatctacttataaataca

SEQ ID NO: 11050 - DNA, 27 bp, Artificial sequence
  SiRNA target sequence
attagaaaaatctacttataaatacag

SEQ ID NO: 11051 - DNA, 27 bp, Artificial sequence
  SiRNA target sequence
ttagaaaaatctacttataaatacagt

SEQ ID NO: 11052 - DNA, 27 bp, Artificial sequence
  SiRNA target sequence
tagaaaaatctacttataaatacagta

SEQ ID NO: 11053 - DNA, 27 bp, Artificial sequence
  SiRNA target sequence
agaaaaatctacttataaatacagtat

SEQ ID NO: 11054 - DNA, 27 bp, Artificial sequence
  SiRNA target sequence
gaaaaatctacttataaatacagtatc

SEQ ID NO: 11055 - DNA, 27 bp, Artificial sequence
  SiRNA target sequence
aaaaatctacttataaatacagtatct

SEQ ID NO: 11056 - DNA, 27 bp, Artificial sequence
  SiRNA target sequence
aaaatctacttataaatacagtatctt

SEQ ID NO: 11057 - DNA, 27 bp, Artificial sequence
  SiRNA target sequence
aaatctacttataaatacagtatcttg

SEQ ID NO: 11058 - DNA, 27 bp, Artificial sequence
  SiRNA target sequence
aatctacttataaatacagtatcttgt

SEQ ID NO: 11059 - DNA, 27 bp, Artificial sequence
  SiRNA target sequence
atctacttataaatacagtatcttgta

SEQ ID NO: 11060 - DNA, 27 bp, Artificial sequence
  SiRNA target sequence
tctacttataaatacagtatcttgtat

SEQ ID NO: 11061 - DNA, 27 bp, Artificial sequence
  SiRNA target sequence
ctacttataaatacagtatcttgtata

SEQ ID NO: 11062 - DNA, 27 bp, Artificial sequence
  SiRNA target sequence
tacttataaatacagtatcttgtatag

SEQ ID NO: 11063 - DNA, 27 bp, Artificial sequence
  SiRNA target sequence
acttataaatacagtatcttgtataga

SEQ ID NO: 11064 - DNA, 27 bp, Artificial sequence
  SiRNA target sequence
cttataaatacagtatcttgtatagag

SEQ ID NO: 11065 - DNA, 27 bp, Artificial sequence
  SiRNA target sequence
ttataaatacagtatcttgtatagagc

SEQ ID NO: 11066 - DNA, 27 bp, Artificial sequence
  SiRNA target sequence
tataaatacagtatcttgtatagagca

SEQ ID NO: 11067 - DNA, 27 bp, Artificial sequence
  SiRNA target sequence
ataaatacagtatcttgtatagagcat

SEQ ID NO: 11068 - DNA, 27 bp, Artificial sequence
  SiRNA target sequence
taaatacagtatcttgtatagagcata

SEQ ID NO: 11069 - DNA, 27 bp, Artificial sequence
  SiRNA target sequence
aaatacagtatcttgtatagagcatat

SEQ ID NO: 11070 - DNA, 27 bp, Artificial sequence
  SiRNA target sequence
aatacagtatcttgtatagagcatatt

SEQ ID NO: 11071 - DNA, 27 bp, Artificial sequence
  SiRNA target sequence
atacagtatcttgtatagagcatattt

SEQ ID NO: 11072 - DNA, 27 bp, Artificial sequence
  SiRNA target sequence
tacagtatcttgtatagagcatatttt

SEQ ID NO: 11073 - DNA, 27 bp, Artificial sequence
  SiRNA target sequence
acagtatcttgtatagagcatattttc

SEQ ID NO: 11074 - DNA, 27 bp, Artificial sequence
  SiRNA target sequence
cagtatcttgtatagagcatattttct

SEQ ID NO: 11075 - DNA, 27 bp, Artificial sequence
  SiRNA target sequence
agtatcttgtatagagcatattttctt

SEQ ID NO: 11076 - DNA, 27 bp, Artificial sequence
  SiRNA target sequence
gtatcttgtatagagcatattttctta

SEQ ID NO: 11077 - DNA, 27 bp, Artificial sequence
  SiRNA target sequence
tatcttgtatagagcatattttcttac

SEQ ID NO: 11078 - DNA, 27 bp, Artificial sequence
  SiRNA target sequence
atcttgtatagagcatattttcttaca

SEQ ID NO: 11079 - DNA, 27 bp, Artificial sequence
  SiRNA target sequence
tcttgtatagagcatattttcttacat

SEQ ID NO: 11080 - DNA, 27 bp, Artificial sequence
  SiRNA target sequence
cttgtatagagcatattttcttacatt

SEQ ID NO: 11081 - DNA, 27 bp, Artificial sequence
  SiRNA target sequence
ttgtatagagcatattttcttacattg

SEQ ID NO: 11082 - DNA, 27 bp, Artificial sequence
  SiRNA target sequence
tgtatagagcatattttcttacattga

SEQ ID NO: 11083 - DNA, 27 bp, Artificial sequence
  SiRNA target sequence
gtatagagcatattttcttacattgaa

SEQ ID NO: 11084 - DNA, 27 bp, Artificial sequence
  SiRNA target sequence
tatagagcatattttcttacattgaag

SEQ ID NO: 11085 - DNA, 27 bp, Artificial sequence
  SiRNA target sequence
atagagcatattttcttacattgaaga

SEQ ID NO: 11086 - DNA, 27 bp, Artificial sequence
  SiRNA target sequence
tagagcatattttcttacattgaagaa

SEQ ID NO: 11087 - DNA, 27 bp, Artificial sequence
  SiRNA target sequence
agagcatattttcttacattgaagaat

SEQ ID NO: 11088 - DNA, 27 bp, Artificial sequence
  SiRNA target sequence
gagcatattttcttacattgaagaatg

SEQ ID NO: 11089 - DNA, 27 bp, Artificial sequence
  SiRNA target sequence
agcatattttcttacattgaagaatga

SEQ ID NO: 11090 - DNA, 27 bp, Artificial sequence
  SiRNA target sequence
gcatattttcttacattgaagaatgaa

SEQ ID NO: 11091 - DNA, 27 bp, Artificial sequence
  SiRNA target sequence
catattttcttacattgaagaatgaat

SEQ ID NO: 11092 - DNA, 27 bp, Artificial sequence
  SiRNA target sequence
atattttcttacattgaagaatgaata

SEQ ID NO: 11093 - DNA, 27 bp, Artificial sequence
  SiRNA target sequence
tattttcttacattgaagaatgaatat

SEQ ID NO: 11094 - DNA, 27 bp, Artificial sequence
  SiRNA target sequence
attttcttacattgaagaatgaatata

SEQ ID NO: 11095 - DNA, 27 bp, Artificial sequence
  SiRNA target sequence
ttttcttacattgaagaatgaatatat

SEQ ID NO: 11096 - DNA, 27 bp, Artificial sequence
  SiRNA target sequence
tttcttacattgaagaatgaatatatt

SEQ ID NO: 11097 - DNA, 27 bp, Artificial sequence
  SiRNA target sequence
ttcttacattgaagaatgaatatattt

SEQ ID NO: 11098 - DNA, 27 bp, Artificial sequence
  SiRNA target sequence
tcttacattgaagaatgaatatatttc

SEQ ID NO: 11099 - DNA, 27 bp, Artificial sequence
  SiRNA target sequence
cttacattgaagaatgaatatatttca

SEQ ID NO: 11100 - DNA, 27 bp, Artificial sequence
  SiRNA target sequence
ttacattgaagaatgaatatatttcat

SEQ ID NO: 11101 - DNA, 27 bp, Artificial sequence
  SiRNA target sequence
tacattgaagaatgaatatatttcatc

SEQ ID NO: 11102 - DNA, 27 bp, Artificial sequence
  SiRNA target sequence
acattgaagaatgaatatatttcatct

SEQ ID NO: 11103 - DNA, 27 bp, Artificial sequence
  SiRNA target sequence
cattgaagaatgaatatatttcatctt

SEQ ID NO: 11104 - DNA, 27 bp, Artificial sequence
  SiRNA target sequence
attgaagaatgaatatatttcatcttc

SEQ ID NO: 11105 - DNA, 27 bp, Artificial sequence
  SiRNA target sequence
ttgaagaatgaatatatttcatcttca

SEQ ID NO: 11106 - DNA, 27 bp, Artificial sequence
  SiRNA target sequence
tgaagaatgaatatatttcatcttcat

SEQ ID NO: 11107 - DNA, 27 bp, Artificial sequence
  SiRNA target sequence
gaagaatgaatatatttcatcttcatt

SEQ ID NO: 11108 - DNA, 27 bp, Artificial sequence
  SiRNA target sequence
aagaatgaatatatttcatcttcattg

SEQ ID NO: 11109 - DNA, 27 bp, Artificial sequence
  SiRNA target sequence
agaatgaatatatttcatcttcattgc

SEQ ID NO: 11110 - DNA, 27 bp, Artificial sequence
  SiRNA target sequence
gaatgaatatatttcatcttcattgcc

SEQ ID NO: 11111 - DNA, 27 bp, Artificial sequence
  SiRNA target sequence
aatgaatatatttcatcttcattgcct

SEQ ID NO: 11112 - DNA, 27 bp, Artificial sequence
  SiRNA target sequence
atgaatatatttcatcttcattgcctt

SEQ ID NO: 11113 - DNA, 27 bp, Artificial sequence
  SiRNA target sequence
tgaatatatttcatcttcattgccttt

SEQ ID NO: 11114 - DNA, 27 bp, Artificial sequence
  SiRNA target sequence
gaatatatttcatcttcattgccttta

SEQ ID NO: 11115 - DNA, 27 bp, Artificial sequence
  SiRNA target sequence
aatatatttcatcttcattgcctttag

SEQ ID NO: 11116 - DNA, 27 bp, Artificial sequence
  SiRNA target sequence
atatatttcatcttcattgcctttaga

SEQ ID NO: 11117 - DNA, 27 bp, Artificial sequence
  SiRNA target sequence
tatatttcatcttcattgcctttagat

SEQ ID NO: 11118 - DNA, 27 bp, Artificial sequence
  SiRNA target sequence
atatttcatcttcattgcctttagatg

SEQ ID NO: 11119 - DNA, 27 bp, Artificial sequence
  SiRNA target sequence
tatttcatcttcattgcctttagatga

SEQ ID NO: 11120 - DNA, 27 bp, Artificial sequence
  SiRNA target sequence
atttcatcttcattgcctttagatgac

SEQ ID NO: 11121 - DNA, 27 bp, Artificial sequence
  SiRNA target sequence
tttcatcttcattgcctttagatgacg

SEQ ID NO: 11122 - DNA, 27 bp, Artificial sequence
  SiRNA target sequence
ttcatcttcattgcctttagatgacga

SEQ ID NO: 11123 - DNA, 27 bp, Artificial sequence
  SiRNA target sequence
tcatcttcattgcctttagatgacgag

SEQ ID NO: 11124 - DNA, 27 bp, Artificial sequence
  SiRNA target sequence
catcttcattgcctttagatgacgaga

SEQ ID NO: 11125 - DNA, 27 bp, Artificial sequence
  SiRNA target sequence
atcttcattgcctttagatgacgagat

SEQ ID NO: 11126 - DNA, 27 bp, Artificial sequence
  SiRNA target sequence
tcttcattgcctttagatgacgagatt

SEQ ID NO: 11127 - DNA, 27 bp, Artificial sequence
  SiRNA target sequence
cttcattgcctttagatgacgagatta

SEQ ID NO: 11128 - DNA, 27 bp, Artificial sequence
  SiRNA target sequence
ttcattgcctttagatgacgagattac

SEQ ID NO: 11129 - DNA, 27 bp, Artificial sequence
  SiRNA target sequence
tcattgcctttagatgacgagattact

SEQ ID NO: 11130 - DNA, 27 bp, Artificial sequence
  SiRNA target sequence
cattgcctttagatgacgagattacta

SEQ ID NO: 11131 - DNA, 27 bp, Artificial sequence
  SiRNA target sequence
attgcctttagatgacgagattactac

SEQ ID NO: 11132 - DNA, 27 bp, Artificial sequence
  SiRNA target sequence
ttgcctttagatgacgagattactacg

SEQ ID NO: 11133 - DNA, 27 bp, Artificial sequence
  SiRNA target sequence
tgcctttagatgacgagattactacgc

SEQ ID NO: 11134 - DNA, 27 bp, Artificial sequence
  SiRNA target sequence
gcctttagatgacgagattactacgct

SEQ ID NO: 11135 - DNA, 27 bp, Artificial sequence
  SiRNA target sequence
cctttagatgacgagattactacgctt

SEQ ID NO: 11136 - DNA, 27 bp, Artificial sequence
  SiRNA target sequence
ctttagatgacgagattactacgcttt

SEQ ID NO: 11137 - DNA, 27 bp, Artificial sequence
  SiRNA target sequence
tttagatgacgagattactacgcttta

SEQ ID NO: 11138 - DNA, 27 bp, Artificial sequence
  SiRNA target sequence
ttagatgacgagattactacgctttac

SEQ ID NO: 11139 - DNA, 27 bp, Artificial sequence
  SiRNA target sequence
tagatgacgagattactacgctttact

SEQ ID NO: 11140 - DNA, 27 bp, Artificial sequence
  SiRNA target sequence
agatgacgagattactacgctttactt

SEQ ID NO: 11141 - DNA, 27 bp, Artificial sequence
  SiRNA target sequence
gatgacgagattactacgctttacttg

SEQ ID NO: 11142 - DNA, 27 bp, Artificial sequence
  SiRNA target sequence
atgacgagattactacgctttacttgt

SEQ ID NO: 11143 - DNA, 27 bp, Artificial sequence
  SiRNA target sequence
tgacgagattactacgctttacttgta

SEQ ID NO: 11144 - DNA, 27 bp, Artificial sequence
  SiRNA target sequence
gacgagattactacgctttacttgtat

SEQ ID NO: 11145 - DNA, 27 bp, Artificial sequence
  SiRNA target sequence
acgagattactacgctttacttgtatt

SEQ ID NO: 11146 - DNA, 27 bp, Artificial sequence
  SiRNA target sequence
cgagattactacgctttacttgtattc

SEQ ID NO: 11147 - DNA, 27 bp, Artificial sequence
  SiRNA target sequence
gagattactacgctttacttgtattct

SEQ ID NO: 11148 - DNA, 27 bp, Artificial sequence
  SiRNA target sequence
agattactacgctttacttgtattcta

SEQ ID NO: 11149 - DNA, 27 bp, Artificial sequence
  SiRNA target sequence
gattactacgctttacttgtattctaa

SEQ ID NO: 11150 - DNA, 27 bp, Artificial sequence
  SiRNA target sequence
attactacgctttacttgtattctaag

SEQ ID NO: 11151 - DNA, 27 bp, Artificial sequence
  SiRNA target sequence
ttactacgctttacttgtattctaaga

SEQ ID NO: 11152 - DNA, 27 bp, Artificial sequence
  SiRNA target sequence
tactacgctttacttgtattctaagat

SEQ ID NO: 11153 - DNA, 27 bp, Artificial sequence
  SiRNA target sequence
actacgctttacttgtattctaagatt

SEQ ID NO: 11154 - DNA, 27 bp, Artificial sequence
  SiRNA target sequence
ctacgctttacttgtattctaagattt

SEQ ID NO: 11155 - DNA, 27 bp, Artificial sequence
  SiRNA target sequence
tacgctttacttgtattctaagatttt

SEQ ID NO: 11156 - DNA, 27 bp, Artificial sequence
  SiRNA target sequence
acgctttacttgtattctaagattttt

SEQ ID NO: 11157 - DNA, 27 bp, Artificial sequence
  SiRNA target sequence
cgctttacttgtattctaagattttta

SEQ ID NO: 11158 - DNA, 27 bp, Artificial sequence
  SiRNA target sequence
gctttacttgtattctaagatttttaa

SEQ ID NO: 11159 - DNA, 27 bp, Artificial sequence
  SiRNA target sequence
ctttacttgtattctaagatttttaaa

SEQ ID NO: 11160 - DNA, 27 bp, Artificial sequence
  SiRNA target sequence
tttacttgtattctaagatttttaaag

SEQ ID NO: 11161 - DNA, 27 bp, Artificial sequence
  SiRNA target sequence
ttacttgtattctaagatttttaaaga

SEQ ID NO: 11162 - DNA, 27 bp, Artificial sequence
  SiRNA target sequence
tacttgtattctaagatttttaaagat

SEQ ID NO: 11163 - DNA, 27 bp, Artificial sequence
  SiRNA target sequence
acttgtattctaagatttttaaagata

SEQ ID NO: 11164 - DNA, 27 bp, Artificial sequence
  SiRNA target sequence
cttgtattctaagatttttaaagataa

SEQ ID NO: 11165 - DNA, 27 bp, Artificial sequence
  SiRNA target sequence
ttgtattctaagatttttaaagataaa

SEQ ID NO: 11166 - DNA, 27 bp, Artificial sequence
  SiRNA target sequence
tgtattctaagatttttaaagataaat

SEQ ID NO: 11167 - DNA, 27 bp, Artificial sequence
  SiRNA target sequence
gtattctaagatttttaaagataaatc

SEQ ID NO: 11168 - DNA, 27 bp, Artificial sequence
  SiRNA target sequence
tattctaagatttttaaagataaatct

SEQ ID NO: 11169 - DNA, 27 bp, Artificial sequence
  SiRNA target sequence
attctaagatttttaaagataaatctg

SEQ ID NO: 11170 - DNA, 27 bp, Artificial sequence
  SiRNA target sequence
ttctaagatttttaaagataaatctga

SEQ ID NO: 11171 - DNA, 27 bp, Artificial sequence
  SiRNA target sequence
tctaagatttttaaagataaatctgat

SEQ ID NO: 11172 - DNA, 27 bp, Artificial sequence
  SiRNA target sequence
ctaagatttttaaagataaatctgata

SEQ ID NO: 11173 - DNA, 27 bp, Artificial sequence
  SiRNA target sequence
taagatttttaaagataaatctgatac

SEQ ID NO: 11174 - DNA, 27 bp, Artificial sequence
  SiRNA target sequence
aagatttttaaagataaatctgatact

SEQ ID NO: 11175 - DNA, 27 bp, Artificial sequence
  SiRNA target sequence
agatttttaaagataaatctgatactt

SEQ ID NO: 11176 - DNA, 27 bp, Artificial sequence
  SiRNA target sequence
gatttttaaagataaatctgatactta

SEQ ID NO: 11177 - DNA, 27 bp, Artificial sequence
  SiRNA target sequence
atttttaaagataaatctgatacttac

SEQ ID NO: 11178 - DNA, 27 bp, Artificial sequence
  SiRNA target sequence
tttttaaagataaatctgatacttacc

SEQ ID NO: 11179 - DNA, 27 bp, Artificial sequence
  SiRNA target sequence
ttttaaagataaatctgatacttacct

SEQ ID NO: 11180 - DNA, 27 bp, Artificial sequence
  SiRNA target sequence
tttaaagataaatctgatacttacctt

SEQ ID NO: 11181 - DNA, 27 bp, Artificial sequence
  SiRNA target sequence
ttaaagataaatctgatacttacctta

SEQ ID NO: 11182 - DNA, 27 bp, Artificial sequence
  SiRNA target sequence
taaagataaatctgatacttaccttaa

SEQ ID NO: 11183 - DNA, 27 bp, Artificial sequence
  SiRNA target sequence
aaagataaatctgatacttaccttaaa

SEQ ID NO: 11184 - DNA, 27 bp, Artificial sequence
  SiRNA target sequence
aagataaatctgatacttaccttaaat

SEQ ID NO: 11185 - DNA, 27 bp, Artificial sequence
  SiRNA target sequence
agataaatctgatacttaccttaaatc

SEQ ID NO: 11186 - DNA, 27 bp, Artificial sequence
  SiRNA target sequence
gataaatctgatacttaccttaaatct

SEQ ID NO: 11187 - DNA, 27 bp, Artificial sequence
  SiRNA target sequence
ataaatctgatacttaccttaaatctg

SEQ ID NO: 11188 - DNA, 27 bp, Artificial sequence
  SiRNA target sequence
taaatctgatacttaccttaaatctgc

SEQ ID NO: 11189 - DNA, 27 bp, Artificial sequence
  SiRNA target sequence
aaatctgatacttaccttaaatctgct

SEQ ID NO: 11190 - DNA, 27 bp, Artificial sequence
  SiRNA target sequence
aatctgatacttaccttaaatctgcta

SEQ ID NO: 11191 - DNA, 27 bp, Artificial sequence
  SiRNA target sequence
atctgatacttaccttaaatctgctat

SEQ ID NO: 11192 - DNA, 27 bp, Artificial sequence
  SiRNA target sequence
tctgatacttaccttaaatctgctata

SEQ ID NO: 11193 - DNA, 27 bp, Artificial sequence
  SiRNA target sequence
ctgatacttaccttaaatctgctatag

SEQ ID NO: 11194 - DNA, 27 bp, Artificial sequence
  SiRNA target sequence
tgatacttaccttaaatctgctataga

SEQ ID NO: 11195 - DNA, 27 bp, Artificial sequence
  SiRNA target sequence
gatacttaccttaaatctgctatagat

SEQ ID NO: 11196 - DNA, 27 bp, Artificial sequence
  SiRNA target sequence
atacttaccttaaatctgctatagata

SEQ ID NO: 11197 - DNA, 27 bp, Artificial sequence
  SiRNA target sequence
tacttaccttaaatctgctatagataa

SEQ ID NO: 11198 - DNA, 27 bp, Artificial sequence
  SiRNA target sequence
acttaccttaaatctgctatagataaa

SEQ ID NO: 11199 - DNA, 27 bp, Artificial sequence
  SiRNA target sequence
cttaccttaaatctgctatagataaat

SEQ ID NO: 11200 - DNA, 27 bp, Artificial sequence
  SiRNA target sequence
ttaccttaaatctgctatagataaatc

SEQ ID NO: 11201 - DNA, 27 bp, Artificial sequence
  SiRNA target sequence
taccttaaatctgctatagataaatca

SEQ ID NO: 11202 - DNA, 27 bp, Artificial sequence
  SiRNA target sequence
accttaaatctgctatagataaatcag

SEQ ID NO: 11203 - DNA, 27 bp, Artificial sequence
  SiRNA target sequence
ccttaaatctgctatagataaatcagt

SEQ ID NO: 11204 - DNA, 27 bp, Artificial sequence
  SiRNA target sequence
cttaaatctgctatagataaatcagta

SEQ ID NO: 11205 - DNA, 27 bp, Artificial sequence
  SiRNA target sequence
ttaaatctgctatagataaatcagtag

SEQ ID NO: 11206 - DNA, 27 bp, Artificial sequence
  SiRNA target sequence
taaatctgctatagataaatcagtaga

SEQ ID NO: 11207 - DNA, 27 bp, Artificial sequence
  SiRNA target sequence
aaatctgctatagataaatcagtagat

SEQ ID NO: 11208 - DNA, 27 bp, Artificial sequence
  SiRNA target sequence
aatctgctatagataaatcagtagatc

SEQ ID NO: 11209 - DNA, 27 bp, Artificial sequence
  SiRNA target sequence
atctgctatagataaatcagtagatct

SEQ ID NO: 11210 - DNA, 27 bp, Artificial sequence
  SiRNA target sequence
tctgctatagataaatcagtagatcta

SEQ ID NO: 11211 - DNA, 27 bp, Artificial sequence
  SiRNA target sequence
ctgctatagataaatcagtagatctac

SEQ ID NO: 11212 - DNA, 27 bp, Artificial sequence
  SiRNA target sequence
tgctatagataaatcagtagatctacc

SEQ ID NO: 11213 - DNA, 27 bp, Artificial sequence
  SiRNA target sequence
gctatagataaatcagtagatctacct

SEQ ID NO: 11214 - DNA, 27 bp, Artificial sequence
  SiRNA target sequence
ctatagataaatcagtagatctaccta

SEQ ID NO: 11215 - DNA, 27 bp, Artificial sequence
  SiRNA target sequence
tatagataaatcagtagatctacctat

SEQ ID NO: 11216 - DNA, 27 bp, Artificial sequence
  SiRNA target sequence
atagataaatcagtagatctacctatt

SEQ ID NO: 11217 - DNA, 27 bp, Artificial sequence
  SiRNA target sequence
tagataaatcagtagatctacctattg

SEQ ID NO: 11218 - DNA, 27 bp, Artificial sequence
  SiRNA target sequence
agataaatcagtagatctacctattga

SEQ ID NO: 11219 - DNA, 27 bp, Artificial sequence
  SiRNA target sequence
gataaatcagtagatctacctattgaa

SEQ ID NO: 11220 - DNA, 27 bp, Artificial sequence
  SiRNA target sequence
ataaatcagtagatctacctattgaac

SEQ ID NO: 11221 - DNA, 27 bp, Artificial sequence
  SiRNA target sequence
taaatcagtagatctacctattgaaca

SEQ ID NO: 11222 - DNA, 27 bp, Artificial sequence
  SiRNA target sequence
aaatcagtagatctacctattgaacag

SEQ ID NO: 11223 - DNA, 27 bp, Artificial sequence
  SiRNA target sequence
aatcagtagatctacctattgaacaga

SEQ ID NO: 11224 - DNA, 27 bp, Artificial sequence
  SiRNA target sequence
atcagtagatctacctattgaacagaa

SEQ ID NO: 11225 - DNA, 27 bp, Artificial sequence
  SiRNA target sequence
tcagtagatctacctattgaacagaaa

SEQ ID NO: 11226 - DNA, 27 bp, Artificial sequence
  SiRNA target sequence
cagtagatctacctattgaacagaaag

SEQ ID NO: 11227 - DNA, 27 bp, Artificial sequence
  SiRNA target sequence
agtagatctacctattgaacagaaaga

SEQ ID NO: 11228 - DNA, 27 bp, Artificial sequence
  SiRNA target sequence
gtagatctacctattgaacagaaagac

SEQ ID NO: 11229 - DNA, 27 bp, Artificial sequence
  SiRNA target sequence
tagatctacctattgaacagaaagact

SEQ ID NO: 11230 - DNA, 27 bp, Artificial sequence
  SiRNA target sequence
agatctacctattgaacagaaagactt

SEQ ID NO: 11231 - DNA, 27 bp, Artificial sequence
  SiRNA target sequence
gatctacctattgaacagaaagacttt

SEQ ID NO: 11232 - DNA, 27 bp, Artificial sequence
  SiRNA target sequence
atctacctattgaacagaaagactttc

SEQ ID NO: 11233 - DNA, 27 bp, Artificial sequence
  SiRNA target sequence
tctacctattgaacagaaagactttct

SEQ ID NO: 11234 - DNA, 27 bp, Artificial sequence
  SiRNA target sequence
ctacctattgaacagaaagactttctg

SEQ ID NO: 11235 - DNA, 27 bp, Artificial sequence
  SiRNA target sequence
tacctattgaacagaaagactttctgt

SEQ ID NO: 11236 - DNA, 27 bp, Artificial sequence
  SiRNA target sequence
acctattgaacagaaagactttctgta

SEQ ID NO: 11237 - DNA, 27 bp, Artificial sequence
  SiRNA target sequence
cctattgaacagaaagactttctgtac

SEQ ID NO: 11238 - DNA, 27 bp, Artificial sequence
  SiRNA target sequence
ctattgaacagaaagactttctgtacg

SEQ ID NO: 11239 - DNA, 27 bp, Artificial sequence
  SiRNA target sequence
tattgaacagaaagactttctgtacgt

SEQ ID NO: 11240 - DNA, 27 bp, Artificial sequence
  SiRNA target sequence
attgaacagaaagactttctgtacgta

SEQ ID NO: 11241 - DNA, 27 bp, Artificial sequence
  SiRNA target sequence
ttgaacagaaagactttctgtacgtag

SEQ ID NO: 11242 - DNA, 27 bp, Artificial sequence
  SiRNA target sequence
tgaacagaaagactttctgtacgtaga

SEQ ID NO: 11243 - DNA, 27 bp, Artificial sequence
  SiRNA target sequence
gaacagaaagactttctgtacgtagat

SEQ ID NO: 11244 - DNA, 27 bp, Artificial sequence
  SiRNA target sequence
aacagaaagactttctgtacgtagatc

SEQ ID NO: 11245 - DNA, 27 bp, Artificial sequence
  SiRNA target sequence
acagaaagactttctgtacgtagatct

SEQ ID NO: 11246 - DNA, 27 bp, Artificial sequence
  SiRNA target sequence
cagaaagactttctgtacgtagatctt

SEQ ID NO: 11247 - DNA, 27 bp, Artificial sequence
  SiRNA target sequence
agaaagactttctgtacgtagatcttc

SEQ ID NO: 11248 - DNA, 27 bp, Artificial sequence
  SiRNA target sequence
gaaagactttctgtacgtagatcttct

SEQ ID NO: 11249 - DNA, 27 bp, Artificial sequence
  SiRNA target sequence
aaagactttctgtacgtagatcttctt

SEQ ID NO: 11250 - DNA, 27 bp, Artificial sequence
  SiRNA target sequence
aagactttctgtacgtagatcttcttg

SEQ ID NO: 11251 - DNA, 27 bp, Artificial sequence
  SiRNA target sequence
agactttctgtacgtagatcttcttgt

SEQ ID NO: 11252 - DNA, 27 bp, Artificial sequence
  SiRNA target sequence
gactttctgtacgtagatcttcttgta

SEQ ID NO: 11253 - DNA, 27 bp, Artificial sequence
  SiRNA target sequence
actttctgtacgtagatcttcttgtat

SEQ ID NO: 11254 - DNA, 27 bp, Artificial sequence
  SiRNA target sequence
ctttctgtacgtagatcttcttgtatt

SEQ ID NO: 11255 - DNA, 27 bp, Artificial sequence
  SiRNA target sequence
tttctgtacgtagatcttcttgtattt

SEQ ID NO: 11256 - DNA, 27 bp, Artificial sequence
  SiRNA target sequence
ttctgtacgtagatcttcttgtatttt

SEQ ID NO: 11257 - DNA, 27 bp, Artificial sequence
  SiRNA target sequence
tctgtacgtagatcttcttgtatttta

SEQ ID NO: 11258 - DNA, 27 bp, Artificial sequence
  SiRNA target sequence
ctgtacgtagatcttcttgtattttac

SEQ ID NO: 11259 - DNA, 27 bp, Artificial sequence
  SiRNA target sequence
tgtacgtagatcttcttgtattttaca

SEQ ID NO: 11260 - DNA, 27 bp, Artificial sequence
  SiRNA target sequence
gtacgtagatcttcttgtattttacat

SEQ ID NO: 11261 - DNA, 27 bp, Artificial sequence
  SiRNA target sequence
tacgtagatcttcttgtattttacatt

SEQ ID NO: 11262 - DNA, 27 bp, Artificial sequence
  SiRNA target sequence
acgtagatcttcttgtattttacattt

SEQ ID NO: 11263 - DNA, 27 bp, Artificial sequence
  SiRNA target sequence
cgtagatcttcttgtattttacatttc

SEQ ID NO: 11264 - DNA, 27 bp, Artificial sequence
  SiRNA target sequence
gtagatcttcttgtattttacatttct

SEQ ID NO: 11265 - DNA, 27 bp, Artificial sequence
  SiRNA target sequence
tagatcttcttgtattttacatttcta

SEQ ID NO: 11266 - DNA, 27 bp, Artificial sequence
  SiRNA target sequence
agatcttcttgtattttacatttctaa

SEQ ID NO: 11267 - DNA, 27 bp, Artificial sequence
  SiRNA target sequence
gatcttcttgtattttacatttctaaa

SEQ ID NO: 11268 - DNA, 27 bp, Artificial sequence
  SiRNA target sequence
atcttcttgtattttacatttctaaaa

SEQ ID NO: 11269 - DNA, 27 bp, Artificial sequence
  SiRNA target sequence
tcttcttgtattttacatttctaaaaa

SEQ ID NO: 11270 - DNA, 27 bp, Artificial sequence
  SiRNA target sequence
cttcttgtattttacatttctaaaaag

SEQ ID NO: 11271 - DNA, 27 bp, Artificial sequence
  SiRNA target sequence
ttcttgtattttacatttctaaaaagg

SEQ ID NO: 11272 - DNA, 27 bp, Artificial sequence
  SiRNA target sequence
tcttgtattttacatttctaaaaagga

SEQ ID NO: 11273 - DNA, 27 bp, Artificial sequence
  SiRNA target sequence
cttgtattttacatttctaaaaaggat

SEQ ID NO: 11274 - DNA, 27 bp, Artificial sequence
  SiRNA target sequence
ttgtattttacatttctaaaaaggatg

SEQ ID NO: 11275 - DNA, 27 bp, Artificial sequence
  SiRNA target sequence
tgtattttacatttctaaaaaggatgt

SEQ ID NO: 11276 - DNA, 27 bp, Artificial sequence
  SiRNA target sequence
gtattttacatttctaaaaaggatgtt

SEQ ID NO: 11277 - DNA, 27 bp, Artificial sequence
  SiRNA target sequence
tattttacatttctaaaaaggatgttg

SEQ ID NO: 11278 - DNA, 27 bp, Artificial sequence
  SiRNA target sequence
attttacatttctaaaaaggatgttga

SEQ ID NO: 11279 - DNA, 27 bp, Artificial sequence
  SiRNA target sequence
ttttacatttctaaaaaggatgttgaa

SEQ ID NO: 11280 - DNA, 27 bp, Artificial sequence
  SiRNA target sequence
tttacatttctaaaaaggatgttgaaa

SEQ ID NO: 11281 - DNA, 27 bp, Artificial sequence
  SiRNA target sequence
ttacatttctaaaaaggatgttgaaaa

SEQ ID NO: 11282 - DNA, 27 bp, Artificial sequence
  SiRNA target sequence
tacatttctaaaaaggatgttgaaaaa

SEQ ID NO: 11283 - DNA, 27 bp, Artificial sequence
  SiRNA target sequence
acatttctaaaaaggatgttgaaaaag

SEQ ID NO: 11284 - DNA, 27 bp, Artificial sequence
  SiRNA target sequence
catttctaaaaaggatgttgaaaaagt

SEQ ID NO: 11285 - DNA, 27 bp, Artificial sequence
  SiRNA target sequence
atttctaaaaaggatgttgaaaaagtt

SEQ ID NO: 11286 - DNA, 27 bp, Artificial sequence
  SiRNA target sequence
tttctaaaaaggatgttgaaaaagtta

SEQ ID NO: 11287 - DNA, 27 bp, Artificial sequence
  SiRNA target sequence
ttctaaaaaggatgttgaaaaagttaa

SEQ ID NO: 11288 - DNA, 27 bp, Artificial sequence
  SiRNA target sequence
tctaaaaaggatgttgaaaaagttaat

SEQ ID NO: 11289 - DNA, 27 bp, Artificial sequence
  SiRNA target sequence
ctaaaaaggatgttgaaaaagttaatg

SEQ ID NO: 11290 - DNA, 27 bp, Artificial sequence
  SiRNA target sequence
taaaaaggatgttgaaaaagttaatga

SEQ ID NO: 11291 - DNA, 27 bp, Artificial sequence
  SiRNA target sequence
aaaaaggatgttgaaaaagttaatgaa

SEQ ID NO: 11292 - DNA, 27 bp, Artificial sequence
  SiRNA target sequence
aaaaggatgttgaaaaagttaatgaaa

SEQ ID NO: 11293 - DNA, 27 bp, Artificial sequence
  SiRNA target sequence
aaaggatgttgaaaaagttaatgaaac

SEQ ID NO: 11294 - DNA, 27 bp, Artificial sequence
  SiRNA target sequence
aaggatgttgaaaaagttaatgaaaca

SEQ ID NO: 11295 - DNA, 27 bp, Artificial sequence
  SiRNA target sequence
aggatgttgaaaaagttaatgaaacaa

SEQ ID NO: 11296 - DNA, 27 bp, Artificial sequence
  SiRNA target sequence
ggatgttgaaaaagttaatgaaacaat

SEQ ID NO: 11297 - DNA, 27 bp, Artificial sequence
  SiRNA target sequence
gatgttgaaaaagttaatgaaacaatt

SEQ ID NO: 11298 - DNA, 27 bp, Artificial sequence
  SiRNA target sequence
atgttgaaaaagttaatgaaacaatta

SEQ ID NO: 11299 - DNA, 27 bp, Artificial sequence
  SiRNA target sequence
tgttgaaaaagttaatgaaacaattaa

SEQ ID NO: 11300 - DNA, 27 bp, Artificial sequence
  SiRNA target sequence
gttgaaaaagttaatgaaacaattaat

SEQ ID NO: 11301 - DNA, 27 bp, Artificial sequence
  SiRNA target sequence
ttgaaaaagttaatgaaacaattaata

SEQ ID NO: 11302 - DNA, 27 bp, Artificial sequence
  SiRNA target sequence
tgaaaaagttaatgaaacaattaataa

SEQ ID NO: 11303 - DNA, 27 bp, Artificial sequence
  SiRNA target sequence
gaaaaagttaatgaaacaattaataat

SEQ ID NO: 11304 - DNA, 27 bp, Artificial sequence
  SiRNA target sequence
aaaaagttaatgaaacaattaataatt

SEQ ID NO: 11305 - DNA, 27 bp, Artificial sequence
  SiRNA target sequence
aaaagttaatgaaacaattaataattt

SEQ ID NO: 11306 - DNA, 27 bp, Artificial sequence
  SiRNA target sequence
aaagttaatgaaacaattaataattta

SEQ ID NO: 11307 - DNA, 27 bp, Artificial sequence
  SiRNA target sequence
aagttaatgaaacaattaataatttaa

SEQ ID NO: 11308 - DNA, 27 bp, Artificial sequence
  SiRNA target sequence
agttaatgaaacaattaataatttaaa

SEQ ID NO: 11309 - DNA, 27 bp, Artificial sequence
  SiRNA target sequence
gttaatgaaacaattaataatttaaaa

SEQ ID NO: 11310 - DNA, 27 bp, Artificial sequence
  SiRNA target sequence
ttaatgaaacaattaataatttaaaag

SEQ ID NO: 11311 - DNA, 27 bp, Artificial sequence
  SiRNA target sequence
taatgaaacaattaataatttaaaaga

SEQ ID NO: 11312 - DNA, 27 bp, Artificial sequence
  SiRNA target sequence
aatgaaacaattaataatttaaaagag

SEQ ID NO: 11313 - DNA, 27 bp, Artificial sequence
  SiRNA target sequence
atgaaacaattaataatttaaaagaga

SEQ ID NO: 11314 - DNA, 27 bp, Artificial sequence
  SiRNA target sequence
tgaaacaattaataatttaaaagagac

SEQ ID NO: 11315 - DNA, 27 bp, Artificial sequence
  SiRNA target sequence
gaaacaattaataatttaaaagagact

SEQ ID NO: 11316 - DNA, 27 bp, Artificial sequence
  SiRNA target sequence
aaacaattaataatttaaaagagactc

SEQ ID NO: 11317 - DNA, 27 bp, Artificial sequence
  SiRNA target sequence
aacaattaataatttaaaagagactct

SEQ ID NO: 11318 - DNA, 27 bp, Artificial sequence
  SiRNA target sequence
acaattaataatttaaaagagactctt

SEQ ID NO: 11319 - DNA, 27 bp, Artificial sequence
  SiRNA target sequence
caattaataatttaaaagagactctta

SEQ ID NO: 11320 - DNA, 27 bp, Artificial sequence
  SiRNA target sequence
aattaataatttaaaagagactcttac

SEQ ID NO: 11321 - DNA, 27 bp, Artificial sequence
  SiRNA target sequence
attaataatttaaaagagactcttacc

SEQ ID NO: 11322 - DNA, 27 bp, Artificial sequence
  SiRNA target sequence
ttaataatttaaaagagactcttaccc

SEQ ID NO: 11323 - DNA, 27 bp, Artificial sequence
  SiRNA target sequence
taataatttaaaagagactcttacccc

SEQ ID NO: 11324 - DNA, 27 bp, Artificial sequence
  SiRNA target sequence
aataatttaaaagagactcttaccccc

SEQ ID NO: 11325 - DNA, 27 bp, Artificial sequence
  SiRNA target sequence
ataatttaaaagagactcttaccccca

SEQ ID NO: 11326 - DNA, 27 bp, Artificial sequence
  SiRNA target sequence
taatttaaaagagactcttacccccac

SEQ ID NO: 11327 - DNA, 27 bp, Artificial sequence
  SiRNA target sequence
aatttaaaagagactcttacccccact

SEQ ID NO: 11328 - DNA, 27 bp, Artificial sequence
  SiRNA target sequence
atttaaaagagactcttacccccactt

SEQ ID NO: 11329 - DNA, 27 bp, Artificial sequence
  SiRNA target sequence
tttaaaagagactcttacccccacttt

SEQ ID NO: 11330 - DNA, 27 bp, Artificial sequence
  SiRNA target sequence
ttaaaagagactcttacccccacttta

SEQ ID NO: 11331 - DNA, 27 bp, Artificial sequence
  SiRNA target sequence
taaaagagactcttacccccactttat

SEQ ID NO: 11332 - DNA, 27 bp, Artificial sequence
  SiRNA target sequence
aaaagagactcttacccccactttatt

SEQ ID NO: 11333 - DNA, 27 bp, Artificial sequence
  SiRNA target sequence
aaagagactcttacccccactttattg

SEQ ID NO: 11334 - DNA, 27 bp, Artificial sequence
  SiRNA target sequence
aagagactcttacccccactttattgg

SEQ ID NO: 11335 - DNA, 27 bp, Artificial sequence
  SiRNA target sequence
agagactcttacccccactttattgga

SEQ ID NO: 11336 - DNA, 27 bp, Artificial sequence
  SiRNA target sequence
gagactcttacccccactttattggaa

SEQ ID NO: 11337 - DNA, 27 bp, Artificial sequence
  SiRNA target sequence
agactcttacccccactttattggaac

SEQ ID NO: 11338 - DNA, 27 bp, Artificial sequence
  SiRNA target sequence
gactcttacccccactttattggaact

SEQ ID NO: 11339 - DNA, 27 bp, Artificial sequence
  SiRNA target sequence
actcttacccccactttattggaactt

SEQ ID NO: 11340 - DNA, 27 bp, Artificial sequence
  SiRNA target sequence
ctcttacccccactttattggaactta

SEQ ID NO: 11341 - DNA, 27 bp, Artificial sequence
  SiRNA target sequence
tcttacccccactttattggaacttat

SEQ ID NO: 11342 - DNA, 27 bp, Artificial sequence
  SiRNA target sequence
cttacccccactttattggaacttatt

SEQ ID NO: 11343 - DNA, 27 bp, Artificial sequence
  SiRNA target sequence
ttacccccactttattggaacttattg

SEQ ID NO: 11344 - DNA, 27 bp, Artificial sequence
  SiRNA target sequence
tacccccactttattggaacttattgg

SEQ ID NO: 11345 - DNA, 27 bp, Artificial sequence
  SiRNA target sequence
acccccactttattggaacttattgga

SEQ ID NO: 11346 - DNA, 27 bp, Artificial sequence
  SiRNA target sequence
cccccactttattggaacttattggag

SEQ ID NO: 11347 - DNA, 27 bp, Artificial sequence
  SiRNA target sequence
ccccactttattggaacttattggaga

SEQ ID NO: 11348 - DNA, 27 bp, Artificial sequence
  SiRNA target sequence
cccactttattggaacttattggagaa

SEQ ID NO: 11349 - DNA, 27 bp, Artificial sequence
  SiRNA target sequence
ccactttattggaacttattggagaat

SEQ ID NO: 11350 - DNA, 27 bp, Artificial sequence
  SiRNA target sequence
cactttattggaacttattggagaata

SEQ ID NO: 11351 - DNA, 27 bp, Artificial sequence
  SiRNA target sequence
actttattggaacttattggagaatat

SEQ ID NO: 11352 - DNA, 27 bp, Artificial sequence
  SiRNA target sequence
ctttattggaacttattggagaatatt

SEQ ID NO: 11353 - DNA, 27 bp, Artificial sequence
  SiRNA target sequence
tttattggaacttattggagaatatta

SEQ ID NO: 11354 - DNA, 27 bp, Artificial sequence
  SiRNA target sequence
ttattggaacttattggagaatattat

SEQ ID NO: 11355 - DNA, 27 bp, Artificial sequence
  SiRNA target sequence
tattggaacttattggagaatattatt

SEQ ID NO: 11356 - DNA, 27 bp, Artificial sequence
  SiRNA target sequence
attggaacttattggagaatattattt

SEQ ID NO: 11357 - DNA, 27 bp, Artificial sequence
  SiRNA target sequence
ttggaacttattggagaatattattta

SEQ ID NO: 11358 - DNA, 27 bp, Artificial sequence
  SiRNA target sequence
tggaacttattggagaatattatttaa

SEQ ID NO: 11359 - DNA, 27 bp, Artificial sequence
  SiRNA target sequence
ggaacttattggagaatattatttaaa

SEQ ID NO: 11360 - DNA, 27 bp, Artificial sequence
  SiRNA target sequence
gaacttattggagaatattatttaaaa

SEQ ID NO: 11361 - DNA, 27 bp, Artificial sequence
  SiRNA target sequence
aacttattggagaatattatttaaaaa

SEQ ID NO: 11362 - DNA, 27 bp, Artificial sequence
  SiRNA target sequence
acttattggagaatattatttaaaaag

SEQ ID NO: 11363 - DNA, 27 bp, Artificial sequence
  SiRNA target sequence
cttattggagaatattatttaaaaagt

SEQ ID NO: 11364 - DNA, 27 bp, Artificial sequence
  SiRNA target sequence
ttattggagaatattatttaaaaagtg

SEQ ID NO: 11365 - DNA, 27 bp, Artificial sequence
  SiRNA target sequence
tattggagaatattatttaaaaagtgg

SEQ ID NO: 11366 - DNA, 27 bp, Artificial sequence
  SiRNA target sequence
attggagaatattatttaaaaagtgga

SEQ ID NO: 11367 - DNA, 27 bp, Artificial sequence
  SiRNA target sequence
ttggagaatattatttaaaaagtggaa

SEQ ID NO: 11368 - DNA, 27 bp, Artificial sequence
  SiRNA target sequence
tggagaatattatttaaaaagtggaaa

SEQ ID NO: 11369 - DNA, 27 bp, Artificial sequence
  SiRNA target sequence
ggagaatattatttaaaaagtggaaat

SEQ ID NO: 11370 - DNA, 27 bp, Artificial sequence
  SiRNA target sequence
gagaatattatttaaaaagtggaaatc

SEQ ID NO: 11371 - DNA, 27 bp, Artificial sequence
  SiRNA target sequence
agaatattatttaaaaagtggaaatca

SEQ ID NO: 11372 - DNA, 27 bp, Artificial sequence
  SiRNA target sequence
gaatattatttaaaaagtggaaatcac

SEQ ID NO: 11373 - DNA, 27 bp, Artificial sequence
  SiRNA target sequence
aatattatttaaaaagtggaaatcact

SEQ ID NO: 11374 - DNA, 27 bp, Artificial sequence
  SiRNA target sequence
atattatttaaaaagtggaaatcactc

SEQ ID NO: 11375 - DNA, 27 bp, Artificial sequence
  SiRNA target sequence
tattatttaaaaagtggaaatcactct

SEQ ID NO: 11376 - DNA, 27 bp, Artificial sequence
  SiRNA target sequence
attatttaaaaagtggaaatcactcta

SEQ ID NO: 11377 - DNA, 27 bp, Artificial sequence
  SiRNA target sequence
ttatttaaaaagtggaaatcactctaa

SEQ ID NO: 11378 - DNA, 27 bp, Artificial sequence
  SiRNA target sequence
tatttaaaaagtggaaatcactctaaa

SEQ ID NO: 11379 - DNA, 27 bp, Artificial sequence
  SiRNA target sequence
atttaaaaagtggaaatcactctaaaa

SEQ ID NO: 11380 - DNA, 27 bp, Artificial sequence
  SiRNA target sequence
tttaaaaagtggaaatcactctaaaat

SEQ ID NO: 11381 - DNA, 27 bp, Artificial sequence
  SiRNA target sequence
ttaaaaagtggaaatcactctaaaatg

SEQ ID NO: 11382 - DNA, 27 bp, Artificial sequence
  SiRNA target sequence
taaaaagtggaaatcactctaaaatgt

SEQ ID NO: 11383 - DNA, 27 bp, Artificial sequence
  SiRNA target sequence
aaaaagtggaaatcactctaaaatgtt

SEQ ID NO: 11384 - DNA, 27 bp, Artificial sequence
  SiRNA target sequence
aaaagtggaaatcactctaaaatgtta

SEQ ID NO: 11385 - DNA, 27 bp, Artificial sequence
  SiRNA target sequence
aaagtggaaatcactctaaaatgttag

SEQ ID NO: 11386 - DNA, 27 bp, Artificial sequence
  SiRNA target sequence
aagtggaaatcactctaaaatgttaga

SEQ ID NO: 11387 - DNA, 27 bp, Artificial sequence
  SiRNA target sequence
agtggaaatcactctaaaatgttagat

SEQ ID NO: 11388 - DNA, 27 bp, Artificial sequence
  SiRNA target sequence
gtggaaatcactctaaaatgttagatc

SEQ ID NO: 11389 - DNA, 27 bp, Artificial sequence
  SiRNA target sequence
tggaaatcactctaaaatgttagatct

SEQ ID NO: 11390 - DNA, 27 bp, Artificial sequence
  SiRNA target sequence
ggaaatcactctaaaatgttagatcta

SEQ ID NO: 11391 - DNA, 27 bp, Artificial sequence
  SiRNA target sequence
gaaatcactctaaaatgttagatctat

SEQ ID NO: 11392 - DNA, 27 bp, Artificial sequence
  SiRNA target sequence
aaatcactctaaaatgttagatctatt

SEQ ID NO: 11393 - DNA, 27 bp, Artificial sequence
  SiRNA target sequence
aatcactctaaaatgttagatctatta

SEQ ID NO: 11394 - DNA, 27 bp, Artificial sequence
  SiRNA target sequence
atcactctaaaatgttagatctattat

SEQ ID NO: 11395 - DNA, 27 bp, Artificial sequence
  SiRNA target sequence
tcactctaaaatgttagatctattatc

SEQ ID NO: 11396 - DNA, 27 bp, Artificial sequence
  SiRNA target sequence
cactctaaaatgttagatctattatct

SEQ ID NO: 11397 - DNA, 27 bp, Artificial sequence
  SiRNA target sequence
actctaaaatgttagatctattatcta

SEQ ID NO: 11398 - DNA, 27 bp, Artificial sequence
  SiRNA target sequence
ctctaaaatgttagatctattatctag

SEQ ID NO: 11399 - DNA, 27 bp, Artificial sequence
  SiRNA target sequence
tctaaaatgttagatctattatctagt

SEQ ID NO: 11400 - DNA, 27 bp, Artificial sequence
  SiRNA target sequence
ctaaaatgttagatctattatctagtc

SEQ ID NO: 11401 - DNA, 27 bp, Artificial sequence
  SiRNA target sequence
taaaatgttagatctattatctagtca

SEQ ID NO: 11402 - DNA, 27 bp, Artificial sequence
  SiRNA target sequence
aaaatgttagatctattatctagtcat

SEQ ID NO: 11403 - DNA, 27 bp, Artificial sequence
  SiRNA target sequence
aaatgttagatctattatctagtcatc

SEQ ID NO: 11404 - DNA, 27 bp, Artificial sequence
  SiRNA target sequence
aatgttagatctattatctagtcatcc

SEQ ID NO: 11405 - DNA, 27 bp, Artificial sequence
  SiRNA target sequence
atgttagatctattatctagtcatcca

SEQ ID NO: 11406 - DNA, 27 bp, Artificial sequence
  SiRNA target sequence
tgttagatctattatctagtcatccag

SEQ ID NO: 11407 - DNA, 27 bp, Artificial sequence
  SiRNA target sequence
gttagatctattatctagtcatccaga

SEQ ID NO: 11408 - DNA, 27 bp, Artificial sequence
  SiRNA target sequence
ttagatctattatctagtcatccagat

SEQ ID NO: 11409 - DNA, 27 bp, Artificial sequence
  SiRNA target sequence
tagatctattatctagtcatccagata

SEQ ID NO: 11410 - DNA, 27 bp, Artificial sequence
  SiRNA target sequence
agatctattatctagtcatccagatac

SEQ ID NO: 11411 - DNA, 27 bp, Artificial sequence
  SiRNA target sequence
gatctattatctagtcatccagatact

SEQ ID NO: 11412 - DNA, 27 bp, Artificial sequence
  SiRNA target sequence
atctattatctagtcatccagatactc

SEQ ID NO: 11413 - DNA, 27 bp, Artificial sequence
  SiRNA target sequence
tctattatctagtcatccagatactcc

SEQ ID NO: 11414 - DNA, 27 bp, Artificial sequence
  SiRNA target sequence
ctattatctagtcatccagatactcct

SEQ ID NO: 11415 - DNA, 27 bp, Artificial sequence
  SiRNA target sequence
tattatctagtcatccagatactcctg

SEQ ID NO: 11416 - DNA, 27 bp, Artificial sequence
  SiRNA target sequence
attatctagtcatccagatactcctgg

SEQ ID NO: 11417 - DNA, 27 bp, Artificial sequence
  SiRNA target sequence
ttatctagtcatccagatactcctggt

SEQ ID NO: 11418 - DNA, 27 bp, Artificial sequence
  SiRNA target sequence
tatctagtcatccagatactcctggta

SEQ ID NO: 11419 - DNA, 27 bp, Artificial sequence
  SiRNA target sequence
atctagtcatccagatactcctggtaa

SEQ ID NO: 11420 - DNA, 27 bp, Artificial sequence
  SiRNA target sequence
tctagtcatccagatactcctggtaaa

SEQ ID NO: 11421 - DNA, 27 bp, Artificial sequence
  SiRNA target sequence
ctagtcatccagatactcctggtaaat

SEQ ID NO: 11422 - DNA, 27 bp, Artificial sequence
  SiRNA target sequence
tagtcatccagatactcctggtaaatt

SEQ ID NO: 11423 - DNA, 27 bp, Artificial sequence
  SiRNA target sequence
agtcatccagatactcctggtaaatta

SEQ ID NO: 11424 - DNA, 27 bp, Artificial sequence
  SiRNA target sequence
gtcatccagatactcctggtaaattac

SEQ ID NO: 11425 - DNA, 27 bp, Artificial sequence
  SiRNA target sequence
tcatccagatactcctggtaaattact

SEQ ID NO: 11426 - DNA, 27 bp, Artificial sequence
  SiRNA target sequence
catccagatactcctggtaaattactt

SEQ ID NO: 11427 - DNA, 27 bp, Artificial sequence
  SiRNA target sequence
atccagatactcctggtaaattacttt

SEQ ID NO: 11428 - DNA, 27 bp, Artificial sequence
  SiRNA target sequence
tccagatactcctggtaaattactttt

SEQ ID NO: 11429 - DNA, 27 bp, Artificial sequence
  SiRNA target sequence
ccagatactcctggtaaattactttta

SEQ ID NO: 11430 - DNA, 27 bp, Artificial sequence
  SiRNA target sequence
cagatactcctggtaaattacttttaa

SEQ ID NO: 11431 - DNA, 27 bp, Artificial sequence
  SiRNA target sequence
agatactcctggtaaattacttttaac

SEQ ID NO: 11432 - DNA, 27 bp, Artificial sequence
  SiRNA target sequence
gatactcctggtaaattacttttaacg

SEQ ID NO: 11433 - DNA, 27 bp, Artificial sequence
  SiRNA target sequence
atactcctggtaaattacttttaacgg

SEQ ID NO: 11434 - DNA, 27 bp, Artificial sequence
  SiRNA target sequence
tactcctggtaaattacttttaacggc

SEQ ID NO: 11435 - DNA, 27 bp, Artificial sequence
  SiRNA target sequence
actcctggtaaattacttttaacggca

SEQ ID NO: 11436 - DNA, 27 bp, Artificial sequence
  SiRNA target sequence
ctcctggtaaattacttttaacggcac

SEQ ID NO: 11437 - DNA, 27 bp, Artificial sequence
  SiRNA target sequence
tcctggtaaattacttttaacggcact

SEQ ID NO: 11438 - DNA, 27 bp, Artificial sequence
  SiRNA target sequence
cctggtaaattacttttaacggcactt

SEQ ID NO: 11439 - DNA, 27 bp, Artificial sequence
  SiRNA target sequence
ctggtaaattacttttaacggcacttt

SEQ ID NO: 11440 - DNA, 27 bp, Artificial sequence
  SiRNA target sequence
tggtaaattacttttaacggcacttta

SEQ ID NO: 11441 - DNA, 27 bp, Artificial sequence
  SiRNA target sequence
ggtaaattacttttaacggcactttat

SEQ ID NO: 11442 - DNA, 27 bp, Artificial sequence
  SiRNA target sequence
gtaaattacttttaacggcactttatg

SEQ ID NO: 11443 - DNA, 27 bp, Artificial sequence
  SiRNA target sequence
taaattacttttaacggcactttatgc

SEQ ID NO: 11444 - DNA, 27 bp, Artificial sequence
  SiRNA target sequence
aaattacttttaacggcactttatgca

SEQ ID NO: 11445 - DNA, 27 bp, Artificial sequence
  SiRNA target sequence
aattacttttaacggcactttatgcaa

SEQ ID NO: 11446 - DNA, 27 bp, Artificial sequence
  SiRNA target sequence
attacttttaacggcactttatgcaat

SEQ ID NO: 11447 - DNA, 27 bp, Artificial sequence
  SiRNA target sequence
ttacttttaacggcactttatgcaata

SEQ ID NO: 11448 - DNA, 27 bp, Artificial sequence
  SiRNA target sequence
tacttttaacggcactttatgcaataa

SEQ ID NO: 11449 - DNA, 27 bp, Artificial sequence
  SiRNA target sequence
acttttaacggcactttatgcaataag

SEQ ID NO: 11450 - DNA, 27 bp, Artificial sequence
  SiRNA target sequence
cttttaacggcactttatgcaataagt

SEQ ID NO: 11451 - DNA, 27 bp, Artificial sequence
  SiRNA target sequence
ttttaacggcactttatgcaataagta

SEQ ID NO: 11452 - DNA, 27 bp, Artificial sequence
  SiRNA target sequence
tttaacggcactttatgcaataagtat

SEQ ID NO: 11453 - DNA, 27 bp, Artificial sequence
  SiRNA target sequence
ttaacggcactttatgcaataagtatt

SEQ ID NO: 11454 - DNA, 27 bp, Artificial sequence
  SiRNA target sequence
taacggcactttatgcaataagtattg

SEQ ID NO: 11455 - DNA, 27 bp, Artificial sequence
  SiRNA target sequence
aacggcactttatgcaataagtattga

SEQ ID NO: 11456 - DNA, 27 bp, Artificial sequence
  SiRNA target sequence
acggcactttatgcaataagtattgat

SEQ ID NO: 11457 - DNA, 27 bp, Artificial sequence
  SiRNA target sequence
cggcactttatgcaataagtattgata

SEQ ID NO: 11458 - DNA, 27 bp, Artificial sequence
  SiRNA target sequence
ggcactttatgcaataagtattgataa

SEQ ID NO: 11459 - DNA, 27 bp, Artificial sequence
  SiRNA target sequence
gcactttatgcaataagtattgataag

SEQ ID NO: 11460 - DNA, 27 bp, Artificial sequence
  SiRNA target sequence
cactttatgcaataagtattgataaga

SEQ ID NO: 11461 - DNA, 27 bp, Artificial sequence
  SiRNA target sequence
actttatgcaataagtattgataagaa

SEQ ID NO: 11462 - DNA, 27 bp, Artificial sequence
  SiRNA target sequence
ctttatgcaataagtattgataagaaa

SEQ ID NO: 11463 - DNA, 27 bp, Artificial sequence
  SiRNA target sequence
tttatgcaataagtattgataagaaaa

SEQ ID NO: 11464 - DNA, 27 bp, Artificial sequence
  SiRNA target sequence
ttatgcaataagtattgataagaaaaa

SEQ ID NO: 11465 - DNA, 27 bp, Artificial sequence
  SiRNA target sequence
tatgcaataagtattgataagaaaaag

SEQ ID NO: 11466 - DNA, 27 bp, Artificial sequence
  SiRNA target sequence
atgcaataagtattgataagaaaaagg

SEQ ID NO: 11467 - DNA, 27 bp, Artificial sequence
  SiRNA target sequence
tgcaataagtattgataagaaaaagga

SEQ ID NO: 11468 - DNA, 27 bp, Artificial sequence
  SiRNA target sequence
gcaataagtattgataagaaaaaggat

SEQ ID NO: 11469 - DNA, 27 bp, Artificial sequence
  SiRNA target sequence
caataagtattgataagaaaaaggatg

SEQ ID NO: 11470 - DNA, 27 bp, Artificial sequence
  SiRNA target sequence
aataagtattgataagaaaaaggatgc

SEQ ID NO: 11471 - DNA, 27 bp, Artificial sequence
  SiRNA target sequence
ataagtattgataagaaaaaggatgct

SEQ ID NO: 11472 - DNA, 27 bp, Artificial sequence
  SiRNA target sequence
taagtattgataagaaaaaggatgcta

SEQ ID NO: 11473 - DNA, 27 bp, Artificial sequence
  SiRNA target sequence
aagtattgataagaaaaaggatgctat

SEQ ID NO: 11474 - DNA, 27 bp, Artificial sequence
  SiRNA target sequence
agtattgataagaaaaaggatgctata

SEQ ID NO: 11475 - DNA, 27 bp, Artificial sequence
  SiRNA target sequence
gtattgataagaaaaaggatgctatag

SEQ ID NO: 11476 - DNA, 27 bp, Artificial sequence
  SiRNA target sequence
tattgataagaaaaaggatgctataga

SEQ ID NO: 11477 - DNA, 27 bp, Artificial sequence
  SiRNA target sequence
attgataagaaaaaggatgctatagaa

SEQ ID NO: 11478 - DNA, 27 bp, Artificial sequence
  SiRNA target sequence
ttgataagaaaaaggatgctatagaaa

SEQ ID NO: 11479 - DNA, 27 bp, Artificial sequence
  SiRNA target sequence
tgataagaaaaaggatgctatagaaat

SEQ ID NO: 11480 - DNA, 27 bp, Artificial sequence
  SiRNA target sequence
gataagaaaaaggatgctatagaaatt

SEQ ID NO: 11481 - DNA, 27 bp, Artificial sequence
  SiRNA target sequence
ataagaaaaaggatgctatagaaattt

SEQ ID NO: 11482 - DNA, 27 bp, Artificial sequence
  SiRNA target sequence
taagaaaaaggatgctatagaaatttt

SEQ ID NO: 11483 - DNA, 27 bp, Artificial sequence
  SiRNA target sequence
aagaaaaaggatgctatagaaatttta

SEQ ID NO: 11484 - DNA, 27 bp, Artificial sequence
  SiRNA target sequence
agaaaaaggatgctatagaaattttat

SEQ ID NO: 11485 - DNA, 27 bp, Artificial sequence
  SiRNA target sequence
gaaaaaggatgctatagaaattttata

SEQ ID NO: 11486 - DNA, 27 bp, Artificial sequence
  SiRNA target sequence
aaaaaggatgctatagaaattttatat

SEQ ID NO: 11487 - DNA, 27 bp, Artificial sequence
  SiRNA target sequence
aaaaggatgctatagaaattttatata

SEQ ID NO: 11488 - DNA, 27 bp, Artificial sequence
  SiRNA target sequence
aaaggatgctatagaaattttatatag

SEQ ID NO: 11489 - DNA, 27 bp, Artificial sequence
  SiRNA target sequence
aaggatgctatagaaattttatataga

SEQ ID NO: 11490 - DNA, 27 bp, Artificial sequence
  SiRNA target sequence
aggatgctatagaaattttatatagaa

SEQ ID NO: 11491 - DNA, 27 bp, Artificial sequence
  SiRNA target sequence
ggatgctatagaaattttatatagaag

SEQ ID NO: 11492 - DNA, 27 bp, Artificial sequence
  SiRNA target sequence
gatgctatagaaattttatatagaagt

SEQ ID NO: 11493 - DNA, 27 bp, Artificial sequence
  SiRNA target sequence
atgctatagaaattttatatagaagta

SEQ ID NO: 11494 - DNA, 27 bp, Artificial sequence
  SiRNA target sequence
tgctatagaaattttatatagaagtat

SEQ ID NO: 11495 - DNA, 27 bp, Artificial sequence
  SiRNA target sequence
gctatagaaattttatatagaagtata

SEQ ID NO: 11496 - DNA, 27 bp, Artificial sequence
  SiRNA target sequence
ctatagaaattttatatagaagtatat

SEQ ID NO: 11497 - DNA, 27 bp, Artificial sequence
  SiRNA target sequence
tatagaaattttatatagaagtatatc

SEQ ID NO: 11498 - DNA, 27 bp, Artificial sequence
  SiRNA target sequence
atagaaattttatatagaagtatatca

SEQ ID NO: 11499 - DNA, 27 bp, Artificial sequence
  SiRNA target sequence
tagaaattttatatagaagtatatcag

SEQ ID NO: 11500 - DNA, 27 bp, Artificial sequence
  SiRNA target sequence
agaaattttatatagaagtatatcaga

SEQ ID NO: 11501 - DNA, 27 bp, Artificial sequence
  SiRNA target sequence
gaaattttatatagaagtatatcagaa

SEQ ID NO: 11502 - DNA, 27 bp, Artificial sequence
  SiRNA target sequence
aaattttatatagaagtatatcagaat

SEQ ID NO: 11503 - DNA, 27 bp, Artificial sequence
  SiRNA target sequence
aattttatatagaagtatatcagaata

SEQ ID NO: 11504 - DNA, 27 bp, Artificial sequence
  SiRNA target sequence
attttatatagaagtatatcagaatat

SEQ ID NO: 11505 - DNA, 27 bp, Artificial sequence
  SiRNA target sequence
ttttatatagaagtatatcagaatatt

SEQ ID NO: 11506 - DNA, 27 bp, Artificial sequence
  SiRNA target sequence
tttatatagaagtatatcagaatattc

SEQ ID NO: 11507 - DNA, 27 bp, Artificial sequence
  SiRNA target sequence
ttatatagaagtatatcagaatattca

SEQ ID NO: 11508 - DNA, 27 bp, Artificial sequence
  SiRNA target sequence
tatatagaagtatatcagaatattcat

SEQ ID NO: 11509 - DNA, 27 bp, Artificial sequence
  SiRNA target sequence
atatagaagtatatcagaatattcatc

SEQ ID NO: 11510 - DNA, 27 bp, Artificial sequence
  SiRNA target sequence
tatagaagtatatcagaatattcatct

SEQ ID NO: 11511 - DNA, 27 bp, Artificial sequence
  SiRNA target sequence
atagaagtatatcagaatattcatctt

SEQ ID NO: 11512 - DNA, 27 bp, Artificial sequence
  SiRNA target sequence
tagaagtatatcagaatattcatctta

SEQ ID NO: 11513 - DNA, 27 bp, Artificial sequence
  SiRNA target sequence
agaagtatatcagaatattcatcttat

SEQ ID NO: 11514 - DNA, 27 bp, Artificial sequence
  SiRNA target sequence
gaagtatatcagaatattcatcttatt

SEQ ID NO: 11515 - DNA, 27 bp, Artificial sequence
  SiRNA target sequence
aagtatatcagaatattcatcttattt

SEQ ID NO: 11516 - DNA, 27 bp, Artificial sequence
  SiRNA target sequence
agtatatcagaatattcatcttatttt

SEQ ID NO: 11517 - DNA, 27 bp, Artificial sequence
  SiRNA target sequence
gtatatcagaatattcatcttatttta

SEQ ID NO: 11518 - DNA, 27 bp, Artificial sequence
  SiRNA target sequence
tatatcagaatattcatcttattttaa

SEQ ID NO: 11519 - DNA, 27 bp, Artificial sequence
  SiRNA target sequence
atatcagaatattcatcttattttaaa

SEQ ID NO: 11520 - DNA, 27 bp, Artificial sequence
  SiRNA target sequence
tatcagaatattcatcttattttaaat

SEQ ID NO: 11521 - DNA, 27 bp, Artificial sequence
  SiRNA target sequence
atcagaatattcatcttattttaaatc

SEQ ID NO: 11522 - DNA, 27 bp, Artificial sequence
  SiRNA target sequence
tcagaatattcatcttattttaaatct

SEQ ID NO: 11523 - DNA, 27 bp, Artificial sequence
  SiRNA target sequence
cagaatattcatcttattttaaatctt

SEQ ID NO: 11524 - DNA, 27 bp, Artificial sequence
  SiRNA target sequence
agaatattcatcttattttaaatctta

SEQ ID NO: 11525 - DNA, 27 bp, Artificial sequence
  SiRNA target sequence
gaatattcatcttattttaaatcttat

SEQ ID NO: 11526 - DNA, 27 bp, Artificial sequence
  SiRNA target sequence
aatattcatcttattttaaatcttatt

SEQ ID NO: 11527 - DNA, 27 bp, Artificial sequence
  SiRNA target sequence
atattcatcttattttaaatcttattt

SEQ ID NO: 11528 - DNA, 27 bp, Artificial sequence
  SiRNA target sequence
tattcatcttattttaaatcttatttg

SEQ ID NO: 11529 - DNA, 27 bp, Artificial sequence
  SiRNA target sequence
attcatcttattttaaatcttatttgt

SEQ ID NO: 11530 - DNA, 27 bp, Artificial sequence
  SiRNA target sequence
ttcatcttattttaaatcttatttgta

SEQ ID NO: 11531 - DNA, 27 bp, Artificial sequence
  SiRNA target sequence
tcatcttattttaaatcttatttgtat

SEQ ID NO: 11532 - DNA, 27 bp, Artificial sequence
  SiRNA target sequence
catcttattttaaatcttatttgtatt

SEQ ID NO: 11533 - DNA, 27 bp, Artificial sequence
  SiRNA target sequence
atcttattttaaatcttatttgtattt

SEQ ID NO: 11534 - DNA, 27 bp, Artificial sequence
  SiRNA target sequence
tcttattttaaatcttatttgtattta

SEQ ID NO: 11535 - DNA, 27 bp, Artificial sequence
  SiRNA target sequence
cttattttaaatcttatttgtatttag

SEQ ID NO: 11536 - DNA, 27 bp, Artificial sequence
  SiRNA target sequence
ttattttaaatcttatttgtatttagg

SEQ ID NO: 11537 - DNA, 27 bp, Artificial sequence
  SiRNA target sequence
tattttaaatcttatttgtatttagga

SEQ ID NO: 11538 - DNA, 27 bp, Artificial sequence
  SiRNA target sequence
attttaaatcttatttgtatttaggaa

SEQ ID NO: 11539 - DNA, 27 bp, Artificial sequence
  SiRNA target sequence
ttttaaatcttatttgtatttaggaaa

SEQ ID NO: 11540 - DNA, 27 bp, Artificial sequence
  SiRNA target sequence
tttaaatcttatttgtatttaggaaat

SEQ ID NO: 11541 - DNA, 27 bp, Artificial sequence
  SiRNA target sequence
ttaaatcttatttgtatttaggaaata

SEQ ID NO: 11542 - DNA, 27 bp, Artificial sequence
  SiRNA target sequence
taaatcttatttgtatttaggaaatat

SEQ ID NO: 11543 - DNA, 27 bp, Artificial sequence
  SiRNA target sequence
aaatcttatttgtatttaggaaatatt

SEQ ID NO: 11544 - DNA, 27 bp, Artificial sequence
  SiRNA target sequence
aatcttatttgtatttaggaaatattt

SEQ ID NO: 11545 - DNA, 27 bp, Artificial sequence
  SiRNA target sequence
atcttatttgtatttaggaaatatttt

SEQ ID NO: 11546 - DNA, 27 bp, Artificial sequence
  SiRNA target sequence
tcttatttgtatttaggaaatatttta

SEQ ID NO: 11547 - DNA, 27 bp, Artificial sequence
  SiRNA target sequence
cttatttgtatttaggaaatattttaa

SEQ ID NO: 11548 - DNA, 27 bp, Artificial sequence
  SiRNA target sequence
ttatttgtatttaggaaatattttaat

SEQ ID NO: 11549 - DNA, 27 bp, Artificial sequence
  SiRNA target sequence
tatttgtatttaggaaatattttaata

SEQ ID NO: 11550 - DNA, 27 bp, Artificial sequence
  SiRNA target sequence
atttgtatttaggaaatattttaataa

SEQ ID NO: 11551 - DNA, 27 bp, Artificial sequence
  SiRNA target sequence
tttgtatttaggaaatattttaataaa

SEQ ID NO: 11552 - DNA, 27 bp, Artificial sequence
  SiRNA target sequence
ttgtatttaggaaatattttaataaat

SEQ ID NO: 11553 - DNA, 27 bp, Artificial sequence
  SiRNA target sequence
tgtatttaggaaatattttaataaatg

SEQ ID NO: 11554 - DNA, 27 bp, Artificial sequence
  SiRNA target sequence
gtatttaggaaatattttaataaatga

SEQ ID NO: 11555 - DNA, 27 bp, Artificial sequence
  SiRNA target sequence
tatttaggaaatattttaataaatgat

SEQ ID NO: 11556 - DNA, 27 bp, Artificial sequence
  SiRNA target sequence
atttaggaaatattttaataaatgatg

SEQ ID NO: 11557 - DNA, 27 bp, Artificial sequence
  SiRNA target sequence
tttaggaaatattttaataaatgatga

SEQ ID NO: 11558 - DNA, 27 bp, Artificial sequence
  SiRNA target sequence
ttaggaaatattttaataaatgatgac

SEQ ID NO: 11559 - DNA, 27 bp, Artificial sequence
  SiRNA target sequence
taggaaatattttaataaatgatgact

SEQ ID NO: 11560 - DNA, 27 bp, Artificial sequence
  SiRNA target sequence
aggaaatattttaataaatgatgactt

SEQ ID NO: 11561 - DNA, 27 bp, Artificial sequence
  SiRNA target sequence
ggaaatattttaataaatgatgactta

SEQ ID NO: 11562 - DNA, 27 bp, Artificial sequence
  SiRNA target sequence
gaaatattttaataaatgatgacttaa

SEQ ID NO: 11563 - DNA, 27 bp, Artificial sequence
  SiRNA target sequence
aaatattttaataaatgatgacttaaa

SEQ ID NO: 11564 - DNA, 27 bp, Artificial sequence
  SiRNA target sequence
aatattttaataaatgatgacttaaat

SEQ ID NO: 11565 - DNA, 27 bp, Artificial sequence
  SiRNA target sequence
atattttaataaatgatgacttaaatg

SEQ ID NO: 11566 - DNA, 27 bp, Artificial sequence
  SiRNA target sequence
tattttaataaatgatgacttaaatga

SEQ ID NO: 11567 - DNA, 27 bp, Artificial sequence
  SiRNA target sequence
attttaataaatgatgacttaaatgaa

SEQ ID NO: 11568 - DNA, 27 bp, Artificial sequence
  SiRNA target sequence
ttttaataaatgatgacttaaatgaat

SEQ ID NO: 11569 - DNA, 27 bp, Artificial sequence
  SiRNA target sequence
tttaataaatgatgacttaaatgaatg

SEQ ID NO: 11570 - DNA, 27 bp, Artificial sequence
  SiRNA target sequence
ttaataaatgatgacttaaatgaatgc

SEQ ID NO: 11571 - DNA, 27 bp, Artificial sequence
  SiRNA target sequence
taataaatgatgacttaaatgaatgca

SEQ ID NO: 11572 - DNA, 27 bp, Artificial sequence
  SiRNA target sequence
aataaatgatgacttaaatgaatgcag

SEQ ID NO: 11573 - DNA, 27 bp, Artificial sequence
  SiRNA target sequence
ataaatgatgacttaaatgaatgcagg

SEQ ID NO: 11574 - DNA, 27 bp, Artificial sequence
  SiRNA target sequence
taaatgatgacttaaatgaatgcagga

SEQ ID NO: 11575 - DNA, 27 bp, Artificial sequence
  SiRNA target sequence
aaatgatgacttaaatgaatgcaggaa

SEQ ID NO: 11576 - DNA, 27 bp, Artificial sequence
  SiRNA target sequence
aatgatgacttaaatgaatgcaggaaa

SEQ ID NO: 11577 - DNA, 27 bp, Artificial sequence
  SiRNA target sequence
atgatgacttaaatgaatgcaggaaat

SEQ ID NO: 11578 - DNA, 27 bp, Artificial sequence
  SiRNA target sequence
tgatgacttaaatgaatgcaggaaatt

SEQ ID NO: 11579 - DNA, 27 bp, Artificial sequence
  SiRNA target sequence
gatgacttaaatgaatgcaggaaattg

SEQ ID NO: 11580 - DNA, 27 bp, Artificial sequence
  SiRNA target sequence
atgacttaaatgaatgcaggaaattgt

SEQ ID NO: 11581 - DNA, 27 bp, Artificial sequence
  SiRNA target sequence
tgacttaaatgaatgcaggaaattgtt

SEQ ID NO: 11582 - DNA, 27 bp, Artificial sequence
  SiRNA target sequence
gacttaaatgaatgcaggaaattgttt

SEQ ID NO: 11583 - DNA, 27 bp, Artificial sequence
  SiRNA target sequence
acttaaatgaatgcaggaaattgttta

SEQ ID NO: 11584 - DNA, 27 bp, Artificial sequence
  SiRNA target sequence
cttaaatgaatgcaggaaattgtttaa

SEQ ID NO: 11585 - DNA, 27 bp, Artificial sequence
  SiRNA target sequence
ttaaatgaatgcaggaaattgtttaat

SEQ ID NO: 11586 - DNA, 27 bp, Artificial sequence
  SiRNA target sequence
taaatgaatgcaggaaattgtttaata

SEQ ID NO: 11587 - DNA, 27 bp, Artificial sequence
  SiRNA target sequence
aaatgaatgcaggaaattgtttaatac

SEQ ID NO: 11588 - DNA, 27 bp, Artificial sequence
  SiRNA target sequence
aatgaatgcaggaaattgtttaataca

SEQ ID NO: 11589 - DNA, 27 bp, Artificial sequence
  SiRNA target sequence
atgaatgcaggaaattgtttaatacat

SEQ ID NO: 11590 - DNA, 27 bp, Artificial sequence
  SiRNA target sequence
tgaatgcaggaaattgtttaatacatc

SEQ ID NO: 11591 - DNA, 27 bp, Artificial sequence
  SiRNA target sequence
gaatgcaggaaattgtttaatacatca

SEQ ID NO: 11592 - DNA, 27 bp, Artificial sequence
  SiRNA target sequence
aatgcaggaaattgtttaatacatcac

SEQ ID NO: 11593 - DNA, 27 bp, Artificial sequence
  SiRNA target sequence
atgcaggaaattgtttaatacatcact

SEQ ID NO: 11594 - DNA, 27 bp, Artificial sequence
  SiRNA target sequence
tgcaggaaattgtttaatacatcactt

SEQ ID NO: 11595 - DNA, 27 bp, Artificial sequence
  SiRNA target sequence
gcaggaaattgtttaatacatcacttc

SEQ ID NO: 11596 - DNA, 27 bp, Artificial sequence
  SiRNA target sequence
caggaaattgtttaatacatcacttca

SEQ ID NO: 11597 - DNA, 27 bp, Artificial sequence
  SiRNA target sequence
aggaaattgtttaatacatcacttcaa

SEQ ID NO: 11598 - DNA, 27 bp, Artificial sequence
  SiRNA target sequence
ggaaattgtttaatacatcacttcaat

SEQ ID NO: 11599 - DNA, 27 bp, Artificial sequence
  SiRNA target sequence
gaaattgtttaatacatcacttcaata

SEQ ID NO: 11600 - DNA, 27 bp, Artificial sequence
  SiRNA target sequence
aaattgtttaatacatcacttcaatat

SEQ ID NO: 11601 - DNA, 27 bp, Artificial sequence
  SiRNA target sequence
aattgtttaatacatcacttcaatatt

SEQ ID NO: 11602 - DNA, 27 bp, Artificial sequence
  SiRNA target sequence
attgtttaatacatcacttcaatattg

SEQ ID NO: 11603 - DNA, 27 bp, Artificial sequence
  SiRNA target sequence
ttgtttaatacatcacttcaatattgt

SEQ ID NO: 11604 - DNA, 27 bp, Artificial sequence
  SiRNA target sequence
tgtttaatacatcacttcaatattgtt

SEQ ID NO: 11605 - DNA, 27 bp, Artificial sequence
  SiRNA target sequence
gtttaatacatcacttcaatattgttg

SEQ ID NO: 11606 - DNA, 27 bp, Artificial sequence
  SiRNA target sequence
tttaatacatcacttcaatattgttgt

SEQ ID NO: 11607 - DNA, 27 bp, Artificial sequence
  SiRNA target sequence
ttaatacatcacttcaatattgttgta

SEQ ID NO: 11608 - DNA, 27 bp, Artificial sequence
  SiRNA target sequence
taatacatcacttcaatattgttgtaa

SEQ ID NO: 11609 - DNA, 27 bp, Artificial sequence
  SiRNA target sequence
aatacatcacttcaatattgttgtaat

SEQ ID NO: 11610 - DNA, 27 bp, Artificial sequence
  SiRNA target sequence
atacatcacttcaatattgttgtaatt

SEQ ID NO: 11611 - DNA, 27 bp, Artificial sequence
  SiRNA target sequence
tacatcacttcaatattgttgtaattc

SEQ ID NO: 11612 - DNA, 27 bp, Artificial sequence
  SiRNA target sequence
acatcacttcaatattgttgtaattct

SEQ ID NO: 11613 - DNA, 27 bp, Artificial sequence
  SiRNA target sequence
catcacttcaatattgttgtaattctg

SEQ ID NO: 11614 - DNA, 27 bp, Artificial sequence
  SiRNA target sequence
atcacttcaatattgttgtaattctga

SEQ ID NO: 11615 - DNA, 27 bp, Artificial sequence
  SiRNA target sequence
tcacttcaatattgttgtaattctgat

SEQ ID NO: 11616 - DNA, 27 bp, Artificial sequence
  SiRNA target sequence
cacttcaatattgttgtaattctgatg

SEQ ID NO: 11617 - DNA, 27 bp, Artificial sequence
  SiRNA target sequence
acttcaatattgttgtaattctgatga

SEQ ID NO: 11618 - DNA, 27 bp, Artificial sequence
  SiRNA target sequence
cttcaatattgttgtaattctgatgag

SEQ ID NO: 11619 - DNA, 27 bp, Artificial sequence
  SiRNA target sequence
ttcaatattgttgtaattctgatgagg

SEQ ID NO: 11620 - DNA, 27 bp, Artificial sequence
  SiRNA target sequence
tcaatattgttgtaattctgatgaggt

SEQ ID NO: 11621 - DNA, 27 bp, Artificial sequence
  SiRNA target sequence
caatattgttgtaattctgatgaggtt

SEQ ID NO: 11622 - DNA, 27 bp, Artificial sequence
  SiRNA target sequence
aatattgttgtaattctgatgaggttt

SEQ ID NO: 11623 - DNA, 27 bp, Artificial sequence
  SiRNA target sequence
atattgttgtaattctgatgaggtttt

SEQ ID NO: 11624 - DNA, 27 bp, Artificial sequence
  SiRNA target sequence
tattgttgtaattctgatgaggttttt

SEQ ID NO: 11625 - DNA, 27 bp, Artificial sequence
  SiRNA target sequence
attgttgtaattctgatgaggttttta

SEQ ID NO: 11626 - DNA, 27 bp, Artificial sequence
  SiRNA target sequence
ttgttgtaattctgatgaggtttttat

SEQ ID NO: 11627 - DNA, 27 bp, Artificial sequence
  SiRNA target sequence
tgttgtaattctgatgaggtttttatt

SEQ ID NO: 11628 - DNA, 27 bp, Artificial sequence
  SiRNA target sequence
gttgtaattctgatgaggtttttattg

SEQ ID NO: 11629 - DNA, 27 bp, Artificial sequence
  SiRNA target sequence
ttgtaattctgatgaggtttttattgt

SEQ ID NO: 11630 - DNA, 27 bp, Artificial sequence
  SiRNA target sequence
tgtaattctgatgaggtttttattgtt

SEQ ID NO: 11631 - DNA, 27 bp, Artificial sequence
  SiRNA target sequence
gtaattctgatgaggtttttattgtta

SEQ ID NO: 11632 - DNA, 27 bp, Artificial sequence
  SiRNA target sequence
taattctgatgaggtttttattgttaa

SEQ ID NO: 11633 - DNA, 27 bp, Artificial sequence
  SiRNA target sequence
aattctgatgaggtttttattgttaag

SEQ ID NO: 11634 - DNA, 27 bp, Artificial sequence
  SiRNA target sequence
attctgatgaggtttttattgttaagc

SEQ ID NO: 11635 - DNA, 27 bp, Artificial sequence
  SiRNA target sequence
ttctgatgaggtttttattgttaagca

SEQ ID NO: 11636 - DNA, 27 bp, Artificial sequence
  SiRNA target sequence
tctgatgaggtttttattgttaagcag

SEQ ID NO: 11637 - DNA, 27 bp, Artificial sequence
  SiRNA target sequence
ctgatgaggtttttattgttaagcagt

SEQ ID NO: 11638 - DNA, 27 bp, Artificial sequence
  SiRNA target sequence
tgatgaggtttttattgttaagcagtc

SEQ ID NO: 11639 - DNA, 27 bp, Artificial sequence
  SiRNA target sequence
gatgaggtttttattgttaagcagtca

SEQ ID NO: 11640 - DNA, 27 bp, Artificial sequence
  SiRNA target sequence
atgaggtttttattgttaagcagtcac

SEQ ID NO: 11641 - DNA, 27 bp, Artificial sequence
  SiRNA target sequence
tgaggtttttattgttaagcagtcact

SEQ ID NO: 11642 - DNA, 27 bp, Artificial sequence
  SiRNA target sequence
gaggtttttattgttaagcagtcactt

SEQ ID NO: 11643 - DNA, 27 bp, Artificial sequence
  SiRNA target sequence
aggtttttattgttaagcagtcactta

SEQ ID NO: 11644 - DNA, 27 bp, Artificial sequence
  SiRNA target sequence
ggtttttattgttaagcagtcacttat

SEQ ID NO: 11645 - DNA, 27 bp, Artificial sequence
  SiRNA target sequence
gtttttattgttaagcagtcacttatt

SEQ ID NO: 11646 - DNA, 27 bp, Artificial sequence
  SiRNA target sequence
tttttattgttaagcagtcacttattt

SEQ ID NO: 11647 - DNA, 27 bp, Artificial sequence
  SiRNA target sequence
ttttattgttaagcagtcacttatttt

SEQ ID NO: 11648 - DNA, 27 bp, Artificial sequence
  SiRNA target sequence
tttattgttaagcagtcacttatttta

SEQ ID NO: 11649 - DNA, 27 bp, Artificial sequence
  SiRNA target sequence
ttattgttaagcagtcacttattttaa

SEQ ID NO: 11650 - DNA, 27 bp, Artificial sequence
  SiRNA target sequence
tattgttaagcagtcacttattttaat

SEQ ID NO: 11651 - DNA, 27 bp, Artificial sequence
  SiRNA target sequence
attgttaagcagtcacttattttaata

SEQ ID NO: 11652 - DNA, 27 bp, Artificial sequence
  SiRNA target sequence
ttgttaagcagtcacttattttaatag

SEQ ID NO: 11653 - DNA, 27 bp, Artificial sequence
  SiRNA target sequence
tgttaagcagtcacttattttaataga

SEQ ID NO: 11654 - DNA, 27 bp, Artificial sequence
  SiRNA target sequence
gttaagcagtcacttattttaatagaa

SEQ ID NO: 11655 - DNA, 27 bp, Artificial sequence
  SiRNA target sequence
ttaagcagtcacttattttaatagaag

SEQ ID NO: 11656 - DNA, 27 bp, Artificial sequence
  SiRNA target sequence
taagcagtcacttattttaatagaagt

SEQ ID NO: 11657 - DNA, 27 bp, Artificial sequence
  SiRNA target sequence
aagcagtcacttattttaatagaagta

SEQ ID NO: 11658 - DNA, 27 bp, Artificial sequence
  SiRNA target sequence
agcagtcacttattttaatagaagtac

SEQ ID NO: 11659 - DNA, 27 bp, Artificial sequence
  SiRNA target sequence
gcagtcacttattttaatagaagtaca

SEQ ID NO: 11660 - DNA, 27 bp, Artificial sequence
  SiRNA target sequence
cagtcacttattttaatagaagtacat

SEQ ID NO: 11661 - DNA, 27 bp, Artificial sequence
  SiRNA target sequence
agtcacttattttaatagaagtacatg

SEQ ID NO: 11662 - DNA, 27 bp, Artificial sequence
  SiRNA target sequence
gtcacttattttaatagaagtacatga

SEQ ID NO: 11663 - DNA, 27 bp, Artificial sequence
  SiRNA target sequence
tcacttattttaatagaagtacatgaa

SEQ ID NO: 11664 - DNA, 27 bp, Artificial sequence
  SiRNA target sequence
cacttattttaatagaagtacatgaat

SEQ ID NO: 11665 - DNA, 27 bp, Artificial sequence
  SiRNA target sequence
acttattttaatagaagtacatgaata

SEQ ID NO: 11666 - DNA, 27 bp, Artificial sequence
  SiRNA target sequence
cttattttaatagaagtacatgaatac

SEQ ID NO: 11667 - DNA, 27 bp, Artificial sequence
  SiRNA target sequence
ttattttaatagaagtacatgaataca

SEQ ID NO: 11668 - DNA, 27 bp, Artificial sequence
  SiRNA target sequence
tattttaatagaagtacatgaatacat

SEQ ID NO: 11669 - DNA, 27 bp, Artificial sequence
  SiRNA target sequence
attttaatagaagtacatgaatacatc

SEQ ID NO: 11670 - DNA, 27 bp, Artificial sequence
  SiRNA target sequence
ttttaatagaagtacatgaatacatca

SEQ ID NO: 11671 - DNA, 27 bp, Artificial sequence
  SiRNA target sequence
tttaatagaagtacatgaatacatcaa

SEQ ID NO: 11672 - DNA, 27 bp, Artificial sequence
  SiRNA target sequence
ttaatagaagtacatgaatacatcaaa

SEQ ID NO: 11673 - DNA, 27 bp, Artificial sequence
  SiRNA target sequence
taatagaagtacatgaatacatcaaag

SEQ ID NO: 11674 - DNA, 27 bp, Artificial sequence
  SiRNA target sequence
aatagaagtacatgaatacatcaaaga

SEQ ID NO: 11675 - DNA, 27 bp, Artificial sequence
  SiRNA target sequence
atagaagtacatgaatacatcaaagaa

SEQ ID NO: 11676 - DNA, 27 bp, Artificial sequence
  SiRNA target sequence
tagaagtacatgaatacatcaaagaaa

SEQ ID NO: 11677 - DNA, 27 bp, Artificial sequence
  SiRNA target sequence
agaagtacatgaatacatcaaagaaaa

SEQ ID NO: 11678 - DNA, 27 bp, Artificial sequence
  SiRNA target sequence
gaagtacatgaatacatcaaagaaaat

SEQ ID NO: 11679 - DNA, 27 bp, Artificial sequence
  SiRNA target sequence
aagtacatgaatacatcaaagaaaata

SEQ ID NO: 11680 - DNA, 27 bp, Artificial sequence
  SiRNA target sequence
agtacatgaatacatcaaagaaaataa

SEQ ID NO: 11681 - DNA, 27 bp, Artificial sequence
  SiRNA target sequence
gtacatgaatacatcaaagaaaataaa

SEQ ID NO: 11682 - DNA, 27 bp, Artificial sequence
  SiRNA target sequence
tacatgaatacatcaaagaaaataaaa

SEQ ID NO: 11683 - DNA, 27 bp, Artificial sequence
  SiRNA target sequence
acatgaatacatcaaagaaaataaaat

SEQ ID NO: 11684 - DNA, 27 bp, Artificial sequence
  SiRNA target sequence
catgaatacatcaaagaaaataaaata

SEQ ID NO: 11685 - DNA, 27 bp, Artificial sequence
  SiRNA target sequence
atgaatacatcaaagaaaataaaatat

SEQ ID NO: 11686 - DNA, 27 bp, Artificial sequence
  SiRNA target sequence
tgaatacatcaaagaaaataaaatata

SEQ ID NO: 11687 - DNA, 27 bp, Artificial sequence
  SiRNA target sequence
gaatacatcaaagaaaataaaatataa

SEQ ID NO: 11688 - DNA, 19 bp, Artificial sequence
  SiRNA target sequence
atgaaatctttctacaaaa

SEQ ID NO: 11689 - DNA, 19 bp, Artificial sequence
  SiRNA target sequence
tgaaatctttctacaaaaa

SEQ ID NO: 11690 - DNA, 19 bp, Artificial sequence
  SiRNA target sequence
gaaatctttctacaaaaaa

SEQ ID NO: 11691 - DNA, 19 bp, Artificial sequence
  SiRNA target sequence
aaatctttctacaaaaaaa

SEQ ID NO: 11692 - DNA, 19 bp, Artificial sequence
  SiRNA target sequence
aatctttctacaaaaaaat

SEQ ID NO: 11693 - DNA, 19 bp, Artificial sequence
  SiRNA target sequence
atctttctacaaaaaaata

SEQ ID NO: 11694 - DNA, 19 bp, Artificial sequence
  SiRNA target sequence
tctttctacaaaaaaataa

SEQ ID NO: 11695 - DNA, 19 bp, Artificial sequence
  SiRNA target sequence
ctttctacaaaaaaataaa

SEQ ID NO: 11696 - DNA, 19 bp, Artificial sequence
  SiRNA target sequence
tttctacaaaaaaataaaa

SEQ ID NO: 11697 - DNA, 19 bp, Artificial sequence
  SiRNA target sequence
ttctacaaaaaaataaaaa

SEQ ID NO: 11698 - DNA, 19 bp, Artificial sequence
  SiRNA target sequence
tctacaaaaaaataaaaag

SEQ ID NO: 11699 - DNA, 19 bp, Artificial sequence
  SiRNA target sequence
ctacaaaaaaataaaaagt

SEQ ID NO: 11700 - DNA, 19 bp, Artificial sequence
  SiRNA target sequence
tacaaaaaaataaaaagtt

SEQ ID NO: 11701 - DNA, 19 bp, Artificial sequence
  SiRNA target sequence
acaaaaaaataaaaagtta

SEQ ID NO: 11702 - DNA, 19 bp, Artificial sequence
  SiRNA target sequence
caaaaaaataaaaagttat

SEQ ID NO: 11703 - DNA, 19 bp, Artificial sequence
  SiRNA target sequence
aaaaaaataaaaagttatt

SEQ ID NO: 11704 - DNA, 19 bp, Artificial sequence
  SiRNA target sequence
aaaaaataaaaagttattt

SEQ ID NO: 11705 - DNA, 19 bp, Artificial sequence
  SiRNA target sequence
aaaaataaaaagttattta

SEQ ID NO: 11706 - DNA, 19 bp, Artificial sequence
  SiRNA target sequence
aaaataaaaagttatttat

SEQ ID NO: 11707 - DNA, 19 bp, Artificial sequence
  SiRNA target sequence
aaataaaaagttatttatt

SEQ ID NO: 11708 - DNA, 19 bp, Artificial sequence
  SiRNA target sequence
aataaaaagttatttattc

SEQ ID NO: 11709 - DNA, 19 bp, Artificial sequence
  SiRNA target sequence
ataaaaagttatttattca

SEQ ID NO: 11710 - DNA, 19 bp, Artificial sequence
  SiRNA target sequence
taaaaagttatttattcaa

SEQ ID NO: 11711 - DNA, 19 bp, Artificial sequence
  SiRNA target sequence
aaaaagttatttattcaaa

SEQ ID NO: 11712 - DNA, 19 bp, Artificial sequence
  SiRNA target sequence
aaaagttatttattcaaat

SEQ ID NO: 11713 - DNA, 19 bp, Artificial sequence
  SiRNA target sequence
aaagttatttattcaaatc

SEQ ID NO: 11714 - DNA, 19 bp, Artificial sequence
  SiRNA target sequence
aagttatttattcaaatct

SEQ ID NO: 11715 - DNA, 19 bp, Artificial sequence
  SiRNA target sequence
agttatttattcaaatctg

SEQ ID NO: 11716 - DNA, 19 bp, Artificial sequence
  SiRNA target sequence
gttatttattcaaatctgc

SEQ ID NO: 11717 - DNA, 19 bp, Artificial sequence
  SiRNA target sequence
ttatttattcaaatctgcc

SEQ ID NO: 11718 - DNA, 19 bp, Artificial sequence
  SiRNA target sequence
tatttattcaaatctgcca

SEQ ID NO: 11719 - DNA, 19 bp, Artificial sequence
  SiRNA target sequence
atttattcaaatctgccat

SEQ ID NO: 11720 - DNA, 19 bp, Artificial sequence
  SiRNA target sequence
tttattcaaatctgccatt

SEQ ID NO: 11721 - DNA, 19 bp, Artificial sequence
  SiRNA target sequence
ttattcaaatctgccatta

SEQ ID NO: 11722 - DNA, 19 bp, Artificial sequence
  SiRNA target sequence
tattcaaatctgccattaa

SEQ ID NO: 11723 - DNA, 19 bp, Artificial sequence
  SiRNA target sequence
attcaaatctgccattaat

SEQ ID NO: 11724 - DNA, 19 bp, Artificial sequence
  SiRNA target sequence
ttcaaatctgccattaata

SEQ ID NO: 11725 - DNA, 19 bp, Artificial sequence
  SiRNA target sequence
tcaaatctgccattaatac

SEQ ID NO: 11726 - DNA, 19 bp, Artificial sequence
  SiRNA target sequence
caaatctgccattaataca

SEQ ID NO: 11727 - DNA, 19 bp, Artificial sequence
  SiRNA target sequence
aaatctgccattaatacat

SEQ ID NO: 11728 - DNA, 19 bp, Artificial sequence
  SiRNA target sequence
aatctgccattaatacatc

SEQ ID NO: 11729 - DNA, 19 bp, Artificial sequence
  SiRNA target sequence
atctgccattaatacatct

SEQ ID NO: 11730 - DNA, 19 bp, Artificial sequence
  SiRNA target sequence
tctgccattaatacatctt

SEQ ID NO: 11731 - DNA, 19 bp, Artificial sequence
  SiRNA target sequence
ctgccattaatacatcttt

SEQ ID NO: 11732 - DNA, 19 bp, Artificial sequence
  SiRNA target sequence
tgccattaatacatctttt

SEQ ID NO: 11733 - DNA, 19 bp, Artificial sequence
  SiRNA target sequence
gccattaatacatcttttg

SEQ ID NO: 11734 - DNA, 19 bp, Artificial sequence
  SiRNA target sequence
ccattaatacatcttttga

SEQ ID NO: 11735 - DNA, 19 bp, Artificial sequence
  SiRNA target sequence
cattaatacatcttttgat

SEQ ID NO: 11736 - DNA, 19 bp, Artificial sequence
  SiRNA target sequence
attaatacatcttttgata

SEQ ID NO: 11737 - DNA, 19 bp, Artificial sequence
  SiRNA target sequence
ttaatacatcttttgatac

SEQ ID NO: 11738 - DNA, 19 bp, Artificial sequence
  SiRNA target sequence
taatacatcttttgatact

SEQ ID NO: 11739 - DNA, 19 bp, Artificial sequence
  SiRNA target sequence
aatacatcttttgatactt

SEQ ID NO: 11740 - DNA, 19 bp, Artificial sequence
  SiRNA target sequence
atacatcttttgatacttt

SEQ ID NO: 11741 - DNA, 19 bp, Artificial sequence
  SiRNA target sequence
tacatcttttgatactttt

SEQ ID NO: 11742 - DNA, 19 bp, Artificial sequence
  SiRNA target sequence
acatcttttgatactttta

SEQ ID NO: 11743 - DNA, 19 bp, Artificial sequence
  SiRNA target sequence
catcttttgatacttttaa

SEQ ID NO: 11744 - DNA, 19 bp, Artificial sequence
  SiRNA target sequence
atcttttgatacttttaat

SEQ ID NO: 11745 - DNA, 19 bp, Artificial sequence
  SiRNA target sequence
tcttttgatacttttaatt

SEQ ID NO: 11746 - DNA, 19 bp, Artificial sequence
  SiRNA target sequence
cttttgatacttttaattt

SEQ ID NO: 11747 - DNA, 19 bp, Artificial sequence
  SiRNA target sequence
ttttgatacttttaattta

SEQ ID NO: 11748 - DNA, 19 bp, Artificial sequence
  SiRNA target sequence
tttgatacttttaatttag

SEQ ID NO: 11749 - DNA, 19 bp, Artificial sequence
  SiRNA target sequence
ttgatacttttaatttaga

SEQ ID NO: 11750 - DNA, 19 bp, Artificial sequence
  SiRNA target sequence
tgatacttttaatttagaa

SEQ ID NO: 11751 - DNA, 19 bp, Artificial sequence
  SiRNA target sequence
gatacttttaatttagaaa

SEQ ID NO: 11752 - DNA, 19 bp, Artificial sequence
  SiRNA target sequence
atacttttaatttagaaaa

SEQ ID NO: 11753 - DNA, 19 bp, Artificial sequence
  SiRNA target sequence
tacttttaatttagaaaat

SEQ ID NO: 11754 - DNA, 19 bp, Artificial sequence
  SiRNA target sequence
acttttaatttagaaaatg

SEQ ID NO: 11755 - DNA, 19 bp, Artificial sequence
  SiRNA target sequence
cttttaatttagaaaatgt

SEQ ID NO: 11756 - DNA, 19 bp, Artificial sequence
  SiRNA target sequence
ttttaatttagaaaatgta

SEQ ID NO: 11757 - DNA, 19 bp, Artificial sequence
  SiRNA target sequence
tttaatttagaaaatgtaa

SEQ ID NO: 11758 - DNA, 19 bp, Artificial sequence
  SiRNA target sequence
ttaatttagaaaatgtaag

SEQ ID NO: 11759 - DNA, 19 bp, Artificial sequence
  SiRNA target sequence
taatttagaaaatgtaagc

SEQ ID NO: 11760 - DNA, 19 bp, Artificial sequence
  SiRNA target sequence
aatttagaaaatgtaagca

SEQ ID NO: 11761 - DNA, 19 bp, Artificial sequence
  SiRNA target sequence
atttagaaaatgtaagcat

SEQ ID NO: 11762 - DNA, 19 bp, Artificial sequence
  SiRNA target sequence
tttagaaaatgtaagcatt

SEQ ID NO: 11763 - DNA, 19 bp, Artificial sequence
  SiRNA target sequence
ttagaaaatgtaagcatta

SEQ ID NO: 11764 - DNA, 19 bp, Artificial sequence
  SiRNA target sequence
tagaaaatgtaagcattac

SEQ ID NO: 11765 - DNA, 19 bp, Artificial sequence
  SiRNA target sequence
agaaaatgtaagcattact

SEQ ID NO: 11766 - DNA, 19 bp, Artificial sequence
  SiRNA target sequence
gaaaatgtaagcattacta

SEQ ID NO: 11767 - DNA, 19 bp, Artificial sequence
  SiRNA target sequence
aaaatgtaagcattactag

SEQ ID NO: 11768 - DNA, 19 bp, Artificial sequence
  SiRNA target sequence
aaatgtaagcattactagc

SEQ ID NO: 11769 - DNA, 19 bp, Artificial sequence
  SiRNA target sequence
aatgtaagcattactagct

SEQ ID NO: 11770 - DNA, 19 bp, Artificial sequence
  SiRNA target sequence
atgtaagcattactagctt

SEQ ID NO: 11771 - DNA, 19 bp, Artificial sequence
  SiRNA target sequence
tgtaagcattactagctta

SEQ ID NO: 11772 - DNA, 19 bp, Artificial sequence
  SiRNA target sequence
gtaagcattactagcttaa

SEQ ID NO: 11773 - DNA, 19 bp, Artificial sequence
  SiRNA target sequence
taagcattactagcttaaa

SEQ ID NO: 11774 - DNA, 19 bp, Artificial sequence
  SiRNA target sequence
aagcattactagcttaaat

SEQ ID NO: 11775 - DNA, 19 bp, Artificial sequence
  SiRNA target sequence
agcattactagcttaaata

SEQ ID NO: 11776 - DNA, 19 bp, Artificial sequence
  SiRNA target sequence
gcattactagcttaaatac

SEQ ID NO: 11777 - DNA, 19 bp, Artificial sequence
  SiRNA target sequence
cattactagcttaaatacg

SEQ ID NO: 11778 - DNA, 19 bp, Artificial sequence
  SiRNA target sequence
attactagcttaaatacgt

SEQ ID NO: 11779 - DNA, 19 bp, Artificial sequence
  SiRNA target sequence
ttactagcttaaatacgta

SEQ ID NO: 11780 - DNA, 19 bp, Artificial sequence
  SiRNA target sequence
tactagcttaaatacgtac

SEQ ID NO: 11781 - DNA, 19 bp, Artificial sequence
  SiRNA target sequence
actagcttaaatacgtaca

SEQ ID NO: 11782 - DNA, 19 bp, Artificial sequence
  SiRNA target sequence
ctagcttaaatacgtacac

SEQ ID NO: 11783 - DNA, 19 bp, Artificial sequence
  SiRNA target sequence
tagcttaaatacgtacacc

SEQ ID NO: 11784 - DNA, 19 bp, Artificial sequence
  SiRNA target sequence
agcttaaatacgtacaccg

SEQ ID NO: 11785 - DNA, 19 bp, Artificial sequence
  SiRNA target sequence
gcttaaatacgtacaccgg

SEQ ID NO: 11786 - DNA, 19 bp, Artificial sequence
  SiRNA target sequence
cttaaatacgtacaccggt

SEQ ID NO: 11787 - DNA, 19 bp, Artificial sequence
  SiRNA target sequence
ttaaatacgtacaccggtg

SEQ ID NO: 11788 - DNA, 19 bp, Artificial sequence
  SiRNA target sequence
taaatacgtacaccggtgt

SEQ ID NO: 11789 - DNA, 19 bp, Artificial sequence
  SiRNA target sequence
aaatacgtacaccggtgtt

SEQ ID NO: 11790 - DNA, 19 bp, Artificial sequence
  SiRNA target sequence
aatacgtacaccggtgtta

SEQ ID NO: 11791 - DNA, 19 bp, Artificial sequence
  SiRNA target sequence
atacgtacaccggtgttaa

SEQ ID NO: 11792 - DNA, 19 bp, Artificial sequence
  SiRNA target sequence
tacgtacaccggtgttaaa

SEQ ID NO: 11793 - DNA, 19 bp, Artificial sequence
  SiRNA target sequence
acgtacaccggtgttaaaa

SEQ ID NO: 11794 - DNA, 19 bp, Artificial sequence
  SiRNA target sequence
cgtacaccggtgttaaaac

SEQ ID NO: 11795 - DNA, 19 bp, Artificial sequence
  SiRNA target sequence
gtacaccggtgttaaaacc

SEQ ID NO: 11796 - DNA, 19 bp, Artificial sequence
  SiRNA target sequence
tacaccggtgttaaaaccg

SEQ ID NO: 11797 - DNA, 19 bp, Artificial sequence
  SiRNA target sequence
acaccggtgttaaaaccga

SEQ ID NO: 11798 - DNA, 19 bp, Artificial sequence
  SiRNA target sequence
caccggtgttaaaaccgaa

SEQ ID NO: 11799 - DNA, 19 bp, Artificial sequence
  SiRNA target sequence
accggtgttaaaaccgaaa

SEQ ID NO: 11800 - DNA, 19 bp, Artificial sequence
  SiRNA target sequence
ccggtgttaaaaccgaaat

SEQ ID NO: 11801 - DNA, 19 bp, Artificial sequence
  SiRNA target sequence
cggtgttaaaaccgaaata

SEQ ID NO: 11802 - DNA, 19 bp, Artificial sequence
  SiRNA target sequence
ggtgttaaaaccgaaatat

SEQ ID NO: 11803 - DNA, 19 bp, Artificial sequence
  SiRNA target sequence
gtgttaaaaccgaaatatc

SEQ ID NO: 11804 - DNA, 19 bp, Artificial sequence
  SiRNA target sequence
tgttaaaaccgaaatatca

SEQ ID NO: 11805 - DNA, 19 bp, Artificial sequence
  SiRNA target sequence
gttaaaaccgaaatatcaa

SEQ ID NO: 11806 - DNA, 19 bp, Artificial sequence
  SiRNA target sequence
ttaaaaccgaaatatcaaa

SEQ ID NO: 11807 - DNA, 19 bp, Artificial sequence
  SiRNA target sequence
taaaaccgaaatatcaaaa

SEQ ID NO: 11808 - DNA, 19 bp, Artificial sequence
  SiRNA target sequence
aaaaccgaaatatcaaaaa

SEQ ID NO: 11809 - DNA, 19 bp, Artificial sequence
  SiRNA target sequence
aaaccgaaatatcaaaaac

SEQ ID NO: 11810 - DNA, 19 bp, Artificial sequence
  SiRNA target sequence
aaccgaaatatcaaaaacc

SEQ ID NO: 11811 - DNA, 19 bp, Artificial sequence
  SiRNA target sequence
accgaaatatcaaaaaccg

SEQ ID NO: 11812 - DNA, 19 bp, Artificial sequence
  SiRNA target sequence
ccgaaatatcaaaaaccgt

SEQ ID NO: 11813 - DNA, 19 bp, Artificial sequence
  SiRNA target sequence
cgaaatatcaaaaaccgta

SEQ ID NO: 11814 - DNA, 19 bp, Artificial sequence
  SiRNA target sequence
gaaatatcaaaaaccgtat

SEQ ID NO: 11815 - DNA, 19 bp, Artificial sequence
  SiRNA target sequence
aaatatcaaaaaccgtatc

SEQ ID NO: 11816 - DNA, 19 bp, Artificial sequence
  SiRNA target sequence
aatatcaaaaaccgtatca

SEQ ID NO: 11817 - DNA, 19 bp, Artificial sequence
  SiRNA target sequence
atatcaaaaaccgtatcac

SEQ ID NO: 11818 - DNA, 19 bp, Artificial sequence
  SiRNA target sequence
tatcaaaaaccgtatcacc

SEQ ID NO: 11819 - DNA, 19 bp, Artificial sequence
  SiRNA target sequence
atcaaaaaccgtatcacca

SEQ ID NO: 11820 - DNA, 19 bp, Artificial sequence
  SiRNA target sequence
tcaaaaaccgtatcaccac

SEQ ID NO: 11821 - DNA, 19 bp, Artificial sequence
  SiRNA target sequence
caaaaaccgtatcaccaca

SEQ ID NO: 11822 - DNA, 19 bp, Artificial sequence
  SiRNA target sequence
aaaaaccgtatcaccacac

SEQ ID NO: 11823 - DNA, 19 bp, Artificial sequence
  SiRNA target sequence
aaaaccgtatcaccacact

SEQ ID NO: 11824 - DNA, 19 bp, Artificial sequence
  SiRNA target sequence
aaaccgtatcaccacactt

SEQ ID NO: 11825 - DNA, 19 bp, Artificial sequence
  SiRNA target sequence
aaccgtatcaccacacttc

SEQ ID NO: 11826 - DNA, 19 bp, Artificial sequence
  SiRNA target sequence
accgtatcaccacacttcc

SEQ ID NO: 11827 - DNA, 19 bp, Artificial sequence
  SiRNA target sequence
ccgtatcaccacacttcca

SEQ ID NO: 11828 - DNA, 19 bp, Artificial sequence
  SiRNA target sequence
cgtatcaccacacttccag

SEQ ID NO: 11829 - DNA, 19 bp, Artificial sequence
  SiRNA target sequence
gtatcaccacacttccaga

SEQ ID NO: 11830 - DNA, 19 bp, Artificial sequence
  SiRNA target sequence
tatcaccacacttccagat

SEQ ID NO: 11831 - DNA, 19 bp, Artificial sequence
  SiRNA target sequence
atcaccacacttccagatt

SEQ ID NO: 11832 - DNA, 19 bp, Artificial sequence
  SiRNA target sequence
tcaccacacttccagattt

SEQ ID NO: 11833 - DNA, 19 bp, Artificial sequence
  SiRNA target sequence
caccacacttccagatttc

SEQ ID NO: 11834 - DNA, 19 bp, Artificial sequence
  SiRNA target sequence
accacacttccagatttct

SEQ ID NO: 11835 - DNA, 19 bp, Artificial sequence
  SiRNA target sequence
ccacacttccagatttctc

SEQ ID NO: 11836 - DNA, 19 bp, Artificial sequence
  SiRNA target sequence
cacacttccagatttctca

SEQ ID NO: 11837 - DNA, 19 bp, Artificial sequence
  SiRNA target sequence
acacttccagatttctcat

SEQ ID NO: 11838 - DNA, 19 bp, Artificial sequence
  SiRNA target sequence
cacttccagatttctcatg

SEQ ID NO: 11839 - DNA, 19 bp, Artificial sequence
  SiRNA target sequence
acttccagatttctcatgt

SEQ ID NO: 11840 - DNA, 19 bp, Artificial sequence
  SiRNA target sequence
cttccagatttctcatgtc

SEQ ID NO: 11841 - DNA, 19 bp, Artificial sequence
  SiRNA target sequence
ttccagatttctcatgtct

SEQ ID NO: 11842 - DNA, 19 bp, Artificial sequence
  SiRNA target sequence
tccagatttctcatgtctc

SEQ ID NO: 11843 - DNA, 19 bp, Artificial sequence
  SiRNA target sequence
ccagatttctcatgtctct

SEQ ID NO: 11844 - DNA, 19 bp, Artificial sequence
  SiRNA target sequence
cagatttctcatgtctctt

SEQ ID NO: 11845 - DNA, 19 bp, Artificial sequence
  SiRNA target sequence
agatttctcatgtctcttc

SEQ ID NO: 11846 - DNA, 19 bp, Artificial sequence
  SiRNA target sequence
gatttctcatgtctcttct

SEQ ID NO: 11847 - DNA, 19 bp, Artificial sequence
  SiRNA target sequence
atttctcatgtctcttcta

SEQ ID NO: 11848 - DNA, 19 bp, Artificial sequence
  SiRNA target sequence
tttctcatgtctcttctat

SEQ ID NO: 11849 - DNA, 19 bp, Artificial sequence
  SiRNA target sequence
ttctcatgtctcttctatg

SEQ ID NO: 11850 - DNA, 19 bp, Artificial sequence
  SiRNA target sequence
tctcatgtctcttctatgg

SEQ ID NO: 11851 - DNA, 19 bp, Artificial sequence
  SiRNA target sequence
ctcatgtctcttctatggg

SEQ ID NO: 11852 - DNA, 19 bp, Artificial sequence
  SiRNA target sequence
tcatgtctcttctatgggc

SEQ ID NO: 11853 - DNA, 19 bp, Artificial sequence
  SiRNA target sequence
catgtctcttctatgggcg

SEQ ID NO: 11854 - DNA, 19 bp, Artificial sequence
  SiRNA target sequence
atgtctcttctatgggcgc

SEQ ID NO: 11855 - DNA, 19 bp, Artificial sequence
  SiRNA target sequence
tgtctcttctatgggcgca

SEQ ID NO: 11856 - DNA, 19 bp, Artificial sequence
  SiRNA target sequence
gtctcttctatgggcgcag

SEQ ID NO: 11857 - DNA, 19 bp, Artificial sequence
  SiRNA target sequence
tctcttctatgggcgcaga

SEQ ID NO: 11858 - DNA, 19 bp, Artificial sequence
  SiRNA target sequence
ctcttctatgggcgcagat

SEQ ID NO: 11859 - DNA, 19 bp, Artificial sequence
  SiRNA target sequence
tcttctatgggcgcagatt

SEQ ID NO: 11860 - DNA, 19 bp, Artificial sequence
  SiRNA target sequence
cttctatgggcgcagattt

SEQ ID NO: 11861 - DNA, 19 bp, Artificial sequence
  SiRNA target sequence
ttctatgggcgcagatttc

SEQ ID NO: 11862 - DNA, 19 bp, Artificial sequence
  SiRNA target sequence
tctatgggcgcagatttcg

SEQ ID NO: 11863 - DNA, 19 bp, Artificial sequence
  SiRNA target sequence
ctatgggcgcagatttcga

SEQ ID NO: 11864 - DNA, 19 bp, Artificial sequence
  SiRNA target sequence
tatgggcgcagatttcgac

SEQ ID NO: 11865 - DNA, 19 bp, Artificial sequence
  SiRNA target sequence
atgggcgcagatttcgaca

SEQ ID NO: 11866 - DNA, 19 bp, Artificial sequence
  SiRNA target sequence
tgggcgcagatttcgacat

SEQ ID NO: 11867 - DNA, 19 bp, Artificial sequence
  SiRNA target sequence
gggcgcagatttcgacata

SEQ ID NO: 11868 - DNA, 19 bp, Artificial sequence
  SiRNA target sequence
ggcgcagatttcgacataa

SEQ ID NO: 11869 - DNA, 19 bp, Artificial sequence
  SiRNA target sequence
gcgcagatttcgacataaa

SEQ ID NO: 11870 - DNA, 19 bp, Artificial sequence
  SiRNA target sequence
cgcagatttcgacataaaa

SEQ ID NO: 11871 - DNA, 19 bp, Artificial sequence
  SiRNA target sequence
gcagatttcgacataaaac

SEQ ID NO: 11872 - DNA, 19 bp, Artificial sequence
  SiRNA target sequence
cagatttcgacataaaaca

SEQ ID NO: 11873 - DNA, 19 bp, Artificial sequence
  SiRNA target sequence
agatttcgacataaaacag

SEQ ID NO: 11874 - DNA, 19 bp, Artificial sequence
  SiRNA target sequence
gatttcgacataaaacaga

SEQ ID NO: 11875 - DNA, 19 bp, Artificial sequence
  SiRNA target sequence
atttcgacataaaacagac

SEQ ID NO: 11876 - DNA, 19 bp, Artificial sequence
  SiRNA target sequence
tttcgacataaaacagaca

SEQ ID NO: 11877 - DNA, 19 bp, Artificial sequence
  SiRNA target sequence
ttcgacataaaacagacat

SEQ ID NO: 11878 - DNA, 19 bp, Artificial sequence
  SiRNA target sequence
tcgacataaaacagacata

SEQ ID NO: 11879 - DNA, 19 bp, Artificial sequence
  SiRNA target sequence
cgacataaaacagacatac

SEQ ID NO: 11880 - DNA, 19 bp, Artificial sequence
  SiRNA target sequence
gacataaaacagacatacg

SEQ ID NO: 11881 - DNA, 19 bp, Artificial sequence
  SiRNA target sequence
acataaaacagacatacgc

SEQ ID NO: 11882 - DNA, 19 bp, Artificial sequence
  SiRNA target sequence
cataaaacagacatacgcc

SEQ ID NO: 11883 - DNA, 19 bp, Artificial sequence
  SiRNA target sequence
ataaaacagacatacgcca

SEQ ID NO: 11884 - DNA, 19 bp, Artificial sequence
  SiRNA target sequence
taaaacagacatacgccac

SEQ ID NO: 11885 - DNA, 19 bp, Artificial sequence
  SiRNA target sequence
aaaacagacatacgccacg

SEQ ID NO: 11886 - DNA, 19 bp, Artificial sequence
  SiRNA target sequence
aaacagacatacgccacgt

SEQ ID NO: 11887 - DNA, 19 bp, Artificial sequence
  SiRNA target sequence
aacagacatacgccacgtt

SEQ ID NO: 11888 - DNA, 19 bp, Artificial sequence
  SiRNA target sequence
acagacatacgccacgttc

SEQ ID NO: 11889 - DNA, 19 bp, Artificial sequence
  SiRNA target sequence
cagacatacgccacgttct

SEQ ID NO: 11890 - DNA, 19 bp, Artificial sequence
  SiRNA target sequence
agacatacgccacgttctg

SEQ ID NO: 11891 - DNA, 19 bp, Artificial sequence
  SiRNA target sequence
gacatacgccacgttctgc

SEQ ID NO: 11892 - DNA, 19 bp, Artificial sequence
  SiRNA target sequence
acatacgccacgttctgct

SEQ ID NO: 11893 - DNA, 19 bp, Artificial sequence
  SiRNA target sequence
catacgccacgttctgctt

SEQ ID NO: 11894 - DNA, 19 bp, Artificial sequence
  SiRNA target sequence
atacgccacgttctgcttt

SEQ ID NO: 11895 - DNA, 19 bp, Artificial sequence
  SiRNA target sequence
tacgccacgttctgcttta

SEQ ID NO: 11896 - DNA, 19 bp, Artificial sequence
  SiRNA target sequence
acgccacgttctgctttaa

SEQ ID NO: 11897 - DNA, 19 bp, Artificial sequence
  SiRNA target sequence
cgccacgttctgctttaac

SEQ ID NO: 11898 - DNA, 19 bp, Artificial sequence
  SiRNA target sequence
gccacgttctgctttaaca

SEQ ID NO: 11899 - DNA, 19 bp, Artificial sequence
  SiRNA target sequence
ccacgttctgctttaacaa

SEQ ID NO: 11900 - DNA, 19 bp, Artificial sequence
  SiRNA target sequence
cacgttctgctttaacaat

SEQ ID NO: 11901 - DNA, 19 bp, Artificial sequence
  SiRNA target sequence
acgttctgctttaacaatc

SEQ ID NO: 11902 - DNA, 19 bp, Artificial sequence
  SiRNA target sequence
cgttctgctttaacaatct

SEQ ID NO: 11903 - DNA, 19 bp, Artificial sequence
  SiRNA target sequence
gttctgctttaacaatctt

SEQ ID NO: 11904 - DNA, 19 bp, Artificial sequence
  SiRNA target sequence
ttctgctttaacaatcttt

SEQ ID NO: 11905 - DNA, 19 bp, Artificial sequence
  SiRNA target sequence
tctgctttaacaatctttt

SEQ ID NO: 11906 - DNA, 19 bp, Artificial sequence
  SiRNA target sequence
ctgctttaacaatcttttg

SEQ ID NO: 11907 - DNA, 19 bp, Artificial sequence
  SiRNA target sequence
tgctttaacaatcttttgc

SEQ ID NO: 11908 - DNA, 19 bp, Artificial sequence
  SiRNA target sequence
gctttaacaatcttttgct

SEQ ID NO: 11909 - DNA, 19 bp, Artificial sequence
  SiRNA target sequence
ctttaacaatcttttgcta

SEQ ID NO: 11910 - DNA, 19 bp, Artificial sequence
  SiRNA target sequence
tttaacaatcttttgctac

SEQ ID NO: 11911 - DNA, 19 bp, Artificial sequence
  SiRNA target sequence
ttaacaatcttttgctaca

SEQ ID NO: 11912 - DNA, 19 bp, Artificial sequence
  SiRNA target sequence
taacaatcttttgctacaa

SEQ ID NO: 11913 - DNA, 19 bp, Artificial sequence
  SiRNA target sequence
aacaatcttttgctacaaa

SEQ ID NO: 11914 - DNA, 19 bp, Artificial sequence
  SiRNA target sequence
acaatcttttgctacaaac

SEQ ID NO: 11915 - DNA, 19 bp, Artificial sequence
  SiRNA target sequence
caatcttttgctacaaacg

SEQ ID NO: 11916 - DNA, 19 bp, Artificial sequence
  SiRNA target sequence
aatcttttgctacaaacga

SEQ ID NO: 11917 - DNA, 19 bp, Artificial sequence
  SiRNA target sequence
atcttttgctacaaacgag

SEQ ID NO: 11918 - DNA, 19 bp, Artificial sequence
  SiRNA target sequence
tcttttgctacaaacgagc

SEQ ID NO: 11919 - DNA, 19 bp, Artificial sequence
  SiRNA target sequence
cttttgctacaaacgagca

SEQ ID NO: 11920 - DNA, 19 bp, Artificial sequence
  SiRNA target sequence
ttttgctacaaacgagcat

SEQ ID NO: 11921 - DNA, 19 bp, Artificial sequence
  SiRNA target sequence
tttgctacaaacgagcata

SEQ ID NO: 11922 - DNA, 19 bp, Artificial sequence
  SiRNA target sequence
ttgctacaaacgagcatag

SEQ ID NO: 11923 - DNA, 19 bp, Artificial sequence
  SiRNA target sequence
tgctacaaacgagcataga

SEQ ID NO: 11924 - DNA, 19 bp, Artificial sequence
  SiRNA target sequence
gctacaaacgagcatagac

SEQ ID NO: 11925 - DNA, 19 bp, Artificial sequence
  SiRNA target sequence
ctacaaacgagcatagacc

SEQ ID NO: 11926 - DNA, 19 bp, Artificial sequence
  SiRNA target sequence
tacaaacgagcatagacca

SEQ ID NO: 11927 - DNA, 19 bp, Artificial sequence
  SiRNA target sequence
acaaacgagcatagaccaa

SEQ ID NO: 11928 - DNA, 19 bp, Artificial sequence
  SiRNA target sequence
caaacgagcatagaccaag

SEQ ID NO: 11929 - DNA, 19 bp, Artificial sequence
  SiRNA target sequence
aaacgagcatagaccaaga

SEQ ID NO: 11930 - DNA, 19 bp, Artificial sequence
  SiRNA target sequence
aacgagcatagaccaagac

SEQ ID NO: 11931 - DNA, 19 bp, Artificial sequence
  SiRNA target sequence
acgagcatagaccaagaca

SEQ ID NO: 11932 - DNA, 19 bp, Artificial sequence
  SiRNA target sequence
cgagcatagaccaagacaa

SEQ ID NO: 11933 - DNA, 19 bp, Artificial sequence
  SiRNA target sequence
gagcatagaccaagacaaa

SEQ ID NO: 11934 - DNA, 19 bp, Artificial sequence
  SiRNA target sequence
agcatagaccaagacaaaa

SEQ ID NO: 11935 - DNA, 19 bp, Artificial sequence
  SiRNA target sequence
gcatagaccaagacaaaat

SEQ ID NO: 11936 - DNA, 19 bp, Artificial sequence
  SiRNA target sequence
catagaccaagacaaaata

SEQ ID NO: 11937 - DNA, 19 bp, Artificial sequence
  SiRNA target sequence
atagaccaagacaaaatat

SEQ ID NO: 11938 - DNA, 19 bp, Artificial sequence
  SiRNA target sequence
tagaccaagacaaaatatt

SEQ ID NO: 11939 - DNA, 19 bp, Artificial sequence
  SiRNA target sequence
agaccaagacaaaatattt

SEQ ID NO: 11940 - DNA, 19 bp, Artificial sequence
  SiRNA target sequence
gaccaagacaaaatattta

SEQ ID NO: 11941 - DNA, 19 bp, Artificial sequence
  SiRNA target sequence
accaagacaaaatatttag

SEQ ID NO: 11942 - DNA, 19 bp, Artificial sequence
  SiRNA target sequence
ccaagacaaaatatttaga

SEQ ID NO: 11943 - DNA, 19 bp, Artificial sequence
  SiRNA target sequence
caagacaaaatatttagaa

SEQ ID NO: 11944 - DNA, 19 bp, Artificial sequence
  SiRNA target sequence
aagacaaaatatttagaat

SEQ ID NO: 11945 - DNA, 19 bp, Artificial sequence
  SiRNA target sequence
agacaaaatatttagaata

SEQ ID NO: 11946 - DNA, 19 bp, Artificial sequence
  SiRNA target sequence
gacaaaatatttagaataa

SEQ ID NO: 11947 - DNA, 19 bp, Artificial sequence
  SiRNA target sequence
acaaaatatttagaataag

SEQ ID NO: 11948 - DNA, 19 bp, Artificial sequence
  SiRNA target sequence
caaaatatttagaataaga

SEQ ID NO: 11949 - DNA, 19 bp, Artificial sequence
  SiRNA target sequence
aaaatatttagaataagag

SEQ ID NO: 11950 - DNA, 19 bp, Artificial sequence
  SiRNA target sequence
aaatatttagaataagagg

SEQ ID NO: 11951 - DNA, 19 bp, Artificial sequence
  SiRNA target sequence
aatatttagaataagaggt

SEQ ID NO: 11952 - DNA, 19 bp, Artificial sequence
  SiRNA target sequence
atatttagaataagaggta

SEQ ID NO: 11953 - DNA, 19 bp, Artificial sequence
  SiRNA target sequence
tatttagaataagaggtac

SEQ ID NO: 11954 - DNA, 19 bp, Artificial sequence
  SiRNA target sequence
atttagaataagaggtacc

SEQ ID NO: 11955 - DNA, 19 bp, Artificial sequence
  SiRNA target sequence
tttagaataagaggtaccc

SEQ ID NO: 11956 - DNA, 19 bp, Artificial sequence
  SiRNA target sequence
ttagaataagaggtaccca

SEQ ID NO: 11957 - DNA, 19 bp, Artificial sequence
  SiRNA target sequence
tagaataagaggtacccac

SEQ ID NO: 11958 - DNA, 19 bp, Artificial sequence
  SiRNA target sequence
agaataagaggtacccaca

SEQ ID NO: 11959 - DNA, 19 bp, Artificial sequence
  SiRNA target sequence
gaataagaggtacccacat

SEQ ID NO: 11960 - DNA, 19 bp, Artificial sequence
  SiRNA target sequence
aataagaggtacccacatg

SEQ ID NO: 11961 - DNA, 19 bp, Artificial sequence
  SiRNA target sequence
ataagaggtacccacatgt

SEQ ID NO: 11962 - DNA, 19 bp, Artificial sequence
  SiRNA target sequence
taagaggtacccacatgtt

SEQ ID NO: 11963 - DNA, 19 bp, Artificial sequence
  SiRNA target sequence
aagaggtacccacatgttt

SEQ ID NO: 11964 - DNA, 19 bp, Artificial sequence
  SiRNA target sequence
agaggtacccacatgttta

SEQ ID NO: 11965 - DNA, 19 bp, Artificial sequence
  SiRNA target sequence
gaggtacccacatgtttaa

SEQ ID NO: 11966 - DNA, 19 bp, Artificial sequence
  SiRNA target sequence
aggtacccacatgtttaaa

SEQ ID NO: 11967 - DNA, 19 bp, Artificial sequence
  SiRNA target sequence
ggtacccacatgtttaaaa

SEQ ID NO: 11968 - DNA, 19 bp, Artificial sequence
  SiRNA target sequence
gtacccacatgtttaaaaa

SEQ ID NO: 11969 - DNA, 19 bp, Artificial sequence
  SiRNA target sequence
tacccacatgtttaaaaat

SEQ ID NO: 11970 - DNA, 19 bp, Artificial sequence
  SiRNA target sequence
acccacatgtttaaaaatc

SEQ ID NO: 11971 - DNA, 19 bp, Artificial sequence
  SiRNA target sequence
cccacatgtttaaaaatct

SEQ ID NO: 11972 - DNA, 19 bp, Artificial sequence
  SiRNA target sequence
ccacatgtttaaaaatcta

SEQ ID NO: 11973 - DNA, 19 bp, Artificial sequence
  SiRNA target sequence
cacatgtttaaaaatctac

SEQ ID NO: 11974 - DNA, 19 bp, Artificial sequence
  SiRNA target sequence
acatgtttaaaaatctact

SEQ ID NO: 11975 - DNA, 19 bp, Artificial sequence
  SiRNA target sequence
catgtttaaaaatctactt

SEQ ID NO: 11976 - DNA, 19 bp, Artificial sequence
  SiRNA target sequence
atgtttaaaaatctactta

SEQ ID NO: 11977 - DNA, 19 bp, Artificial sequence
  SiRNA target sequence
tgtttaaaaatctacttac

SEQ ID NO: 11978 - DNA, 19 bp, Artificial sequence
  SiRNA target sequence
gtttaaaaatctacttact

SEQ ID NO: 11979 - DNA, 19 bp, Artificial sequence
  SiRNA target sequence
tttaaaaatctacttacta

SEQ ID NO: 11980 - DNA, 19 bp, Artificial sequence
  SiRNA target sequence
ttaaaaatctacttactaa

SEQ ID NO: 11981 - DNA, 19 bp, Artificial sequence
  SiRNA target sequence
taaaaatctacttactaaa

SEQ ID NO: 11982 - DNA, 19 bp, Artificial sequence
  SiRNA target sequence
aaaaatctacttactaaat

SEQ ID NO: 11983 - DNA, 19 bp, Artificial sequence
  SiRNA target sequence
aaaatctacttactaaatt

SEQ ID NO: 11984 - DNA, 19 bp, Artificial sequence
  SiRNA target sequence
aaatctacttactaaattc

SEQ ID NO: 11985 - DNA, 19 bp, Artificial sequence
  SiRNA target sequence
aatctacttactaaattcc

SEQ ID NO: 11986 - DNA, 19 bp, Artificial sequence
  SiRNA target sequence
atctacttactaaattcca

SEQ ID NO: 11987 - DNA, 19 bp, Artificial sequence
  SiRNA target sequence
tctacttactaaattccat

SEQ ID NO: 11988 - DNA, 19 bp, Artificial sequence
  SiRNA target sequence
ctacttactaaattccata

SEQ ID NO: 11989 - DNA, 19 bp, Artificial sequence
  SiRNA target sequence
tacttactaaattccatac

SEQ ID NO: 11990 - DNA, 19 bp, Artificial sequence
  SiRNA target sequence
acttactaaattccataca

SEQ ID NO: 11991 - DNA, 19 bp, Artificial sequence
  SiRNA target sequence
cttactaaattccatacag

SEQ ID NO: 11992 - DNA, 19 bp, Artificial sequence
  SiRNA target sequence
ttactaaattccatacagt

SEQ ID NO: 11993 - DNA, 19 bp, Artificial sequence
  SiRNA target sequence
tactaaattccatacagta

SEQ ID NO: 11994 - DNA, 19 bp, Artificial sequence
  SiRNA target sequence
actaaattccatacagtaa

SEQ ID NO: 11995 - DNA, 19 bp, Artificial sequence
  SiRNA target sequence
ctaaattccatacagtaat

SEQ ID NO: 11996 - DNA, 19 bp, Artificial sequence
  SiRNA target sequence
taaattccatacagtaatt

SEQ ID NO: 11997 - DNA, 19 bp, Artificial sequence
  SiRNA target sequence
aaattccatacagtaattg

SEQ ID NO: 11998 - DNA, 19 bp, Artificial sequence
  SiRNA target sequence
aattccatacagtaattgg

SEQ ID NO: 11999 - DNA, 19 bp, Artificial sequence
  SiRNA target sequence
attccatacagtaattggt

SEQ ID NO: 12000 - DNA, 19 bp, Artificial sequence
  SiRNA target sequence
ttccatacagtaattggta

SEQ ID NO: 12001 - DNA, 19 bp, Artificial sequence
  SiRNA target sequence
tccatacagtaattggtag

SEQ ID NO: 12002 - DNA, 19 bp, Artificial sequence
  SiRNA target sequence
ccatacagtaattggtaga

SEQ ID NO: 12003 - DNA, 19 bp, Artificial sequence
  SiRNA target sequence
catacagtaattggtagaa

SEQ ID NO: 12004 - DNA, 19 bp, Artificial sequence
  SiRNA target sequence
atacagtaattggtagaag

SEQ ID NO: 12005 - DNA, 19 bp, Artificial sequence
  SiRNA target sequence
tacagtaattggtagaagt

SEQ ID NO: 12006 - DNA, 19 bp, Artificial sequence
  SiRNA target sequence
acagtaattggtagaagta

SEQ ID NO: 12007 - DNA, 19 bp, Artificial sequence
  SiRNA target sequence
cagtaattggtagaagtaa

SEQ ID NO: 12008 - DNA, 19 bp, Artificial sequence
  SiRNA target sequence
agtaattggtagaagtaaa

SEQ ID NO: 12009 - DNA, 19 bp, Artificial sequence
  SiRNA target sequence
gtaattggtagaagtaaag

SEQ ID NO: 12010 - DNA, 19 bp, Artificial sequence
  SiRNA target sequence
taattggtagaagtaaaga

SEQ ID NO: 12011 - DNA, 19 bp, Artificial sequence
  SiRNA target sequence
aattggtagaagtaaagat

SEQ ID NO: 12012 - DNA, 19 bp, Artificial sequence
  SiRNA target sequence
attggtagaagtaaagata

SEQ ID NO: 12013 - DNA, 19 bp, Artificial sequence
  SiRNA target sequence
ttggtagaagtaaagatat

SEQ ID NO: 12014 - DNA, 19 bp, Artificial sequence
  SiRNA target sequence
tggtagaagtaaagatatc

SEQ ID NO: 12015 - DNA, 19 bp, Artificial sequence
  SiRNA target sequence
ggtagaagtaaagatatct

SEQ ID NO: 12016 - DNA, 19 bp, Artificial sequence
  SiRNA target sequence
gtagaagtaaagatatctt

SEQ ID NO: 12017 - DNA, 19 bp, Artificial sequence
  SiRNA target sequence
tagaagtaaagatatcttt

SEQ ID NO: 12018 - DNA, 19 bp, Artificial sequence
  SiRNA target sequence
agaagtaaagatatcttta

SEQ ID NO: 12019 - DNA, 19 bp, Artificial sequence
  SiRNA target sequence
gaagtaaagatatctttac

SEQ ID NO: 12020 - DNA, 19 bp, Artificial sequence
  SiRNA target sequence
aagtaaagatatctttaca

SEQ ID NO: 12021 - DNA, 19 bp, Artificial sequence
  SiRNA target sequence
agtaaagatatctttacac

SEQ ID NO: 12022 - DNA, 19 bp, Artificial sequence
  SiRNA target sequence
gtaaagatatctttacaca

SEQ ID NO: 12023 - DNA, 19 bp, Artificial sequence
  SiRNA target sequence
taaagatatctttacacaa

SEQ ID NO: 12024 - DNA, 19 bp, Artificial sequence
  SiRNA target sequence
aaagatatctttacacaaa

SEQ ID NO: 12025 - DNA, 19 bp, Artificial sequence
  SiRNA target sequence
aagatatctttacacaaat

SEQ ID NO: 12026 - DNA, 19 bp, Artificial sequence
  SiRNA target sequence
agatatctttacacaaata

SEQ ID NO: 12027 - DNA, 19 bp, Artificial sequence
  SiRNA target sequence
gatatctttacacaaatag

SEQ ID NO: 12028 - DNA, 19 bp, Artificial sequence
  SiRNA target sequence
atatctttacacaaataga

SEQ ID NO: 12029 - DNA, 19 bp, Artificial sequence
  SiRNA target sequence
tatctttacacaaatagag

SEQ ID NO: 12030 - DNA, 19 bp, Artificial sequence
  SiRNA target sequence
atctttacacaaatagagg

SEQ ID NO: 12031 - DNA, 19 bp, Artificial sequence
  SiRNA target sequence
tctttacacaaatagaggt

SEQ ID NO: 12032 - DNA, 19 bp, Artificial sequence
  SiRNA target sequence
ctttacacaaatagaggta

SEQ ID NO: 12033 - DNA, 19 bp, Artificial sequence
  SiRNA target sequence
tttacacaaatagaggtag

SEQ ID NO: 12034 - DNA, 19 bp, Artificial sequence
  SiRNA target sequence
ttacacaaatagaggtaga

SEQ ID NO: 12035 - DNA, 19 bp, Artificial sequence
  SiRNA target sequence
tacacaaatagaggtagac

SEQ ID NO: 12036 - DNA, 19 bp, Artificial sequence
  SiRNA target sequence
acacaaatagaggtagaca

SEQ ID NO: 12037 - DNA, 19 bp, Artificial sequence
  SiRNA target sequence
cacaaatagaggtagacat

SEQ ID NO: 12038 - DNA, 19 bp, Artificial sequence
  SiRNA target sequence
acaaatagaggtagacata

SEQ ID NO: 12039 - DNA, 19 bp, Artificial sequence
  SiRNA target sequence
caaatagaggtagacataa

SEQ ID NO: 12040 - DNA, 19 bp, Artificial sequence
  SiRNA target sequence
aaatagaggtagacataaa

SEQ ID NO: 12041 - DNA, 19 bp, Artificial sequence
  SiRNA target sequence
aatagaggtagacataaaa

SEQ ID NO: 12042 - DNA, 19 bp, Artificial sequence
  SiRNA target sequence
atagaggtagacataaaaa

SEQ ID NO: 12043 - DNA, 19 bp, Artificial sequence
  SiRNA target sequence
tagaggtagacataaaaaa

SEQ ID NO: 12044 - DNA, 19 bp, Artificial sequence
  SiRNA target sequence
agaggtagacataaaaaat

SEQ ID NO: 12045 - DNA, 19 bp, Artificial sequence
  SiRNA target sequence
gaggtagacataaaaaata

SEQ ID NO: 12046 - DNA, 19 bp, Artificial sequence
  SiRNA target sequence
aggtagacataaaaaataa

SEQ ID NO: 12047 - DNA, 19 bp, Artificial sequence
  SiRNA target sequence
ggtagacataaaaaataaa

SEQ ID NO: 12048 - DNA, 19 bp, Artificial sequence
  SiRNA target sequence
gtagacataaaaaataaat

SEQ ID NO: 12049 - DNA, 19 bp, Artificial sequence
  SiRNA target sequence
tagacataaaaaataaata

SEQ ID NO: 12050 - DNA, 19 bp, Artificial sequence
  SiRNA target sequence
agacataaaaaataaatac

SEQ ID NO: 12051 - DNA, 19 bp, Artificial sequence
  SiRNA target sequence
gacataaaaaataaataca

SEQ ID NO: 12052 - DNA, 19 bp, Artificial sequence
  SiRNA target sequence
acataaaaaataaatacaa

SEQ ID NO: 12053 - DNA, 19 bp, Artificial sequence
  SiRNA target sequence
cataaaaaataaatacaat

SEQ ID NO: 12054 - DNA, 19 bp, Artificial sequence
  SiRNA target sequence
ataaaaaataaatacaata

SEQ ID NO: 12055 - DNA, 19 bp, Artificial sequence
  SiRNA target sequence
taaaaaataaatacaataa

SEQ ID NO: 12056 - DNA, 19 bp, Artificial sequence
  SiRNA target sequence
aaaaaataaatacaataat

SEQ ID NO: 12057 - DNA, 19 bp, Artificial sequence
  SiRNA target sequence
aaaaataaatacaataata

SEQ ID NO: 12058 - DNA, 19 bp, Artificial sequence
  SiRNA target sequence
aaaataaatacaataatat

SEQ ID NO: 12059 - DNA, 19 bp, Artificial sequence
  SiRNA target sequence
aaataaatacaataatatg

SEQ ID NO: 12060 - DNA, 19 bp, Artificial sequence
  SiRNA target sequence
aataaatacaataatatgt

SEQ ID NO: 12061 - DNA, 19 bp, Artificial sequence
  SiRNA target sequence
ataaatacaataatatgtg

SEQ ID NO: 12062 - DNA, 19 bp, Artificial sequence
  SiRNA target sequence
taaatacaataatatgtgt

SEQ ID NO: 12063 - DNA, 19 bp, Artificial sequence
  SiRNA target sequence
aaatacaataatatgtgta

SEQ ID NO: 12064 - DNA, 19 bp, Artificial sequence
  SiRNA target sequence
aatacaataatatgtgtat

SEQ ID NO: 12065 - DNA, 19 bp, Artificial sequence
  SiRNA target sequence
atacaataatatgtgtata

SEQ ID NO: 12066 - DNA, 19 bp, Artificial sequence
  SiRNA target sequence
tacaataatatgtgtataa

SEQ ID NO: 12067 - DNA, 19 bp, Artificial sequence
  SiRNA target sequence
acaataatatgtgtataaa

SEQ ID NO: 12068 - DNA, 19 bp, Artificial sequence
  SiRNA target sequence
caataatatgtgtataaaa

SEQ ID NO: 12069 - DNA, 19 bp, Artificial sequence
  SiRNA target sequence
aataatatgtgtataaaaa

SEQ ID NO: 12070 - DNA, 19 bp, Artificial sequence
  SiRNA target sequence
ataatatgtgtataaaaat

SEQ ID NO: 12071 - DNA, 19 bp, Artificial sequence
  SiRNA target sequence
taatatgtgtataaaaatg

SEQ ID NO: 12072 - DNA, 19 bp, Artificial sequence
  SiRNA target sequence
aatatgtgtataaaaatga

SEQ ID NO: 12073 - DNA, 19 bp, Artificial sequence
  SiRNA target sequence
atatgtgtataaaaatgat

SEQ ID NO: 12074 - DNA, 19 bp, Artificial sequence
  SiRNA target sequence
tatgtgtataaaaatgata

SEQ ID NO: 12075 - DNA, 19 bp, Artificial sequence
  SiRNA target sequence
atgtgtataaaaatgatac

SEQ ID NO: 12076 - DNA, 19 bp, Artificial sequence
  SiRNA target sequence
tgtgtataaaaatgataca

SEQ ID NO: 12077 - DNA, 19 bp, Artificial sequence
  SiRNA target sequence
gtgtataaaaatgatacag

SEQ ID NO: 12078 - DNA, 19 bp, Artificial sequence
  SiRNA target sequence
tgtataaaaatgatacagc

SEQ ID NO: 12079 - DNA, 19 bp, Artificial sequence
  SiRNA target sequence
gtataaaaatgatacagcc

SEQ ID NO: 12080 - DNA, 19 bp, Artificial sequence
  SiRNA target sequence
tataaaaatgatacagcca

SEQ ID NO: 12081 - DNA, 19 bp, Artificial sequence
  SiRNA target sequence
ataaaaatgatacagccag

SEQ ID NO: 12082 - DNA, 19 bp, Artificial sequence
  SiRNA target sequence
taaaaatgatacagccagc

SEQ ID NO: 12083 - DNA, 19 bp, Artificial sequence
  SiRNA target sequence
aaaaatgatacagccagct

SEQ ID NO: 12084 - DNA, 19 bp, Artificial sequence
  SiRNA target sequence
aaaatgatacagccagcta

SEQ ID NO: 12085 - DNA, 19 bp, Artificial sequence
  SiRNA target sequence
aaatgatacagccagctat

SEQ ID NO: 12086 - DNA, 19 bp, Artificial sequence
  SiRNA target sequence
aatgatacagccagctatt

SEQ ID NO: 12087 - DNA, 19 bp, Artificial sequence
  SiRNA target sequence
atgatacagccagctatta

SEQ ID NO: 12088 - DNA, 19 bp, Artificial sequence
  SiRNA target sequence
tgatacagccagctattaa

SEQ ID NO: 12089 - DNA, 19 bp, Artificial sequence
  SiRNA target sequence
gatacagccagctattaaa

SEQ ID NO: 12090 - DNA, 19 bp, Artificial sequence
  SiRNA target sequence
atacagccagctattaaag

SEQ ID NO: 12091 - DNA, 19 bp, Artificial sequence
  SiRNA target sequence
tacagccagctattaaagg

SEQ ID NO: 12092 - DNA, 19 bp, Artificial sequence
  SiRNA target sequence
acagccagctattaaaggt

SEQ ID NO: 12093 - DNA, 19 bp, Artificial sequence
  SiRNA target sequence
cagccagctattaaaggtg

SEQ ID NO: 12094 - DNA, 19 bp, Artificial sequence
  SiRNA target sequence
agccagctattaaaggtgc

SEQ ID NO: 12095 - DNA, 19 bp, Artificial sequence
  SiRNA target sequence
gccagctattaaaggtgct

SEQ ID NO: 12096 - DNA, 19 bp, Artificial sequence
  SiRNA target sequence
ccagctattaaaggtgctt

SEQ ID NO: 12097 - DNA, 19 bp, Artificial sequence
  SiRNA target sequence
cagctattaaaggtgcttc

SEQ ID NO: 12098 - DNA, 19 bp, Artificial sequence
  SiRNA target sequence
agctattaaaggtgcttca

SEQ ID NO: 12099 - DNA, 19 bp, Artificial sequence
  SiRNA target sequence
gctattaaaggtgcttcat

SEQ ID NO: 12100 - DNA, 19 bp, Artificial sequence
  SiRNA target sequence
ctattaaaggtgcttcatg

SEQ ID NO: 12101 - DNA, 19 bp, Artificial sequence
  SiRNA target sequence
tattaaaggtgcttcatgt

SEQ ID NO: 12102 - DNA, 19 bp, Artificial sequence
  SiRNA target sequence
attaaaggtgcttcatgta

SEQ ID NO: 12103 - DNA, 19 bp, Artificial sequence
  SiRNA target sequence
ttaaaggtgcttcatgtat

SEQ ID NO: 12104 - DNA, 19 bp, Artificial sequence
  SiRNA target sequence
taaaggtgcttcatgtata

SEQ ID NO: 12105 - DNA, 19 bp, Artificial sequence
  SiRNA target sequence
aaaggtgcttcatgtatat

SEQ ID NO: 12106 - DNA, 19 bp, Artificial sequence
  SiRNA target sequence
aaggtgcttcatgtatata

SEQ ID NO: 12107 - DNA, 19 bp, Artificial sequence
  SiRNA target sequence
aggtgcttcatgtatatac

SEQ ID NO: 12108 - DNA, 19 bp, Artificial sequence
  SiRNA target sequence
ggtgcttcatgtatatacg

SEQ ID NO: 12109 - DNA, 19 bp, Artificial sequence
  SiRNA target sequence
gtgcttcatgtatatacgt

SEQ ID NO: 12110 - DNA, 19 bp, Artificial sequence
  SiRNA target sequence
tgcttcatgtatatacgtg

SEQ ID NO: 12111 - DNA, 19 bp, Artificial sequence
  SiRNA target sequence
gcttcatgtatatacgtgg

SEQ ID NO: 12112 - DNA, 19 bp, Artificial sequence
  SiRNA target sequence
cttcatgtatatacgtggg

SEQ ID NO: 12113 - DNA, 19 bp, Artificial sequence
  SiRNA target sequence
ttcatgtatatacgtgggt

SEQ ID NO: 12114 - DNA, 19 bp, Artificial sequence
  SiRNA target sequence
tcatgtatatacgtgggta

SEQ ID NO: 12115 - DNA, 19 bp, Artificial sequence
  SiRNA target sequence
catgtatatacgtgggtaa

SEQ ID NO: 12116 - DNA, 19 bp, Artificial sequence
  SiRNA target sequence
atgtatatacgtgggtaat

SEQ ID NO: 12117 - DNA, 19 bp, Artificial sequence
  SiRNA target sequence
tgtatatacgtgggtaatt

SEQ ID NO: 12118 - DNA, 19 bp, Artificial sequence
  SiRNA target sequence
gtatatacgtgggtaatta

SEQ ID NO: 12119 - DNA, 19 bp, Artificial sequence
  SiRNA target sequence
tatatacgtgggtaattat

SEQ ID NO: 12120 - DNA, 19 bp, Artificial sequence
  SiRNA target sequence
atatacgtgggtaattata

SEQ ID NO: 12121 - DNA, 19 bp, Artificial sequence
  SiRNA target sequence
tatacgtgggtaattatat

SEQ ID NO: 12122 - DNA, 19 bp, Artificial sequence
  SiRNA target sequence
atacgtgggtaattatatg

SEQ ID NO: 12123 - DNA, 19 bp, Artificial sequence
  SiRNA target sequence
tacgtgggtaattatatgc

SEQ ID NO: 12124 - DNA, 19 bp, Artificial sequence
  SiRNA target sequence
acgtgggtaattatatgca

SEQ ID NO: 12125 - DNA, 19 bp, Artificial sequence
  SiRNA target sequence
cgtgggtaattatatgcag

SEQ ID NO: 12126 - DNA, 19 bp, Artificial sequence
  SiRNA target sequence
gtgggtaattatatgcagc

SEQ ID NO: 12127 - DNA, 19 bp, Artificial sequence
  SiRNA target sequence
tgggtaattatatgcagca

SEQ ID NO: 12128 - DNA, 19 bp, Artificial sequence
  SiRNA target sequence
gggtaattatatgcagcag

SEQ ID NO: 12129 - DNA, 19 bp, Artificial sequence
  SiRNA target sequence
ggtaattatatgcagcagc

SEQ ID NO: 12130 - DNA, 19 bp, Artificial sequence
  SiRNA target sequence
gtaattatatgcagcagct

SEQ ID NO: 12131 - DNA, 19 bp, Artificial sequence
  SiRNA target sequence
taattatatgcagcagcta

SEQ ID NO: 12132 - DNA, 19 bp, Artificial sequence
  SiRNA target sequence
aattatatgcagcagctag

SEQ ID NO: 12133 - DNA, 19 bp, Artificial sequence
  SiRNA target sequence
attatatgcagcagctagg

SEQ ID NO: 12134 - DNA, 19 bp, Artificial sequence
  SiRNA target sequence
ttatatgcagcagctagga

SEQ ID NO: 12135 - DNA, 19 bp, Artificial sequence
  SiRNA target sequence
tatatgcagcagctaggag

SEQ ID NO: 12136 - DNA, 19 bp, Artificial sequence
  SiRNA target sequence
atatgcagcagctaggagt

SEQ ID NO: 12137 - DNA, 19 bp, Artificial sequence
  SiRNA target sequence
tatgcagcagctaggagta

SEQ ID NO: 12138 - DNA, 19 bp, Artificial sequence
  SiRNA target sequence
atgcagcagctaggagtaa

SEQ ID NO: 12139 - DNA, 19 bp, Artificial sequence
  SiRNA target sequence
tgcagcagctaggagtaat

SEQ ID NO: 12140 - DNA, 19 bp, Artificial sequence
  SiRNA target sequence
gcagcagctaggagtaatt

SEQ ID NO: 12141 - DNA, 19 bp, Artificial sequence
  SiRNA target sequence
cagcagctaggagtaatta

SEQ ID NO: 12142 - DNA, 19 bp, Artificial sequence
  SiRNA target sequence
agcagctaggagtaattag

SEQ ID NO: 12143 - DNA, 19 bp, Artificial sequence
  SiRNA target sequence
gcagctaggagtaattagt

SEQ ID NO: 12144 - DNA, 19 bp, Artificial sequence
  SiRNA target sequence
cagctaggagtaattagtc

SEQ ID NO: 12145 - DNA, 19 bp, Artificial sequence
  SiRNA target sequence
agctaggagtaattagtct

SEQ ID NO: 12146 - DNA, 19 bp, Artificial sequence
  SiRNA target sequence
gctaggagtaattagtctt

SEQ ID NO: 12147 - DNA, 19 bp, Artificial sequence
  SiRNA target sequence
ctaggagtaattagtcttg

SEQ ID NO: 12148 - DNA, 19 bp, Artificial sequence
  SiRNA target sequence
taggagtaattagtcttgg

SEQ ID NO: 12149 - DNA, 19 bp, Artificial sequence
  SiRNA target sequence
aggagtaattagtcttggt

SEQ ID NO: 12150 - DNA, 19 bp, Artificial sequence
  SiRNA target sequence
ggagtaattagtcttggtg

SEQ ID NO: 12151 - DNA, 19 bp, Artificial sequence
  SiRNA target sequence
gagtaattagtcttggtgg

SEQ ID NO: 12152 - DNA, 19 bp, Artificial sequence
  SiRNA target sequence
agtaattagtcttggtggg

SEQ ID NO: 12153 - DNA, 19 bp, Artificial sequence
  SiRNA target sequence
gtaattagtcttggtgggg

SEQ ID NO: 12154 - DNA, 19 bp, Artificial sequence
  SiRNA target sequence
taattagtcttggtgggga

SEQ ID NO: 12155 - DNA, 19 bp, Artificial sequence
  SiRNA target sequence
aattagtcttggtggggag

SEQ ID NO: 12156 - DNA, 19 bp, Artificial sequence
  SiRNA target sequence
attagtcttggtggggaga

SEQ ID NO: 12157 - DNA, 19 bp, Artificial sequence
  SiRNA target sequence
ttagtcttggtggggagat

SEQ ID NO: 12158 - DNA, 19 bp, Artificial sequence
  SiRNA target sequence
tagtcttggtggggagatt

SEQ ID NO: 12159 - DNA, 19 bp, Artificial sequence
  SiRNA target sequence
agtcttggtggggagatta

SEQ ID NO: 12160 - DNA, 19 bp, Artificial sequence
  SiRNA target sequence
gtcttggtggggagattat

SEQ ID NO: 12161 - DNA, 19 bp, Artificial sequence
  SiRNA target sequence
tcttggtggggagattatt

SEQ ID NO: 12162 - DNA, 19 bp, Artificial sequence
  SiRNA target sequence
cttggtggggagattatta

SEQ ID NO: 12163 - DNA, 19 bp, Artificial sequence
  SiRNA target sequence
ttggtggggagattattaa

SEQ ID NO: 12164 - DNA, 19 bp, Artificial sequence
  SiRNA target sequence
tggtggggagattattaaa

SEQ ID NO: 12165 - DNA, 19 bp, Artificial sequence
  SiRNA target sequence
ggtggggagattattaaag

SEQ ID NO: 12166 - DNA, 19 bp, Artificial sequence
  SiRNA target sequence
gtggggagattattaaagc

SEQ ID NO: 12167 - DNA, 19 bp, Artificial sequence
  SiRNA target sequence
tggggagattattaaagct

SEQ ID NO: 12168 - DNA, 19 bp, Artificial sequence
  SiRNA target sequence
ggggagattattaaagctg

SEQ ID NO: 12169 - DNA, 19 bp, Artificial sequence
  SiRNA target sequence
gggagattattaaagctga

SEQ ID NO: 12170 - DNA, 19 bp, Artificial sequence
  SiRNA target sequence
ggagattattaaagctgat

SEQ ID NO: 12171 - DNA, 19 bp, Artificial sequence
  SiRNA target sequence
gagattattaaagctgatg

SEQ ID NO: 12172 - DNA, 19 bp, Artificial sequence
  SiRNA target sequence
agattattaaagctgatga

SEQ ID NO: 12173 - DNA, 19 bp, Artificial sequence
  SiRNA target sequence
gattattaaagctgatgaa

SEQ ID NO: 12174 - DNA, 19 bp, Artificial sequence
  SiRNA target sequence
attattaaagctgatgaat

SEQ ID NO: 12175 - DNA, 19 bp, Artificial sequence
  SiRNA target sequence
ttattaaagctgatgaata

SEQ ID NO: 12176 - DNA, 19 bp, Artificial sequence
  SiRNA target sequence
tattaaagctgatgaatac

SEQ ID NO: 12177 - DNA, 19 bp, Artificial sequence
  SiRNA target sequence
attaaagctgatgaataca

SEQ ID NO: 12178 - DNA, 19 bp, Artificial sequence
  SiRNA target sequence
ttaaagctgatgaatacat

SEQ ID NO: 12179 - DNA, 19 bp, Artificial sequence
  SiRNA target sequence
taaagctgatgaatacatt

SEQ ID NO: 12180 - DNA, 19 bp, Artificial sequence
  SiRNA target sequence
aaagctgatgaatacattg

SEQ ID NO: 12181 - DNA, 19 bp, Artificial sequence
  SiRNA target sequence
aagctgatgaatacattgg

SEQ ID NO: 12182 - DNA, 19 bp, Artificial sequence
  SiRNA target sequence
agctgatgaatacattgga

SEQ ID NO: 12183 - DNA, 19 bp, Artificial sequence
  SiRNA target sequence
gctgatgaatacattggac

SEQ ID NO: 12184 - DNA, 19 bp, Artificial sequence
  SiRNA target sequence
ctgatgaatacattggact

SEQ ID NO: 12185 - DNA, 19 bp, Artificial sequence
  SiRNA target sequence
tgatgaatacattggacta

SEQ ID NO: 12186 - DNA, 19 bp, Artificial sequence
  SiRNA target sequence
gatgaatacattggactat

SEQ ID NO: 12187 - DNA, 19 bp, Artificial sequence
  SiRNA target sequence
atgaatacattggactatc

SEQ ID NO: 12188 - DNA, 19 bp, Artificial sequence
  SiRNA target sequence
tgaatacattggactatct

SEQ ID NO: 12189 - DNA, 19 bp, Artificial sequence
  SiRNA target sequence
gaatacattggactatctt

SEQ ID NO: 12190 - DNA, 19 bp, Artificial sequence
  SiRNA target sequence
aatacattggactatcttt

SEQ ID NO: 12191 - DNA, 19 bp, Artificial sequence
  SiRNA target sequence
atacattggactatctttt

SEQ ID NO: 12192 - DNA, 19 bp, Artificial sequence
  SiRNA target sequence
tacattggactatcttttg

SEQ ID NO: 12193 - DNA, 19 bp, Artificial sequence
  SiRNA target sequence
acattggactatcttttgt

SEQ ID NO: 12194 - DNA, 19 bp, Artificial sequence
  SiRNA target sequence
cattggactatcttttgta

SEQ ID NO: 12195 - DNA, 19 bp, Artificial sequence
  SiRNA target sequence
attggactatcttttgtag

SEQ ID NO: 12196 - DNA, 19 bp, Artificial sequence
  SiRNA target sequence
ttggactatcttttgtagg

SEQ ID NO: 12197 - DNA, 19 bp, Artificial sequence
  SiRNA target sequence
tggactatcttttgtaggg

SEQ ID NO: 12198 - DNA, 19 bp, Artificial sequence
  SiRNA target sequence
ggactatcttttgtaggga

SEQ ID NO: 12199 - DNA, 19 bp, Artificial sequence
  SiRNA target sequence
gactatcttttgtagggag

SEQ ID NO: 12200 - DNA, 19 bp, Artificial sequence
  SiRNA target sequence
actatcttttgtagggaga

SEQ ID NO: 12201 - DNA, 19 bp, Artificial sequence
  SiRNA target sequence
ctatcttttgtagggagat

SEQ ID NO: 12202 - DNA, 19 bp, Artificial sequence
  SiRNA target sequence
tatcttttgtagggagata

SEQ ID NO: 12203 - DNA, 19 bp, Artificial sequence
  SiRNA target sequence
atcttttgtagggagatat

SEQ ID NO: 12204 - DNA, 19 bp, Artificial sequence
  SiRNA target sequence
tcttttgtagggagatatg

SEQ ID NO: 12205 - DNA, 19 bp, Artificial sequence
  SiRNA target sequence
cttttgtagggagatatga

SEQ ID NO: 12206 - DNA, 19 bp, Artificial sequence
  SiRNA target sequence
ttttgtagggagatatgaa

SEQ ID NO: 12207 - DNA, 19 bp, Artificial sequence
  SiRNA target sequence
tttgtagggagatatgaag

SEQ ID NO: 12208 - DNA, 19 bp, Artificial sequence
  SiRNA target sequence
ttgtagggagatatgaagg

SEQ ID NO: 12209 - DNA, 19 bp, Artificial sequence
  SiRNA target sequence
tgtagggagatatgaaggg

SEQ ID NO: 12210 - DNA, 19 bp, Artificial sequence
  SiRNA target sequence
gtagggagatatgaaggga

SEQ ID NO: 12211 - DNA, 19 bp, Artificial sequence
  SiRNA target sequence
tagggagatatgaagggat

SEQ ID NO: 12212 - DNA, 19 bp, Artificial sequence
  SiRNA target sequence
agggagatatgaagggatt

SEQ ID NO: 12213 - DNA, 19 bp, Artificial sequence
  SiRNA target sequence
gggagatatgaagggattg

SEQ ID NO: 12214 - DNA, 19 bp, Artificial sequence
  SiRNA target sequence
ggagatatgaagggattgg

SEQ ID NO: 12215 - DNA, 19 bp, Artificial sequence
  SiRNA target sequence
gagatatgaagggattggt

SEQ ID NO: 12216 - DNA, 19 bp, Artificial sequence
  SiRNA target sequence
agatatgaagggattggtt

SEQ ID NO: 12217 - DNA, 19 bp, Artificial sequence
  SiRNA target sequence
gatatgaagggattggttc

SEQ ID NO: 12218 - DNA, 19 bp, Artificial sequence
  SiRNA target sequence
atatgaagggattggttct

SEQ ID NO: 12219 - DNA, 19 bp, Artificial sequence
  SiRNA target sequence
tatgaagggattggttcta

SEQ ID NO: 12220 - DNA, 19 bp, Artificial sequence
  SiRNA target sequence
atgaagggattggttctat

SEQ ID NO: 12221 - DNA, 19 bp, Artificial sequence
  SiRNA target sequence
tgaagggattggttctatt

SEQ ID NO: 12222 - DNA, 19 bp, Artificial sequence
  SiRNA target sequence
gaagggattggttctattt

SEQ ID NO: 12223 - DNA, 19 bp, Artificial sequence
  SiRNA target sequence
aagggattggttctatttc

SEQ ID NO: 12224 - DNA, 19 bp, Artificial sequence
  SiRNA target sequence
agggattggttctatttct

SEQ ID NO: 12225 - DNA, 19 bp, Artificial sequence
  SiRNA target sequence
gggattggttctatttcta

SEQ ID NO: 12226 - DNA, 19 bp, Artificial sequence
  SiRNA target sequence
ggattggttctatttctac

SEQ ID NO: 12227 - DNA, 19 bp, Artificial sequence
  SiRNA target sequence
gattggttctatttctact

SEQ ID NO: 12228 - DNA, 19 bp, Artificial sequence
  SiRNA target sequence
attggttctatttctacta

SEQ ID NO: 12229 - DNA, 19 bp, Artificial sequence
  SiRNA target sequence
ttggttctatttctactat

SEQ ID NO: 12230 - DNA, 19 bp, Artificial sequence
  SiRNA target sequence
tggttctatttctactata

SEQ ID NO: 12231 - DNA, 19 bp, Artificial sequence
  SiRNA target sequence
ggttctatttctactatat

SEQ ID NO: 12232 - DNA, 19 bp, Artificial sequence
  SiRNA target sequence
gttctatttctactatatc

SEQ ID NO: 12233 - DNA, 19 bp, Artificial sequence
  SiRNA target sequence
ttctatttctactatatca

SEQ ID NO: 12234 - DNA, 19 bp, Artificial sequence
  SiRNA target sequence
tctatttctactatatcac

SEQ ID NO: 12235 - DNA, 19 bp, Artificial sequence
  SiRNA target sequence
ctatttctactatatcact

SEQ ID NO: 12236 - DNA, 19 bp, Artificial sequence
  SiRNA target sequence
tatttctactatatcactt

SEQ ID NO: 12237 - DNA, 19 bp, Artificial sequence
  SiRNA target sequence
atttctactatatcacttc

SEQ ID NO: 12238 - DNA, 19 bp, Artificial sequence
  SiRNA target sequence
tttctactatatcacttca

SEQ ID NO: 12239 - DNA, 19 bp, Artificial sequence
  SiRNA target sequence
ttctactatatcacttcag

SEQ ID NO: 12240 - DNA, 19 bp, Artificial sequence
  SiRNA target sequence
tctactatatcacttcagc

SEQ ID NO: 12241 - DNA, 19 bp, Artificial sequence
  SiRNA target sequence
ctactatatcacttcagca

SEQ ID NO: 12242 - DNA, 19 bp, Artificial sequence
  SiRNA target sequence
tactatatcacttcagcag

SEQ ID NO: 12243 - DNA, 19 bp, Artificial sequence
  SiRNA target sequence
actatatcacttcagcagt

SEQ ID NO: 12244 - DNA, 19 bp, Artificial sequence
  SiRNA target sequence
ctatatcacttcagcagtt

SEQ ID NO: 12245 - DNA, 19 bp, Artificial sequence
  SiRNA target sequence
tatatcacttcagcagttt

SEQ ID NO: 12246 - DNA, 19 bp, Artificial sequence
  SiRNA target sequence
atatcacttcagcagttta

SEQ ID NO: 12247 - DNA, 19 bp, Artificial sequence
  SiRNA target sequence
tatcacttcagcagtttaa

SEQ ID NO: 12248 - DNA, 19 bp, Artificial sequence
  SiRNA target sequence
atcacttcagcagtttaat

SEQ ID NO: 12249 - DNA, 19 bp, Artificial sequence
  SiRNA target sequence
tcacttcagcagtttaata

SEQ ID NO: 12250 - DNA, 19 bp, Artificial sequence
  SiRNA target sequence
cacttcagcagtttaatac

SEQ ID NO: 12251 - DNA, 19 bp, Artificial sequence
  SiRNA target sequence
acttcagcagtttaataca

SEQ ID NO: 12252 - DNA, 19 bp, Artificial sequence
  SiRNA target sequence
cttcagcagtttaatacac

SEQ ID NO: 12253 - DNA, 19 bp, Artificial sequence
  SiRNA target sequence
ttcagcagtttaatacact

SEQ ID NO: 12254 - DNA, 19 bp, Artificial sequence
  SiRNA target sequence
tcagcagtttaatacactg

SEQ ID NO: 12255 - DNA, 19 bp, Artificial sequence
  SiRNA target sequence
cagcagtttaatacactgt

SEQ ID NO: 12256 - DNA, 19 bp, Artificial sequence
  SiRNA target sequence
agcagtttaatacactgtc

SEQ ID NO: 12257 - DNA, 19 bp, Artificial sequence
  SiRNA target sequence
gcagtttaatacactgtct

SEQ ID NO: 12258 - DNA, 19 bp, Artificial sequence
  SiRNA target sequence
cagtttaatacactgtcta

SEQ ID NO: 12259 - DNA, 19 bp, Artificial sequence
  SiRNA target sequence
agtttaatacactgtctat

SEQ ID NO: 12260 - DNA, 19 bp, Artificial sequence
  SiRNA target sequence
gtttaatacactgtctata

SEQ ID NO: 12261 - DNA, 19 bp, Artificial sequence
  SiRNA target sequence
tttaatacactgtctatag

SEQ ID NO: 12262 - DNA, 19 bp, Artificial sequence
  SiRNA target sequence
ttaatacactgtctataga

SEQ ID NO: 12263 - DNA, 19 bp, Artificial sequence
  SiRNA target sequence
taatacactgtctatagat

SEQ ID NO: 12264 - DNA, 19 bp, Artificial sequence
  SiRNA target sequence
aatacactgtctatagatt

SEQ ID NO: 12265 - DNA, 19 bp, Artificial sequence
  SiRNA target sequence
atacactgtctatagatta

SEQ ID NO: 12266 - DNA, 19 bp, Artificial sequence
  SiRNA target sequence
tacactgtctatagattat

SEQ ID NO: 12267 - DNA, 19 bp, Artificial sequence
  SiRNA target sequence
acactgtctatagattatt

SEQ ID NO: 12268 - DNA, 19 bp, Artificial sequence
  SiRNA target sequence
cactgtctatagattatta

SEQ ID NO: 12269 - DNA, 19 bp, Artificial sequence
  SiRNA target sequence
actgtctatagattattac

SEQ ID NO: 12270 - DNA, 19 bp, Artificial sequence
  SiRNA target sequence
ctgtctatagattattaca

SEQ ID NO: 12271 - DNA, 19 bp, Artificial sequence
  SiRNA target sequence
tgtctatagattattacaa

SEQ ID NO: 12272 - DNA, 19 bp, Artificial sequence
  SiRNA target sequence
gtctatagattattacaag

SEQ ID NO: 12273 - DNA, 19 bp, Artificial sequence
  SiRNA target sequence
tctatagattattacaaga

SEQ ID NO: 12274 - DNA, 19 bp, Artificial sequence
  SiRNA target sequence
ctatagattattacaagac

SEQ ID NO: 12275 - DNA, 19 bp, Artificial sequence
  SiRNA target sequence
tatagattattacaagaca

SEQ ID NO: 12276 - DNA, 19 bp, Artificial sequence
  SiRNA target sequence
atagattattacaagacat

SEQ ID NO: 12277 - DNA, 19 bp, Artificial sequence
  SiRNA target sequence
tagattattacaagacatt

SEQ ID NO: 12278 - DNA, 19 bp, Artificial sequence
  SiRNA target sequence
agattattacaagacattg

SEQ ID NO: 12279 - DNA, 19 bp, Artificial sequence
  SiRNA target sequence
gattattacaagacattgt

SEQ ID NO: 12280 - DNA, 19 bp, Artificial sequence
  SiRNA target sequence
attattacaagacattgtc

SEQ ID NO: 12281 - DNA, 19 bp, Artificial sequence
  SiRNA target sequence
ttattacaagacattgtct

SEQ ID NO: 12282 - DNA, 19 bp, Artificial sequence
  SiRNA target sequence
tattacaagacattgtctt

SEQ ID NO: 12283 - DNA, 19 bp, Artificial sequence
  SiRNA target sequence
attacaagacattgtcttc

SEQ ID NO: 12284 - DNA, 19 bp, Artificial sequence
  SiRNA target sequence
ttacaagacattgtcttct

SEQ ID NO: 12285 - DNA, 19 bp, Artificial sequence
  SiRNA target sequence
tacaagacattgtcttcta

SEQ ID NO: 12286 - DNA, 19 bp, Artificial sequence
  SiRNA target sequence
acaagacattgtcttctat

SEQ ID NO: 12287 - DNA, 19 bp, Artificial sequence
  SiRNA target sequence
caagacattgtcttctatt

SEQ ID NO: 12288 - DNA, 19 bp, Artificial sequence
  SiRNA target sequence
aagacattgtcttctattt

SEQ ID NO: 12289 - DNA, 19 bp, Artificial sequence
  SiRNA target sequence
agacattgtcttctatttg

SEQ ID NO: 12290 - DNA, 19 bp, Artificial sequence
  SiRNA target sequence
gacattgtcttctatttgt

SEQ ID NO: 12291 - DNA, 19 bp, Artificial sequence
  SiRNA target sequence
acattgtcttctatttgtg

SEQ ID NO: 12292 - DNA, 19 bp, Artificial sequence
  SiRNA target sequence
cattgtcttctatttgtga

SEQ ID NO: 12293 - DNA, 19 bp, Artificial sequence
  SiRNA target sequence
attgtcttctatttgtgac

SEQ ID NO: 12294 - DNA, 19 bp, Artificial sequence
  SiRNA target sequence
ttgtcttctatttgtgacg

SEQ ID NO: 12295 - DNA, 19 bp, Artificial sequence
  SiRNA target sequence
tgtcttctatttgtgacgt

SEQ ID NO: 12296 - DNA, 19 bp, Artificial sequence
  SiRNA target sequence
gtcttctatttgtgacgta

SEQ ID NO: 12297 - DNA, 19 bp, Artificial sequence
  SiRNA target sequence
tcttctatttgtgacgtag

SEQ ID NO: 12298 - DNA, 19 bp, Artificial sequence
  SiRNA target sequence
cttctatttgtgacgtagg

SEQ ID NO: 12299 - DNA, 19 bp, Artificial sequence
  SiRNA target sequence
ttctatttgtgacgtaggt

SEQ ID NO: 12300 - DNA, 19 bp, Artificial sequence
  SiRNA target sequence
tctatttgtgacgtaggta

SEQ ID NO: 12301 - DNA, 19 bp, Artificial sequence
  SiRNA target sequence
ctatttgtgacgtaggtat

SEQ ID NO: 12302 - DNA, 19 bp, Artificial sequence
  SiRNA target sequence
tatttgtgacgtaggtatt

SEQ ID NO: 12303 - DNA, 19 bp, Artificial sequence
  SiRNA target sequence
atttgtgacgtaggtatta

SEQ ID NO: 12304 - DNA, 19 bp, Artificial sequence
  SiRNA target sequence
tttgtgacgtaggtattaa

SEQ ID NO: 12305 - DNA, 19 bp, Artificial sequence
  SiRNA target sequence
ttgtgacgtaggtattaaa

SEQ ID NO: 12306 - DNA, 19 bp, Artificial sequence
  SiRNA target sequence
tgtgacgtaggtattaaaa

SEQ ID NO: 12307 - DNA, 19 bp, Artificial sequence
  SiRNA target sequence
gtgacgtaggtattaaaat

SEQ ID NO: 12308 - DNA, 19 bp, Artificial sequence
  SiRNA target sequence
tgacgtaggtattaaaata

SEQ ID NO: 12309 - DNA, 19 bp, Artificial sequence
  SiRNA target sequence
gacgtaggtattaaaatat

SEQ ID NO: 12310 - DNA, 19 bp, Artificial sequence
  SiRNA target sequence
acgtaggtattaaaatatc

SEQ ID NO: 12311 - DNA, 19 bp, Artificial sequence
  SiRNA target sequence
cgtaggtattaaaatatca

SEQ ID NO: 12312 - DNA, 19 bp, Artificial sequence
  SiRNA target sequence
gtaggtattaaaatatcaa

SEQ ID NO: 12313 - DNA, 19 bp, Artificial sequence
  SiRNA target sequence
taggtattaaaatatcaac

SEQ ID NO: 12314 - DNA, 19 bp, Artificial sequence
  SiRNA target sequence
aggtattaaaatatcaact

SEQ ID NO: 12315 - DNA, 19 bp, Artificial sequence
  SiRNA target sequence
ggtattaaaatatcaactg

SEQ ID NO: 12316 - DNA, 19 bp, Artificial sequence
  SiRNA target sequence
gtattaaaatatcaactga

SEQ ID NO: 12317 - DNA, 19 bp, Artificial sequence
  SiRNA target sequence
tattaaaatatcaactgat

SEQ ID NO: 12318 - DNA, 19 bp, Artificial sequence
  SiRNA target sequence
attaaaatatcaactgata

SEQ ID NO: 12319 - DNA, 19 bp, Artificial sequence
  SiRNA target sequence
ttaaaatatcaactgatag

SEQ ID NO: 12320 - DNA, 19 bp, Artificial sequence
  SiRNA target sequence
taaaatatcaactgatagg

SEQ ID NO: 12321 - DNA, 19 bp, Artificial sequence
  SiRNA target sequence
aaaatatcaactgataggg

SEQ ID NO: 12322 - DNA, 19 bp, Artificial sequence
  SiRNA target sequence
aaatatcaactgataggga

SEQ ID NO: 12323 - DNA, 19 bp, Artificial sequence
  SiRNA target sequence
aatatcaactgatagggaa

SEQ ID NO: 12324 - DNA, 19 bp, Artificial sequence
  SiRNA target sequence
atatcaactgatagggaaa

SEQ ID NO: 12325 - DNA, 19 bp, Artificial sequence
  SiRNA target sequence
tatcaactgatagggaaaa

SEQ ID NO: 12326 - DNA, 19 bp, Artificial sequence
  SiRNA target sequence
atcaactgatagggaaaaa

SEQ ID NO: 12327 - DNA, 19 bp, Artificial sequence
  SiRNA target sequence
tcaactgatagggaaaaat

SEQ ID NO: 12328 - DNA, 19 bp, Artificial sequence
  SiRNA target sequence
caactgatagggaaaaatc

SEQ ID NO: 12329 - DNA, 19 bp, Artificial sequence
  SiRNA target sequence
aactgatagggaaaaatca

SEQ ID NO: 12330 - DNA, 19 bp, Artificial sequence
  SiRNA target sequence
actgatagggaaaaatcag

SEQ ID NO: 12331 - DNA, 19 bp, Artificial sequence
  SiRNA target sequence
ctgatagggaaaaatcagt

SEQ ID NO: 12332 - DNA, 19 bp, Artificial sequence
  SiRNA target sequence
tgatagggaaaaatcagtt

SEQ ID NO: 12333 - DNA, 19 bp, Artificial sequence
  SiRNA target sequence
gatagggaaaaatcagtta

SEQ ID NO: 12334 - DNA, 19 bp, Artificial sequence
  SiRNA target sequence
atagggaaaaatcagttaa

SEQ ID NO: 12335 - DNA, 19 bp, Artificial sequence
  SiRNA target sequence
tagggaaaaatcagttaat

SEQ ID NO: 12336 - DNA, 19 bp, Artificial sequence
  SiRNA target sequence
agggaaaaatcagttaatt

SEQ ID NO: 12337 - DNA, 19 bp, Artificial sequence
  SiRNA target sequence
gggaaaaatcagttaatta

SEQ ID NO: 12338 - DNA, 19 bp, Artificial sequence
  SiRNA target sequence
ggaaaaatcagttaattat

SEQ ID NO: 12339 - DNA, 19 bp, Artificial sequence
  SiRNA target sequence
gaaaaatcagttaattatg

SEQ ID NO: 12340 - DNA, 19 bp, Artificial sequence
  SiRNA target sequence
aaaaatcagttaattatgg

SEQ ID NO: 12341 - DNA, 19 bp, Artificial sequence
  SiRNA target sequence
aaaatcagttaattatgga

SEQ ID NO: 12342 - DNA, 19 bp, Artificial sequence
  SiRNA target sequence
aaatcagttaattatggat

SEQ ID NO: 12343 - DNA, 19 bp, Artificial sequence
  SiRNA target sequence
aatcagttaattatggatt

SEQ ID NO: 12344 - DNA, 19 bp, Artificial sequence
  SiRNA target sequence
atcagttaattatggatta

SEQ ID NO: 12345 - DNA, 19 bp, Artificial sequence
  SiRNA target sequence
tcagttaattatggattag

SEQ ID NO: 12346 - DNA, 19 bp, Artificial sequence
  SiRNA target sequence
cagttaattatggattagg

SEQ ID NO: 12347 - DNA, 19 bp, Artificial sequence
  SiRNA target sequence
agttaattatggattagga

SEQ ID NO: 12348 - DNA, 19 bp, Artificial sequence
  SiRNA target sequence
gttaattatggattaggag

SEQ ID NO: 12349 - DNA, 19 bp, Artificial sequence
  SiRNA target sequence
ttaattatggattaggagt

SEQ ID NO: 12350 - DNA, 19 bp, Artificial sequence
  SiRNA target sequence
taattatggattaggagtt

SEQ ID NO: 12351 - DNA, 19 bp, Artificial sequence
  SiRNA target sequence
aattatggattaggagtta

SEQ ID NO: 12352 - DNA, 19 bp, Artificial sequence
  SiRNA target sequence
attatggattaggagttaa

SEQ ID NO: 12353 - DNA, 19 bp, Artificial sequence
  SiRNA target sequence
ttatggattaggagttaaa

SEQ ID NO: 12354 - DNA, 19 bp, Artificial sequence
  SiRNA target sequence
tatggattaggagttaaac

SEQ ID NO: 12355 - DNA, 19 bp, Artificial sequence
  SiRNA target sequence
atggattaggagttaaact

SEQ ID NO: 12356 - DNA, 19 bp, Artificial sequence
  SiRNA target sequence
tggattaggagttaaacta

SEQ ID NO: 12357 - DNA, 19 bp, Artificial sequence
  SiRNA target sequence
ggattaggagttaaactac

SEQ ID NO: 12358 - DNA, 19 bp, Artificial sequence
  SiRNA target sequence
gattaggagttaaactaca

SEQ ID NO: 12359 - DNA, 19 bp, Artificial sequence
  SiRNA target sequence
attaggagttaaactacac

SEQ ID NO: 12360 - DNA, 19 bp, Artificial sequence
  SiRNA target sequence
ttaggagttaaactacaca

SEQ ID NO: 12361 - DNA, 19 bp, Artificial sequence
  SiRNA target sequence
taggagttaaactacacag

SEQ ID NO: 12362 - DNA, 19 bp, Artificial sequence
  SiRNA target sequence
aggagttaaactacacagt

SEQ ID NO: 12363 - DNA, 19 bp, Artificial sequence
  SiRNA target sequence
ggagttaaactacacagta

SEQ ID NO: 12364 - DNA, 19 bp, Artificial sequence
  SiRNA target sequence
gagttaaactacacagtaa

SEQ ID NO: 12365 - DNA, 19 bp, Artificial sequence
  SiRNA target sequence
agttaaactacacagtaaa

SEQ ID NO: 12366 - DNA, 19 bp, Artificial sequence
  SiRNA target sequence
gttaaactacacagtaaaa

SEQ ID NO: 12367 - DNA, 19 bp, Artificial sequence
  SiRNA target sequence
ttaaactacacagtaaaaa

SEQ ID NO: 12368 - DNA, 19 bp, Artificial sequence
  SiRNA target sequence
taaactacacagtaaaaaa

SEQ ID NO: 12369 - DNA, 19 bp, Artificial sequence
  SiRNA target sequence
aaactacacagtaaaaaag

SEQ ID NO: 12370 - DNA, 19 bp, Artificial sequence
  SiRNA target sequence
aactacacagtaaaaaagg

SEQ ID NO: 12371 - DNA, 19 bp, Artificial sequence
  SiRNA target sequence
actacacagtaaaaaagga

SEQ ID NO: 12372 - DNA, 19 bp, Artificial sequence
  SiRNA target sequence
ctacacagtaaaaaaggag

SEQ ID NO: 12373 - DNA, 19 bp, Artificial sequence
  SiRNA target sequence
tacacagtaaaaaaggaga

SEQ ID NO: 12374 - DNA, 19 bp, Artificial sequence
  SiRNA target sequence
acacagtaaaaaaggagaa

SEQ ID NO: 12375 - DNA, 19 bp, Artificial sequence
  SiRNA target sequence
cacagtaaaaaaggagaaa

SEQ ID NO: 12376 - DNA, 19 bp, Artificial sequence
  SiRNA target sequence
acagtaaaaaaggagaaat

SEQ ID NO: 12377 - DNA, 19 bp, Artificial sequence
  SiRNA target sequence
cagtaaaaaaggagaaatt

SEQ ID NO: 12378 - DNA, 19 bp, Artificial sequence
  SiRNA target sequence
agtaaaaaaggagaaatta

SEQ ID NO: 12379 - DNA, 19 bp, Artificial sequence
  SiRNA target sequence
gtaaaaaaggagaaattat

SEQ ID NO: 12380 - DNA, 19 bp, Artificial sequence
  SiRNA target sequence
taaaaaaggagaaattatc

SEQ ID NO: 12381 - DNA, 19 bp, Artificial sequence
  SiRNA target sequence
aaaaaaggagaaattatcg

SEQ ID NO: 12382 - DNA, 19 bp, Artificial sequence
  SiRNA target sequence
aaaaaggagaaattatcgg

SEQ ID NO: 12383 - DNA, 19 bp, Artificial sequence
  SiRNA target sequence
aaaaggagaaattatcgga

SEQ ID NO: 12384 - DNA, 19 bp, Artificial sequence
  SiRNA target sequence
aaaggagaaattatcggat

SEQ ID NO: 12385 - DNA, 19 bp, Artificial sequence
  SiRNA target sequence
aaggagaaattatcggatg

SEQ ID NO: 12386 - DNA, 19 bp, Artificial sequence
  SiRNA target sequence
aggagaaattatcggatgt

SEQ ID NO: 12387 - DNA, 19 bp, Artificial sequence
  SiRNA target sequence
ggagaaattatcggatgtg

SEQ ID NO: 12388 - DNA, 19 bp, Artificial sequence
  SiRNA target sequence
gagaaattatcggatgtgt

SEQ ID NO: 12389 - DNA, 19 bp, Artificial sequence
  SiRNA target sequence
agaaattatcggatgtgta

SEQ ID NO: 12390 - DNA, 19 bp, Artificial sequence
  SiRNA target sequence
gaaattatcggatgtgtag

SEQ ID NO: 12391 - DNA, 19 bp, Artificial sequence
  SiRNA target sequence
aaattatcggatgtgtaga

SEQ ID NO: 12392 - DNA, 19 bp, Artificial sequence
  SiRNA target sequence
aattatcggatgtgtagat

SEQ ID NO: 12393 - DNA, 19 bp, Artificial sequence
  SiRNA target sequence
attatcggatgtgtagata

SEQ ID NO: 12394 - DNA, 19 bp, Artificial sequence
  SiRNA target sequence
ttatcggatgtgtagataa

SEQ ID NO: 12395 - DNA, 19 bp, Artificial sequence
  SiRNA target sequence
tatcggatgtgtagataac

SEQ ID NO: 12396 - DNA, 19 bp, Artificial sequence
  SiRNA target sequence
atcggatgtgtagataaca

SEQ ID NO: 12397 - DNA, 19 bp, Artificial sequence
  SiRNA target sequence
tcggatgtgtagataacaa

SEQ ID NO: 12398 - DNA, 19 bp, Artificial sequence
  SiRNA target sequence
cggatgtgtagataacaat

SEQ ID NO: 12399 - DNA, 19 bp, Artificial sequence
  SiRNA target sequence
ggatgtgtagataacaatc

SEQ ID NO: 12400 - DNA, 19 bp, Artificial sequence
  SiRNA target sequence
gatgtgtagataacaatca

SEQ ID NO: 12401 - DNA, 19 bp, Artificial sequence
  SiRNA target sequence
atgtgtagataacaatcat

SEQ ID NO: 12402 - DNA, 19 bp, Artificial sequence
  SiRNA target sequence
tgtgtagataacaatcata

SEQ ID NO: 12403 - DNA, 19 bp, Artificial sequence
  SiRNA target sequence
gtgtagataacaatcatat

SEQ ID NO: 12404 - DNA, 19 bp, Artificial sequence
  SiRNA target sequence
tgtagataacaatcatatt

SEQ ID NO: 12405 - DNA, 19 bp, Artificial sequence
  SiRNA target sequence
gtagataacaatcatattt

SEQ ID NO: 12406 - DNA, 19 bp, Artificial sequence
  SiRNA target sequence
tagataacaatcatatttt

SEQ ID NO: 12407 - DNA, 19 bp, Artificial sequence
  SiRNA target sequence
agataacaatcatatttta

SEQ ID NO: 12408 - DNA, 19 bp, Artificial sequence
  SiRNA target sequence
gataacaatcatattttaa

SEQ ID NO: 12409 - DNA, 19 bp, Artificial sequence
  SiRNA target sequence
ataacaatcatattttaag

SEQ ID NO: 12410 - DNA, 19 bp, Artificial sequence
  SiRNA target sequence
taacaatcatattttaagc

SEQ ID NO: 12411 - DNA, 19 bp, Artificial sequence
  SiRNA target sequence
aacaatcatattttaagca

SEQ ID NO: 12412 - DNA, 19 bp, Artificial sequence
  SiRNA target sequence
acaatcatattttaagcat

SEQ ID NO: 12413 - DNA, 19 bp, Artificial sequence
  SiRNA target sequence
caatcatattttaagcata

SEQ ID NO: 12414 - DNA, 19 bp, Artificial sequence
  SiRNA target sequence
aatcatattttaagcataa

SEQ ID NO: 12415 - DNA, 19 bp, Artificial sequence
  SiRNA target sequence
atcatattttaagcataat

SEQ ID NO: 12416 - DNA, 19 bp, Artificial sequence
  SiRNA target sequence
tcatattttaagcataatt

SEQ ID NO: 12417 - DNA, 19 bp, Artificial sequence
  SiRNA target sequence
catattttaagcataattt

SEQ ID NO: 12418 - DNA, 19 bp, Artificial sequence
  SiRNA target sequence
atattttaagcataattta

SEQ ID NO: 12419 - DNA, 19 bp, Artificial sequence
  SiRNA target sequence
tattttaagcataatttat

SEQ ID NO: 12420 - DNA, 19 bp, Artificial sequence
  SiRNA target sequence
attttaagcataatttata

SEQ ID NO: 12421 - DNA, 19 bp, Artificial sequence
  SiRNA target sequence
ttttaagcataatttataa

SEQ ID NO: 12422 - DNA, 19 bp, Artificial sequence
  SiRNA target sequence
tttaagcataatttataat

SEQ ID NO: 12423 - DNA, 19 bp, Artificial sequence
  SiRNA target sequence
ttaagcataatttataatg

SEQ ID NO: 12424 - DNA, 19 bp, Artificial sequence
  SiRNA target sequence
taagcataatttataatga

SEQ ID NO: 12425 - DNA, 19 bp, Artificial sequence
  SiRNA target sequence
aagcataatttataatgat

SEQ ID NO: 12426 - DNA, 19 bp, Artificial sequence
  SiRNA target sequence
agcataatttataatgata

SEQ ID NO: 12427 - DNA, 19 bp, Artificial sequence
  SiRNA target sequence
gcataatttataatgataa

SEQ ID NO: 12428 - DNA, 19 bp, Artificial sequence
  SiRNA target sequence
cataatttataatgataaa

SEQ ID NO: 12429 - DNA, 19 bp, Artificial sequence
  SiRNA target sequence
ataatttataatgataaat

SEQ ID NO: 12430 - DNA, 19 bp, Artificial sequence
  SiRNA target sequence
taatttataatgataaatt

SEQ ID NO: 12431 - DNA, 19 bp, Artificial sequence
  SiRNA target sequence
aatttataatgataaatta

SEQ ID NO: 12432 - DNA, 19 bp, Artificial sequence
  SiRNA target sequence
atttataatgataaattat

SEQ ID NO: 12433 - DNA, 19 bp, Artificial sequence
  SiRNA target sequence
tttataatgataaattatc

SEQ ID NO: 12434 - DNA, 19 bp, Artificial sequence
  SiRNA target sequence
ttataatgataaattatct

SEQ ID NO: 12435 - DNA, 19 bp, Artificial sequence
  SiRNA target sequence
tataatgataaattatctg

SEQ ID NO: 12436 - DNA, 19 bp, Artificial sequence
  SiRNA target sequence
ataatgataaattatctga

SEQ ID NO: 12437 - DNA, 19 bp, Artificial sequence
  SiRNA target sequence
taatgataaattatctgaa

SEQ ID NO: 12438 - DNA, 19 bp, Artificial sequence
  SiRNA target sequence
aatgataaattatctgaag

SEQ ID NO: 12439 - DNA, 19 bp, Artificial sequence
  SiRNA target sequence
atgataaattatctgaagg

SEQ ID NO: 12440 - DNA, 19 bp, Artificial sequence
  SiRNA target sequence
tgataaattatctgaaggg

SEQ ID NO: 12441 - DNA, 19 bp, Artificial sequence
  SiRNA target sequence
gataaattatctgaagggt

SEQ ID NO: 12442 - DNA, 19 bp, Artificial sequence
  SiRNA target sequence
ataaattatctgaagggtt

SEQ ID NO: 12443 - DNA, 19 bp, Artificial sequence
  SiRNA target sequence
taaattatctgaagggtta

SEQ ID NO: 12444 - DNA, 19 bp, Artificial sequence
  SiRNA target sequence
aaattatctgaagggttaa

SEQ ID NO: 12445 - DNA, 19 bp, Artificial sequence
  SiRNA target sequence
aattatctgaagggttaac

SEQ ID NO: 12446 - DNA, 19 bp, Artificial sequence
  SiRNA target sequence
attatctgaagggttaaca

SEQ ID NO: 12447 - DNA, 19 bp, Artificial sequence
  SiRNA target sequence
ttatctgaagggttaacac

SEQ ID NO: 12448 - DNA, 19 bp, Artificial sequence
  SiRNA target sequence
tatctgaagggttaacact

SEQ ID NO: 12449 - DNA, 19 bp, Artificial sequence
  SiRNA target sequence
atctgaagggttaacactt

SEQ ID NO: 12450 - DNA, 19 bp, Artificial sequence
  SiRNA target sequence
tctgaagggttaacactta

SEQ ID NO: 12451 - DNA, 19 bp, Artificial sequence
  SiRNA target sequence
ctgaagggttaacacttaa

SEQ ID NO: 12452 - DNA, 19 bp, Artificial sequence
  SiRNA target sequence
tgaagggttaacacttaat

SEQ ID NO: 12453 - DNA, 19 bp, Artificial sequence
  SiRNA target sequence
gaagggttaacacttaatt

SEQ ID NO: 12454 - DNA, 19 bp, Artificial sequence
  SiRNA target sequence
aagggttaacacttaattt

SEQ ID NO: 12455 - DNA, 19 bp, Artificial sequence
  SiRNA target sequence
agggttaacacttaatttg

SEQ ID NO: 12456 - DNA, 19 bp, Artificial sequence
  SiRNA target sequence
gggttaacacttaatttga

SEQ ID NO: 12457 - DNA, 19 bp, Artificial sequence
  SiRNA target sequence
ggttaacacttaatttgag

SEQ ID NO: 12458 - DNA, 19 bp, Artificial sequence
  SiRNA target sequence
gttaacacttaatttgagt

SEQ ID NO: 12459 - DNA, 19 bp, Artificial sequence
  SiRNA target sequence
ttaacacttaatttgagtt

SEQ ID NO: 12460 - DNA, 19 bp, Artificial sequence
  SiRNA target sequence
taacacttaatttgagttg

SEQ ID NO: 12461 - DNA, 19 bp, Artificial sequence
  SiRNA target sequence
aacacttaatttgagttgt

SEQ ID NO: 12462 - DNA, 19 bp, Artificial sequence
  SiRNA target sequence
acacttaatttgagttgta

SEQ ID NO: 12463 - DNA, 19 bp, Artificial sequence
  SiRNA target sequence
cacttaatttgagttgtag

SEQ ID NO: 12464 - DNA, 19 bp, Artificial sequence
  SiRNA target sequence
acttaatttgagttgtaga

SEQ ID NO: 12465 - DNA, 19 bp, Artificial sequence
  SiRNA target sequence
cttaatttgagttgtagat

SEQ ID NO: 12466 - DNA, 19 bp, Artificial sequence
  SiRNA target sequence
ttaatttgagttgtagatt

SEQ ID NO: 12467 - DNA, 19 bp, Artificial sequence
  SiRNA target sequence
taatttgagttgtagattt

SEQ ID NO: 12468 - DNA, 19 bp, Artificial sequence
  SiRNA target sequence
aatttgagttgtagatttg

SEQ ID NO: 12469 - DNA, 19 bp, Artificial sequence
  SiRNA target sequence
atttgagttgtagatttgg

SEQ ID NO: 12470 - DNA, 19 bp, Artificial sequence
  SiRNA target sequence
tttgagttgtagatttggt

SEQ ID NO: 12471 - DNA, 19 bp, Artificial sequence
  SiRNA target sequence
ttgagttgtagatttggta

SEQ ID NO: 12472 - DNA, 19 bp, Artificial sequence
  SiRNA target sequence
tgagttgtagatttggtaa

SEQ ID NO: 12473 - DNA, 19 bp, Artificial sequence
  SiRNA target sequence
gagttgtagatttggtaag

SEQ ID NO: 12474 - DNA, 19 bp, Artificial sequence
  SiRNA target sequence
agttgtagatttggtaaga

SEQ ID NO: 12475 - DNA, 19 bp, Artificial sequence
  SiRNA target sequence
gttgtagatttggtaagaa

SEQ ID NO: 12476 - DNA, 19 bp, Artificial sequence
  SiRNA target sequence
ttgtagatttggtaagaaa

SEQ ID NO: 12477 - DNA, 19 bp, Artificial sequence
  SiRNA target sequence
tgtagatttggtaagaaag

SEQ ID NO: 12478 - DNA, 19 bp, Artificial sequence
  SiRNA target sequence
gtagatttggtaagaaagt

SEQ ID NO: 12479 - DNA, 19 bp, Artificial sequence
  SiRNA target sequence
tagatttggtaagaaagta

SEQ ID NO: 12480 - DNA, 19 bp, Artificial sequence
  SiRNA target sequence
agatttggtaagaaagtat

SEQ ID NO: 12481 - DNA, 19 bp, Artificial sequence
  SiRNA target sequence
gatttggtaagaaagtatt

SEQ ID NO: 12482 - DNA, 19 bp, Artificial sequence
  SiRNA target sequence
atttggtaagaaagtattt

SEQ ID NO: 12483 - DNA, 19 bp, Artificial sequence
  SiRNA target sequence
tttggtaagaaagtatttg

SEQ ID NO: 12484 - DNA, 19 bp, Artificial sequence
  SiRNA target sequence
ttggtaagaaagtatttga

SEQ ID NO: 12485 - DNA, 19 bp, Artificial sequence
  SiRNA target sequence
tggtaagaaagtatttgat

SEQ ID NO: 12486 - DNA, 19 bp, Artificial sequence
  SiRNA target sequence
ggtaagaaagtatttgatt

SEQ ID NO: 12487 - DNA, 19 bp, Artificial sequence
  SiRNA target sequence
gtaagaaagtatttgatta

SEQ ID NO: 12488 - DNA, 19 bp, Artificial sequence
  SiRNA target sequence
taagaaagtatttgattat

SEQ ID NO: 12489 - DNA, 19 bp, Artificial sequence
  SiRNA target sequence
aagaaagtatttgattatg

SEQ ID NO: 12490 - DNA, 19 bp, Artificial sequence
  SiRNA target sequence
agaaagtatttgattatgg

SEQ ID NO: 12491 - DNA, 19 bp, Artificial sequence
  SiRNA target sequence
gaaagtatttgattatggc

SEQ ID NO: 12492 - DNA, 19 bp, Artificial sequence
  SiRNA target sequence
aaagtatttgattatggct

SEQ ID NO: 12493 - DNA, 19 bp, Artificial sequence
  SiRNA target sequence
aagtatttgattatggcta

SEQ ID NO: 12494 - DNA, 19 bp, Artificial sequence
  SiRNA target sequence
agtatttgattatggctat

SEQ ID NO: 12495 - DNA, 19 bp, Artificial sequence
  SiRNA target sequence
gtatttgattatggctatg

SEQ ID NO: 12496 - DNA, 19 bp, Artificial sequence
  SiRNA target sequence
tatttgattatggctatgg

SEQ ID NO: 12497 - DNA, 19 bp, Artificial sequence
  SiRNA target sequence
atttgattatggctatggg

SEQ ID NO: 12498 - DNA, 19 bp, Artificial sequence
  SiRNA target sequence
tttgattatggctatgggt

SEQ ID NO: 12499 - DNA, 19 bp, Artificial sequence
  SiRNA target sequence
ttgattatggctatgggtt

SEQ ID NO: 12500 - DNA, 19 bp, Artificial sequence
  SiRNA target sequence
tgattatggctatgggttt

SEQ ID NO: 12501 - DNA, 19 bp, Artificial sequence
  SiRNA target sequence
gattatggctatgggttta

SEQ ID NO: 12502 - DNA, 19 bp, Artificial sequence
  SiRNA target sequence
attatggctatgggtttat

SEQ ID NO: 12503 - DNA, 19 bp, Artificial sequence
  SiRNA target sequence
ttatggctatgggtttatt

SEQ ID NO: 12504 - DNA, 19 bp, Artificial sequence
  SiRNA target sequence
tatggctatgggtttattt

SEQ ID NO: 12505 - DNA, 19 bp, Artificial sequence
  SiRNA target sequence
atggctatgggtttattta

SEQ ID NO: 12506 - DNA, 19 bp, Artificial sequence
  SiRNA target sequence
tggctatgggtttatttat

SEQ ID NO: 12507 - DNA, 19 bp, Artificial sequence
  SiRNA target sequence
ggctatgggtttatttatg

SEQ ID NO: 12508 - DNA, 19 bp, Artificial sequence
  SiRNA target sequence
gctatgggtttatttatga

SEQ ID NO: 12509 - DNA, 19 bp, Artificial sequence
  SiRNA target sequence
ctatgggtttatttatgaa

SEQ ID NO: 12510 - DNA, 19 bp, Artificial sequence
  SiRNA target sequence
tatgggtttatttatgaat

SEQ ID NO: 12511 - DNA, 19 bp, Artificial sequence
  SiRNA target sequence
atgggtttatttatgaatt

SEQ ID NO: 12512 - DNA, 19 bp, Artificial sequence
  SiRNA target sequence
tgggtttatttatgaattt

SEQ ID NO: 12513 - DNA, 19 bp, Artificial sequence
  SiRNA target sequence
gggtttatttatgaatttt

SEQ ID NO: 12514 - DNA, 19 bp, Artificial sequence
  SiRNA target sequence
ggtttatttatgaatttta

SEQ ID NO: 12515 - DNA, 19 bp, Artificial sequence
  SiRNA target sequence
gtttatttatgaattttaa

SEQ ID NO: 12516 - DNA, 20 bp, Artificial sequence
  SiRNA target sequence
atgaaatctttctacaaaaa

SEQ ID NO: 12517 - DNA, 20 bp, Artificial sequence
  SiRNA target sequence
tgaaatctttctacaaaaaa

SEQ ID NO: 12518 - DNA, 20 bp, Artificial sequence
  SiRNA target sequence
gaaatctttctacaaaaaaa

SEQ ID NO: 12519 - DNA, 20 bp, Artificial sequence
  SiRNA target sequence
aaatctttctacaaaaaaat

SEQ ID NO: 12520 - DNA, 20 bp, Artificial sequence
  SiRNA target sequence
aatctttctacaaaaaaata

SEQ ID NO: 12521 - DNA, 20 bp, Artificial sequence
  SiRNA target sequence
atctttctacaaaaaaataa

SEQ ID NO: 12522 - DNA, 20 bp, Artificial sequence
  SiRNA target sequence
tctttctacaaaaaaataaa

SEQ ID NO: 12523 - DNA, 20 bp, Artificial sequence
  SiRNA target sequence
ctttctacaaaaaaataaaa

SEQ ID NO: 12524 - DNA, 20 bp, Artificial sequence
  SiRNA target sequence
tttctacaaaaaaataaaaa

SEQ ID NO: 12525 - DNA, 20 bp, Artificial sequence
  SiRNA target sequence
ttctacaaaaaaataaaaag

SEQ ID NO: 12526 - DNA, 20 bp, Artificial sequence
  SiRNA target sequence
tctacaaaaaaataaaaagt

SEQ ID NO: 12527 - DNA, 20 bp, Artificial sequence
  SiRNA target sequence
ctacaaaaaaataaaaagtt

SEQ ID NO: 12528 - DNA, 20 bp, Artificial sequence
  SiRNA target sequence
tacaaaaaaataaaaagtta

SEQ ID NO: 12529 - DNA, 20 bp, Artificial sequence
  SiRNA target sequence
acaaaaaaataaaaagttat

SEQ ID NO: 12530 - DNA, 20 bp, Artificial sequence
  SiRNA target sequence
caaaaaaataaaaagttatt

SEQ ID NO: 12531 - DNA, 20 bp, Artificial sequence
  SiRNA target sequence
aaaaaaataaaaagttattt

SEQ ID NO: 12532 - DNA, 20 bp, Artificial sequence
  SiRNA target sequence
aaaaaataaaaagttattta

SEQ ID NO: 12533 - DNA, 20 bp, Artificial sequence
  SiRNA target sequence
aaaaataaaaagttatttat

SEQ ID NO: 12534 - DNA, 20 bp, Artificial sequence
  SiRNA target sequence
aaaataaaaagttatttatt

SEQ ID NO: 12535 - DNA, 20 bp, Artificial sequence
  SiRNA target sequence
aaataaaaagttatttattc

SEQ ID NO: 12536 - DNA, 20 bp, Artificial sequence
  SiRNA target sequence
aataaaaagttatttattca

SEQ ID NO: 12537 - DNA, 20 bp, Artificial sequence
  SiRNA target sequence
ataaaaagttatttattcaa

SEQ ID NO: 12538 - DNA, 20 bp, Artificial sequence
  SiRNA target sequence
taaaaagttatttattcaaa

SEQ ID NO: 12539 - DNA, 20 bp, Artificial sequence
  SiRNA target sequence
aaaaagttatttattcaaat

SEQ ID NO: 12540 - DNA, 20 bp, Artificial sequence
  SiRNA target sequence
aaaagttatttattcaaatc

SEQ ID NO: 12541 - DNA, 20 bp, Artificial sequence
  SiRNA target sequence
aaagttatttattcaaatct

SEQ ID NO: 12542 - DNA, 20 bp, Artificial sequence
  SiRNA target sequence
aagttatttattcaaatctg

SEQ ID NO: 12543 - DNA, 20 bp, Artificial sequence
  SiRNA target sequence
agttatttattcaaatctgc

SEQ ID NO: 12544 - DNA, 20 bp, Artificial sequence
  SiRNA target sequence
gttatttattcaaatctgcc

SEQ ID NO: 12545 - DNA, 20 bp, Artificial sequence
  SiRNA target sequence
ttatttattcaaatctgcca

SEQ ID NO: 12546 - DNA, 20 bp, Artificial sequence
  SiRNA target sequence
tatttattcaaatctgccat

SEQ ID NO: 12547 - DNA, 20 bp, Artificial sequence
  SiRNA target sequence
atttattcaaatctgccatt

SEQ ID NO: 12548 - DNA, 20 bp, Artificial sequence
  SiRNA target sequence
tttattcaaatctgccatta

SEQ ID NO: 12549 - DNA, 20 bp, Artificial sequence
  SiRNA target sequence
ttattcaaatctgccattaa

SEQ ID NO: 12550 - DNA, 20 bp, Artificial sequence
  SiRNA target sequence
tattcaaatctgccattaat

SEQ ID NO: 12551 - DNA, 20 bp, Artificial sequence
  SiRNA target sequence
attcaaatctgccattaata

SEQ ID NO: 12552 - DNA, 20 bp, Artificial sequence
  SiRNA target sequence
ttcaaatctgccattaatac

SEQ ID NO: 12553 - DNA, 20 bp, Artificial sequence
  SiRNA target sequence
tcaaatctgccattaataca

SEQ ID NO: 12554 - DNA, 20 bp, Artificial sequence
  SiRNA target sequence
caaatctgccattaatacat

SEQ ID NO: 12555 - DNA, 20 bp, Artificial sequence
  SiRNA target sequence
aaatctgccattaatacatc

SEQ ID NO: 12556 - DNA, 20 bp, Artificial sequence
  SiRNA target sequence
aatctgccattaatacatct

SEQ ID NO: 12557 - DNA, 20 bp, Artificial sequence
  SiRNA target sequence
atctgccattaatacatctt

SEQ ID NO: 12558 - DNA, 20 bp, Artificial sequence
  SiRNA target sequence
tctgccattaatacatcttt

SEQ ID NO: 12559 - DNA, 20 bp, Artificial sequence
  SiRNA target sequence
ctgccattaatacatctttt

SEQ ID NO: 12560 - DNA, 20 bp, Artificial sequence
  SiRNA target sequence
tgccattaatacatcttttg

SEQ ID NO: 12561 - DNA, 20 bp, Artificial sequence
  SiRNA target sequence
gccattaatacatcttttga

SEQ ID NO: 12562 - DNA, 20 bp, Artificial sequence
  SiRNA target sequence
ccattaatacatcttttgat

SEQ ID NO: 12563 - DNA, 20 bp, Artificial sequence
  SiRNA target sequence
cattaatacatcttttgata

SEQ ID NO: 12564 - DNA, 20 bp, Artificial sequence
  SiRNA target sequence
attaatacatcttttgatac

SEQ ID NO: 12565 - DNA, 20 bp, Artificial sequence
  SiRNA target sequence
ttaatacatcttttgatact

SEQ ID NO: 12566 - DNA, 20 bp, Artificial sequence
  SiRNA target sequence
taatacatcttttgatactt

SEQ ID NO: 12567 - DNA, 20 bp, Artificial sequence
  SiRNA target sequence
aatacatcttttgatacttt

SEQ ID NO: 12568 - DNA, 20 bp, Artificial sequence
  SiRNA target sequence
atacatcttttgatactttt

SEQ ID NO: 12569 - DNA, 20 bp, Artificial sequence
  SiRNA target sequence
tacatcttttgatactttta

SEQ ID NO: 12570 - DNA, 20 bp, Artificial sequence
  SiRNA target sequence
acatcttttgatacttttaa

SEQ ID NO: 12571 - DNA, 20 bp, Artificial sequence
  SiRNA target sequence
catcttttgatacttttaat

SEQ ID NO: 12572 - DNA, 20 bp, Artificial sequence
  SiRNA target sequence
atcttttgatacttttaatt

SEQ ID NO: 12573 - DNA, 20 bp, Artificial sequence
  SiRNA target sequence
tcttttgatacttttaattt

SEQ ID NO: 12574 - DNA, 20 bp, Artificial sequence
  SiRNA target sequence
cttttgatacttttaattta

SEQ ID NO: 12575 - DNA, 20 bp, Artificial sequence
  SiRNA target sequence
ttttgatacttttaatttag

SEQ ID NO: 12576 - DNA, 20 bp, Artificial sequence
  SiRNA target sequence
tttgatacttttaatttaga

SEQ ID NO: 12577 - DNA, 20 bp, Artificial sequence
  SiRNA target sequence
ttgatacttttaatttagaa

SEQ ID NO: 12578 - DNA, 20 bp, Artificial sequence
  SiRNA target sequence
tgatacttttaatttagaaa

SEQ ID NO: 12579 - DNA, 20 bp, Artificial sequence
  SiRNA target sequence
gatacttttaatttagaaaa

SEQ ID NO: 12580 - DNA, 20 bp, Artificial sequence
  SiRNA target sequence
atacttttaatttagaaaat

SEQ ID NO: 12581 - DNA, 20 bp, Artificial sequence
  SiRNA target sequence
tacttttaatttagaaaatg

SEQ ID NO: 12582 - DNA, 20 bp, Artificial sequence
  SiRNA target sequence
acttttaatttagaaaatgt

SEQ ID NO: 12583 - DNA, 20 bp, Artificial sequence
  SiRNA target sequence
cttttaatttagaaaatgta

SEQ ID NO: 12584 - DNA, 20 bp, Artificial sequence
  SiRNA target sequence
ttttaatttagaaaatgtaa

SEQ ID NO: 12585 - DNA, 20 bp, Artificial sequence
  SiRNA target sequence
tttaatttagaaaatgtaag

SEQ ID NO: 12586 - DNA, 20 bp, Artificial sequence
  SiRNA target sequence
ttaatttagaaaatgtaagc

SEQ ID NO: 12587 - DNA, 20 bp, Artificial sequence
  SiRNA target sequence
taatttagaaaatgtaagca

SEQ ID NO: 12588 - DNA, 20 bp, Artificial sequence
  SiRNA target sequence
aatttagaaaatgtaagcat

SEQ ID NO: 12589 - DNA, 20 bp, Artificial sequence
  SiRNA target sequence
atttagaaaatgtaagcatt

SEQ ID NO: 12590 - DNA, 20 bp, Artificial sequence
  SiRNA target sequence
tttagaaaatgtaagcatta

SEQ ID NO: 12591 - DNA, 20 bp, Artificial sequence
  SiRNA target sequence
ttagaaaatgtaagcattac

SEQ ID NO: 12592 - DNA, 20 bp, Artificial sequence
  SiRNA target sequence
tagaaaatgtaagcattact

SEQ ID NO: 12593 - DNA, 20 bp, Artificial sequence
  SiRNA target sequence
agaaaatgtaagcattacta

SEQ ID NO: 12594 - DNA, 20 bp, Artificial sequence
  SiRNA target sequence
gaaaatgtaagcattactag

SEQ ID NO: 12595 - DNA, 20 bp, Artificial sequence
  SiRNA target sequence
aaaatgtaagcattactagc

SEQ ID NO: 12596 - DNA, 20 bp, Artificial sequence
  SiRNA target sequence
aaatgtaagcattactagct

SEQ ID NO: 12597 - DNA, 20 bp, Artificial sequence
  SiRNA target sequence
aatgtaagcattactagctt

SEQ ID NO: 12598 - DNA, 20 bp, Artificial sequence
  SiRNA target sequence
atgtaagcattactagctta

SEQ ID NO: 12599 - DNA, 20 bp, Artificial sequence
  SiRNA target sequence
tgtaagcattactagcttaa

SEQ ID NO: 12600 - DNA, 20 bp, Artificial sequence
  SiRNA target sequence
gtaagcattactagcttaaa

SEQ ID NO: 12601 - DNA, 20 bp, Artificial sequence
  SiRNA target sequence
taagcattactagcttaaat

SEQ ID NO: 12602 - DNA, 20 bp, Artificial sequence
  SiRNA target sequence
aagcattactagcttaaata

SEQ ID NO: 12603 - DNA, 20 bp, Artificial sequence
  SiRNA target sequence
agcattactagcttaaatac

SEQ ID NO: 12604 - DNA, 20 bp, Artificial sequence
  SiRNA target sequence
gcattactagcttaaatacg

SEQ ID NO: 12605 - DNA, 20 bp, Artificial sequence
  SiRNA target sequence
cattactagcttaaatacgt

SEQ ID NO: 12606 - DNA, 20 bp, Artificial sequence
  SiRNA target sequence
attactagcttaaatacgta

SEQ ID NO: 12607 - DNA, 20 bp, Artificial sequence
  SiRNA target sequence
ttactagcttaaatacgtac

SEQ ID NO: 12608 - DNA, 20 bp, Artificial sequence
  SiRNA target sequence
tactagcttaaatacgtaca

SEQ ID NO: 12609 - DNA, 20 bp, Artificial sequence
  SiRNA target sequence
actagcttaaatacgtacac

SEQ ID NO: 12610 - DNA, 20 bp, Artificial sequence
  SiRNA target sequence
ctagcttaaatacgtacacc

SEQ ID NO: 12611 - DNA, 20 bp, Artificial sequence
  SiRNA target sequence
tagcttaaatacgtacaccg

SEQ ID NO: 12612 - DNA, 20 bp, Artificial sequence
  SiRNA target sequence
agcttaaatacgtacaccgg

SEQ ID NO: 12613 - DNA, 20 bp, Artificial sequence
  SiRNA target sequence
gcttaaatacgtacaccggt

SEQ ID NO: 12614 - DNA, 20 bp, Artificial sequence
  SiRNA target sequence
cttaaatacgtacaccggtg

SEQ ID NO: 12615 - DNA, 20 bp, Artificial sequence
  SiRNA target sequence
ttaaatacgtacaccggtgt

SEQ ID NO: 12616 - DNA, 20 bp, Artificial sequence
  SiRNA target sequence
taaatacgtacaccggtgtt

SEQ ID NO: 12617 - DNA, 20 bp, Artificial sequence
  SiRNA target sequence
aaatacgtacaccggtgtta

SEQ ID NO: 12618 - DNA, 20 bp, Artificial sequence
  SiRNA target sequence
aatacgtacaccggtgttaa

SEQ ID NO: 12619 - DNA, 20 bp, Artificial sequence
  SiRNA target sequence
atacgtacaccggtgttaaa

SEQ ID NO: 12620 - DNA, 20 bp, Artificial sequence
  SiRNA target sequence
tacgtacaccggtgttaaaa

SEQ ID NO: 12621 - DNA, 20 bp, Artificial sequence
  SiRNA target sequence
acgtacaccggtgttaaaac

SEQ ID NO: 12622 - DNA, 20 bp, Artificial sequence
  SiRNA target sequence
cgtacaccggtgttaaaacc

SEQ ID NO: 12623 - DNA, 20 bp, Artificial sequence
  SiRNA target sequence
gtacaccggtgttaaaaccg

SEQ ID NO: 12624 - DNA, 20 bp, Artificial sequence
  SiRNA target sequence
tacaccggtgttaaaaccga

SEQ ID NO: 12625 - DNA, 20 bp, Artificial sequence
  SiRNA target sequence
acaccggtgttaaaaccgaa

SEQ ID NO: 12626 - DNA, 20 bp, Artificial sequence
  SiRNA target sequence
caccggtgttaaaaccgaaa

SEQ ID NO: 12627 - DNA, 20 bp, Artificial sequence
  SiRNA target sequence
accggtgttaaaaccgaaat

SEQ ID NO: 12628 - DNA, 20 bp, Artificial sequence
  SiRNA target sequence
ccggtgttaaaaccgaaata

SEQ ID NO: 12629 - DNA, 20 bp, Artificial sequence
  SiRNA target sequence
cggtgttaaaaccgaaatat

SEQ ID NO: 12630 - DNA, 20 bp, Artificial sequence
  SiRNA target sequence
ggtgttaaaaccgaaatatc

SEQ ID NO: 12631 - DNA, 20 bp, Artificial sequence
  SiRNA target sequence
gtgttaaaaccgaaatatca

SEQ ID NO: 12632 - DNA, 20 bp, Artificial sequence
  SiRNA target sequence
tgttaaaaccgaaatatcaa

SEQ ID NO: 12633 - DNA, 20 bp, Artificial sequence
  SiRNA target sequence
gttaaaaccgaaatatcaaa

SEQ ID NO: 12634 - DNA, 20 bp, Artificial sequence
  SiRNA target sequence
ttaaaaccgaaatatcaaaa

SEQ ID NO: 12635 - DNA, 20 bp, Artificial sequence
  SiRNA target sequence
taaaaccgaaatatcaaaaa

SEQ ID NO: 12636 - DNA, 20 bp, Artificial sequence
  SiRNA target sequence
aaaaccgaaatatcaaaaac

SEQ ID NO: 12637 - DNA, 20 bp, Artificial sequence
  SiRNA target sequence
aaaccgaaatatcaaaaacc

SEQ ID NO: 12638 - DNA, 20 bp, Artificial sequence
  SiRNA target sequence
aaccgaaatatcaaaaaccg

SEQ ID NO: 12639 - DNA, 20 bp, Artificial sequence
  SiRNA target sequence
accgaaatatcaaaaaccgt

SEQ ID NO: 12640 - DNA, 20 bp, Artificial sequence
  SiRNA target sequence
ccgaaatatcaaaaaccgta

SEQ ID NO: 12641 - DNA, 20 bp, Artificial sequence
  SiRNA target sequence
cgaaatatcaaaaaccgtat

SEQ ID NO: 12642 - DNA, 20 bp, Artificial sequence
  SiRNA target sequence
gaaatatcaaaaaccgtatc

SEQ ID NO: 12643 - DNA, 20 bp, Artificial sequence
  SiRNA target sequence
aaatatcaaaaaccgtatca

SEQ ID NO: 12644 - DNA, 20 bp, Artificial sequence
  SiRNA target sequence
aatatcaaaaaccgtatcac

SEQ ID NO: 12645 - DNA, 20 bp, Artificial sequence
  SiRNA target sequence
atatcaaaaaccgtatcacc

SEQ ID NO: 12646 - DNA, 20 bp, Artificial sequence
  SiRNA target sequence
tatcaaaaaccgtatcacca

SEQ ID NO: 12647 - DNA, 20 bp, Artificial sequence
  SiRNA target sequence
atcaaaaaccgtatcaccac

SEQ ID NO: 12648 - DNA, 20 bp, Artificial sequence
  SiRNA target sequence
tcaaaaaccgtatcaccaca

SEQ ID NO: 12649 - DNA, 20 bp, Artificial sequence
  SiRNA target sequence
caaaaaccgtatcaccacac

SEQ ID NO: 12650 - DNA, 20 bp, Artificial sequence
  SiRNA target sequence
aaaaaccgtatcaccacact

SEQ ID NO: 12651 - DNA, 20 bp, Artificial sequence
  SiRNA target sequence
aaaaccgtatcaccacactt

SEQ ID NO: 12652 - DNA, 20 bp, Artificial sequence
  SiRNA target sequence
aaaccgtatcaccacacttc

SEQ ID NO: 12653 - DNA, 20 bp, Artificial sequence
  SiRNA target sequence
aaccgtatcaccacacttcc

SEQ ID NO: 12654 - DNA, 20 bp, Artificial sequence
  SiRNA target sequence
accgtatcaccacacttcca

SEQ ID NO: 12655 - DNA, 20 bp, Artificial sequence
  SiRNA target sequence
ccgtatcaccacacttccag

SEQ ID NO: 12656 - DNA, 20 bp, Artificial sequence
  SiRNA target sequence
cgtatcaccacacttccaga

SEQ ID NO: 12657 - DNA, 20 bp, Artificial sequence
  SiRNA target sequence
gtatcaccacacttccagat

SEQ ID NO: 12658 - DNA, 20 bp, Artificial sequence
  SiRNA target sequence
tatcaccacacttccagatt

SEQ ID NO: 12659 - DNA, 20 bp, Artificial sequence
  SiRNA target sequence
atcaccacacttccagattt

SEQ ID NO: 12660 - DNA, 20 bp, Artificial sequence
  SiRNA target sequence
tcaccacacttccagatttc

SEQ ID NO: 12661 - DNA, 20 bp, Artificial sequence
  SiRNA target sequence
caccacacttccagatttct

SEQ ID NO: 12662 - DNA, 20 bp, Artificial sequence
  SiRNA target sequence
accacacttccagatttctc

SEQ ID NO: 12663 - DNA, 20 bp, Artificial sequence
  SiRNA target sequence
ccacacttccagatttctca

SEQ ID NO: 12664 - DNA, 20 bp, Artificial sequence
  SiRNA target sequence
cacacttccagatttctcat

SEQ ID NO: 12665 - DNA, 20 bp, Artificial sequence
  SiRNA target sequence
acacttccagatttctcatg

SEQ ID NO: 12666 - DNA, 20 bp, Artificial sequence
  SiRNA target sequence
cacttccagatttctcatgt

SEQ ID NO: 12667 - DNA, 20 bp, Artificial sequence
  SiRNA target sequence
acttccagatttctcatgtc

SEQ ID NO: 12668 - DNA, 20 bp, Artificial sequence
  SiRNA target sequence
cttccagatttctcatgtct

SEQ ID NO: 12669 - DNA, 20 bp, Artificial sequence
  SiRNA target sequence
ttccagatttctcatgtctc

SEQ ID NO: 12670 - DNA, 20 bp, Artificial sequence
  SiRNA target sequence
tccagatttctcatgtctct

SEQ ID NO: 12671 - DNA, 20 bp, Artificial sequence
  SiRNA target sequence
ccagatttctcatgtctctt

SEQ ID NO: 12672 - DNA, 20 bp, Artificial sequence
  SiRNA target sequence
cagatttctcatgtctcttc

SEQ ID NO: 12673 - DNA, 20 bp, Artificial sequence
  SiRNA target sequence
agatttctcatgtctcttct

SEQ ID NO: 12674 - DNA, 20 bp, Artificial sequence
  SiRNA target sequence
gatttctcatgtctcttcta

SEQ ID NO: 12675 - DNA, 20 bp, Artificial sequence
  SiRNA target sequence
atttctcatgtctcttctat

SEQ ID NO: 12676 - DNA, 20 bp, Artificial sequence
  SiRNA target sequence
tttctcatgtctcttctatg

SEQ ID NO: 12677 - DNA, 20 bp, Artificial sequence
  SiRNA target sequence
ttctcatgtctcttctatgg

SEQ ID NO: 12678 - DNA, 20 bp, Artificial sequence
  SiRNA target sequence
tctcatgtctcttctatggg

SEQ ID NO: 12679 - DNA, 20 bp, Artificial sequence
  SiRNA target sequence
ctcatgtctcttctatgggc

SEQ ID NO: 12680 - DNA, 20 bp, Artificial sequence
  SiRNA target sequence
tcatgtctcttctatgggcg

SEQ ID NO: 12681 - DNA, 20 bp, Artificial sequence
  SiRNA target sequence
catgtctcttctatgggcgc

SEQ ID NO: 12682 - DNA, 20 bp, Artificial sequence
  SiRNA target sequence
atgtctcttctatgggcgca

SEQ ID NO: 12683 - DNA, 20 bp, Artificial sequence
  SiRNA target sequence
tgtctcttctatgggcgcag

SEQ ID NO: 12684 - DNA, 20 bp, Artificial sequence
  SiRNA target sequence
gtctcttctatgggcgcaga

SEQ ID NO: 12685 - DNA, 20 bp, Artificial sequence
  SiRNA target sequence
tctcttctatgggcgcagat

SEQ ID NO: 12686 - DNA, 20 bp, Artificial sequence
  SiRNA target sequence
ctcttctatgggcgcagatt

SEQ ID NO: 12687 - DNA, 20 bp, Artificial sequence
  SiRNA target sequence
tcttctatgggcgcagattt

SEQ ID NO: 12688 - DNA, 20 bp, Artificial sequence
  SiRNA target sequence
cttctatgggcgcagatttc

SEQ ID NO: 12689 - DNA, 20 bp, Artificial sequence
  SiRNA target sequence
ttctatgggcgcagatttcg

SEQ ID NO: 12690 - DNA, 20 bp, Artificial sequence
  SiRNA target sequence
tctatgggcgcagatttcga

SEQ ID NO: 12691 - DNA, 20 bp, Artificial sequence
  SiRNA target sequence
ctatgggcgcagatttcgac

SEQ ID NO: 12692 - DNA, 20 bp, Artificial sequence
  SiRNA target sequence
tatgggcgcagatttcgaca

SEQ ID NO: 12693 - DNA, 20 bp, Artificial sequence
  SiRNA target sequence
atgggcgcagatttcgacat

SEQ ID NO: 12694 - DNA, 20 bp, Artificial sequence
  SiRNA target sequence
tgggcgcagatttcgacata

SEQ ID NO: 12695 - DNA, 20 bp, Artificial sequence
  SiRNA target sequence
gggcgcagatttcgacataa

SEQ ID NO: 12696 - DNA, 20 bp, Artificial sequence
  SiRNA target sequence
ggcgcagatttcgacataaa

SEQ ID NO: 12697 - DNA, 20 bp, Artificial sequence
  SiRNA target sequence
gcgcagatttcgacataaaa

SEQ ID NO: 12698 - DNA, 20 bp, Artificial sequence
  SiRNA target sequence
cgcagatttcgacataaaac

SEQ ID NO: 12699 - DNA, 20 bp, Artificial sequence
  SiRNA target sequence
gcagatttcgacataaaaca

SEQ ID NO: 12700 - DNA, 20 bp, Artificial sequence
  SiRNA target sequence
cagatttcgacataaaacag

SEQ ID NO: 12701 - DNA, 20 bp, Artificial sequence
  SiRNA target sequence
agatttcgacataaaacaga

SEQ ID NO: 12702 - DNA, 20 bp, Artificial sequence
  SiRNA target sequence
gatttcgacataaaacagac

SEQ ID NO: 12703 - DNA, 20 bp, Artificial sequence
  SiRNA target sequence
atttcgacataaaacagaca

SEQ ID NO: 12704 - DNA, 20 bp, Artificial sequence
  SiRNA target sequence
tttcgacataaaacagacat

SEQ ID NO: 12705 - DNA, 20 bp, Artificial sequence
  SiRNA target sequence
ttcgacataaaacagacata

SEQ ID NO: 12706 - DNA, 20 bp, Artificial sequence
  SiRNA target sequence
tcgacataaaacagacatac

SEQ ID NO: 12707 - DNA, 20 bp, Artificial sequence
  SiRNA target sequence
cgacataaaacagacatacg

SEQ ID NO: 12708 - DNA, 20 bp, Artificial sequence
  SiRNA target sequence
gacataaaacagacatacgc

SEQ ID NO: 12709 - DNA, 20 bp, Artificial sequence
  SiRNA target sequence
acataaaacagacatacgcc

SEQ ID NO: 12710 - DNA, 20 bp, Artificial sequence
  SiRNA target sequence
cataaaacagacatacgcca

SEQ ID NO: 12711 - DNA, 20 bp, Artificial sequence
  SiRNA target sequence
ataaaacagacatacgccac

SEQ ID NO: 12712 - DNA, 20 bp, Artificial sequence
  SiRNA target sequence
taaaacagacatacgccacg

SEQ ID NO: 12713 - DNA, 20 bp, Artificial sequence
  SiRNA target sequence
aaaacagacatacgccacgt

SEQ ID NO: 12714 - DNA, 20 bp, Artificial sequence
  SiRNA target sequence
aaacagacatacgccacgtt

SEQ ID NO: 12715 - DNA, 20 bp, Artificial sequence
  SiRNA target sequence
aacagacatacgccacgttc

SEQ ID NO: 12716 - DNA, 20 bp, Artificial sequence
  SiRNA target sequence
acagacatacgccacgttct

SEQ ID NO: 12717 - DNA, 20 bp, Artificial sequence
  SiRNA target sequence
cagacatacgccacgttctg

SEQ ID NO: 12718 - DNA, 20 bp, Artificial sequence
  SiRNA target sequence
agacatacgccacgttctgc

SEQ ID NO: 12719 - DNA, 20 bp, Artificial sequence
  SiRNA target sequence
gacatacgccacgttctgct

SEQ ID NO: 12720 - DNA, 20 bp, Artificial sequence
  SiRNA target sequence
acatacgccacgttctgctt

SEQ ID NO: 12721 - DNA, 20 bp, Artificial sequence
  SiRNA target sequence
catacgccacgttctgcttt

SEQ ID NO: 12722 - DNA, 20 bp, Artificial sequence
  SiRNA target sequence
atacgccacgttctgcttta

SEQ ID NO: 12723 - DNA, 20 bp, Artificial sequence
  SiRNA target sequence
tacgccacgttctgctttaa

SEQ ID NO: 12724 - DNA, 20 bp, Artificial sequence
  SiRNA target sequence
acgccacgttctgctttaac

SEQ ID NO: 12725 - DNA, 20 bp, Artificial sequence
  SiRNA target sequence
cgccacgttctgctttaaca

SEQ ID NO: 12726 - DNA, 20 bp, Artificial sequence
  SiRNA target sequence
gccacgttctgctttaacaa

SEQ ID NO: 12727 - DNA, 20 bp, Artificial sequence
  SiRNA target sequence
ccacgttctgctttaacaat

SEQ ID NO: 12728 - DNA, 20 bp, Artificial sequence
  SiRNA target sequence
cacgttctgctttaacaatc

SEQ ID NO: 12729 - DNA, 20 bp, Artificial sequence
  SiRNA target sequence
acgttctgctttaacaatct

SEQ ID NO: 12730 - DNA, 20 bp, Artificial sequence
  SiRNA target sequence
cgttctgctttaacaatctt

SEQ ID NO: 12731 - DNA, 20 bp, Artificial sequence
  SiRNA target sequence
gttctgctttaacaatcttt

SEQ ID NO: 12732 - DNA, 20 bp, Artificial sequence
  SiRNA target sequence
ttctgctttaacaatctttt

SEQ ID NO: 12733 - DNA, 20 bp, Artificial sequence
  SiRNA target sequence
tctgctttaacaatcttttg

SEQ ID NO: 12734 - DNA, 20 bp, Artificial sequence
  SiRNA target sequence
ctgctttaacaatcttttgc

SEQ ID NO: 12735 - DNA, 20 bp, Artificial sequence
  SiRNA target sequence
tgctttaacaatcttttgct

SEQ ID NO: 12736 - DNA, 20 bp, Artificial sequence
  SiRNA target sequence
gctttaacaatcttttgcta

SEQ ID NO: 12737 - DNA, 20 bp, Artificial sequence
  SiRNA target sequence
ctttaacaatcttttgctac

SEQ ID NO: 12738 - DNA, 20 bp, Artificial sequence
  SiRNA target sequence
tttaacaatcttttgctaca

SEQ ID NO: 12739 - DNA, 20 bp, Artificial sequence
  SiRNA target sequence
ttaacaatcttttgctacaa

SEQ ID NO: 12740 - DNA, 20 bp, Artificial sequence
  SiRNA target sequence
taacaatcttttgctacaaa

SEQ ID NO: 12741 - DNA, 20 bp, Artificial sequence
  SiRNA target sequence
aacaatcttttgctacaaac

SEQ ID NO: 12742 - DNA, 20 bp, Artificial sequence
  SiRNA target sequence
acaatcttttgctacaaacg

SEQ ID NO: 12743 - DNA, 20 bp, Artificial sequence
  SiRNA target sequence
caatcttttgctacaaacga

SEQ ID NO: 12744 - DNA, 20 bp, Artificial sequence
  SiRNA target sequence
aatcttttgctacaaacgag

SEQ ID NO: 12745 - DNA, 20 bp, Artificial sequence
  SiRNA target sequence
atcttttgctacaaacgagc

SEQ ID NO: 12746 - DNA, 20 bp, Artificial sequence
  SiRNA target sequence
tcttttgctacaaacgagca

SEQ ID NO: 12747 - DNA, 20 bp, Artificial sequence
  SiRNA target sequence
cttttgctacaaacgagcat

SEQ ID NO: 12748 - DNA, 20 bp, Artificial sequence
  SiRNA target sequence
ttttgctacaaacgagcata

SEQ ID NO: 12749 - DNA, 20 bp, Artificial sequence
  SiRNA target sequence
tttgctacaaacgagcatag

SEQ ID NO: 12750 - DNA, 20 bp, Artificial sequence
  SiRNA target sequence
ttgctacaaacgagcataga

SEQ ID NO: 12751 - DNA, 20 bp, Artificial sequence
  SiRNA target sequence
tgctacaaacgagcatagac

SEQ ID NO: 12752 - DNA, 20 bp, Artificial sequence
  SiRNA target sequence
gctacaaacgagcatagacc

SEQ ID NO: 12753 - DNA, 20 bp, Artificial sequence
  SiRNA target sequence
ctacaaacgagcatagacca

SEQ ID NO: 12754 - DNA, 20 bp, Artificial sequence
  SiRNA target sequence
tacaaacgagcatagaccaa

SEQ ID NO: 12755 - DNA, 20 bp, Artificial sequence
  SiRNA target sequence
acaaacgagcatagaccaag

SEQ ID NO: 12756 - DNA, 20 bp, Artificial sequence
  SiRNA target sequence
caaacgagcatagaccaaga

SEQ ID NO: 12757 - DNA, 20 bp, Artificial sequence
  SiRNA target sequence
aaacgagcatagaccaagac

SEQ ID NO: 12758 - DNA, 20 bp, Artificial sequence
  SiRNA target sequence
aacgagcatagaccaagaca

SEQ ID NO: 12759 - DNA, 20 bp, Artificial sequence
  SiRNA target sequence
acgagcatagaccaagacaa

SEQ ID NO: 12760 - DNA, 20 bp, Artificial sequence
  SiRNA target sequence
cgagcatagaccaagacaaa

SEQ ID NO: 12761 - DNA, 20 bp, Artificial sequence
  SiRNA target sequence
gagcatagaccaagacaaaa

SEQ ID NO: 12762 - DNA, 20 bp, Artificial sequence
  SiRNA target sequence
agcatagaccaagacaaaat

SEQ ID NO: 12763 - DNA, 20 bp, Artificial sequence
  SiRNA target sequence
gcatagaccaagacaaaata

SEQ ID NO: 12764 - DNA, 20 bp, Artificial sequence
  SiRNA target sequence
catagaccaagacaaaatat

SEQ ID NO: 12765 - DNA, 20 bp, Artificial sequence
  SiRNA target sequence
atagaccaagacaaaatatt

SEQ ID NO: 12766 - DNA, 20 bp, Artificial sequence
  SiRNA target sequence
tagaccaagacaaaatattt

SEQ ID NO: 12767 - DNA, 20 bp, Artificial sequence
  SiRNA target sequence
agaccaagacaaaatattta

SEQ ID NO: 12768 - DNA, 20 bp, Artificial sequence
  SiRNA target sequence
gaccaagacaaaatatttag

SEQ ID NO: 12769 - DNA, 20 bp, Artificial sequence
  SiRNA target sequence
accaagacaaaatatttaga

SEQ ID NO: 12770 - DNA, 20 bp, Artificial sequence
  SiRNA target sequence
ccaagacaaaatatttagaa

SEQ ID NO: 12771 - DNA, 20 bp, Artificial sequence
  SiRNA target sequence
caagacaaaatatttagaat

SEQ ID NO: 12772 - DNA, 20 bp, Artificial sequence
  SiRNA target sequence
aagacaaaatatttagaata

SEQ ID NO: 12773 - DNA, 20 bp, Artificial sequence
  SiRNA target sequence
agacaaaatatttagaataa

SEQ ID NO: 12774 - DNA, 20 bp, Artificial sequence
  SiRNA target sequence
gacaaaatatttagaataag

SEQ ID NO: 12775 - DNA, 20 bp, Artificial sequence
  SiRNA target sequence
acaaaatatttagaataaga

SEQ ID NO: 12776 - DNA, 20 bp, Artificial sequence
  SiRNA target sequence
caaaatatttagaataagag

SEQ ID NO: 12777 - DNA, 20 bp, Artificial sequence
  SiRNA target sequence
aaaatatttagaataagagg

SEQ ID NO: 12778 - DNA, 20 bp, Artificial sequence
  SiRNA target sequence
aaatatttagaataagaggt

SEQ ID NO: 12779 - DNA, 20 bp, Artificial sequence
  SiRNA target sequence
aatatttagaataagaggta

SEQ ID NO: 12780 - DNA, 20 bp, Artificial sequence
  SiRNA target sequence
atatttagaataagaggtac

SEQ ID NO: 12781 - DNA, 20 bp, Artificial sequence
  SiRNA target sequence
tatttagaataagaggtacc

SEQ ID NO: 12782 - DNA, 20 bp, Artificial sequence
  SiRNA target sequence
atttagaataagaggtaccc

SEQ ID NO: 12783 - DNA, 20 bp, Artificial sequence
  SiRNA target sequence
tttagaataagaggtaccca

SEQ ID NO: 12784 - DNA, 20 bp, Artificial sequence
  SiRNA target sequence
ttagaataagaggtacccac

SEQ ID NO: 12785 - DNA, 20 bp, Artificial sequence
  SiRNA target sequence
tagaataagaggtacccaca

SEQ ID NO: 12786 - DNA, 20 bp, Artificial sequence
  SiRNA target sequence
agaataagaggtacccacat

SEQ ID NO: 12787 - DNA, 20 bp, Artificial sequence
  SiRNA target sequence
gaataagaggtacccacatg

SEQ ID NO: 12788 - DNA, 20 bp, Artificial sequence
  SiRNA target sequence
aataagaggtacccacatgt

SEQ ID NO: 12789 - DNA, 20 bp, Artificial sequence
  SiRNA target sequence
ataagaggtacccacatgtt

SEQ ID NO: 12790 - DNA, 20 bp, Artificial sequence
  SiRNA target sequence
taagaggtacccacatgttt

SEQ ID NO: 12791 - DNA, 20 bp, Artificial sequence
  SiRNA target sequence
aagaggtacccacatgttta

SEQ ID NO: 12792 - DNA, 20 bp, Artificial sequence
  SiRNA target sequence
agaggtacccacatgtttaa

SEQ ID NO: 12793 - DNA, 20 bp, Artificial sequence
  SiRNA target sequence
gaggtacccacatgtttaaa

SEQ ID NO: 12794 - DNA, 20 bp, Artificial sequence
  SiRNA target sequence
aggtacccacatgtttaaaa

SEQ ID NO: 12795 - DNA, 20 bp, Artificial sequence
  SiRNA target sequence
ggtacccacatgtttaaaaa

SEQ ID NO: 12796 - DNA, 20 bp, Artificial sequence
  SiRNA target sequence
gtacccacatgtttaaaaat

SEQ ID NO: 12797 - DNA, 20 bp, Artificial sequence
  SiRNA target sequence
tacccacatgtttaaaaatc

SEQ ID NO: 12798 - DNA, 20 bp, Artificial sequence
  SiRNA target sequence
acccacatgtttaaaaatct

SEQ ID NO: 12799 - DNA, 20 bp, Artificial sequence
  SiRNA target sequence
cccacatgtttaaaaatcta

SEQ ID NO: 12800 - DNA, 20 bp, Artificial sequence
  SiRNA target sequence
ccacatgtttaaaaatctac

SEQ ID NO: 12801 - DNA, 20 bp, Artificial sequence
  SiRNA target sequence
cacatgtttaaaaatctact

SEQ ID NO: 12802 - DNA, 20 bp, Artificial sequence
  SiRNA target sequence
acatgtttaaaaatctactt

SEQ ID NO: 12803 - DNA, 20 bp, Artificial sequence
  SiRNA target sequence
catgtttaaaaatctactta

SEQ ID NO: 12804 - DNA, 20 bp, Artificial sequence
  SiRNA target sequence
atgtttaaaaatctacttac

SEQ ID NO: 12805 - DNA, 20 bp, Artificial sequence
  SiRNA target sequence
tgtttaaaaatctacttact

SEQ ID NO: 12806 - DNA, 20 bp, Artificial sequence
  SiRNA target sequence
gtttaaaaatctacttacta

SEQ ID NO: 12807 - DNA, 20 bp, Artificial sequence
  SiRNA target sequence
tttaaaaatctacttactaa

SEQ ID NO: 12808 - DNA, 20 bp, Artificial sequence
  SiRNA target sequence
ttaaaaatctacttactaaa

SEQ ID NO: 12809 - DNA, 20 bp, Artificial sequence
  SiRNA target sequence
taaaaatctacttactaaat

SEQ ID NO: 12810 - DNA, 20 bp, Artificial sequence
  SiRNA target sequence
aaaaatctacttactaaatt

SEQ ID NO: 12811 - DNA, 20 bp, Artificial sequence
  SiRNA target sequence
aaaatctacttactaaattc

SEQ ID NO: 12812 - DNA, 20 bp, Artificial sequence
  SiRNA target sequence
aaatctacttactaaattcc

SEQ ID NO: 12813 - DNA, 20 bp, Artificial sequence
  SiRNA target sequence
aatctacttactaaattcca

SEQ ID NO: 12814 - DNA, 20 bp, Artificial sequence
  SiRNA target sequence
atctacttactaaattccat

SEQ ID NO: 12815 - DNA, 20 bp, Artificial sequence
  SiRNA target sequence
tctacttactaaattccata

SEQ ID NO: 12816 - DNA, 20 bp, Artificial sequence
  SiRNA target sequence
ctacttactaaattccatac

SEQ ID NO: 12817 - DNA, 20 bp, Artificial sequence
  SiRNA target sequence
tacttactaaattccataca

SEQ ID NO: 12818 - DNA, 20 bp, Artificial sequence
  SiRNA target sequence
acttactaaattccatacag

SEQ ID NO: 12819 - DNA, 20 bp, Artificial sequence
  SiRNA target sequence
cttactaaattccatacagt

SEQ ID NO: 12820 - DNA, 20 bp, Artificial sequence
  SiRNA target sequence
ttactaaattccatacagta

SEQ ID NO: 12821 - DNA, 20 bp, Artificial sequence
  SiRNA target sequence
tactaaattccatacagtaa

SEQ ID NO: 12822 - DNA, 20 bp, Artificial sequence
  SiRNA target sequence
actaaattccatacagtaat

SEQ ID NO: 12823 - DNA, 20 bp, Artificial sequence
  SiRNA target sequence
ctaaattccatacagtaatt

SEQ ID NO: 12824 - DNA, 20 bp, Artificial sequence
  SiRNA target sequence
taaattccatacagtaattg

SEQ ID NO: 12825 - DNA, 20 bp, Artificial sequence
  SiRNA target sequence
aaattccatacagtaattgg

SEQ ID NO: 12826 - DNA, 20 bp, Artificial sequence
  SiRNA target sequence
aattccatacagtaattggt

SEQ ID NO: 12827 - DNA, 20 bp, Artificial sequence
  SiRNA target sequence
attccatacagtaattggta

SEQ ID NO: 12828 - DNA, 20 bp, Artificial sequence
  SiRNA target sequence
ttccatacagtaattggtag

SEQ ID NO: 12829 - DNA, 20 bp, Artificial sequence
  SiRNA target sequence
tccatacagtaattggtaga

SEQ ID NO: 12830 - DNA, 20 bp, Artificial sequence
  SiRNA target sequence
ccatacagtaattggtagaa

SEQ ID NO: 12831 - DNA, 20 bp, Artificial sequence
  SiRNA target sequence
catacagtaattggtagaag

SEQ ID NO: 12832 - DNA, 20 bp, Artificial sequence
  SiRNA target sequence
atacagtaattggtagaagt

SEQ ID NO: 12833 - DNA, 20 bp, Artificial sequence
  SiRNA target sequence
tacagtaattggtagaagta

SEQ ID NO: 12834 - DNA, 20 bp, Artificial sequence
  SiRNA target sequence
acagtaattggtagaagtaa

SEQ ID NO: 12835 - DNA, 20 bp, Artificial sequence
  SiRNA target sequence
cagtaattggtagaagtaaa

SEQ ID NO: 12836 - DNA, 20 bp, Artificial sequence
  SiRNA target sequence
agtaattggtagaagtaaag

SEQ ID NO: 12837 - DNA, 20 bp, Artificial sequence
  SiRNA target sequence
gtaattggtagaagtaaaga

SEQ ID NO: 12838 - DNA, 20 bp, Artificial sequence
  SiRNA target sequence
taattggtagaagtaaagat

SEQ ID NO: 12839 - DNA, 20 bp, Artificial sequence
  SiRNA target sequence
aattggtagaagtaaagata

SEQ ID NO: 12840 - DNA, 20 bp, Artificial sequence
  SiRNA target sequence
attggtagaagtaaagatat

SEQ ID NO: 12841 - DNA, 20 bp, Artificial sequence
  SiRNA target sequence
ttggtagaagtaaagatatc

SEQ ID NO: 12842 - DNA, 20 bp, Artificial sequence
  SiRNA target sequence
tggtagaagtaaagatatct

SEQ ID NO: 12843 - DNA, 20 bp, Artificial sequence
  SiRNA target sequence
ggtagaagtaaagatatctt

SEQ ID NO: 12844 - DNA, 20 bp, Artificial sequence
  SiRNA target sequence
gtagaagtaaagatatcttt

SEQ ID NO: 12845 - DNA, 20 bp, Artificial sequence
  SiRNA target sequence
tagaagtaaagatatcttta

SEQ ID NO: 12846 - DNA, 20 bp, Artificial sequence
  SiRNA target sequence
agaagtaaagatatctttac

SEQ ID NO: 12847 - DNA, 20 bp, Artificial sequence
  SiRNA target sequence
gaagtaaagatatctttaca

SEQ ID NO: 12848 - DNA, 20 bp, Artificial sequence
  SiRNA target sequence
aagtaaagatatctttacac

SEQ ID NO: 12849 - DNA, 20 bp, Artificial sequence
  SiRNA target sequence
agtaaagatatctttacaca

SEQ ID NO: 12850 - DNA, 20 bp, Artificial sequence
  SiRNA target sequence
gtaaagatatctttacacaa

SEQ ID NO: 12851 - DNA, 20 bp, Artificial sequence
  SiRNA target sequence
taaagatatctttacacaaa

SEQ ID NO: 12852 - DNA, 20 bp, Artificial sequence
  SiRNA target sequence
aaagatatctttacacaaat

SEQ ID NO: 12853 - DNA, 20 bp, Artificial sequence
  SiRNA target sequence
aagatatctttacacaaata

SEQ ID NO: 12854 - DNA, 20 bp, Artificial sequence
  SiRNA target sequence
agatatctttacacaaatag

SEQ ID NO: 12855 - DNA, 20 bp, Artificial sequence
  SiRNA target sequence
gatatctttacacaaataga

SEQ ID NO: 12856 - DNA, 20 bp, Artificial sequence
  SiRNA target sequence
atatctttacacaaatagag

SEQ ID NO: 12857 - DNA, 20 bp, Artificial sequence
  SiRNA target sequence
tatctttacacaaatagagg

SEQ ID NO: 12858 - DNA, 20 bp, Artificial sequence
  SiRNA target sequence
atctttacacaaatagaggt

SEQ ID NO: 12859 - DNA, 20 bp, Artificial sequence
  SiRNA target sequence
tctttacacaaatagaggta

SEQ ID NO: 12860 - DNA, 20 bp, Artificial sequence
  SiRNA target sequence
ctttacacaaatagaggtag

SEQ ID NO: 12861 - DNA, 20 bp, Artificial sequence
  SiRNA target sequence
tttacacaaatagaggtaga

SEQ ID NO: 12862 - DNA, 20 bp, Artificial sequence
  SiRNA target sequence
ttacacaaatagaggtagac

SEQ ID NO: 12863 - DNA, 20 bp, Artificial sequence
  SiRNA target sequence
tacacaaatagaggtagaca

SEQ ID NO: 12864 - DNA, 20 bp, Artificial sequence
  SiRNA target sequence
acacaaatagaggtagacat

SEQ ID NO: 12865 - DNA, 20 bp, Artificial sequence
  SiRNA target sequence
cacaaatagaggtagacata

SEQ ID NO: 12866 - DNA, 20 bp, Artificial sequence
  SiRNA target sequence
acaaatagaggtagacataa

SEQ ID NO: 12867 - DNA, 20 bp, Artificial sequence
  SiRNA target sequence
caaatagaggtagacataaa

SEQ ID NO: 12868 - DNA, 20 bp, Artificial sequence
  SiRNA target sequence
aaatagaggtagacataaaa

SEQ ID NO: 12869 - DNA, 20 bp, Artificial sequence
  SiRNA target sequence
aatagaggtagacataaaaa

SEQ ID NO: 12870 - DNA, 20 bp, Artificial sequence
  SiRNA target sequence
atagaggtagacataaaaaa

SEQ ID NO: 12871 - DNA, 20 bp, Artificial sequence
  SiRNA target sequence
tagaggtagacataaaaaat

SEQ ID NO: 12872 - DNA, 20 bp, Artificial sequence
  SiRNA target sequence
agaggtagacataaaaaata

SEQ ID NO: 12873 - DNA, 20 bp, Artificial sequence
  SiRNA target sequence
gaggtagacataaaaaataa

SEQ ID NO: 12874 - DNA, 20 bp, Artificial sequence
  SiRNA target sequence
aggtagacataaaaaataaa

SEQ ID NO: 12875 - DNA, 20 bp, Artificial sequence
  SiRNA target sequence
ggtagacataaaaaataaat

SEQ ID NO: 12876 - DNA, 20 bp, Artificial sequence
  SiRNA target sequence
gtagacataaaaaataaata

SEQ ID NO: 12877 - DNA, 20 bp, Artificial sequence
  SiRNA target sequence
tagacataaaaaataaatac

SEQ ID NO: 12878 - DNA, 20 bp, Artificial sequence
  SiRNA target sequence
agacataaaaaataaataca

SEQ ID NO: 12879 - DNA, 20 bp, Artificial sequence
  SiRNA target sequence
gacataaaaaataaatacaa

SEQ ID NO: 12880 - DNA, 20 bp, Artificial sequence
  SiRNA target sequence
acataaaaaataaatacaat

SEQ ID NO: 12881 - DNA, 20 bp, Artificial sequence
  SiRNA target sequence
cataaaaaataaatacaata

SEQ ID NO: 12882 - DNA, 20 bp, Artificial sequence
  SiRNA target sequence
ataaaaaataaatacaataa

SEQ ID NO: 12883 - DNA, 20 bp, Artificial sequence
  SiRNA target sequence
taaaaaataaatacaataat

SEQ ID NO: 12884 - DNA, 20 bp, Artificial sequence
  SiRNA target sequence
aaaaaataaatacaataata

SEQ ID NO: 12885 - DNA, 20 bp, Artificial sequence
  SiRNA target sequence
aaaaataaatacaataatat

SEQ ID NO: 12886 - DNA, 20 bp, Artificial sequence
  SiRNA target sequence
aaaataaatacaataatatg

SEQ ID NO: 12887 - DNA, 20 bp, Artificial sequence
  SiRNA target sequence
aaataaatacaataatatgt

SEQ ID NO: 12888 - DNA, 20 bp, Artificial sequence
  SiRNA target sequence
aataaatacaataatatgtg

SEQ ID NO: 12889 - DNA, 20 bp, Artificial sequence
  SiRNA target sequence
ataaatacaataatatgtgt

SEQ ID NO: 12890 - DNA, 20 bp, Artificial sequence
  SiRNA target sequence
taaatacaataatatgtgta

SEQ ID NO: 12891 - DNA, 20 bp, Artificial sequence
  SiRNA target sequence
aaatacaataatatgtgtat

SEQ ID NO: 12892 - DNA, 20 bp, Artificial sequence
  SiRNA target sequence
aatacaataatatgtgtata

SEQ ID NO: 12893 - DNA, 20 bp, Artificial sequence
  SiRNA target sequence
atacaataatatgtgtataa

SEQ ID NO: 12894 - DNA, 20 bp, Artificial sequence
  SiRNA target sequence
tacaataatatgtgtataaa

SEQ ID NO: 12895 - DNA, 20 bp, Artificial sequence
  SiRNA target sequence
acaataatatgtgtataaaa

SEQ ID NO: 12896 - DNA, 20 bp, Artificial sequence
  SiRNA target sequence
caataatatgtgtataaaaa

SEQ ID NO: 12897 - DNA, 20 bp, Artificial sequence
  SiRNA target sequence
aataatatgtgtataaaaat

SEQ ID NO: 12898 - DNA, 20 bp, Artificial sequence
  SiRNA target sequence
ataatatgtgtataaaaatg

SEQ ID NO: 12899 - DNA, 20 bp, Artificial sequence
  SiRNA target sequence
taatatgtgtataaaaatga

SEQ ID NO: 12900 - DNA, 20 bp, Artificial sequence
  SiRNA target sequence
aatatgtgtataaaaatgat

SEQ ID NO: 12901 - DNA, 20 bp, Artificial sequence
  SiRNA target sequence
atatgtgtataaaaatgata

SEQ ID NO: 12902 - DNA, 20 bp, Artificial sequence
  SiRNA target sequence
tatgtgtataaaaatgatac

SEQ ID NO: 12903 - DNA, 20 bp, Artificial sequence
  SiRNA target sequence
atgtgtataaaaatgataca

SEQ ID NO: 12904 - DNA, 20 bp, Artificial sequence
  SiRNA target sequence
tgtgtataaaaatgatacag

SEQ ID NO: 12905 - DNA, 20 bp, Artificial sequence
  SiRNA target sequence
gtgtataaaaatgatacagc

SEQ ID NO: 12906 - DNA, 20 bp, Artificial sequence
  SiRNA target sequence
tgtataaaaatgatacagcc

SEQ ID NO: 12907 - DNA, 20 bp, Artificial sequence
  SiRNA target sequence
gtataaaaatgatacagcca

SEQ ID NO: 12908 - DNA, 20 bp, Artificial sequence
  SiRNA target sequence
tataaaaatgatacagccag

SEQ ID NO: 12909 - DNA, 20 bp, Artificial sequence
  SiRNA target sequence
ataaaaatgatacagccagc

SEQ ID NO: 12910 - DNA, 20 bp, Artificial sequence
  SiRNA target sequence
taaaaatgatacagccagct

SEQ ID NO: 12911 - DNA, 20 bp, Artificial sequence
  SiRNA target sequence
aaaaatgatacagccagcta

SEQ ID NO: 12912 - DNA, 20 bp, Artificial sequence
  SiRNA target sequence
aaaatgatacagccagctat

SEQ ID NO: 12913 - DNA, 20 bp, Artificial sequence
  SiRNA target sequence
aaatgatacagccagctatt

SEQ ID NO: 12914 - DNA, 20 bp, Artificial sequence
  SiRNA target sequence
aatgatacagccagctatta

SEQ ID NO: 12915 - DNA, 20 bp, Artificial sequence
  SiRNA target sequence
atgatacagccagctattaa

SEQ ID NO: 12916 - DNA, 20 bp, Artificial sequence
  SiRNA target sequence
tgatacagccagctattaaa

SEQ ID NO: 12917 - DNA, 20 bp, Artificial sequence
  SiRNA target sequence
gatacagccagctattaaag

SEQ ID NO: 12918 - DNA, 20 bp, Artificial sequence
  SiRNA target sequence
atacagccagctattaaagg

SEQ ID NO: 12919 - DNA, 20 bp, Artificial sequence
  SiRNA target sequence
tacagccagctattaaaggt

SEQ ID NO: 12920 - DNA, 20 bp, Artificial sequence
  SiRNA target sequence
acagccagctattaaaggtg

SEQ ID NO: 12921 - DNA, 20 bp, Artificial sequence
  SiRNA target sequence
cagccagctattaaaggtgc

SEQ ID NO: 12922 - DNA, 20 bp, Artificial sequence
  SiRNA target sequence
agccagctattaaaggtgct

SEQ ID NO: 12923 - DNA, 20 bp, Artificial sequence
  SiRNA target sequence
gccagctattaaaggtgctt

SEQ ID NO: 12924 - DNA, 20 bp, Artificial sequence
  SiRNA target sequence
ccagctattaaaggtgcttc

SEQ ID NO: 12925 - DNA, 20 bp, Artificial sequence
  SiRNA target sequence
cagctattaaaggtgcttca

SEQ ID NO: 12926 - DNA, 20 bp, Artificial sequence
  SiRNA target sequence
agctattaaaggtgcttcat

SEQ ID NO: 12927 - DNA, 20 bp, Artificial sequence
  SiRNA target sequence
gctattaaaggtgcttcatg

SEQ ID NO: 12928 - DNA, 20 bp, Artificial sequence
  SiRNA target sequence
ctattaaaggtgcttcatgt

SEQ ID NO: 12929 - DNA, 20 bp, Artificial sequence
  SiRNA target sequence
tattaaaggtgcttcatgta

SEQ ID NO: 12930 - DNA, 20 bp, Artificial sequence
  SiRNA target sequence
attaaaggtgcttcatgtat

SEQ ID NO: 12931 - DNA, 20 bp, Artificial sequence
  SiRNA target sequence
ttaaaggtgcttcatgtata

SEQ ID NO: 12932 - DNA, 20 bp, Artificial sequence
  SiRNA target sequence
taaaggtgcttcatgtatat

SEQ ID NO: 12933 - DNA, 20 bp, Artificial sequence
  SiRNA target sequence
aaaggtgcttcatgtatata

SEQ ID NO: 12934 - DNA, 20 bp, Artificial sequence
  SiRNA target sequence
aaggtgcttcatgtatatac

SEQ ID NO: 12935 - DNA, 20 bp, Artificial sequence
  SiRNA target sequence
aggtgcttcatgtatatacg

SEQ ID NO: 12936 - DNA, 20 bp, Artificial sequence
  SiRNA target sequence
ggtgcttcatgtatatacgt

SEQ ID NO: 12937 - DNA, 20 bp, Artificial sequence
  SiRNA target sequence
gtgcttcatgtatatacgtg

SEQ ID NO: 12938 - DNA, 20 bp, Artificial sequence
  SiRNA target sequence
tgcttcatgtatatacgtgg

SEQ ID NO: 12939 - DNA, 20 bp, Artificial sequence
  SiRNA target sequence
gcttcatgtatatacgtggg

SEQ ID NO: 12940 - DNA, 20 bp, Artificial sequence
  SiRNA target sequence
cttcatgtatatacgtgggt

SEQ ID NO: 12941 - DNA, 20 bp, Artificial sequence
  SiRNA target sequence
ttcatgtatatacgtgggta

SEQ ID NO: 12942 - DNA, 20 bp, Artificial sequence
  SiRNA target sequence
tcatgtatatacgtgggtaa

SEQ ID NO: 12943 - DNA, 20 bp, Artificial sequence
  SiRNA target sequence
catgtatatacgtgggtaat

SEQ ID NO: 12944 - DNA, 20 bp, Artificial sequence
  SiRNA target sequence
atgtatatacgtgggtaatt

SEQ ID NO: 12945 - DNA, 20 bp, Artificial sequence
  SiRNA target sequence
tgtatatacgtgggtaatta

SEQ ID NO: 12946 - DNA, 20 bp, Artificial sequence
  SiRNA target sequence
gtatatacgtgggtaattat

SEQ ID NO: 12947 - DNA, 20 bp, Artificial sequence
  SiRNA target sequence
tatatacgtgggtaattata

SEQ ID NO: 12948 - DNA, 20 bp, Artificial sequence
  SiRNA target sequence
atatacgtgggtaattatat

SEQ ID NO: 12949 - DNA, 20 bp, Artificial sequence
  SiRNA target sequence
tatacgtgggtaattatatg

SEQ ID NO: 12950 - DNA, 20 bp, Artificial sequence
  SiRNA target sequence
atacgtgggtaattatatgc

SEQ ID NO: 12951 - DNA, 20 bp, Artificial sequence
  SiRNA target sequence
tacgtgggtaattatatgca

SEQ ID NO: 12952 - DNA, 20 bp, Artificial sequence
  SiRNA target sequence
acgtgggtaattatatgcag

SEQ ID NO: 12953 - DNA, 20 bp, Artificial sequence
  SiRNA target sequence
cgtgggtaattatatgcagc

SEQ ID NO: 12954 - DNA, 20 bp, Artificial sequence
  SiRNA target sequence
gtgggtaattatatgcagca

SEQ ID NO: 12955 - DNA, 20 bp, Artificial sequence
  SiRNA target sequence
tgggtaattatatgcagcag

SEQ ID NO: 12956 - DNA, 20 bp, Artificial sequence
  SiRNA target sequence
gggtaattatatgcagcagc

SEQ ID NO: 12957 - DNA, 20 bp, Artificial sequence
  SiRNA target sequence
ggtaattatatgcagcagct

SEQ ID NO: 12958 - DNA, 20 bp, Artificial sequence
  SiRNA target sequence
gtaattatatgcagcagcta

SEQ ID NO: 12959 - DNA, 20 bp, Artificial sequence
  SiRNA target sequence
taattatatgcagcagctag

SEQ ID NO: 12960 - DNA, 20 bp, Artificial sequence
  SiRNA target sequence
aattatatgcagcagctagg

SEQ ID NO: 12961 - DNA, 20 bp, Artificial sequence
  SiRNA target sequence
attatatgcagcagctagga

SEQ ID NO: 12962 - DNA, 20 bp, Artificial sequence
  SiRNA target sequence
ttatatgcagcagctaggag

SEQ ID NO: 12963 - DNA, 20 bp, Artificial sequence
  SiRNA target sequence
tatatgcagcagctaggagt

SEQ ID NO: 12964 - DNA, 20 bp, Artificial sequence
  SiRNA target sequence
atatgcagcagctaggagta

SEQ ID NO: 12965 - DNA, 20 bp, Artificial sequence
  SiRNA target sequence
tatgcagcagctaggagtaa

SEQ ID NO: 12966 - DNA, 20 bp, Artificial sequence
  SiRNA target sequence
atgcagcagctaggagtaat

SEQ ID NO: 12967 - DNA, 20 bp, Artificial sequence
  SiRNA target sequence
tgcagcagctaggagtaatt

SEQ ID NO: 12968 - DNA, 20 bp, Artificial sequence
  SiRNA target sequence
gcagcagctaggagtaatta

SEQ ID NO: 12969 - DNA, 20 bp, Artificial sequence
  SiRNA target sequence
cagcagctaggagtaattag

SEQ ID NO: 12970 - DNA, 20 bp, Artificial sequence
  SiRNA target sequence
agcagctaggagtaattagt

SEQ ID NO: 12971 - DNA, 20 bp, Artificial sequence
  SiRNA target sequence
gcagctaggagtaattagtc

SEQ ID NO: 12972 - DNA, 20 bp, Artificial sequence
  SiRNA target sequence
cagctaggagtaattagtct

SEQ ID NO: 12973 - DNA, 20 bp, Artificial sequence
  SiRNA target sequence
agctaggagtaattagtctt

SEQ ID NO: 12974 - DNA, 20 bp, Artificial sequence
  SiRNA target sequence
gctaggagtaattagtcttg

SEQ ID NO: 12975 - DNA, 20 bp, Artificial sequence
  SiRNA target sequence
ctaggagtaattagtcttgg

SEQ ID NO: 12976 - DNA, 20 bp, Artificial sequence
  SiRNA target sequence
taggagtaattagtcttggt

SEQ ID NO: 12977 - DNA, 20 bp, Artificial sequence
  SiRNA target sequence
aggagtaattagtcttggtg

SEQ ID NO: 12978 - DNA, 20 bp, Artificial sequence
  SiRNA target sequence
ggagtaattagtcttggtgg

SEQ ID NO: 12979 - DNA, 20 bp, Artificial sequence
  SiRNA target sequence
gagtaattagtcttggtggg

SEQ ID NO: 12980 - DNA, 20 bp, Artificial sequence
  SiRNA target sequence
agtaattagtcttggtgggg

SEQ ID NO: 12981 - DNA, 20 bp, Artificial sequence
  SiRNA target sequence
gtaattagtcttggtgggga

SEQ ID NO: 12982 - DNA, 20 bp, Artificial sequence
  SiRNA target sequence
taattagtcttggtggggag

SEQ ID NO: 12983 - DNA, 20 bp, Artificial sequence
  SiRNA target sequence
aattagtcttggtggggaga

SEQ ID NO: 12984 - DNA, 20 bp, Artificial sequence
  SiRNA target sequence
attagtcttggtggggagat

SEQ ID NO: 12985 - DNA, 20 bp, Artificial sequence
  SiRNA target sequence
ttagtcttggtggggagatt

SEQ ID NO: 12986 - DNA, 20 bp, Artificial sequence
  SiRNA target sequence
tagtcttggtggggagatta

SEQ ID NO: 12987 - DNA, 20 bp, Artificial sequence
  SiRNA target sequence
agtcttggtggggagattat

SEQ ID NO: 12988 - DNA, 20 bp, Artificial sequence
  SiRNA target sequence
gtcttggtggggagattatt

SEQ ID NO: 12989 - DNA, 20 bp, Artificial sequence
  SiRNA target sequence
tcttggtggggagattatta

SEQ ID NO: 12990 - DNA, 20 bp, Artificial sequence
  SiRNA target sequence
cttggtggggagattattaa

SEQ ID NO: 12991 - DNA, 20 bp, Artificial sequence
  SiRNA target sequence
ttggtggggagattattaaa

SEQ ID NO: 12992 - DNA, 20 bp, Artificial sequence
  SiRNA target sequence
tggtggggagattattaaag

SEQ ID NO: 12993 - DNA, 20 bp, Artificial sequence
  SiRNA target sequence
ggtggggagattattaaagc

SEQ ID NO: 12994 - DNA, 20 bp, Artificial sequence
  SiRNA target sequence
gtggggagattattaaagct

SEQ ID NO: 12995 - DNA, 20 bp, Artificial sequence
  SiRNA target sequence
tggggagattattaaagctg

SEQ ID NO: 12996 - DNA, 20 bp, Artificial sequence
  SiRNA target sequence
ggggagattattaaagctga

SEQ ID NO: 12997 - DNA, 20 bp, Artificial sequence
  SiRNA target sequence
gggagattattaaagctgat

SEQ ID NO: 12998 - DNA, 20 bp, Artificial sequence
  SiRNA target sequence
ggagattattaaagctgatg

SEQ ID NO: 12999 - DNA, 20 bp, Artificial sequence
  SiRNA target sequence
gagattattaaagctgatga

SEQ ID NO: 13000 - DNA, 20 bp, Artificial sequence
  SiRNA target sequence
agattattaaagctgatgaa

SEQ ID NO: 13001 - DNA, 20 bp, Artificial sequence
  SiRNA target sequence
gattattaaagctgatgaat

SEQ ID NO: 13002 - DNA, 20 bp, Artificial sequence
  SiRNA target sequence
attattaaagctgatgaata

SEQ ID NO: 13003 - DNA, 20 bp, Artificial sequence
  SiRNA target sequence
ttattaaagctgatgaatac

SEQ ID NO: 13004 - DNA, 20 bp, Artificial sequence
  SiRNA target sequence
tattaaagctgatgaataca

SEQ ID NO: 13005 - DNA, 20 bp, Artificial sequence
  SiRNA target sequence
attaaagctgatgaatacat

SEQ ID NO: 13006 - DNA, 20 bp, Artificial sequence
  SiRNA target sequence
ttaaagctgatgaatacatt

SEQ ID NO: 13007 - DNA, 20 bp, Artificial sequence
  SiRNA target sequence
taaagctgatgaatacattg

SEQ ID NO: 13008 - DNA, 20 bp, Artificial sequence
  SiRNA target sequence
aaagctgatgaatacattgg

SEQ ID NO: 13009 - DNA, 20 bp, Artificial sequence
  SiRNA target sequence
aagctgatgaatacattgga

SEQ ID NO: 13010 - DNA, 20 bp, Artificial sequence
  SiRNA target sequence
agctgatgaatacattggac

SEQ ID NO: 13011 - DNA, 20 bp, Artificial sequence
  SiRNA target sequence
gctgatgaatacattggact

SEQ ID NO: 13012 - DNA, 20 bp, Artificial sequence
  SiRNA target sequence
ctgatgaatacattggacta

SEQ ID NO: 13013 - DNA, 20 bp, Artificial sequence
  SiRNA target sequence
tgatgaatacattggactat

SEQ ID NO: 13014 - DNA, 20 bp, Artificial sequence
  SiRNA target sequence
gatgaatacattggactatc

SEQ ID NO: 13015 - DNA, 20 bp, Artificial sequence
  SiRNA target sequence
atgaatacattggactatct

SEQ ID NO: 13016 - DNA, 20 bp, Artificial sequence
  SiRNA target sequence
tgaatacattggactatctt

SEQ ID NO: 13017 - DNA, 20 bp, Artificial sequence
  SiRNA target sequence
gaatacattggactatcttt

SEQ ID NO: 13018 - DNA, 20 bp, Artificial sequence
  SiRNA target sequence
aatacattggactatctttt

SEQ ID NO: 13019 - DNA, 20 bp, Artificial sequence
  SiRNA target sequence
atacattggactatcttttg

SEQ ID NO: 13020 - DNA, 20 bp, Artificial sequence
  SiRNA target sequence
tacattggactatcttttgt

SEQ ID NO: 13021 - DNA, 20 bp, Artificial sequence
  SiRNA target sequence
acattggactatcttttgta

SEQ ID NO: 13022 - DNA, 20 bp, Artificial sequence
  SiRNA target sequence
cattggactatcttttgtag

SEQ ID NO: 13023 - DNA, 20 bp, Artificial sequence
  SiRNA target sequence
attggactatcttttgtagg

SEQ ID NO: 13024 - DNA, 20 bp, Artificial sequence
  SiRNA target sequence
ttggactatcttttgtaggg

SEQ ID NO: 13025 - DNA, 20 bp, Artificial sequence
  SiRNA target sequence
tggactatcttttgtaggga

SEQ ID NO: 13026 - DNA, 20 bp, Artificial sequence
  SiRNA target sequence
ggactatcttttgtagggag

SEQ ID NO: 13027 - DNA, 20 bp, Artificial sequence
  SiRNA target sequence
gactatcttttgtagggaga

SEQ ID NO: 13028 - DNA, 20 bp, Artificial sequence
  SiRNA target sequence
actatcttttgtagggagat

SEQ ID NO: 13029 - DNA, 20 bp, Artificial sequence
  SiRNA target sequence
ctatcttttgtagggagata

SEQ ID NO: 13030 - DNA, 20 bp, Artificial sequence
  SiRNA target sequence
tatcttttgtagggagatat

SEQ ID NO: 13031 - DNA, 20 bp, Artificial sequence
  SiRNA target sequence
atcttttgtagggagatatg

SEQ ID NO: 13032 - DNA, 20 bp, Artificial sequence
  SiRNA target sequence
tcttttgtagggagatatga

SEQ ID NO: 13033 - DNA, 20 bp, Artificial sequence
  SiRNA target sequence
cttttgtagggagatatgaa

SEQ ID NO: 13034 - DNA, 20 bp, Artificial sequence
  SiRNA target sequence
ttttgtagggagatatgaag

SEQ ID NO: 13035 - DNA, 20 bp, Artificial sequence
  SiRNA target sequence
tttgtagggagatatgaagg

SEQ ID NO: 13036 - DNA, 20 bp, Artificial sequence
  SiRNA target sequence
ttgtagggagatatgaaggg

SEQ ID NO: 13037 - DNA, 20 bp, Artificial sequence
  SiRNA target sequence
tgtagggagatatgaaggga

SEQ ID NO: 13038 - DNA, 20 bp, Artificial sequence
  SiRNA target sequence
gtagggagatatgaagggat

SEQ ID NO: 13039 - DNA, 20 bp, Artificial sequence
  SiRNA target sequence
tagggagatatgaagggatt

SEQ ID NO: 13040 - DNA, 20 bp, Artificial sequence
  SiRNA target sequence
agggagatatgaagggattg

SEQ ID NO: 13041 - DNA, 20 bp, Artificial sequence
  SiRNA target sequence
gggagatatgaagggattgg

SEQ ID NO: 13042 - DNA, 20 bp, Artificial sequence
  SiRNA target sequence
ggagatatgaagggattggt

SEQ ID NO: 13043 - DNA, 20 bp, Artificial sequence
  SiRNA target sequence
gagatatgaagggattggtt

SEQ ID NO: 13044 - DNA, 20 bp, Artificial sequence
  SiRNA target sequence
agatatgaagggattggttc

SEQ ID NO: 13045 - DNA, 20 bp, Artificial sequence
  SiRNA target sequence
gatatgaagggattggttct

SEQ ID NO: 13046 - DNA, 20 bp, Artificial sequence
  SiRNA target sequence
atatgaagggattggttcta

SEQ ID NO: 13047 - DNA, 20 bp, Artificial sequence
  SiRNA target sequence
tatgaagggattggttctat

SEQ ID NO: 13048 - DNA, 20 bp, Artificial sequence
  SiRNA target sequence
atgaagggattggttctatt

SEQ ID NO: 13049 - DNA, 20 bp, Artificial sequence
  SiRNA target sequence
tgaagggattggttctattt

SEQ ID NO: 13050 - DNA, 20 bp, Artificial sequence
  SiRNA target sequence
gaagggattggttctatttc

SEQ ID NO: 13051 - DNA, 20 bp, Artificial sequence
  SiRNA target sequence
aagggattggttctatttct

SEQ ID NO: 13052 - DNA, 20 bp, Artificial sequence
  SiRNA target sequence
agggattggttctatttcta

SEQ ID NO: 13053 - DNA, 20 bp, Artificial sequence
  SiRNA target sequence
gggattggttctatttctac

SEQ ID NO: 13054 - DNA, 20 bp, Artificial sequence
  SiRNA target sequence
ggattggttctatttctact

SEQ ID NO: 13055 - DNA, 20 bp, Artificial sequence
  SiRNA target sequence
gattggttctatttctacta

SEQ ID NO: 13056 - DNA, 20 bp, Artificial sequence
  SiRNA target sequence
attggttctatttctactat

SEQ ID NO: 13057 - DNA, 20 bp, Artificial sequence
  SiRNA target sequence
ttggttctatttctactata

SEQ ID NO: 13058 - DNA, 20 bp, Artificial sequence
  SiRNA target sequence
tggttctatttctactatat

SEQ ID NO: 13059 - DNA, 20 bp, Artificial sequence
  SiRNA target sequence
ggttctatttctactatatc

SEQ ID NO: 13060 - DNA, 20 bp, Artificial sequence
  SiRNA target sequence
gttctatttctactatatca

SEQ ID NO: 13061 - DNA, 20 bp, Artificial sequence
  SiRNA target sequence
ttctatttctactatatcac

SEQ ID NO: 13062 - DNA, 20 bp, Artificial sequence
  SiRNA target sequence
tctatttctactatatcact

SEQ ID NO: 13063 - DNA, 20 bp, Artificial sequence
  SiRNA target sequence
ctatttctactatatcactt

SEQ ID NO: 13064 - DNA, 20 bp, Artificial sequence
  SiRNA target sequence
tatttctactatatcacttc

SEQ ID NO: 13065 - DNA, 20 bp, Artificial sequence
  SiRNA target sequence
atttctactatatcacttca

SEQ ID NO: 13066 - DNA, 20 bp, Artificial sequence
  SiRNA target sequence
tttctactatatcacttcag

SEQ ID NO: 13067 - DNA, 20 bp, Artificial sequence
  SiRNA target sequence
ttctactatatcacttcagc

SEQ ID NO: 13068 - DNA, 20 bp, Artificial sequence
  SiRNA target sequence
tctactatatcacttcagca

SEQ ID NO: 13069 - DNA, 20 bp, Artificial sequence
  SiRNA target sequence
ctactatatcacttcagcag

SEQ ID NO: 13070 - DNA, 20 bp, Artificial sequence
  SiRNA target sequence
tactatatcacttcagcagt

SEQ ID NO: 13071 - DNA, 20 bp, Artificial sequence
  SiRNA target sequence
actatatcacttcagcagtt

SEQ ID NO: 13072 - DNA, 20 bp, Artificial sequence
  SiRNA target sequence
ctatatcacttcagcagttt

SEQ ID NO: 13073 - DNA, 20 bp, Artificial sequence
  SiRNA target sequence
tatatcacttcagcagttta

SEQ ID NO: 13074 - DNA, 20 bp, Artificial sequence
  SiRNA target sequence
atatcacttcagcagtttaa

SEQ ID NO: 13075 - DNA, 20 bp, Artificial sequence
  SiRNA target sequence
tatcacttcagcagtttaat

SEQ ID NO: 13076 - DNA, 20 bp, Artificial sequence
  SiRNA target sequence
atcacttcagcagtttaata

SEQ ID NO: 13077 - DNA, 20 bp, Artificial sequence
  SiRNA target sequence
tcacttcagcagtttaatac

SEQ ID NO: 13078 - DNA, 20 bp, Artificial sequence
  SiRNA target sequence
cacttcagcagtttaataca

SEQ ID NO: 13079 - DNA, 20 bp, Artificial sequence
  SiRNA target sequence
acttcagcagtttaatacac

SEQ ID NO: 13080 - DNA, 20 bp, Artificial sequence
  SiRNA target sequence
cttcagcagtttaatacact

SEQ ID NO: 13081 - DNA, 20 bp, Artificial sequence
  SiRNA target sequence
ttcagcagtttaatacactg

SEQ ID NO: 13082 - DNA, 20 bp, Artificial sequence
  SiRNA target sequence
tcagcagtttaatacactgt

SEQ ID NO: 13083 - DNA, 20 bp, Artificial sequence
  SiRNA target sequence
cagcagtttaatacactgtc

SEQ ID NO: 13084 - DNA, 20 bp, Artificial sequence
  SiRNA target sequence
agcagtttaatacactgtct

SEQ ID NO: 13085 - DNA, 20 bp, Artificial sequence
  SiRNA target sequence
gcagtttaatacactgtcta

SEQ ID NO: 13086 - DNA, 20 bp, Artificial sequence
  SiRNA target sequence
cagtttaatacactgtctat

SEQ ID NO: 13087 - DNA, 20 bp, Artificial sequence
  SiRNA target sequence
agtttaatacactgtctata

SEQ ID NO: 13088 - DNA, 20 bp, Artificial sequence
  SiRNA target sequence
gtttaatacactgtctatag

SEQ ID NO: 13089 - DNA, 20 bp, Artificial sequence
  SiRNA target sequence
tttaatacactgtctataga

SEQ ID NO: 13090 - DNA, 20 bp, Artificial sequence
  SiRNA target sequence
ttaatacactgtctatagat

SEQ ID NO: 13091 - DNA, 20 bp, Artificial sequence
  SiRNA target sequence
taatacactgtctatagatt

SEQ ID NO: 13092 - DNA, 20 bp, Artificial sequence
  SiRNA target sequence
aatacactgtctatagatta

SEQ ID NO: 13093 - DNA, 20 bp, Artificial sequence
  SiRNA target sequence
atacactgtctatagattat

SEQ ID NO: 13094 - DNA, 20 bp, Artificial sequence
  SiRNA target sequence
tacactgtctatagattatt

SEQ ID NO: 13095 - DNA, 20 bp, Artificial sequence
  SiRNA target sequence
acactgtctatagattatta

SEQ ID NO: 13096 - DNA, 20 bp, Artificial sequence
  SiRNA target sequence
cactgtctatagattattac

SEQ ID NO: 13097 - DNA, 20 bp, Artificial sequence
  SiRNA target sequence
actgtctatagattattaca

SEQ ID NO: 13098 - DNA, 20 bp, Artificial sequence
  SiRNA target sequence
ctgtctatagattattacaa

SEQ ID NO: 13099 - DNA, 20 bp, Artificial sequence
  SiRNA target sequence
tgtctatagattattacaag

SEQ ID NO: 13100 - DNA, 20 bp, Artificial sequence
  SiRNA target sequence
gtctatagattattacaaga

SEQ ID NO: 13101 - DNA, 20 bp, Artificial sequence
  SiRNA target sequence
tctatagattattacaagac

SEQ ID NO: 13102 - DNA, 20 bp, Artificial sequence
  SiRNA target sequence
ctatagattattacaagaca

SEQ ID NO: 13103 - DNA, 20 bp, Artificial sequence
  SiRNA target sequence
tatagattattacaagacat

SEQ ID NO: 13104 - DNA, 20 bp, Artificial sequence
  SiRNA target sequence
atagattattacaagacatt

SEQ ID NO: 13105 - DNA, 20 bp, Artificial sequence
  SiRNA target sequence
tagattattacaagacattg

SEQ ID NO: 13106 - DNA, 20 bp, Artificial sequence
  SiRNA target sequence
agattattacaagacattgt

SEQ ID NO: 13107 - DNA, 20 bp, Artificial sequence
  SiRNA target sequence
gattattacaagacattgtc

SEQ ID NO: 13108 - DNA, 20 bp, Artificial sequence
  SiRNA target sequence
attattacaagacattgtct

SEQ ID NO: 13109 - DNA, 20 bp, Artificial sequence
  SiRNA target sequence
ttattacaagacattgtctt

SEQ ID NO: 13110 - DNA, 20 bp, Artificial sequence
  SiRNA target sequence
tattacaagacattgtcttc

SEQ ID NO: 13111 - DNA, 20 bp, Artificial sequence
  SiRNA target sequence
attacaagacattgtcttct

SEQ ID NO: 13112 - DNA, 20 bp, Artificial sequence
  SiRNA target sequence
ttacaagacattgtcttcta

SEQ ID NO: 13113 - DNA, 20 bp, Artificial sequence
  SiRNA target sequence
tacaagacattgtcttctat

SEQ ID NO: 13114 - DNA, 20 bp, Artificial sequence
  SiRNA target sequence
acaagacattgtcttctatt

SEQ ID NO: 13115 - DNA, 20 bp, Artificial sequence
  SiRNA target sequence
caagacattgtcttctattt

SEQ ID NO: 13116 - DNA, 20 bp, Artificial sequence
  SiRNA target sequence
aagacattgtcttctatttg

SEQ ID NO: 13117 - DNA, 20 bp, Artificial sequence
  SiRNA target sequence
agacattgtcttctatttgt

SEQ ID NO: 13118 - DNA, 20 bp, Artificial sequence
  SiRNA target sequence
gacattgtcttctatttgtg

SEQ ID NO: 13119 - DNA, 20 bp, Artificial sequence
  SiRNA target sequence
acattgtcttctatttgtga

SEQ ID NO: 13120 - DNA, 20 bp, Artificial sequence
  SiRNA target sequence
cattgtcttctatttgtgac

SEQ ID NO: 13121 - DNA, 20 bp, Artificial sequence
  SiRNA target sequence
attgtcttctatttgtgacg

SEQ ID NO: 13122 - DNA, 20 bp, Artificial sequence
  SiRNA target sequence
ttgtcttctatttgtgacgt

SEQ ID NO: 13123 - DNA, 20 bp, Artificial sequence
  SiRNA target sequence
tgtcttctatttgtgacgta

SEQ ID NO: 13124 - DNA, 20 bp, Artificial sequence
  SiRNA target sequence
gtcttctatttgtgacgtag

SEQ ID NO: 13125 - DNA, 20 bp, Artificial sequence
  SiRNA target sequence
tcttctatttgtgacgtagg

SEQ ID NO: 13126 - DNA, 20 bp, Artificial sequence
  SiRNA target sequence
cttctatttgtgacgtaggt

SEQ ID NO: 13127 - DNA, 20 bp, Artificial sequence
  SiRNA target sequence
ttctatttgtgacgtaggta

SEQ ID NO: 13128 - DNA, 20 bp, Artificial sequence
  SiRNA target sequence
tctatttgtgacgtaggtat

SEQ ID NO: 13129 - DNA, 20 bp, Artificial sequence
  SiRNA target sequence
ctatttgtgacgtaggtatt

SEQ ID NO: 13130 - DNA, 20 bp, Artificial sequence
  SiRNA target sequence
tatttgtgacgtaggtatta

SEQ ID NO: 13131 - DNA, 20 bp, Artificial sequence
  SiRNA target sequence
atttgtgacgtaggtattaa

SEQ ID NO: 13132 - DNA, 20 bp, Artificial sequence
  SiRNA target sequence
tttgtgacgtaggtattaaa

SEQ ID NO: 13133 - DNA, 20 bp, Artificial sequence
  SiRNA target sequence
ttgtgacgtaggtattaaaa

SEQ ID NO: 13134 - DNA, 20 bp, Artificial sequence
  SiRNA target sequence
tgtgacgtaggtattaaaat

SEQ ID NO: 13135 - DNA, 20 bp, Artificial sequence
  SiRNA target sequence
gtgacgtaggtattaaaata

SEQ ID NO: 13136 - DNA, 20 bp, Artificial sequence
  SiRNA target sequence
tgacgtaggtattaaaatat

SEQ ID NO: 13137 - DNA, 20 bp, Artificial sequence
  SiRNA target sequence
gacgtaggtattaaaatatc

SEQ ID NO: 13138 - DNA, 20 bp, Artificial sequence
  SiRNA target sequence
acgtaggtattaaaatatca

SEQ ID NO: 13139 - DNA, 20 bp, Artificial sequence
  SiRNA target sequence
cgtaggtattaaaatatcaa

SEQ ID NO: 13140 - DNA, 20 bp, Artificial sequence
  SiRNA target sequence
gtaggtattaaaatatcaac

SEQ ID NO: 13141 - DNA, 20 bp, Artificial sequence
  SiRNA target sequence
taggtattaaaatatcaact

SEQ ID NO: 13142 - DNA, 20 bp, Artificial sequence
  SiRNA target sequence
aggtattaaaatatcaactg

SEQ ID NO: 13143 - DNA, 20 bp, Artificial sequence
  SiRNA target sequence
ggtattaaaatatcaactga

SEQ ID NO: 13144 - DNA, 20 bp, Artificial sequence
  SiRNA target sequence
gtattaaaatatcaactgat

SEQ ID NO: 13145 - DNA, 20 bp, Artificial sequence
  SiRNA target sequence
tattaaaatatcaactgata

SEQ ID NO: 13146 - DNA, 20 bp, Artificial sequence
  SiRNA target sequence
attaaaatatcaactgatag

SEQ ID NO: 13147 - DNA, 20 bp, Artificial sequence
  SiRNA target sequence
ttaaaatatcaactgatagg

SEQ ID NO: 13148 - DNA, 20 bp, Artificial sequence
  SiRNA target sequence
taaaatatcaactgataggg

SEQ ID NO: 13149 - DNA, 20 bp, Artificial sequence
  SiRNA target sequence
aaaatatcaactgataggga

SEQ ID NO: 13150 - DNA, 20 bp, Artificial sequence
  SiRNA target sequence
aaatatcaactgatagggaa

SEQ ID NO: 13151 - DNA, 20 bp, Artificial sequence
  SiRNA target sequence
aatatcaactgatagggaaa

SEQ ID NO: 13152 - DNA, 20 bp, Artificial sequence
  SiRNA target sequence
atatcaactgatagggaaaa

SEQ ID NO: 13153 - DNA, 20 bp, Artificial sequence
  SiRNA target sequence
tatcaactgatagggaaaaa

SEQ ID NO: 13154 - DNA, 20 bp, Artificial sequence
  SiRNA target sequence
atcaactgatagggaaaaat

SEQ ID NO: 13155 - DNA, 20 bp, Artificial sequence
  SiRNA target sequence
tcaactgatagggaaaaatc

SEQ ID NO: 13156 - DNA, 20 bp, Artificial sequence
  SiRNA target sequence
caactgatagggaaaaatca

SEQ ID NO: 13157 - DNA, 20 bp, Artificial sequence
  SiRNA target sequence
aactgatagggaaaaatcag

SEQ ID NO: 13158 - DNA, 20 bp, Artificial sequence
  SiRNA target sequence
actgatagggaaaaatcagt

SEQ ID NO: 13159 - DNA, 20 bp, Artificial sequence
  SiRNA target sequence
ctgatagggaaaaatcagtt

SEQ ID NO: 13160 - DNA, 20 bp, Artificial sequence
  SiRNA target sequence
tgatagggaaaaatcagtta

SEQ ID NO: 13161 - DNA, 20 bp, Artificial sequence
  SiRNA target sequence
gatagggaaaaatcagttaa

SEQ ID NO: 13162 - DNA, 20 bp, Artificial sequence
  SiRNA target sequence
atagggaaaaatcagttaat

SEQ ID NO: 13163 - DNA, 20 bp, Artificial sequence
  SiRNA target sequence
tagggaaaaatcagttaatt

SEQ ID NO: 13164 - DNA, 20 bp, Artificial sequence
  SiRNA target sequence
agggaaaaatcagttaatta

SEQ ID NO: 13165 - DNA, 20 bp, Artificial sequence
  SiRNA target sequence
gggaaaaatcagttaattat

SEQ ID NO: 13166 - DNA, 20 bp, Artificial sequence
  SiRNA target sequence
ggaaaaatcagttaattatg

SEQ ID NO: 13167 - DNA, 20 bp, Artificial sequence
  SiRNA target sequence
gaaaaatcagttaattatgg

SEQ ID NO: 13168 - DNA, 20 bp, Artificial sequence
  SiRNA target sequence
aaaaatcagttaattatgga

SEQ ID NO: 13169 - DNA, 20 bp, Artificial sequence
  SiRNA target sequence
aaaatcagttaattatggat

SEQ ID NO: 13170 - DNA, 20 bp, Artificial sequence
  SiRNA target sequence
aaatcagttaattatggatt

SEQ ID NO: 13171 - DNA, 20 bp, Artificial sequence
  SiRNA target sequence
aatcagttaattatggatta

SEQ ID NO: 13172 - DNA, 20 bp, Artificial sequence
  SiRNA target sequence
atcagttaattatggattag

SEQ ID NO: 13173 - DNA, 20 bp, Artificial sequence
  SiRNA target sequence
tcagttaattatggattagg

SEQ ID NO: 13174 - DNA, 20 bp, Artificial sequence
  SiRNA target sequence
cagttaattatggattagga

SEQ ID NO: 13175 - DNA, 20 bp, Artificial sequence
  SiRNA target sequence
agttaattatggattaggag

SEQ ID NO: 13176 - DNA, 20 bp, Artificial sequence
  SiRNA target sequence
gttaattatggattaggagt

SEQ ID NO: 13177 - DNA, 20 bp, Artificial sequence
  SiRNA target sequence
ttaattatggattaggagtt

SEQ ID NO: 13178 - DNA, 20 bp, Artificial sequence
  SiRNA target sequence
taattatggattaggagtta

SEQ ID NO: 13179 - DNA, 20 bp, Artificial sequence
  SiRNA target sequence
aattatggattaggagttaa

SEQ ID NO: 13180 - DNA, 20 bp, Artificial sequence
  SiRNA target sequence
attatggattaggagttaaa

SEQ ID NO: 13181 - DNA, 20 bp, Artificial sequence
  SiRNA target sequence
ttatggattaggagttaaac

SEQ ID NO: 13182 - DNA, 20 bp, Artificial sequence
  SiRNA target sequence
tatggattaggagttaaact

SEQ ID NO: 13183 - DNA, 20 bp, Artificial sequence
  SiRNA target sequence
atggattaggagttaaacta

SEQ ID NO: 13184 - DNA, 20 bp, Artificial sequence
  SiRNA target sequence
tggattaggagttaaactac

SEQ ID NO: 13185 - DNA, 20 bp, Artificial sequence
  SiRNA target sequence
ggattaggagttaaactaca

SEQ ID NO: 13186 - DNA, 20 bp, Artificial sequence
  SiRNA target sequence
gattaggagttaaactacac

SEQ ID NO: 13187 - DNA, 20 bp, Artificial sequence
  SiRNA target sequence
attaggagttaaactacaca

SEQ ID NO: 13188 - DNA, 20 bp, Artificial sequence
  SiRNA target sequence
ttaggagttaaactacacag

SEQ ID NO: 13189 - DNA, 20 bp, Artificial sequence
  SiRNA target sequence
taggagttaaactacacagt

SEQ ID NO: 13190 - DNA, 20 bp, Artificial sequence
  SiRNA target sequence
aggagttaaactacacagta

SEQ ID NO: 13191 - DNA, 20 bp, Artificial sequence
  SiRNA target sequence
ggagttaaactacacagtaa

SEQ ID NO: 13192 - DNA, 20 bp, Artificial sequence
  SiRNA target sequence
gagttaaactacacagtaaa

SEQ ID NO: 13193 - DNA, 20 bp, Artificial sequence
  SiRNA target sequence
agttaaactacacagtaaaa

SEQ ID NO: 13194 - DNA, 20 bp, Artificial sequence
  SiRNA target sequence
gttaaactacacagtaaaaa

SEQ ID NO: 13195 - DNA, 20 bp, Artificial sequence
  SiRNA target sequence
ttaaactacacagtaaaaaa

SEQ ID NO: 13196 - DNA, 20 bp, Artificial sequence
  SiRNA target sequence
taaactacacagtaaaaaag

SEQ ID NO: 13197 - DNA, 20 bp, Artificial sequence
  SiRNA target sequence
aaactacacagtaaaaaagg

SEQ ID NO: 13198 - DNA, 20 bp, Artificial sequence
  SiRNA target sequence
aactacacagtaaaaaagga

SEQ ID NO: 13199 - DNA, 20 bp, Artificial sequence
  SiRNA target sequence
actacacagtaaaaaaggag

SEQ ID NO: 13200 - DNA, 20 bp, Artificial sequence
  SiRNA target sequence
ctacacagtaaaaaaggaga

SEQ ID NO: 13201 - DNA, 20 bp, Artificial sequence
  SiRNA target sequence
tacacagtaaaaaaggagaa

SEQ ID NO: 13202 - DNA, 20 bp, Artificial sequence
  SiRNA target sequence
acacagtaaaaaaggagaaa

SEQ ID NO: 13203 - DNA, 20 bp, Artificial sequence
  SiRNA target sequence
cacagtaaaaaaggagaaat

SEQ ID NO: 13204 - DNA, 20 bp, Artificial sequence
  SiRNA target sequence
acagtaaaaaaggagaaatt

SEQ ID NO: 13205 - DNA, 20 bp, Artificial sequence
  SiRNA target sequence
cagtaaaaaaggagaaatta

SEQ ID NO: 13206 - DNA, 20 bp, Artificial sequence
  SiRNA target sequence
agtaaaaaaggagaaattat

SEQ ID NO: 13207 - DNA, 20 bp, Artificial sequence
  SiRNA target sequence
gtaaaaaaggagaaattatc

SEQ ID NO: 13208 - DNA, 20 bp, Artificial sequence
  SiRNA target sequence
taaaaaaggagaaattatcg

SEQ ID NO: 13209 - DNA, 20 bp, Artificial sequence
  SiRNA target sequence
aaaaaaggagaaattatcgg

SEQ ID NO: 13210 - DNA, 20 bp, Artificial sequence
  SiRNA target sequence
aaaaaggagaaattatcgga

SEQ ID NO: 13211 - DNA, 20 bp, Artificial sequence
  SiRNA target sequence
aaaaggagaaattatcggat

SEQ ID NO: 13212 - DNA, 20 bp, Artificial sequence
  SiRNA target sequence
aaaggagaaattatcggatg

SEQ ID NO: 13213 - DNA, 20 bp, Artificial sequence
  SiRNA target sequence
aaggagaaattatcggatgt

SEQ ID NO: 13214 - DNA, 20 bp, Artificial sequence
  SiRNA target sequence
aggagaaattatcggatgtg

SEQ ID NO: 13215 - DNA, 20 bp, Artificial sequence
  SiRNA target sequence
ggagaaattatcggatgtgt

SEQ ID NO: 13216 - DNA, 20 bp, Artificial sequence
  SiRNA target sequence
gagaaattatcggatgtgta

SEQ ID NO: 13217 - DNA, 20 bp, Artificial sequence
  SiRNA target sequence
agaaattatcggatgtgtag

SEQ ID NO: 13218 - DNA, 20 bp, Artificial sequence
  SiRNA target sequence
gaaattatcggatgtgtaga

SEQ ID NO: 13219 - DNA, 20 bp, Artificial sequence
  SiRNA target sequence
aaattatcggatgtgtagat

SEQ ID NO: 13220 - DNA, 20 bp, Artificial sequence
  SiRNA target sequence
aattatcggatgtgtagata

SEQ ID NO: 13221 - DNA, 20 bp, Artificial sequence
  SiRNA target sequence
attatcggatgtgtagataa

SEQ ID NO: 13222 - DNA, 20 bp, Artificial sequence
  SiRNA target sequence
ttatcggatgtgtagataac

SEQ ID NO: 13223 - DNA, 20 bp, Artificial sequence
  SiRNA target sequence
tatcggatgtgtagataaca

SEQ ID NO: 13224 - DNA, 20 bp, Artificial sequence
  SiRNA target sequence
atcggatgtgtagataacaa

SEQ ID NO: 13225 - DNA, 20 bp, Artificial sequence
  SiRNA target sequence
tcggatgtgtagataacaat

SEQ ID NO: 13226 - DNA, 20 bp, Artificial sequence
  SiRNA target sequence
cggatgtgtagataacaatc

SEQ ID NO: 13227 - DNA, 20 bp, Artificial sequence
  SiRNA target sequence
ggatgtgtagataacaatca

SEQ ID NO: 13228 - DNA, 20 bp, Artificial sequence
  SiRNA target sequence
gatgtgtagataacaatcat

SEQ ID NO: 13229 - DNA, 20 bp, Artificial sequence
  SiRNA target sequence
atgtgtagataacaatcata

SEQ ID NO: 13230 - DNA, 20 bp, Artificial sequence
  SiRNA target sequence
tgtgtagataacaatcatat

SEQ ID NO: 13231 - DNA, 20 bp, Artificial sequence
  SiRNA target sequence
gtgtagataacaatcatatt

SEQ ID NO: 13232 - DNA, 20 bp, Artificial sequence
  SiRNA target sequence
tgtagataacaatcatattt

SEQ ID NO: 13233 - DNA, 20 bp, Artificial sequence
  SiRNA target sequence
gtagataacaatcatatttt

SEQ ID NO: 13234 - DNA, 20 bp, Artificial sequence
  SiRNA target sequence
tagataacaatcatatttta

SEQ ID NO: 13235 - DNA, 20 bp, Artificial sequence
  SiRNA target sequence
agataacaatcatattttaa

SEQ ID NO: 13236 - DNA, 20 bp, Artificial sequence
  SiRNA target sequence
gataacaatcatattttaag

SEQ ID NO: 13237 - DNA, 20 bp, Artificial sequence
  SiRNA target sequence
ataacaatcatattttaagc

SEQ ID NO: 13238 - DNA, 20 bp, Artificial sequence
  SiRNA target sequence
taacaatcatattttaagca

SEQ ID NO: 13239 - DNA, 20 bp, Artificial sequence
  SiRNA target sequence
aacaatcatattttaagcat

SEQ ID NO: 13240 - DNA, 20 bp, Artificial sequence
  SiRNA target sequence
acaatcatattttaagcata

SEQ ID NO: 13241 - DNA, 20 bp, Artificial sequence
  SiRNA target sequence
caatcatattttaagcataa

SEQ ID NO: 13242 - DNA, 20 bp, Artificial sequence
  SiRNA target sequence
aatcatattttaagcataat

SEQ ID NO: 13243 - DNA, 20 bp, Artificial sequence
  SiRNA target sequence
atcatattttaagcataatt

SEQ ID NO: 13244 - DNA, 20 bp, Artificial sequence
  SiRNA target sequence
tcatattttaagcataattt

SEQ ID NO: 13245 - DNA, 20 bp, Artificial sequence
  SiRNA target sequence
catattttaagcataattta

SEQ ID NO: 13246 - DNA, 20 bp, Artificial sequence
  SiRNA target sequence
atattttaagcataatttat

SEQ ID NO: 13247 - DNA, 20 bp, Artificial sequence
  SiRNA target sequence
tattttaagcataatttata

SEQ ID NO: 13248 - DNA, 20 bp, Artificial sequence
  SiRNA target sequence
attttaagcataatttataa

SEQ ID NO: 13249 - DNA, 20 bp, Artificial sequence
  SiRNA target sequence
ttttaagcataatttataat

SEQ ID NO: 13250 - DNA, 20 bp, Artificial sequence
  SiRNA target sequence
tttaagcataatttataatg

SEQ ID NO: 13251 - DNA, 20 bp, Artificial sequence
  SiRNA target sequence
ttaagcataatttataatga

SEQ ID NO: 13252 - DNA, 20 bp, Artificial sequence
  SiRNA target sequence
taagcataatttataatgat

SEQ ID NO: 13253 - DNA, 20 bp, Artificial sequence
  SiRNA target sequence
aagcataatttataatgata

SEQ ID NO: 13254 - DNA, 20 bp, Artificial sequence
  SiRNA target sequence
agcataatttataatgataa

SEQ ID NO: 13255 - DNA, 20 bp, Artificial sequence
  SiRNA target sequence
gcataatttataatgataaa

SEQ ID NO: 13256 - DNA, 20 bp, Artificial sequence
  SiRNA target sequence
cataatttataatgataaat

SEQ ID NO: 13257 - DNA, 20 bp, Artificial sequence
  SiRNA target sequence
ataatttataatgataaatt

SEQ ID NO: 13258 - DNA, 20 bp, Artificial sequence
  SiRNA target sequence
taatttataatgataaatta

SEQ ID NO: 13259 - DNA, 20 bp, Artificial sequence
  SiRNA target sequence
aatttataatgataaattat

SEQ ID NO: 13260 - DNA, 20 bp, Artificial sequence
  SiRNA target sequence
atttataatgataaattatc

SEQ ID NO: 13261 - DNA, 20 bp, Artificial sequence
  SiRNA target sequence
tttataatgataaattatct

SEQ ID NO: 13262 - DNA, 20 bp, Artificial sequence
  SiRNA target sequence
ttataatgataaattatctg

SEQ ID NO: 13263 - DNA, 20 bp, Artificial sequence
  SiRNA target sequence
tataatgataaattatctga

SEQ ID NO: 13264 - DNA, 20 bp, Artificial sequence
  SiRNA target sequence
ataatgataaattatctgaa

SEQ ID NO: 13265 - DNA, 20 bp, Artificial sequence
  SiRNA target sequence
taatgataaattatctgaag

SEQ ID NO: 13266 - DNA, 20 bp, Artificial sequence
  SiRNA target sequence
aatgataaattatctgaagg

SEQ ID NO: 13267 - DNA, 20 bp, Artificial sequence
  SiRNA target sequence
atgataaattatctgaaggg

SEQ ID NO: 13268 - DNA, 20 bp, Artificial sequence
  SiRNA target sequence
tgataaattatctgaagggt

SEQ ID NO: 13269 - DNA, 20 bp, Artificial sequence
  SiRNA target sequence
gataaattatctgaagggtt

SEQ ID NO: 13270 - DNA, 20 bp, Artificial sequence
  SiRNA target sequence
ataaattatctgaagggtta

SEQ ID NO: 13271 - DNA, 20 bp, Artificial sequence
  SiRNA target sequence
taaattatctgaagggttaa

SEQ ID NO: 13272 - DNA, 20 bp, Artificial sequence
  SiRNA target sequence
aaattatctgaagggttaac

SEQ ID NO: 13273 - DNA, 20 bp, Artificial sequence
  SiRNA target sequence
aattatctgaagggttaaca

SEQ ID NO: 13274 - DNA, 20 bp, Artificial sequence
  SiRNA target sequence
attatctgaagggttaacac

SEQ ID NO: 13275 - DNA, 20 bp, Artificial sequence
  SiRNA target sequence
ttatctgaagggttaacact

SEQ ID NO: 13276 - DNA, 20 bp, Artificial sequence
  SiRNA target sequence
tatctgaagggttaacactt

SEQ ID NO: 13277 - DNA, 20 bp, Artificial sequence
  SiRNA target sequence
atctgaagggttaacactta

SEQ ID NO: 13278 - DNA, 20 bp, Artificial sequence
  SiRNA target sequence
tctgaagggttaacacttaa

SEQ ID NO: 13279 - DNA, 20 bp, Artificial sequence
  SiRNA target sequence
ctgaagggttaacacttaat

SEQ ID NO: 13280 - DNA, 20 bp, Artificial sequence
  SiRNA target sequence
tgaagggttaacacttaatt

SEQ ID NO: 13281 - DNA, 20 bp, Artificial sequence
  SiRNA target sequence
gaagggttaacacttaattt

SEQ ID NO: 13282 - DNA, 20 bp, Artificial sequence
  SiRNA target sequence
aagggttaacacttaatttg

SEQ ID NO: 13283 - DNA, 20 bp, Artificial sequence
  SiRNA target sequence
agggttaacacttaatttga

SEQ ID NO: 13284 - DNA, 20 bp, Artificial sequence
  SiRNA target sequence
gggttaacacttaatttgag

SEQ ID NO: 13285 - DNA, 20 bp, Artificial sequence
  SiRNA target sequence
ggttaacacttaatttgagt

SEQ ID NO: 13286 - DNA, 20 bp, Artificial sequence
  SiRNA target sequence
gttaacacttaatttgagtt

SEQ ID NO: 13287 - DNA, 20 bp, Artificial sequence
  SiRNA target sequence
ttaacacttaatttgagttg

SEQ ID NO: 13288 - DNA, 20 bp, Artificial sequence
  SiRNA target sequence
taacacttaatttgagttgt

SEQ ID NO: 13289 - DNA, 20 bp, Artificial sequence
  SiRNA target sequence
aacacttaatttgagttgta

SEQ ID NO: 13290 - DNA, 20 bp, Artificial sequence
  SiRNA target sequence
acacttaatttgagttgtag

SEQ ID NO: 13291 - DNA, 20 bp, Artificial sequence
  SiRNA target sequence
cacttaatttgagttgtaga

SEQ ID NO: 13292 - DNA, 20 bp, Artificial sequence
  SiRNA target sequence
acttaatttgagttgtagat

SEQ ID NO: 13293 - DNA, 20 bp, Artificial sequence
  SiRNA target sequence
cttaatttgagttgtagatt

SEQ ID NO: 13294 - DNA, 20 bp, Artificial sequence
  SiRNA target sequence
ttaatttgagttgtagattt

SEQ ID NO: 13295 - DNA, 20 bp, Artificial sequence
  SiRNA target sequence
taatttgagttgtagatttg

SEQ ID NO: 13296 - DNA, 20 bp, Artificial sequence
  SiRNA target sequence
aatttgagttgtagatttgg

SEQ ID NO: 13297 - DNA, 20 bp, Artificial sequence
  SiRNA target sequence
atttgagttgtagatttggt

SEQ ID NO: 13298 - DNA, 20 bp, Artificial sequence
  SiRNA target sequence
tttgagttgtagatttggta

SEQ ID NO: 13299 - DNA, 20 bp, Artificial sequence
  SiRNA target sequence
ttgagttgtagatttggtaa

SEQ ID NO: 13300 - DNA, 20 bp, Artificial sequence
  SiRNA target sequence
tgagttgtagatttggtaag

SEQ ID NO: 13301 - DNA, 20 bp, Artificial sequence
  SiRNA target sequence
gagttgtagatttggtaaga

SEQ ID NO: 13302 - DNA, 20 bp, Artificial sequence
  SiRNA target sequence
agttgtagatttggtaagaa

SEQ ID NO: 13303 - DNA, 20 bp, Artificial sequence
  SiRNA target sequence
gttgtagatttggtaagaaa

SEQ ID NO: 13304 - DNA, 20 bp, Artificial sequence
  SiRNA target sequence
ttgtagatttggtaagaaag

SEQ ID NO: 13305 - DNA, 20 bp, Artificial sequence
  SiRNA target sequence
tgtagatttggtaagaaagt

SEQ ID NO: 13306 - DNA, 20 bp, Artificial sequence
  SiRNA target sequence
gtagatttggtaagaaagta

SEQ ID NO: 13307 - DNA, 20 bp, Artificial sequence
  SiRNA target sequence
tagatttggtaagaaagtat

SEQ ID NO: 13308 - DNA, 20 bp, Artificial sequence
  SiRNA target sequence
agatttggtaagaaagtatt

SEQ ID NO: 13309 - DNA, 20 bp, Artificial sequence
  SiRNA target sequence
gatttggtaagaaagtattt

SEQ ID NO: 13310 - DNA, 20 bp, Artificial sequence
  SiRNA target sequence
atttggtaagaaagtatttg

SEQ ID NO: 13311 - DNA, 20 bp, Artificial sequence
  SiRNA target sequence
tttggtaagaaagtatttga

SEQ ID NO: 13312 - DNA, 20 bp, Artificial sequence
  SiRNA target sequence
ttggtaagaaagtatttgat

SEQ ID NO: 13313 - DNA, 20 bp, Artificial sequence
  SiRNA target sequence
tggtaagaaagtatttgatt

SEQ ID NO: 13314 - DNA, 20 bp, Artificial sequence
  SiRNA target sequence
ggtaagaaagtatttgatta

SEQ ID NO: 13315 - DNA, 20 bp, Artificial sequence
  SiRNA target sequence
gtaagaaagtatttgattat

SEQ ID NO: 13316 - DNA, 20 bp, Artificial sequence
  SiRNA target sequence
taagaaagtatttgattatg

SEQ ID NO: 13317 - DNA, 20 bp, Artificial sequence
  SiRNA target sequence
aagaaagtatttgattatgg

SEQ ID NO: 13318 - DNA, 20 bp, Artificial sequence
  SiRNA target sequence
agaaagtatttgattatggc

SEQ ID NO: 13319 - DNA, 20 bp, Artificial sequence
  SiRNA target sequence
gaaagtatttgattatggct

SEQ ID NO: 13320 - DNA, 20 bp, Artificial sequence
  SiRNA target sequence
aaagtatttgattatggcta

SEQ ID NO: 13321 - DNA, 20 bp, Artificial sequence
  SiRNA target sequence
aagtatttgattatggctat

SEQ ID NO: 13322 - DNA, 20 bp, Artificial sequence
  SiRNA target sequence
agtatttgattatggctatg

SEQ ID NO: 13323 - DNA, 20 bp, Artificial sequence
  SiRNA target sequence
gtatttgattatggctatgg

SEQ ID NO: 13324 - DNA, 20 bp, Artificial sequence
  SiRNA target sequence
tatttgattatggctatggg

SEQ ID NO: 13325 - DNA, 20 bp, Artificial sequence
  SiRNA target sequence
atttgattatggctatgggt

SEQ ID NO: 13326 - DNA, 20 bp, Artificial sequence
  SiRNA target sequence
tttgattatggctatgggtt

SEQ ID NO: 13327 - DNA, 20 bp, Artificial sequence
  SiRNA target sequence
ttgattatggctatgggttt

SEQ ID NO: 13328 - DNA, 20 bp, Artificial sequence
  SiRNA target sequence
tgattatggctatgggttta

SEQ ID NO: 13329 - DNA, 20 bp, Artificial sequence
  SiRNA target sequence
gattatggctatgggtttat

SEQ ID NO: 13330 - DNA, 20 bp, Artificial sequence
  SiRNA target sequence
attatggctatgggtttatt

SEQ ID NO: 13331 - DNA, 20 bp, Artificial sequence
  SiRNA target sequence
ttatggctatgggtttattt

SEQ ID NO: 13332 - DNA, 20 bp, Artificial sequence
  SiRNA target sequence
tatggctatgggtttattta

SEQ ID NO: 13333 - DNA, 20 bp, Artificial sequence
  SiRNA target sequence
atggctatgggtttatttat

SEQ ID NO: 13334 - DNA, 20 bp, Artificial sequence
  SiRNA target sequence
tggctatgggtttatttatg

SEQ ID NO: 13335 - DNA, 20 bp, Artificial sequence
  SiRNA target sequence
ggctatgggtttatttatga

SEQ ID NO: 13336 - DNA, 20 bp, Artificial sequence
  SiRNA target sequence
gctatgggtttatttatgaa

SEQ ID NO: 13337 - DNA, 20 bp, Artificial sequence
  SiRNA target sequence
ctatgggtttatttatgaat

SEQ ID NO: 13338 - DNA, 20 bp, Artificial sequence
  SiRNA target sequence
tatgggtttatttatgaatt

SEQ ID NO: 13339 - DNA, 20 bp, Artificial sequence
  SiRNA target sequence
atgggtttatttatgaattt

SEQ ID NO: 13340 - DNA, 20 bp, Artificial sequence
  SiRNA target sequence
tgggtttatttatgaatttt

SEQ ID NO: 13341 - DNA, 20 bp, Artificial sequence
  SiRNA target sequence
gggtttatttatgaatttta

SEQ ID NO: 13342 - DNA, 20 bp, Artificial sequence
  SiRNA target sequence
ggtttatttatgaattttaa

SEQ ID NO: 13343 - DNA, 21 bp, Artificial sequence
  SiRNA target sequence
atgaaatctttctacaaaaaa

SEQ ID NO: 13344 - DNA, 21 bp, Artificial sequence
  SiRNA target sequence
tgaaatctttctacaaaaaaa

SEQ ID NO: 13345 - DNA, 21 bp, Artificial sequence
  SiRNA target sequence
gaaatctttctacaaaaaaat

SEQ ID NO: 13346 - DNA, 21 bp, Artificial sequence
  SiRNA target sequence
aaatctttctacaaaaaaata

SEQ ID NO: 13347 - DNA, 21 bp, Artificial sequence
  SiRNA target sequence
aatctttctacaaaaaaataa

SEQ ID NO: 13348 - DNA, 21 bp, Artificial sequence
  SiRNA target sequence
atctttctacaaaaaaataaa

SEQ ID NO: 13349 - DNA, 21 bp, Artificial sequence
  SiRNA target sequence
tctttctacaaaaaaataaaa

SEQ ID NO: 13350 - DNA, 21 bp, Artificial sequence
  SiRNA target sequence
ctttctacaaaaaaataaaaa

SEQ ID NO: 13351 - DNA, 21 bp, Artificial sequence
  SiRNA target sequence
tttctacaaaaaaataaaaag

SEQ ID NO: 13352 - DNA, 21 bp, Artificial sequence
  SiRNA target sequence
ttctacaaaaaaataaaaagt

SEQ ID NO: 13353 - DNA, 21 bp, Artificial sequence
  SiRNA target sequence
tctacaaaaaaataaaaagtt

SEQ ID NO: 13354 - DNA, 21 bp, Artificial sequence
  SiRNA target sequence
ctacaaaaaaataaaaagtta

SEQ ID NO: 13355 - DNA, 21 bp, Artificial sequence
  SiRNA target sequence
tacaaaaaaataaaaagttat

SEQ ID NO: 13356 - DNA, 21 bp, Artificial sequence
  SiRNA target sequence
acaaaaaaataaaaagttatt

SEQ ID NO: 13357 - DNA, 21 bp, Artificial sequence
  SiRNA target sequence
caaaaaaataaaaagttattt

SEQ ID NO: 13358 - DNA, 21 bp, Artificial sequence
  SiRNA target sequence
aaaaaaataaaaagttattta

SEQ ID NO: 13359 - DNA, 21 bp, Artificial sequence
  SiRNA target sequence
aaaaaataaaaagttatttat

SEQ ID NO: 13360 - DNA, 21 bp, Artificial sequence
  SiRNA target sequence
aaaaataaaaagttatttatt

SEQ ID NO: 13361 - DNA, 21 bp, Artificial sequence
  SiRNA target sequence
aaaataaaaagttatttattc

SEQ ID NO: 13362 - DNA, 21 bp, Artificial sequence
  SiRNA target sequence
aaataaaaagttatttattca

SEQ ID NO: 13363 - DNA, 21 bp, Artificial sequence
  SiRNA target sequence
aataaaaagttatttattcaa

SEQ ID NO: 13364 - DNA, 21 bp, Artificial sequence
  SiRNA target sequence
ataaaaagttatttattcaaa

SEQ ID NO: 13365 - DNA, 21 bp, Artificial sequence
  SiRNA target sequence
taaaaagttatttattcaaat

SEQ ID NO: 13366 - DNA, 21 bp, Artificial sequence
  SiRNA target sequence
aaaaagttatttattcaaatc

SEQ ID NO: 13367 - DNA, 21 bp, Artificial sequence
  SiRNA target sequence
aaaagttatttattcaaatct

SEQ ID NO: 13368 - DNA, 21 bp, Artificial sequence
  SiRNA target sequence
aaagttatttattcaaatctg

SEQ ID NO: 13369 - DNA, 21 bp, Artificial sequence
  SiRNA target sequence
aagttatttattcaaatctgc

SEQ ID NO: 13370 - DNA, 21 bp, Artificial sequence
  SiRNA target sequence
agttatttattcaaatctgcc

SEQ ID NO: 13371 - DNA, 21 bp, Artificial sequence
  SiRNA target sequence
gttatttattcaaatctgcca

SEQ ID NO: 13372 - DNA, 21 bp, Artificial sequence
  SiRNA target sequence
ttatttattcaaatctgccat

SEQ ID NO: 13373 - DNA, 21 bp, Artificial sequence
  SiRNA target sequence
tatttattcaaatctgccatt

SEQ ID NO: 13374 - DNA, 21 bp, Artificial sequence
  SiRNA target sequence
atttattcaaatctgccatta

SEQ ID NO: 13375 - DNA, 21 bp, Artificial sequence
  SiRNA target sequence
tttattcaaatctgccattaa

SEQ ID NO: 13376 - DNA, 21 bp, Artificial sequence
  SiRNA target sequence
ttattcaaatctgccattaat

SEQ ID NO: 13377 - DNA, 21 bp, Artificial sequence
  SiRNA target sequence
tattcaaatctgccattaata

SEQ ID NO: 13378 - DNA, 21 bp, Artificial sequence
  SiRNA target sequence
attcaaatctgccattaatac

SEQ ID NO: 13379 - DNA, 21 bp, Artificial sequence
  SiRNA target sequence
ttcaaatctgccattaataca

SEQ ID NO: 13380 - DNA, 21 bp, Artificial sequence
  SiRNA target sequence
tcaaatctgccattaatacat

SEQ ID NO: 13381 - DNA, 21 bp, Artificial sequence
  SiRNA target sequence
caaatctgccattaatacatc

SEQ ID NO: 13382 - DNA, 21 bp, Artificial sequence
  SiRNA target sequence
aaatctgccattaatacatct

SEQ ID NO: 13383 - DNA, 21 bp, Artificial sequence
  SiRNA target sequence
aatctgccattaatacatctt

SEQ ID NO: 13384 - DNA, 21 bp, Artificial sequence
  SiRNA target sequence
atctgccattaatacatcttt

SEQ ID NO: 13385 - DNA, 21 bp, Artificial sequence
  SiRNA target sequence
tctgccattaatacatctttt

SEQ ID NO: 13386 - DNA, 21 bp, Artificial sequence
  SiRNA target sequence
ctgccattaatacatcttttg

SEQ ID NO: 13387 - DNA, 21 bp, Artificial sequence
  SiRNA target sequence
tgccattaatacatcttttga

SEQ ID NO: 13388 - DNA, 21 bp, Artificial sequence
  SiRNA target sequence
gccattaatacatcttttgat

SEQ ID NO: 13389 - DNA, 21 bp, Artificial sequence
  SiRNA target sequence
ccattaatacatcttttgata

SEQ ID NO: 13390 - DNA, 21 bp, Artificial sequence
  SiRNA target sequence
cattaatacatcttttgatac

SEQ ID NO: 13391 - DNA, 21 bp, Artificial sequence
  SiRNA target sequence
attaatacatcttttgatact

SEQ ID NO: 13392 - DNA, 21 bp, Artificial sequence
  SiRNA target sequence
ttaatacatcttttgatactt

SEQ ID NO: 13393 - DNA, 21 bp, Artificial sequence
  SiRNA target sequence
taatacatcttttgatacttt

SEQ ID NO: 13394 - DNA, 21 bp, Artificial sequence
  SiRNA target sequence
aatacatcttttgatactttt

SEQ ID NO: 13395 - DNA, 21 bp, Artificial sequence
  SiRNA target sequence
atacatcttttgatactttta

SEQ ID NO: 13396 - DNA, 21 bp, Artificial sequence
  SiRNA target sequence
tacatcttttgatacttttaa

SEQ ID NO: 13397 - DNA, 21 bp, Artificial sequence
  SiRNA target sequence
acatcttttgatacttttaat

SEQ ID NO: 13398 - DNA, 21 bp, Artificial sequence
  SiRNA target sequence
catcttttgatacttttaatt

SEQ ID NO: 13399 - DNA, 21 bp, Artificial sequence
  SiRNA target sequence
atcttttgatacttttaattt

SEQ ID NO: 13400 - DNA, 21 bp, Artificial sequence
  SiRNA target sequence
tcttttgatacttttaattta

SEQ ID NO: 13401 - DNA, 21 bp, Artificial sequence
  SiRNA target sequence
cttttgatacttttaatttag

SEQ ID NO: 13402 - DNA, 21 bp, Artificial sequence
  SiRNA target sequence
ttttgatacttttaatttaga

SEQ ID NO: 13403 - DNA, 21 bp, Artificial sequence
  SiRNA target sequence
tttgatacttttaatttagaa

SEQ ID NO: 13404 - DNA, 21 bp, Artificial sequence
  SiRNA target sequence
ttgatacttttaatttagaaa

SEQ ID NO: 13405 - DNA, 21 bp, Artificial sequence
  SiRNA target sequence
tgatacttttaatttagaaaa

SEQ ID NO: 13406 - DNA, 21 bp, Artificial sequence
  SiRNA target sequence
gatacttttaatttagaaaat

SEQ ID NO: 13407 - DNA, 21 bp, Artificial sequence
  SiRNA target sequence
atacttttaatttagaaaatg

SEQ ID NO: 13408 - DNA, 21 bp, Artificial sequence
  SiRNA target sequence
tacttttaatttagaaaatgt

SEQ ID NO: 13409 - DNA, 21 bp, Artificial sequence
  SiRNA target sequence
acttttaatttagaaaatgta

SEQ ID NO: 13410 - DNA, 21 bp, Artificial sequence
  SiRNA target sequence
cttttaatttagaaaatgtaa

SEQ ID NO: 13411 - DNA, 21 bp, Artificial sequence
  SiRNA target sequence
ttttaatttagaaaatgtaag

SEQ ID NO: 13412 - DNA, 21 bp, Artificial sequence
  SiRNA target sequence
tttaatttagaaaatgtaagc

SEQ ID NO: 13413 - DNA, 21 bp, Artificial sequence
  SiRNA target sequence
ttaatttagaaaatgtaagca

SEQ ID NO: 13414 - DNA, 21 bp, Artificial sequence
  SiRNA target sequence
taatttagaaaatgtaagcat

SEQ ID NO: 13415 - DNA, 21 bp, Artificial sequence
  SiRNA target sequence
aatttagaaaatgtaagcatt

SEQ ID NO: 13416 - DNA, 21 bp, Artificial sequence
  SiRNA target sequence
atttagaaaatgtaagcatta

SEQ ID NO: 13417 - DNA, 21 bp, Artificial sequence
  SiRNA target sequence
tttagaaaatgtaagcattac

SEQ ID NO: 13418 - DNA, 21 bp, Artificial sequence
  SiRNA target sequence
ttagaaaatgtaagcattact

SEQ ID NO: 13419 - DNA, 21 bp, Artificial sequence
  SiRNA target sequence
tagaaaatgtaagcattacta

SEQ ID NO: 13420 - DNA, 21 bp, Artificial sequence
  SiRNA target sequence
agaaaatgtaagcattactag

SEQ ID NO: 13421 - DNA, 21 bp, Artificial sequence
  SiRNA target sequence
gaaaatgtaagcattactagc

SEQ ID NO: 13422 - DNA, 21 bp, Artificial sequence
  SiRNA target sequence
aaaatgtaagcattactagct

SEQ ID NO: 13423 - DNA, 21 bp, Artificial sequence
  SiRNA target sequence
aaatgtaagcattactagctt

SEQ ID NO: 13424 - DNA, 21 bp, Artificial sequence
  SiRNA target sequence
aatgtaagcattactagctta

SEQ ID NO: 13425 - DNA, 21 bp, Artificial sequence
  SiRNA target sequence
atgtaagcattactagcttaa

SEQ ID NO: 13426 - DNA, 21 bp, Artificial sequence
  SiRNA target sequence
tgtaagcattactagcttaaa

SEQ ID NO: 13427 - DNA, 21 bp, Artificial sequence
  SiRNA target sequence
gtaagcattactagcttaaat

SEQ ID NO: 13428 - DNA, 21 bp, Artificial sequence
  SiRNA target sequence
taagcattactagcttaaata

SEQ ID NO: 13429 - DNA, 21 bp, Artificial sequence
  SiRNA target sequence
aagcattactagcttaaatac

SEQ ID NO: 13430 - DNA, 21 bp, Artificial sequence
  SiRNA target sequence
agcattactagcttaaatacg

SEQ ID NO: 13431 - DNA, 21 bp, Artificial sequence
  SiRNA target sequence
gcattactagcttaaatacgt

SEQ ID NO: 13432 - DNA, 21 bp, Artificial sequence
  SiRNA target sequence
cattactagcttaaatacgta

SEQ ID NO: 13433 - DNA, 21 bp, Artificial sequence
  SiRNA target sequence
attactagcttaaatacgtac

SEQ ID NO: 13434 - DNA, 21 bp, Artificial sequence
  SiRNA target sequence
ttactagcttaaatacgtaca

SEQ ID NO: 13435 - DNA, 21 bp, Artificial sequence
  SiRNA target sequence
tactagcttaaatacgtacac

SEQ ID NO: 13436 - DNA, 21 bp, Artificial sequence
  SiRNA target sequence
actagcttaaatacgtacacc

SEQ ID NO: 13437 - DNA, 21 bp, Artificial sequence
  SiRNA target sequence
ctagcttaaatacgtacaccg

SEQ ID NO: 13438 - DNA, 21 bp, Artificial sequence
  SiRNA target sequence
tagcttaaatacgtacaccgg

SEQ ID NO: 13439 - DNA, 21 bp, Artificial sequence
  SiRNA target sequence
agcttaaatacgtacaccggt

SEQ ID NO: 13440 - DNA, 21 bp, Artificial sequence
  SiRNA target sequence
gcttaaatacgtacaccggtg

SEQ ID NO: 13441 - DNA, 21 bp, Artificial sequence
  SiRNA target sequence
cttaaatacgtacaccggtgt

SEQ ID NO: 13442 - DNA, 21 bp, Artificial sequence
  SiRNA target sequence
ttaaatacgtacaccggtgtt

SEQ ID NO: 13443 - DNA, 21 bp, Artificial sequence
  SiRNA target sequence
taaatacgtacaccggtgtta

SEQ ID NO: 13444 - DNA, 21 bp, Artificial sequence
  SiRNA target sequence
aaatacgtacaccggtgttaa

SEQ ID NO: 13445 - DNA, 21 bp, Artificial sequence
  SiRNA target sequence
aatacgtacaccggtgttaaa

SEQ ID NO: 13446 - DNA, 21 bp, Artificial sequence
  SiRNA target sequence
atacgtacaccggtgttaaaa

SEQ ID NO: 13447 - DNA, 21 bp, Artificial sequence
  SiRNA target sequence
tacgtacaccggtgttaaaac

SEQ ID NO: 13448 - DNA, 21 bp, Artificial sequence
  SiRNA target sequence
acgtacaccggtgttaaaacc

SEQ ID NO: 13449 - DNA, 21 bp, Artificial sequence
  SiRNA target sequence
cgtacaccggtgttaaaaccg

SEQ ID NO: 13450 - DNA, 21 bp, Artificial sequence
  SiRNA target sequence
gtacaccggtgttaaaaccga

SEQ ID NO: 13451 - DNA, 21 bp, Artificial sequence
  SiRNA target sequence
tacaccggtgttaaaaccgaa

SEQ ID NO: 13452 - DNA, 21 bp, Artificial sequence
  SiRNA target sequence
acaccggtgttaaaaccgaaa

SEQ ID NO: 13453 - DNA, 21 bp, Artificial sequence
  SiRNA target sequence
caccggtgttaaaaccgaaat

SEQ ID NO: 13454 - DNA, 21 bp, Artificial sequence
  SiRNA target sequence
accggtgttaaaaccgaaata

SEQ ID NO: 13455 - DNA, 21 bp, Artificial sequence
  SiRNA target sequence
ccggtgttaaaaccgaaatat

SEQ ID NO: 13456 - DNA, 21 bp, Artificial sequence
  SiRNA target sequence
cggtgttaaaaccgaaatatc

SEQ ID NO: 13457 - DNA, 21 bp, Artificial sequence
  SiRNA target sequence
ggtgttaaaaccgaaatatca

SEQ ID NO: 13458 - DNA, 21 bp, Artificial sequence
  SiRNA target sequence
gtgttaaaaccgaaatatcaa

SEQ ID NO: 13459 - DNA, 21 bp, Artificial sequence
  SiRNA target sequence
tgttaaaaccgaaatatcaaa

SEQ ID NO: 13460 - DNA, 21 bp, Artificial sequence
  SiRNA target sequence
gttaaaaccgaaatatcaaaa

SEQ ID NO: 13461 - DNA, 21 bp, Artificial sequence
  SiRNA target sequence
ttaaaaccgaaatatcaaaaa

SEQ ID NO: 13462 - DNA, 21 bp, Artificial sequence
  SiRNA target sequence
taaaaccgaaatatcaaaaac

SEQ ID NO: 13463 - DNA, 21 bp, Artificial sequence
  SiRNA target sequence
aaaaccgaaatatcaaaaacc

SEQ ID NO: 13464 - DNA, 21 bp, Artificial sequence
  SiRNA target sequence
aaaccgaaatatcaaaaaccg

SEQ ID NO: 13465 - DNA, 21 bp, Artificial sequence
  SiRNA target sequence
aaccgaaatatcaaaaaccgt

SEQ ID NO: 13466 - DNA, 21 bp, Artificial sequence
  SiRNA target sequence
accgaaatatcaaaaaccgta

SEQ ID NO: 13467 - DNA, 21 bp, Artificial sequence
  SiRNA target sequence
ccgaaatatcaaaaaccgtat

SEQ ID NO: 13468 - DNA, 21 bp, Artificial sequence
  SiRNA target sequence
cgaaatatcaaaaaccgtatc

SEQ ID NO: 13469 - DNA, 21 bp, Artificial sequence
  SiRNA target sequence
gaaatatcaaaaaccgtatca

SEQ ID NO: 13470 - DNA, 21 bp, Artificial sequence
  SiRNA target sequence
aaatatcaaaaaccgtatcac

SEQ ID NO: 13471 - DNA, 21 bp, Artificial sequence
  SiRNA target sequence
aatatcaaaaaccgtatcacc

SEQ ID NO: 13472 - DNA, 21 bp, Artificial sequence
  SiRNA target sequence
atatcaaaaaccgtatcacca

SEQ ID NO: 13473 - DNA, 21 bp, Artificial sequence
  SiRNA target sequence
tatcaaaaaccgtatcaccac

SEQ ID NO: 13474 - DNA, 21 bp, Artificial sequence
  SiRNA target sequence
atcaaaaaccgtatcaccaca

SEQ ID NO: 13475 - DNA, 21 bp, Artificial sequence
  SiRNA target sequence
tcaaaaaccgtatcaccacac

SEQ ID NO: 13476 - DNA, 21 bp, Artificial sequence
  SiRNA target sequence
caaaaaccgtatcaccacact

SEQ ID NO: 13477 - DNA, 21 bp, Artificial sequence
  SiRNA target sequence
aaaaaccgtatcaccacactt

SEQ ID NO: 13478 - DNA, 21 bp, Artificial sequence
  SiRNA target sequence
aaaaccgtatcaccacacttc

SEQ ID NO: 13479 - DNA, 21 bp, Artificial sequence
  SiRNA target sequence
aaaccgtatcaccacacttcc

SEQ ID NO: 13480 - DNA, 21 bp, Artificial sequence
  SiRNA target sequence
aaccgtatcaccacacttcca

SEQ ID NO: 13481 - DNA, 21 bp, Artificial sequence
  SiRNA target sequence
accgtatcaccacacttccag

SEQ ID NO: 13482 - DNA, 21 bp, Artificial sequence
  SiRNA target sequence
ccgtatcaccacacttccaga

SEQ ID NO: 13483 - DNA, 21 bp, Artificial sequence
  SiRNA target sequence
cgtatcaccacacttccagat

SEQ ID NO: 13484 - DNA, 21 bp, Artificial sequence
  SiRNA target sequence
gtatcaccacacttccagatt

SEQ ID NO: 13485 - DNA, 21 bp, Artificial sequence
  SiRNA target sequence
tatcaccacacttccagattt

SEQ ID NO: 13486 - DNA, 21 bp, Artificial sequence
  SiRNA target sequence
atcaccacacttccagatttc

SEQ ID NO: 13487 - DNA, 21 bp, Artificial sequence
  SiRNA target sequence
tcaccacacttccagatttct

SEQ ID NO: 13488 - DNA, 21 bp, Artificial sequence
  SiRNA target sequence
caccacacttccagatttctc

SEQ ID NO: 13489 - DNA, 21 bp, Artificial sequence
  SiRNA target sequence
accacacttccagatttctca

SEQ ID NO: 13490 - DNA, 21 bp, Artificial sequence
  SiRNA target sequence
ccacacttccagatttctcat

SEQ ID NO: 13491 - DNA, 21 bp, Artificial sequence
  SiRNA target sequence
cacacttccagatttctcatg

SEQ ID NO: 13492 - DNA, 21 bp, Artificial sequence
  SiRNA target sequence
acacttccagatttctcatgt

SEQ ID NO: 13493 - DNA, 21 bp, Artificial sequence
  SiRNA target sequence
cacttccagatttctcatgtc

SEQ ID NO: 13494 - DNA, 21 bp, Artificial sequence
  SiRNA target sequence
acttccagatttctcatgtct

SEQ ID NO: 13495 - DNA, 21 bp, Artificial sequence
  SiRNA target sequence
cttccagatttctcatgtctc

SEQ ID NO: 13496 - DNA, 21 bp, Artificial sequence
  SiRNA target sequence
ttccagatttctcatgtctct

SEQ ID NO: 13497 - DNA, 21 bp, Artificial sequence
  SiRNA target sequence
tccagatttctcatgtctctt

SEQ ID NO: 13498 - DNA, 21 bp, Artificial sequence
  SiRNA target sequence
ccagatttctcatgtctcttc

SEQ ID NO: 13499 - DNA, 21 bp, Artificial sequence
  SiRNA target sequence
cagatttctcatgtctcttct

SEQ ID NO: 13500 - DNA, 21 bp, Artificial sequence
  SiRNA target sequence
agatttctcatgtctcttcta

SEQ ID NO: 13501 - DNA, 21 bp, Artificial sequence
  SiRNA target sequence
gatttctcatgtctcttctat

SEQ ID NO: 13502 - DNA, 21 bp, Artificial sequence
  SiRNA target sequence
atttctcatgtctcttctatg

SEQ ID NO: 13503 - DNA, 21 bp, Artificial sequence
  SiRNA target sequence
tttctcatgtctcttctatgg

SEQ ID NO: 13504 - DNA, 21 bp, Artificial sequence
  SiRNA target sequence
ttctcatgtctcttctatggg

SEQ ID NO: 13505 - DNA, 21 bp, Artificial sequence
  SiRNA target sequence
tctcatgtctcttctatgggc

SEQ ID NO: 13506 - DNA, 21 bp, Artificial sequence
  SiRNA target sequence
ctcatgtctcttctatgggcg

SEQ ID NO: 13507 - DNA, 21 bp, Artificial sequence
  SiRNA target sequence
tcatgtctcttctatgggcgc

SEQ ID NO: 13508 - DNA, 21 bp, Artificial sequence
  SiRNA target sequence
catgtctcttctatgggcgca

SEQ ID NO: 13509 - DNA, 21 bp, Artificial sequence
  SiRNA target sequence
atgtctcttctatgggcgcag

SEQ ID NO: 13510 - DNA, 21 bp, Artificial sequence
  SiRNA target sequence
tgtctcttctatgggcgcaga

SEQ ID NO: 13511 - DNA, 21 bp, Artificial sequence
  SiRNA target sequence
gtctcttctatgggcgcagat

SEQ ID NO: 13512 - DNA, 21 bp, Artificial sequence
  SiRNA target sequence
tctcttctatgggcgcagatt

SEQ ID NO: 13513 - DNA, 21 bp, Artificial sequence
  SiRNA target sequence
ctcttctatgggcgcagattt

SEQ ID NO: 13514 - DNA, 21 bp, Artificial sequence
  SiRNA target sequence
tcttctatgggcgcagatttc

SEQ ID NO: 13515 - DNA, 21 bp, Artificial sequence
  SiRNA target sequence
cttctatgggcgcagatttcg

SEQ ID NO: 13516 - DNA, 21 bp, Artificial sequence
  SiRNA target sequence
ttctatgggcgcagatttcga

SEQ ID NO: 13517 - DNA, 21 bp, Artificial sequence
  SiRNA target sequence
tctatgggcgcagatttcgac

SEQ ID NO: 13518 - DNA, 21 bp, Artificial sequence
  SiRNA target sequence
ctatgggcgcagatttcgaca

SEQ ID NO: 13519 - DNA, 21 bp, Artificial sequence
  SiRNA target sequence
tatgggcgcagatttcgacat

SEQ ID NO: 13520 - DNA, 21 bp, Artificial sequence
  SiRNA target sequence
atgggcgcagatttcgacata

SEQ ID NO: 13521 - DNA, 21 bp, Artificial sequence
  SiRNA target sequence
tgggcgcagatttcgacataa

SEQ ID NO: 13522 - DNA, 21 bp, Artificial sequence
  SiRNA target sequence
gggcgcagatttcgacataaa

SEQ ID NO: 13523 - DNA, 21 bp, Artificial sequence
  SiRNA target sequence
ggcgcagatttcgacataaaa

SEQ ID NO: 13524 - DNA, 21 bp, Artificial sequence
  SiRNA target sequence
gcgcagatttcgacataaaac

SEQ ID NO: 13525 - DNA, 21 bp, Artificial sequence
  SiRNA target sequence
cgcagatttcgacataaaaca

SEQ ID NO: 13526 - DNA, 21 bp, Artificial sequence
  SiRNA target sequence
gcagatttcgacataaaacag

SEQ ID NO: 13527 - DNA, 21 bp, Artificial sequence
  SiRNA target sequence
cagatttcgacataaaacaga

SEQ ID NO: 13528 - DNA, 21 bp, Artificial sequence
  SiRNA target sequence
agatttcgacataaaacagac

SEQ ID NO: 13529 - DNA, 21 bp, Artificial sequence
  SiRNA target sequence
gatttcgacataaaacagaca

SEQ ID NO: 13530 - DNA, 21 bp, Artificial sequence
  SiRNA target sequence
atttcgacataaaacagacat

SEQ ID NO: 13531 - DNA, 21 bp, Artificial sequence
  SiRNA target sequence
tttcgacataaaacagacata

SEQ ID NO: 13532 - DNA, 21 bp, Artificial sequence
  SiRNA target sequence
ttcgacataaaacagacatac

SEQ ID NO: 13533 - DNA, 21 bp, Artificial sequence
  SiRNA target sequence
tcgacataaaacagacatacg

SEQ ID NO: 13534 - DNA, 21 bp, Artificial sequence
  SiRNA target sequence
cgacataaaacagacatacgc

SEQ ID NO: 13535 - DNA, 21 bp, Artificial sequence
  SiRNA target sequence
gacataaaacagacatacgcc

SEQ ID NO: 13536 - DNA, 21 bp, Artificial sequence
  SiRNA target sequence
acataaaacagacatacgcca

SEQ ID NO: 13537 - DNA, 21 bp, Artificial sequence
  SiRNA target sequence
cataaaacagacatacgccac

SEQ ID NO: 13538 - DNA, 21 bp, Artificial sequence
  SiRNA target sequence
ataaaacagacatacgccacg

SEQ ID NO: 13539 - DNA, 21 bp, Artificial sequence
  SiRNA target sequence
taaaacagacatacgccacgt

SEQ ID NO: 13540 - DNA, 21 bp, Artificial sequence
  SiRNA target sequence
aaaacagacatacgccacgtt

SEQ ID NO: 13541 - DNA, 21 bp, Artificial sequence
  SiRNA target sequence
aaacagacatacgccacgttc

SEQ ID NO: 13542 - DNA, 21 bp, Artificial sequence
  SiRNA target sequence
aacagacatacgccacgttct

SEQ ID NO: 13543 - DNA, 21 bp, Artificial sequence
  SiRNA target sequence
acagacatacgccacgttctg

SEQ ID NO: 13544 - DNA, 21 bp, Artificial sequence
  SiRNA target sequence
cagacatacgccacgttctgc

SEQ ID NO: 13545 - DNA, 21 bp, Artificial sequence
  SiRNA target sequence
agacatacgccacgttctgct

SEQ ID NO: 13546 - DNA, 21 bp, Artificial sequence
  SiRNA target sequence
gacatacgccacgttctgctt

SEQ ID NO: 13547 - DNA, 21 bp, Artificial sequence
  SiRNA target sequence
acatacgccacgttctgcttt

SEQ ID NO: 13548 - DNA, 21 bp, Artificial sequence
  SiRNA target sequence
catacgccacgttctgcttta

SEQ ID NO: 13549 - DNA, 21 bp, Artificial sequence
  SiRNA target sequence
atacgccacgttctgctttaa

SEQ ID NO: 13550 - DNA, 21 bp, Artificial sequence
  SiRNA target sequence
tacgccacgttctgctttaac

SEQ ID NO: 13551 - DNA, 21 bp, Artificial sequence
  SiRNA target sequence
acgccacgttctgctttaaca

SEQ ID NO: 13552 - DNA, 21 bp, Artificial sequence
  SiRNA target sequence
cgccacgttctgctttaacaa

SEQ ID NO: 13553 - DNA, 21 bp, Artificial sequence
  SiRNA target sequence
gccacgttctgctttaacaat

SEQ ID NO: 13554 - DNA, 21 bp, Artificial sequence
  SiRNA target sequence
ccacgttctgctttaacaatc

SEQ ID NO: 13555 - DNA, 21 bp, Artificial sequence
  SiRNA target sequence
cacgttctgctttaacaatct

SEQ ID NO: 13556 - DNA, 21 bp, Artificial sequence
  SiRNA target sequence
acgttctgctttaacaatctt

SEQ ID NO: 13557 - DNA, 21 bp, Artificial sequence
  SiRNA target sequence
cgttctgctttaacaatcttt

SEQ ID NO: 13558 - DNA, 21 bp, Artificial sequence
  SiRNA target sequence
gttctgctttaacaatctttt

SEQ ID NO: 13559 - DNA, 21 bp, Artificial sequence
  SiRNA target sequence
ttctgctttaacaatcttttg

SEQ ID NO: 13560 - DNA, 21 bp, Artificial sequence
  SiRNA target sequence
tctgctttaacaatcttttgc

SEQ ID NO: 13561 - DNA, 21 bp, Artificial sequence
  SiRNA target sequence
ctgctttaacaatcttttgct

SEQ ID NO: 13562 - DNA, 21 bp, Artificial sequence
  SiRNA target sequence
tgctttaacaatcttttgcta

SEQ ID NO: 13563 - DNA, 21 bp, Artificial sequence
  SiRNA target sequence
gctttaacaatcttttgctac

SEQ ID NO: 13564 - DNA, 21 bp, Artificial sequence
  SiRNA target sequence
ctttaacaatcttttgctaca

SEQ ID NO: 13565 - DNA, 21 bp, Artificial sequence
  SiRNA target sequence
tttaacaatcttttgctacaa

SEQ ID NO: 13566 - DNA, 21 bp, Artificial sequence
  SiRNA target sequence
ttaacaatcttttgctacaaa

SEQ ID NO: 13567 - DNA, 21 bp, Artificial sequence
  SiRNA target sequence
taacaatcttttgctacaaac

SEQ ID NO: 13568 - DNA, 21 bp, Artificial sequence
  SiRNA target sequence
aacaatcttttgctacaaacg

SEQ ID NO: 13569 - DNA, 21 bp, Artificial sequence
  SiRNA target sequence
acaatcttttgctacaaacga

SEQ ID NO: 13570 - DNA, 21 bp, Artificial sequence
  SiRNA target sequence
caatcttttgctacaaacgag

SEQ ID NO: 13571 - DNA, 21 bp, Artificial sequence
  SiRNA target sequence
aatcttttgctacaaacgagc

SEQ ID NO: 13572 - DNA, 21 bp, Artificial sequence
  SiRNA target sequence
atcttttgctacaaacgagca

SEQ ID NO: 13573 - DNA, 21 bp, Artificial sequence
  SiRNA target sequence
tcttttgctacaaacgagcat

SEQ ID NO: 13574 - DNA, 21 bp, Artificial sequence
  SiRNA target sequence
cttttgctacaaacgagcata

SEQ ID NO: 13575 - DNA, 21 bp, Artificial sequence
  SiRNA target sequence
ttttgctacaaacgagcatag

SEQ ID NO: 13576 - DNA, 21 bp, Artificial sequence
  SiRNA target sequence
tttgctacaaacgagcataga

SEQ ID NO: 13577 - DNA, 21 bp, Artificial sequence
  SiRNA target sequence
ttgctacaaacgagcatagac

SEQ ID NO: 13578 - DNA, 21 bp, Artificial sequence
  SiRNA target sequence
tgctacaaacgagcatagacc

SEQ ID NO: 13579 - DNA, 21 bp, Artificial sequence
  SiRNA target sequence
gctacaaacgagcatagacca

SEQ ID NO: 13580 - DNA, 21 bp, Artificial sequence
  SiRNA target sequence
ctacaaacgagcatagaccaa

SEQ ID NO: 13581 - DNA, 21 bp, Artificial sequence
  SiRNA target sequence
tacaaacgagcatagaccaag

SEQ ID NO: 13582 - DNA, 21 bp, Artificial sequence
  SiRNA target sequence
acaaacgagcatagaccaaga

SEQ ID NO: 13583 - DNA, 21 bp, Artificial sequence
  SiRNA target sequence
caaacgagcatagaccaagac

SEQ ID NO: 13584 - DNA, 21 bp, Artificial sequence
  SiRNA target sequence
aaacgagcatagaccaagaca

SEQ ID NO: 13585 - DNA, 21 bp, Artificial sequence
  SiRNA target sequence
aacgagcatagaccaagacaa

SEQ ID NO: 13586 - DNA, 21 bp, Artificial sequence
  SiRNA target sequence
acgagcatagaccaagacaaa

SEQ ID NO: 13587 - DNA, 21 bp, Artificial sequence
  SiRNA target sequence
cgagcatagaccaagacaaaa

SEQ ID NO: 13588 - DNA, 21 bp, Artificial sequence
  SiRNA target sequence
gagcatagaccaagacaaaat

SEQ ID NO: 13589 - DNA, 21 bp, Artificial sequence
  SiRNA target sequence
agcatagaccaagacaaaata

SEQ ID NO: 13590 - DNA, 21 bp, Artificial sequence
  SiRNA target sequence
gcatagaccaagacaaaatat

SEQ ID NO: 13591 - DNA, 21 bp, Artificial sequence
  SiRNA target sequence
catagaccaagacaaaatatt

SEQ ID NO: 13592 - DNA, 21 bp, Artificial sequence
  SiRNA target sequence
atagaccaagacaaaatattt

SEQ ID NO: 13593 - DNA, 21 bp, Artificial sequence
  SiRNA target sequence
tagaccaagacaaaatattta

SEQ ID NO: 13594 - DNA, 21 bp, Artificial sequence
  SiRNA target sequence
agaccaagacaaaatatttag

SEQ ID NO: 13595 - DNA, 21 bp, Artificial sequence
  SiRNA target sequence
gaccaagacaaaatatttaga

SEQ ID NO: 13596 - DNA, 21 bp, Artificial sequence
  SiRNA target sequence
accaagacaaaatatttagaa

SEQ ID NO: 13597 - DNA, 21 bp, Artificial sequence
  SiRNA target sequence
ccaagacaaaatatttagaat

SEQ ID NO: 13598 - DNA, 21 bp, Artificial sequence
  SiRNA target sequence
caagacaaaatatttagaata

SEQ ID NO: 13599 - DNA, 21 bp, Artificial sequence
  SiRNA target sequence
aagacaaaatatttagaataa

SEQ ID NO: 13600 - DNA, 21 bp, Artificial sequence
  SiRNA target sequence
agacaaaatatttagaataag

SEQ ID NO: 13601 - DNA, 21 bp, Artificial sequence
  SiRNA target sequence
gacaaaatatttagaataaga

SEQ ID NO: 13602 - DNA, 21 bp, Artificial sequence
  SiRNA target sequence
acaaaatatttagaataagag

SEQ ID NO: 13603 - DNA, 21 bp, Artificial sequence
  SiRNA target sequence
caaaatatttagaataagagg

SEQ ID NO: 13604 - DNA, 21 bp, Artificial sequence
  SiRNA target sequence
aaaatatttagaataagaggt

SEQ ID NO: 13605 - DNA, 21 bp, Artificial sequence
  SiRNA target sequence
aaatatttagaataagaggta

SEQ ID NO: 13606 - DNA, 21 bp, Artificial sequence
  SiRNA target sequence
aatatttagaataagaggtac

SEQ ID NO: 13607 - DNA, 21 bp, Artificial sequence
  SiRNA target sequence
atatttagaataagaggtacc

SEQ ID NO: 13608 - DNA, 21 bp, Artificial sequence
  SiRNA target sequence
tatttagaataagaggtaccc

SEQ ID NO: 13609 - DNA, 21 bp, Artificial sequence
  SiRNA target sequence
atttagaataagaggtaccca

SEQ ID NO: 13610 - DNA, 21 bp, Artificial sequence
  SiRNA target sequence
tttagaataagaggtacccac

SEQ ID NO: 13611 - DNA, 21 bp, Artificial sequence
  SiRNA target sequence
ttagaataagaggtacccaca

SEQ ID NO: 13612 - DNA, 21 bp, Artificial sequence
  SiRNA target sequence
tagaataagaggtacccacat

SEQ ID NO: 13613 - DNA, 21 bp, Artificial sequence
  SiRNA target sequence
agaataagaggtacccacatg

SEQ ID NO: 13614 - DNA, 21 bp, Artificial sequence
  SiRNA target sequence
gaataagaggtacccacatgt

SEQ ID NO: 13615 - DNA, 21 bp, Artificial sequence
  SiRNA target sequence
aataagaggtacccacatgtt

SEQ ID NO: 13616 - DNA, 21 bp, Artificial sequence
  SiRNA target sequence
ataagaggtacccacatgttt

SEQ ID NO: 13617 - DNA, 21 bp, Artificial sequence
  SiRNA target sequence
taagaggtacccacatgttta

SEQ ID NO: 13618 - DNA, 21 bp, Artificial sequence
  SiRNA target sequence
aagaggtacccacatgtttaa

SEQ ID NO: 13619 - DNA, 21 bp, Artificial sequence
  SiRNA target sequence
agaggtacccacatgtttaaa

SEQ ID NO: 13620 - DNA, 21 bp, Artificial sequence
  SiRNA target sequence
gaggtacccacatgtttaaaa

SEQ ID NO: 13621 - DNA, 21 bp, Artificial sequence
  SiRNA target sequence
aggtacccacatgtttaaaaa

SEQ ID NO: 13622 - DNA, 21 bp, Artificial sequence
  SiRNA target sequence
ggtacccacatgtttaaaaat

SEQ ID NO: 13623 - DNA, 21 bp, Artificial sequence
  SiRNA target sequence
gtacccacatgtttaaaaatc

SEQ ID NO: 13624 - DNA, 21 bp, Artificial sequence
  SiRNA target sequence
tacccacatgtttaaaaatct

SEQ ID NO: 13625 - DNA, 21 bp, Artificial sequence
  SiRNA target sequence
acccacatgtttaaaaatcta

SEQ ID NO: 13626 - DNA, 21 bp, Artificial sequence
  SiRNA target sequence
cccacatgtttaaaaatctac

SEQ ID NO: 13627 - DNA, 21 bp, Artificial sequence
  SiRNA target sequence
ccacatgtttaaaaatctact

SEQ ID NO: 13628 - DNA, 21 bp, Artificial sequence
  SiRNA target sequence
cacatgtttaaaaatctactt

SEQ ID NO: 13629 - DNA, 21 bp, Artificial sequence
  SiRNA target sequence
acatgtttaaaaatctactta

SEQ ID NO: 13630 - DNA, 21 bp, Artificial sequence
  SiRNA target sequence
catgtttaaaaatctacttac

SEQ ID NO: 13631 - DNA, 21 bp, Artificial sequence
  SiRNA target sequence
atgtttaaaaatctacttact

SEQ ID NO: 13632 - DNA, 21 bp, Artificial sequence
  SiRNA target sequence
tgtttaaaaatctacttacta

SEQ ID NO: 13633 - DNA, 21 bp, Artificial sequence
  SiRNA target sequence
gtttaaaaatctacttactaa

SEQ ID NO: 13634 - DNA, 21 bp, Artificial sequence
  SiRNA target sequence
tttaaaaatctacttactaaa

SEQ ID NO: 13635 - DNA, 21 bp, Artificial sequence
  SiRNA target sequence
ttaaaaatctacttactaaat

SEQ ID NO: 13636 - DNA, 21 bp, Artificial sequence
  SiRNA target sequence
taaaaatctacttactaaatt

SEQ ID NO: 13637 - DNA, 21 bp, Artificial sequence
  SiRNA target sequence
aaaaatctacttactaaattc

SEQ ID NO: 13638 - DNA, 21 bp, Artificial sequence
  SiRNA target sequence
aaaatctacttactaaattcc

SEQ ID NO: 13639 - DNA, 21 bp, Artificial sequence
  SiRNA target sequence
aaatctacttactaaattcca

SEQ ID NO: 13640 - DNA, 21 bp, Artificial sequence
  SiRNA target sequence
aatctacttactaaattccat

SEQ ID NO: 13641 - DNA, 21 bp, Artificial sequence
  SiRNA target sequence
atctacttactaaattccata

SEQ ID NO: 13642 - DNA, 21 bp, Artificial sequence
  SiRNA target sequence
tctacttactaaattccatac

SEQ ID NO: 13643 - DNA, 21 bp, Artificial sequence
  SiRNA target sequence
ctacttactaaattccataca

SEQ ID NO: 13644 - DNA, 21 bp, Artificial sequence
  SiRNA target sequence
tacttactaaattccatacag

SEQ ID NO: 13645 - DNA, 21 bp, Artificial sequence
  SiRNA target sequence
acttactaaattccatacagt

SEQ ID NO: 13646 - DNA, 21 bp, Artificial sequence
  SiRNA target sequence
cttactaaattccatacagta

SEQ ID NO: 13647 - DNA, 21 bp, Artificial sequence
  SiRNA target sequence
ttactaaattccatacagtaa

SEQ ID NO: 13648 - DNA, 21 bp, Artificial sequence
  SiRNA target sequence
tactaaattccatacagtaat

SEQ ID NO: 13649 - DNA, 21 bp, Artificial sequence
  SiRNA target sequence
actaaattccatacagtaatt

SEQ ID NO: 13650 - DNA, 21 bp, Artificial sequence
  SiRNA target sequence
ctaaattccatacagtaattg

SEQ ID NO: 13651 - DNA, 21 bp, Artificial sequence
  SiRNA target sequence
taaattccatacagtaattgg

SEQ ID NO: 13652 - DNA, 21 bp, Artificial sequence
  SiRNA target sequence
aaattccatacagtaattggt

SEQ ID NO: 13653 - DNA, 21 bp, Artificial sequence
  SiRNA target sequence
aattccatacagtaattggta

SEQ ID NO: 13654 - DNA, 21 bp, Artificial sequence
  SiRNA target sequence
attccatacagtaattggtag

SEQ ID NO: 13655 - DNA, 21 bp, Artificial sequence
  SiRNA target sequence
ttccatacagtaattggtaga

SEQ ID NO: 13656 - DNA, 21 bp, Artificial sequence
  SiRNA target sequence
tccatacagtaattggtagaa

SEQ ID NO: 13657 - DNA, 21 bp, Artificial sequence
  SiRNA target sequence
ccatacagtaattggtagaag

SEQ ID NO: 13658 - DNA, 21 bp, Artificial sequence
  SiRNA target sequence
catacagtaattggtagaagt

SEQ ID NO: 13659 - DNA, 21 bp, Artificial sequence
  SiRNA target sequence
atacagtaattggtagaagta

SEQ ID NO: 13660 - DNA, 21 bp, Artificial sequence
  SiRNA target sequence
tacagtaattggtagaagtaa

SEQ ID NO: 13661 - DNA, 21 bp, Artificial sequence
  SiRNA target sequence
acagtaattggtagaagtaaa

SEQ ID NO: 13662 - DNA, 21 bp, Artificial sequence
  SiRNA target sequence
cagtaattggtagaagtaaag

SEQ ID NO: 13663 - DNA, 21 bp, Artificial sequence
  SiRNA target sequence
agtaattggtagaagtaaaga

SEQ ID NO: 13664 - DNA, 21 bp, Artificial sequence
  SiRNA target sequence
gtaattggtagaagtaaagat

SEQ ID NO: 13665 - DNA, 21 bp, Artificial sequence
  SiRNA target sequence
taattggtagaagtaaagata

SEQ ID NO: 13666 - DNA, 21 bp, Artificial sequence
  SiRNA target sequence
aattggtagaagtaaagatat

SEQ ID NO: 13667 - DNA, 21 bp, Artificial sequence
  SiRNA target sequence
attggtagaagtaaagatatc

SEQ ID NO: 13668 - DNA, 21 bp, Artificial sequence
  SiRNA target sequence
ttggtagaagtaaagatatct

SEQ ID NO: 13669 - DNA, 21 bp, Artificial sequence
  SiRNA target sequence
tggtagaagtaaagatatctt

SEQ ID NO: 13670 - DNA, 21 bp, Artificial sequence
  SiRNA target sequence
ggtagaagtaaagatatcttt

SEQ ID NO: 13671 - DNA, 21 bp, Artificial sequence
  SiRNA target sequence
gtagaagtaaagatatcttta

SEQ ID NO: 13672 - DNA, 21 bp, Artificial sequence
  SiRNA target sequence
tagaagtaaagatatctttac

SEQ ID NO: 13673 - DNA, 21 bp, Artificial sequence
  SiRNA target sequence
agaagtaaagatatctttaca

SEQ ID NO: 13674 - DNA, 21 bp, Artificial sequence
  SiRNA target sequence
gaagtaaagatatctttacac

SEQ ID NO: 13675 - DNA, 21 bp, Artificial sequence
  SiRNA target sequence
aagtaaagatatctttacaca

SEQ ID NO: 13676 - DNA, 21 bp, Artificial sequence
  SiRNA target sequence
agtaaagatatctttacacaa

SEQ ID NO: 13677 - DNA, 21 bp, Artificial sequence
  SiRNA target sequence
gtaaagatatctttacacaaa

SEQ ID NO: 13678 - DNA, 21 bp, Artificial sequence
  SiRNA target sequence
taaagatatctttacacaaat

SEQ ID NO: 13679 - DNA, 21 bp, Artificial sequence
  SiRNA target sequence
aaagatatctttacacaaata

SEQ ID NO: 13680 - DNA, 21 bp, Artificial sequence
  SiRNA target sequence
aagatatctttacacaaatag

SEQ ID NO: 13681 - DNA, 21 bp, Artificial sequence
  SiRNA target sequence
agatatctttacacaaataga

SEQ ID NO: 13682 - DNA, 21 bp, Artificial sequence
  SiRNA target sequence
gatatctttacacaaatagag

SEQ ID NO: 13683 - DNA, 21 bp, Artificial sequence
  SiRNA target sequence
atatctttacacaaatagagg

SEQ ID NO: 13684 - DNA, 21 bp, Artificial sequence
  SiRNA target sequence
tatctttacacaaatagaggt

SEQ ID NO: 13685 - DNA, 21 bp, Artificial sequence
  SiRNA target sequence
atctttacacaaatagaggta

SEQ ID NO: 13686 - DNA, 21 bp, Artificial sequence
  SiRNA target sequence
tctttacacaaatagaggtag

SEQ ID NO: 13687 - DNA, 21 bp, Artificial sequence
  SiRNA target sequence
ctttacacaaatagaggtaga

SEQ ID NO: 13688 - DNA, 21 bp, Artificial sequence
  SiRNA target sequence
tttacacaaatagaggtagac

SEQ ID NO: 13689 - DNA, 21 bp, Artificial sequence
  SiRNA target sequence
ttacacaaatagaggtagaca

SEQ ID NO: 13690 - DNA, 21 bp, Artificial sequence
  SiRNA target sequence
tacacaaatagaggtagacat

SEQ ID NO: 13691 - DNA, 21 bp, Artificial sequence
  SiRNA target sequence
acacaaatagaggtagacata

SEQ ID NO: 13692 - DNA, 21 bp, Artificial sequence
  SiRNA target sequence
cacaaatagaggtagacataa

SEQ ID NO: 13693 - DNA, 21 bp, Artificial sequence
  SiRNA target sequence
acaaatagaggtagacataaa

SEQ ID NO: 13694 - DNA, 21 bp, Artificial sequence
  SiRNA target sequence
caaatagaggtagacataaaa

SEQ ID NO: 13695 - DNA, 21 bp, Artificial sequence
  SiRNA target sequence
aaatagaggtagacataaaaa

SEQ ID NO: 13696 - DNA, 21 bp, Artificial sequence
  SiRNA target sequence
aatagaggtagacataaaaaa

SEQ ID NO: 13697 - DNA, 21 bp, Artificial sequence
  SiRNA target sequence
atagaggtagacataaaaaat

SEQ ID NO: 13698 - DNA, 21 bp, Artificial sequence
  SiRNA target sequence
tagaggtagacataaaaaata

SEQ ID NO: 13699 - DNA, 21 bp, Artificial sequence
  SiRNA target sequence
agaggtagacataaaaaataa

SEQ ID NO: 13700 - DNA, 21 bp, Artificial sequence
  SiRNA target sequence
gaggtagacataaaaaataaa

SEQ ID NO: 13701 - DNA, 21 bp, Artificial sequence
  SiRNA target sequence
aggtagacataaaaaataaat

SEQ ID NO: 13702 - DNA, 21 bp, Artificial sequence
  SiRNA target sequence
ggtagacataaaaaataaata

SEQ ID NO: 13703 - DNA, 21 bp, Artificial sequence
  SiRNA target sequence
gtagacataaaaaataaatac

SEQ ID NO: 13704 - DNA, 21 bp, Artificial sequence
  SiRNA target sequence
tagacataaaaaataaataca

SEQ ID NO: 13705 - DNA, 21 bp, Artificial sequence
  SiRNA target sequence
agacataaaaaataaatacaa

SEQ ID NO: 13706 - DNA, 21 bp, Artificial sequence
  SiRNA target sequence
gacataaaaaataaatacaat

SEQ ID NO: 13707 - DNA, 21 bp, Artificial sequence
  SiRNA target sequence
acataaaaaataaatacaata

SEQ ID NO: 13708 - DNA, 21 bp, Artificial sequence
  SiRNA target sequence
cataaaaaataaatacaataa

SEQ ID NO: 13709 - DNA, 21 bp, Artificial sequence
  SiRNA target sequence
ataaaaaataaatacaataat

SEQ ID NO: 13710 - DNA, 21 bp, Artificial sequence
  SiRNA target sequence
taaaaaataaatacaataata

SEQ ID NO: 13711 - DNA, 21 bp, Artificial sequence
  SiRNA target sequence
aaaaaataaatacaataatat

SEQ ID NO: 13712 - DNA, 21 bp, Artificial sequence
  SiRNA target sequence
aaaaataaatacaataatatg

SEQ ID NO: 13713 - DNA, 21 bp, Artificial sequence
  SiRNA target sequence
aaaataaatacaataatatgt

SEQ ID NO: 13714 - DNA, 21 bp, Artificial sequence
  SiRNA target sequence
aaataaatacaataatatgtg

SEQ ID NO: 13715 - DNA, 21 bp, Artificial sequence
  SiRNA target sequence
aataaatacaataatatgtgt

SEQ ID NO: 13716 - DNA, 21 bp, Artificial sequence
  SiRNA target sequence
ataaatacaataatatgtgta

SEQ ID NO: 13717 - DNA, 21 bp, Artificial sequence
  SiRNA target sequence
taaatacaataatatgtgtat

SEQ ID NO: 13718 - DNA, 21 bp, Artificial sequence
  SiRNA target sequence
aaatacaataatatgtgtata

SEQ ID NO: 13719 - DNA, 21 bp, Artificial sequence
  SiRNA target sequence
aatacaataatatgtgtataa

SEQ ID NO: 13720 - DNA, 21 bp, Artificial sequence
  SiRNA target sequence
atacaataatatgtgtataaa

SEQ ID NO: 13721 - DNA, 21 bp, Artificial sequence
  SiRNA target sequence
tacaataatatgtgtataaaa

SEQ ID NO: 13722 - DNA, 21 bp, Artificial sequence
  SiRNA target sequence
acaataatatgtgtataaaaa

SEQ ID NO: 13723 - DNA, 21 bp, Artificial sequence
  SiRNA target sequence
caataatatgtgtataaaaat

SEQ ID NO: 13724 - DNA, 21 bp, Artificial sequence
  SiRNA target sequence
aataatatgtgtataaaaatg

SEQ ID NO: 13725 - DNA, 21 bp, Artificial sequence
  SiRNA target sequence
ataatatgtgtataaaaatga

SEQ ID NO: 13726 - DNA, 21 bp, Artificial sequence
  SiRNA target sequence
taatatgtgtataaaaatgat

SEQ ID NO: 13727 - DNA, 21 bp, Artificial sequence
  SiRNA target sequence
aatatgtgtataaaaatgata

SEQ ID NO: 13728 - DNA, 21 bp, Artificial sequence
  SiRNA target sequence
atatgtgtataaaaatgatac

SEQ ID NO: 13729 - DNA, 21 bp, Artificial sequence
  SiRNA target sequence
tatgtgtataaaaatgataca

SEQ ID NO: 13730 - DNA, 21 bp, Artificial sequence
  SiRNA target sequence
atgtgtataaaaatgatacag

SEQ ID NO: 13731 - DNA, 21 bp, Artificial sequence
  SiRNA target sequence
tgtgtataaaaatgatacagc

SEQ ID NO: 13732 - DNA, 21 bp, Artificial sequence
  SiRNA target sequence
gtgtataaaaatgatacagcc

SEQ ID NO: 13733 - DNA, 21 bp, Artificial sequence
  SiRNA target sequence
tgtataaaaatgatacagcca

SEQ ID NO: 13734 - DNA, 21 bp, Artificial sequence
  SiRNA target sequence
gtataaaaatgatacagccag

SEQ ID NO: 13735 - DNA, 21 bp, Artificial sequence
  SiRNA target sequence
tataaaaatgatacagccagc

SEQ ID NO: 13736 - DNA, 21 bp, Artificial sequence
  SiRNA target sequence
ataaaaatgatacagccagct

SEQ ID NO: 13737 - DNA, 21 bp, Artificial sequence
  SiRNA target sequence
taaaaatgatacagccagcta

SEQ ID NO: 13738 - DNA, 21 bp, Artificial sequence
  SiRNA target sequence
aaaaatgatacagccagctat

SEQ ID NO: 13739 - DNA, 21 bp, Artificial sequence
  SiRNA target sequence
aaaatgatacagccagctatt

SEQ ID NO: 13740 - DNA, 21 bp, Artificial sequence
  SiRNA target sequence
aaatgatacagccagctatta

SEQ ID NO: 13741 - DNA, 21 bp, Artificial sequence
  SiRNA target sequence
aatgatacagccagctattaa

SEQ ID NO: 13742 - DNA, 21 bp, Artificial sequence
  SiRNA target sequence
atgatacagccagctattaaa

SEQ ID NO: 13743 - DNA, 21 bp, Artificial sequence
  SiRNA target sequence
tgatacagccagctattaaag

SEQ ID NO: 13744 - DNA, 21 bp, Artificial sequence
  SiRNA target sequence
gatacagccagctattaaagg

SEQ ID NO: 13745 - DNA, 21 bp, Artificial sequence
  SiRNA target sequence
atacagccagctattaaaggt

SEQ ID NO: 13746 - DNA, 21 bp, Artificial sequence
  SiRNA target sequence
tacagccagctattaaaggtg

SEQ ID NO: 13747 - DNA, 21 bp, Artificial sequence
  SiRNA target sequence
acagccagctattaaaggtgc

SEQ ID NO: 13748 - DNA, 21 bp, Artificial sequence
  SiRNA target sequence
cagccagctattaaaggtgct

SEQ ID NO: 13749 - DNA, 21 bp, Artificial sequence
  SiRNA target sequence
agccagctattaaaggtgctt

SEQ ID NO: 13750 - DNA, 21 bp, Artificial sequence
  SiRNA target sequence
gccagctattaaaggtgcttc

SEQ ID NO: 13751 - DNA, 21 bp, Artificial sequence
  SiRNA target sequence
ccagctattaaaggtgcttca

SEQ ID NO: 13752 - DNA, 21 bp, Artificial sequence
  SiRNA target sequence
cagctattaaaggtgcttcat

SEQ ID NO: 13753 - DNA, 21 bp, Artificial sequence
  SiRNA target sequence
agctattaaaggtgcttcatg

SEQ ID NO: 13754 - DNA, 21 bp, Artificial sequence
  SiRNA target sequence
gctattaaaggtgcttcatgt

SEQ ID NO: 13755 - DNA, 21 bp, Artificial sequence
  SiRNA target sequence
ctattaaaggtgcttcatgta

SEQ ID NO: 13756 - DNA, 21 bp, Artificial sequence
  SiRNA target sequence
tattaaaggtgcttcatgtat

SEQ ID NO: 13757 - DNA, 21 bp, Artificial sequence
  SiRNA target sequence
attaaaggtgcttcatgtata

SEQ ID NO: 13758 - DNA, 21 bp, Artificial sequence
  SiRNA target sequence
ttaaaggtgcttcatgtatat

SEQ ID NO: 13759 - DNA, 21 bp, Artificial sequence
  SiRNA target sequence
taaaggtgcttcatgtatata

SEQ ID NO: 13760 - DNA, 21 bp, Artificial sequence
  SiRNA target sequence
aaaggtgcttcatgtatatac

SEQ ID NO: 13761 - DNA, 21 bp, Artificial sequence
  SiRNA target sequence
aaggtgcttcatgtatatacg

SEQ ID NO: 13762 - DNA, 21 bp, Artificial sequence
  SiRNA target sequence
aggtgcttcatgtatatacgt

SEQ ID NO: 13763 - DNA, 21 bp, Artificial sequence
  SiRNA target sequence
ggtgcttcatgtatatacgtg

SEQ ID NO: 13764 - DNA, 21 bp, Artificial sequence
  SiRNA target sequence
gtgcttcatgtatatacgtgg

SEQ ID NO: 13765 - DNA, 21 bp, Artificial sequence
  SiRNA target sequence
tgcttcatgtatatacgtggg

SEQ ID NO: 13766 - DNA, 21 bp, Artificial sequence
  SiRNA target sequence
gcttcatgtatatacgtgggt

SEQ ID NO: 13767 - DNA, 21 bp, Artificial sequence
  SiRNA target sequence
cttcatgtatatacgtgggta

SEQ ID NO: 13768 - DNA, 21 bp, Artificial sequence
  SiRNA target sequence
ttcatgtatatacgtgggtaa

SEQ ID NO: 13769 - DNA, 21 bp, Artificial sequence
  SiRNA target sequence
tcatgtatatacgtgggtaat

SEQ ID NO: 13770 - DNA, 21 bp, Artificial sequence
  SiRNA target sequence
catgtatatacgtgggtaatt

SEQ ID NO: 13771 - DNA, 21 bp, Artificial sequence
  SiRNA target sequence
atgtatatacgtgggtaatta

SEQ ID NO: 13772 - DNA, 21 bp, Artificial sequence
  SiRNA target sequence
tgtatatacgtgggtaattat

SEQ ID NO: 13773 - DNA, 21 bp, Artificial sequence
  SiRNA target sequence
gtatatacgtgggtaattata

SEQ ID NO: 13774 - DNA, 21 bp, Artificial sequence
  SiRNA target sequence
tatatacgtgggtaattatat

SEQ ID NO: 13775 - DNA, 21 bp, Artificial sequence
  SiRNA target sequence
atatacgtgggtaattatatg

SEQ ID NO: 13776 - DNA, 21 bp, Artificial sequence
  SiRNA target sequence
tatacgtgggtaattatatgc

SEQ ID NO: 13777 - DNA, 21 bp, Artificial sequence
  SiRNA target sequence
atacgtgggtaattatatgca

SEQ ID NO: 13778 - DNA, 21 bp, Artificial sequence
  SiRNA target sequence
tacgtgggtaattatatgcag

SEQ ID NO: 13779 - DNA, 21 bp, Artificial sequence
  SiRNA target sequence
acgtgggtaattatatgcagc

SEQ ID NO: 13780 - DNA, 21 bp, Artificial sequence
  SiRNA target sequence
cgtgggtaattatatgcagca

SEQ ID NO: 13781 - DNA, 21 bp, Artificial sequence
  SiRNA target sequence
gtgggtaattatatgcagcag

SEQ ID NO: 13782 - DNA, 21 bp, Artificial sequence
  SiRNA target sequence
tgggtaattatatgcagcagc

SEQ ID NO: 13783 - DNA, 21 bp, Artificial sequence
  SiRNA target sequence
gggtaattatatgcagcagct

SEQ ID NO: 13784 - DNA, 21 bp, Artificial sequence
  SiRNA target sequence
ggtaattatatgcagcagcta

SEQ ID NO: 13785 - DNA, 21 bp, Artificial sequence
  SiRNA target sequence
gtaattatatgcagcagctag

SEQ ID NO: 13786 - DNA, 21 bp, Artificial sequence
  SiRNA target sequence
taattatatgcagcagctagg

SEQ ID NO: 13787 - DNA, 21 bp, Artificial sequence
  SiRNA target sequence
aattatatgcagcagctagga

SEQ ID NO: 13788 - DNA, 21 bp, Artificial sequence
  SiRNA target sequence
attatatgcagcagctaggag

SEQ ID NO: 13789 - DNA, 21 bp, Artificial sequence
  SiRNA target sequence
ttatatgcagcagctaggagt

SEQ ID NO: 13790 - DNA, 21 bp, Artificial sequence
  SiRNA target sequence
tatatgcagcagctaggagta

SEQ ID NO: 13791 - DNA, 21 bp, Artificial sequence
  SiRNA target sequence
atatgcagcagctaggagtaa

SEQ ID NO: 13792 - DNA, 21 bp, Artificial sequence
  SiRNA target sequence
tatgcagcagctaggagtaat

SEQ ID NO: 13793 - DNA, 21 bp, Artificial sequence
  SiRNA target sequence
atgcagcagctaggagtaatt

SEQ ID NO: 13794 - DNA, 21 bp, Artificial sequence
  SiRNA target sequence
tgcagcagctaggagtaatta

SEQ ID NO: 13795 - DNA, 21 bp, Artificial sequence
  SiRNA target sequence
gcagcagctaggagtaattag

SEQ ID NO: 13796 - DNA, 21 bp, Artificial sequence
  SiRNA target sequence
cagcagctaggagtaattagt

SEQ ID NO: 13797 - DNA, 21 bp, Artificial sequence
  SiRNA target sequence
agcagctaggagtaattagtc

SEQ ID NO: 13798 - DNA, 21 bp, Artificial sequence
  SiRNA target sequence
gcagctaggagtaattagtct

SEQ ID NO: 13799 - DNA, 21 bp, Artificial sequence
  SiRNA target sequence
cagctaggagtaattagtctt

SEQ ID NO: 13800 - DNA, 21 bp, Artificial sequence
  SiRNA target sequence
agctaggagtaattagtcttg

SEQ ID NO: 13801 - DNA, 21 bp, Artificial sequence
  SiRNA target sequence
gctaggagtaattagtcttgg

SEQ ID NO: 13802 - DNA, 21 bp, Artificial sequence
  SiRNA target sequence
ctaggagtaattagtcttggt

SEQ ID NO: 13803 - DNA, 21 bp, Artificial sequence
  SiRNA target sequence
taggagtaattagtcttggtg

SEQ ID NO: 13804 - DNA, 21 bp, Artificial sequence
  SiRNA target sequence
aggagtaattagtcttggtgg

SEQ ID NO: 13805 - DNA, 21 bp, Artificial sequence
  SiRNA target sequence
ggagtaattagtcttggtggg

SEQ ID NO: 13806 - DNA, 21 bp, Artificial sequence
  SiRNA target sequence
gagtaattagtcttggtgggg

SEQ ID NO: 13807 - DNA, 21 bp, Artificial sequence
  SiRNA target sequence
agtaattagtcttggtgggga

SEQ ID NO: 13808 - DNA, 21 bp, Artificial sequence
  SiRNA target sequence
gtaattagtcttggtggggag

SEQ ID NO: 13809 - DNA, 21 bp, Artificial sequence
  SiRNA target sequence
taattagtcttggtggggaga

SEQ ID NO: 13810 - DNA, 21 bp, Artificial sequence
  SiRNA target sequence
aattagtcttggtggggagat

SEQ ID NO: 13811 - DNA, 21 bp, Artificial sequence
  SiRNA target sequence
attagtcttggtggggagatt

SEQ ID NO: 13812 - DNA, 21 bp, Artificial sequence
  SiRNA target sequence
ttagtcttggtggggagatta

SEQ ID NO: 13813 - DNA, 21 bp, Artificial sequence
  SiRNA target sequence
tagtcttggtggggagattat

SEQ ID NO: 13814 - DNA, 21 bp, Artificial sequence
  SiRNA target sequence
agtcttggtggggagattatt

SEQ ID NO: 13815 - DNA, 21 bp, Artificial sequence
  SiRNA target sequence
gtcttggtggggagattatta

SEQ ID NO: 13816 - DNA, 21 bp, Artificial sequence
  SiRNA target sequence
tcttggtggggagattattaa

SEQ ID NO: 13817 - DNA, 21 bp, Artificial sequence
  SiRNA target sequence
cttggtggggagattattaaa

SEQ ID NO: 13818 - DNA, 21 bp, Artificial sequence
  SiRNA target sequence
ttggtggggagattattaaag

SEQ ID NO: 13819 - DNA, 21 bp, Artificial sequence
  SiRNA target sequence
tggtggggagattattaaagc

SEQ ID NO: 13820 - DNA, 21 bp, Artificial sequence
  SiRNA target sequence
ggtggggagattattaaagct

SEQ ID NO: 13821 - DNA, 21 bp, Artificial sequence
  SiRNA target sequence
gtggggagattattaaagctg

SEQ ID NO: 13822 - DNA, 21 bp, Artificial sequence
  SiRNA target sequence
tggggagattattaaagctga

SEQ ID NO: 13823 - DNA, 21 bp, Artificial sequence
  SiRNA target sequence
ggggagattattaaagctgat

SEQ ID NO: 13824 - DNA, 21 bp, Artificial sequence
  SiRNA target sequence
gggagattattaaagctgatg

SEQ ID NO: 13825 - DNA, 21 bp, Artificial sequence
  SiRNA target sequence
ggagattattaaagctgatga

SEQ ID NO: 13826 - DNA, 21 bp, Artificial sequence
  SiRNA target sequence
gagattattaaagctgatgaa

SEQ ID NO: 13827 - DNA, 21 bp, Artificial sequence
  SiRNA target sequence
agattattaaagctgatgaat

SEQ ID NO: 13828 - DNA, 21 bp, Artificial sequence
  SiRNA target sequence
gattattaaagctgatgaata

SEQ ID NO: 13829 - DNA, 21 bp, Artificial sequence
  SiRNA target sequence
attattaaagctgatgaatac

SEQ ID NO: 13830 - DNA, 21 bp, Artificial sequence
  SiRNA target sequence
ttattaaagctgatgaataca

SEQ ID NO: 13831 - DNA, 21 bp, Artificial sequence
  SiRNA target sequence
tattaaagctgatgaatacat

SEQ ID NO: 13832 - DNA, 21 bp, Artificial sequence
  SiRNA target sequence
attaaagctgatgaatacatt

SEQ ID NO: 13833 - DNA, 21 bp, Artificial sequence
  SiRNA target sequence
ttaaagctgatgaatacattg

SEQ ID NO: 13834 - DNA, 21 bp, Artificial sequence
  SiRNA target sequence
taaagctgatgaatacattgg

SEQ ID NO: 13835 - DNA, 21 bp, Artificial sequence
  SiRNA target sequence
aaagctgatgaatacattgga

SEQ ID NO: 13836 - DNA, 21 bp, Artificial sequence
  SiRNA target sequence
aagctgatgaatacattggac

SEQ ID NO: 13837 - DNA, 21 bp, Artificial sequence
  SiRNA target sequence
agctgatgaatacattggact

SEQ ID NO: 13838 - DNA, 21 bp, Artificial sequence
  SiRNA target sequence
gctgatgaatacattggacta

SEQ ID NO: 13839 - DNA, 21 bp, Artificial sequence
  SiRNA target sequence
ctgatgaatacattggactat

SEQ ID NO: 13840 - DNA, 21 bp, Artificial sequence
  SiRNA target sequence
tgatgaatacattggactatc

SEQ ID NO: 13841 - DNA, 21 bp, Artificial sequence
  SiRNA target sequence
gatgaatacattggactatct

SEQ ID NO: 13842 - DNA, 21 bp, Artificial sequence
  SiRNA target sequence
atgaatacattggactatctt

SEQ ID NO: 13843 - DNA, 21 bp, Artificial sequence
  SiRNA target sequence
tgaatacattggactatcttt

SEQ ID NO: 13844 - DNA, 21 bp, Artificial sequence
  SiRNA target sequence
gaatacattggactatctttt

SEQ ID NO: 13845 - DNA, 21 bp, Artificial sequence
  SiRNA target sequence
aatacattggactatcttttg

SEQ ID NO: 13846 - DNA, 21 bp, Artificial sequence
  SiRNA target sequence
atacattggactatcttttgt

SEQ ID NO: 13847 - DNA, 21 bp, Artificial sequence
  SiRNA target sequence
tacattggactatcttttgta

SEQ ID NO: 13848 - DNA, 21 bp, Artificial sequence
  SiRNA target sequence
acattggactatcttttgtag

SEQ ID NO: 13849 - DNA, 21 bp, Artificial sequence
  SiRNA target sequence
cattggactatcttttgtagg

SEQ ID NO: 13850 - DNA, 21 bp, Artificial sequence
  SiRNA target sequence
attggactatcttttgtaggg

SEQ ID NO: 13851 - DNA, 21 bp, Artificial sequence
  SiRNA target sequence
ttggactatcttttgtaggga

SEQ ID NO: 13852 - DNA, 21 bp, Artificial sequence
  SiRNA target sequence
tggactatcttttgtagggag

SEQ ID NO: 13853 - DNA, 21 bp, Artificial sequence
  SiRNA target sequence
ggactatcttttgtagggaga

SEQ ID NO: 13854 - DNA, 21 bp, Artificial sequence
  SiRNA target sequence
gactatcttttgtagggagat

SEQ ID NO: 13855 - DNA, 21 bp, Artificial sequence
  SiRNA target sequence
actatcttttgtagggagata

SEQ ID NO: 13856 - DNA, 21 bp, Artificial sequence
  SiRNA target sequence
ctatcttttgtagggagatat

SEQ ID NO: 13857 - DNA, 21 bp, Artificial sequence
  SiRNA target sequence
tatcttttgtagggagatatg

SEQ ID NO: 13858 - DNA, 21 bp, Artificial sequence
  SiRNA target sequence
atcttttgtagggagatatga

SEQ ID NO: 13859 - DNA, 21 bp, Artificial sequence
  SiRNA target sequence
tcttttgtagggagatatgaa

SEQ ID NO: 13860 - DNA, 21 bp, Artificial sequence
  SiRNA target sequence
cttttgtagggagatatgaag

SEQ ID NO: 13861 - DNA, 21 bp, Artificial sequence
  SiRNA target sequence
ttttgtagggagatatgaagg

SEQ ID NO: 13862 - DNA, 21 bp, Artificial sequence
  SiRNA target sequence
tttgtagggagatatgaaggg

SEQ ID NO: 13863 - DNA, 21 bp, Artificial sequence
  SiRNA target sequence
ttgtagggagatatgaaggga

SEQ ID NO: 13864 - DNA, 21 bp, Artificial sequence
  SiRNA target sequence
tgtagggagatatgaagggat

SEQ ID NO: 13865 - DNA, 21 bp, Artificial sequence
  SiRNA target sequence
gtagggagatatgaagggatt

SEQ ID NO: 13866 - DNA, 21 bp, Artificial sequence
  SiRNA target sequence
tagggagatatgaagggattg

SEQ ID NO: 13867 - DNA, 21 bp, Artificial sequence
  SiRNA target sequence
agggagatatgaagggattgg

SEQ ID NO: 13868 - DNA, 21 bp, Artificial sequence
  SiRNA target sequence
gggagatatgaagggattggt

SEQ ID NO: 13869 - DNA, 21 bp, Artificial sequence
  SiRNA target sequence
ggagatatgaagggattggtt

SEQ ID NO: 13870 - DNA, 21 bp, Artificial sequence
  SiRNA target sequence
gagatatgaagggattggttc

SEQ ID NO: 13871 - DNA, 21 bp, Artificial sequence
  SiRNA target sequence
agatatgaagggattggttct

SEQ ID NO: 13872 - DNA, 21 bp, Artificial sequence
  SiRNA target sequence
gatatgaagggattggttcta

SEQ ID NO: 13873 - DNA, 21 bp, Artificial sequence
  SiRNA target sequence
atatgaagggattggttctat

SEQ ID NO: 13874 - DNA, 21 bp, Artificial sequence
  SiRNA target sequence
tatgaagggattggttctatt

SEQ ID NO: 13875 - DNA, 21 bp, Artificial sequence
  SiRNA target sequence
atgaagggattggttctattt

SEQ ID NO: 13876 - DNA, 21 bp, Artificial sequence
  SiRNA target sequence
tgaagggattggttctatttc

SEQ ID NO: 13877 - DNA, 21 bp, Artificial sequence
  SiRNA target sequence
gaagggattggttctatttct

SEQ ID NO: 13878 - DNA, 21 bp, Artificial sequence
  SiRNA target sequence
aagggattggttctatttcta

SEQ ID NO: 13879 - DNA, 21 bp, Artificial sequence
  SiRNA target sequence
agggattggttctatttctac

SEQ ID NO: 13880 - DNA, 21 bp, Artificial sequence
  SiRNA target sequence
gggattggttctatttctact

SEQ ID NO: 13881 - DNA, 21 bp, Artificial sequence
  SiRNA target sequence
ggattggttctatttctacta

SEQ ID NO: 13882 - DNA, 21 bp, Artificial sequence
  SiRNA target sequence
gattggttctatttctactat

SEQ ID NO: 13883 - DNA, 21 bp, Artificial sequence
  SiRNA target sequence
attggttctatttctactata

SEQ ID NO: 13884 - DNA, 21 bp, Artificial sequence
  SiRNA target sequence
ttggttctatttctactatat

SEQ ID NO: 13885 - DNA, 21 bp, Artificial sequence
  SiRNA target sequence
tggttctatttctactatatc

SEQ ID NO: 13886 - DNA, 21 bp, Artificial sequence
  SiRNA target sequence
ggttctatttctactatatca

SEQ ID NO: 13887 - DNA, 21 bp, Artificial sequence
  SiRNA target sequence
gttctatttctactatatcac

SEQ ID NO: 13888 - DNA, 21 bp, Artificial sequence
  SiRNA target sequence
ttctatttctactatatcact

SEQ ID NO: 13889 - DNA, 21 bp, Artificial sequence
  SiRNA target sequence
tctatttctactatatcactt

SEQ ID NO: 13890 - DNA, 21 bp, Artificial sequence
  SiRNA target sequence
ctatttctactatatcacttc

SEQ ID NO: 13891 - DNA, 21 bp, Artificial sequence
  SiRNA target sequence
tatttctactatatcacttca

SEQ ID NO: 13892 - DNA, 21 bp, Artificial sequence
  SiRNA target sequence
atttctactatatcacttcag

SEQ ID NO: 13893 - DNA, 21 bp, Artificial sequence
  SiRNA target sequence
tttctactatatcacttcagc

SEQ ID NO: 13894 - DNA, 21 bp, Artificial sequence
  SiRNA target sequence
ttctactatatcacttcagca

SEQ ID NO: 13895 - DNA, 21 bp, Artificial sequence
  SiRNA target sequence
tctactatatcacttcagcag

SEQ ID NO: 13896 - DNA, 21 bp, Artificial sequence
  SiRNA target sequence
ctactatatcacttcagcagt

SEQ ID NO: 13897 - DNA, 21 bp, Artificial sequence
  SiRNA target sequence
tactatatcacttcagcagtt

SEQ ID NO: 13898 - DNA, 21 bp, Artificial sequence
  SiRNA target sequence
actatatcacttcagcagttt

SEQ ID NO: 13899 - DNA, 21 bp, Artificial sequence
  SiRNA target sequence
ctatatcacttcagcagttta

SEQ ID NO: 13900 - DNA, 21 bp, Artificial sequence
  SiRNA target sequence
tatatcacttcagcagtttaa

SEQ ID NO: 13901 - DNA, 21 bp, Artificial sequence
  SiRNA target sequence
atatcacttcagcagtttaat

SEQ ID NO: 13902 - DNA, 21 bp, Artificial sequence
  SiRNA target sequence
tatcacttcagcagtttaata

SEQ ID NO: 13903 - DNA, 21 bp, Artificial sequence
  SiRNA target sequence
atcacttcagcagtttaatac

SEQ ID NO: 13904 - DNA, 21 bp, Artificial sequence
  SiRNA target sequence
tcacttcagcagtttaataca

SEQ ID NO: 13905 - DNA, 21 bp, Artificial sequence
  SiRNA target sequence
cacttcagcagtttaatacac

SEQ ID NO: 13906 - DNA, 21 bp, Artificial sequence
  SiRNA target sequence
acttcagcagtttaatacact

SEQ ID NO: 13907 - DNA, 21 bp, Artificial sequence
  SiRNA target sequence
cttcagcagtttaatacactg

SEQ ID NO: 13908 - DNA, 21 bp, Artificial sequence
  SiRNA target sequence
ttcagcagtttaatacactgt

SEQ ID NO: 13909 - DNA, 21 bp, Artificial sequence
  SiRNA target sequence
tcagcagtttaatacactgtc

SEQ ID NO: 13910 - DNA, 21 bp, Artificial sequence
  SiRNA target sequence
cagcagtttaatacactgtct

SEQ ID NO: 13911 - DNA, 21 bp, Artificial sequence
  SiRNA target sequence
agcagtttaatacactgtcta

SEQ ID NO: 13912 - DNA, 21 bp, Artificial sequence
  SiRNA target sequence
gcagtttaatacactgtctat

SEQ ID NO: 13913 - DNA, 21 bp, Artificial sequence
  SiRNA target sequence
cagtttaatacactgtctata

SEQ ID NO: 13914 - DNA, 21 bp, Artificial sequence
  SiRNA target sequence
agtttaatacactgtctatag

SEQ ID NO: 13915 - DNA, 21 bp, Artificial sequence
  SiRNA target sequence
gtttaatacactgtctataga

SEQ ID NO: 13916 - DNA, 21 bp, Artificial sequence
  SiRNA target sequence
tttaatacactgtctatagat

SEQ ID NO: 13917 - DNA, 21 bp, Artificial sequence
  SiRNA target sequence
ttaatacactgtctatagatt

SEQ ID NO: 13918 - DNA, 21 bp, Artificial sequence
  SiRNA target sequence
taatacactgtctatagatta

SEQ ID NO: 13919 - DNA, 21 bp, Artificial sequence
  SiRNA target sequence
aatacactgtctatagattat

SEQ ID NO: 13920 - DNA, 21 bp, Artificial sequence
  SiRNA target sequence
atacactgtctatagattatt

SEQ ID NO: 13921 - DNA, 21 bp, Artificial sequence
  SiRNA target sequence
tacactgtctatagattatta

SEQ ID NO: 13922 - DNA, 21 bp, Artificial sequence
  SiRNA target sequence
acactgtctatagattattac

SEQ ID NO: 13923 - DNA, 21 bp, Artificial sequence
  SiRNA target sequence
cactgtctatagattattaca

SEQ ID NO: 13924 - DNA, 21 bp, Artificial sequence
  SiRNA target sequence
actgtctatagattattacaa

SEQ ID NO: 13925 - DNA, 21 bp, Artificial sequence
  SiRNA target sequence
ctgtctatagattattacaag

SEQ ID NO: 13926 - DNA, 21 bp, Artificial sequence
  SiRNA target sequence
tgtctatagattattacaaga

SEQ ID NO: 13927 - DNA, 21 bp, Artificial sequence
  SiRNA target sequence
gtctatagattattacaagac

SEQ ID NO: 13928 - DNA, 21 bp, Artificial sequence
  SiRNA target sequence
tctatagattattacaagaca

SEQ ID NO: 13929 - DNA, 21 bp, Artificial sequence
  SiRNA target sequence
ctatagattattacaagacat

SEQ ID NO: 13930 - DNA, 21 bp, Artificial sequence
  SiRNA target sequence
tatagattattacaagacatt

SEQ ID NO: 13931 - DNA, 21 bp, Artificial sequence
  SiRNA target sequence
atagattattacaagacattg

SEQ ID NO: 13932 - DNA, 21 bp, Artificial sequence
  SiRNA target sequence
tagattattacaagacattgt

SEQ ID NO: 13933 - DNA, 21 bp, Artificial sequence
  SiRNA target sequence
agattattacaagacattgtc

SEQ ID NO: 13934 - DNA, 21 bp, Artificial sequence
  SiRNA target sequence
gattattacaagacattgtct

SEQ ID NO: 13935 - DNA, 21 bp, Artificial sequence
  SiRNA target sequence
attattacaagacattgtctt

SEQ ID NO: 13936 - DNA, 21 bp, Artificial sequence
  SiRNA target sequence
ttattacaagacattgtcttc

SEQ ID NO: 13937 - DNA, 21 bp, Artificial sequence
  SiRNA target sequence
tattacaagacattgtcttct

SEQ ID NO: 13938 - DNA, 21 bp, Artificial sequence
  SiRNA target sequence
attacaagacattgtcttcta

SEQ ID NO: 13939 - DNA, 21 bp, Artificial sequence
  SiRNA target sequence
ttacaagacattgtcttctat

SEQ ID NO: 13940 - DNA, 21 bp, Artificial sequence
  SiRNA target sequence
tacaagacattgtcttctatt

SEQ ID NO: 13941 - DNA, 21 bp, Artificial sequence
  SiRNA target sequence
acaagacattgtcttctattt

SEQ ID NO: 13942 - DNA, 21 bp, Artificial sequence
  SiRNA target sequence
caagacattgtcttctatttg

SEQ ID NO: 13943 - DNA, 21 bp, Artificial sequence
  SiRNA target sequence
aagacattgtcttctatttgt

SEQ ID NO: 13944 - DNA, 21 bp, Artificial sequence
  SiRNA target sequence
agacattgtcttctatttgtg

SEQ ID NO: 13945 - DNA, 21 bp, Artificial sequence
  SiRNA target sequence
gacattgtcttctatttgtga

SEQ ID NO: 13946 - DNA, 21 bp, Artificial sequence
  SiRNA target sequence
acattgtcttctatttgtgac

SEQ ID NO: 13947 - DNA, 21 bp, Artificial sequence
  SiRNA target sequence
cattgtcttctatttgtgacg

SEQ ID NO: 13948 - DNA, 21 bp, Artificial sequence
  SiRNA target sequence
attgtcttctatttgtgacgt

SEQ ID NO: 13949 - DNA, 21 bp, Artificial sequence
  SiRNA target sequence
ttgtcttctatttgtgacgta

SEQ ID NO: 13950 - DNA, 21 bp, Artificial sequence
  SiRNA target sequence
tgtcttctatttgtgacgtag

SEQ ID NO: 13951 - DNA, 21 bp, Artificial sequence
  SiRNA target sequence
gtcttctatttgtgacgtagg

SEQ ID NO: 13952 - DNA, 21 bp, Artificial sequence
  SiRNA target sequence
tcttctatttgtgacgtaggt

SEQ ID NO: 13953 - DNA, 21 bp, Artificial sequence
  SiRNA target sequence
cttctatttgtgacgtaggta

SEQ ID NO: 13954 - DNA, 21 bp, Artificial sequence
  SiRNA target sequence
ttctatttgtgacgtaggtat

SEQ ID NO: 13955 - DNA, 21 bp, Artificial sequence
  SiRNA target sequence
tctatttgtgacgtaggtatt

SEQ ID NO: 13956 - DNA, 21 bp, Artificial sequence
  SiRNA target sequence
ctatttgtgacgtaggtatta

SEQ ID NO: 13957 - DNA, 21 bp, Artificial sequence
  SiRNA target sequence
tatttgtgacgtaggtattaa

SEQ ID NO: 13958 - DNA, 21 bp, Artificial sequence
  SiRNA target sequence
atttgtgacgtaggtattaaa

SEQ ID NO: 13959 - DNA, 21 bp, Artificial sequence
  SiRNA target sequence
tttgtgacgtaggtattaaaa

SEQ ID NO: 13960 - DNA, 21 bp, Artificial sequence
  SiRNA target sequence
ttgtgacgtaggtattaaaat

SEQ ID NO: 13961 - DNA, 21 bp, Artificial sequence
  SiRNA target sequence
tgtgacgtaggtattaaaata

SEQ ID NO: 13962 - DNA, 21 bp, Artificial sequence
  SiRNA target sequence
gtgacgtaggtattaaaatat

SEQ ID NO: 13963 - DNA, 21 bp, Artificial sequence
  SiRNA target sequence
tgacgtaggtattaaaatatc

SEQ ID NO: 13964 - DNA, 21 bp, Artificial sequence
  SiRNA target sequence
gacgtaggtattaaaatatca

SEQ ID NO: 13965 - DNA, 21 bp, Artificial sequence
  SiRNA target sequence
acgtaggtattaaaatatcaa

SEQ ID NO: 13966 - DNA, 21 bp, Artificial sequence
  SiRNA target sequence
cgtaggtattaaaatatcaac

SEQ ID NO: 13967 - DNA, 21 bp, Artificial sequence
  SiRNA target sequence
gtaggtattaaaatatcaact

SEQ ID NO: 13968 - DNA, 21 bp, Artificial sequence
  SiRNA target sequence
taggtattaaaatatcaactg

SEQ ID NO: 13969 - DNA, 21 bp, Artificial sequence
  SiRNA target sequence
aggtattaaaatatcaactga

SEQ ID NO: 13970 - DNA, 21 bp, Artificial sequence
  SiRNA target sequence
ggtattaaaatatcaactgat

SEQ ID NO: 13971 - DNA, 21 bp, Artificial sequence
  SiRNA target sequence
gtattaaaatatcaactgata

SEQ ID NO: 13972 - DNA, 21 bp, Artificial sequence
  SiRNA target sequence
tattaaaatatcaactgatag

SEQ ID NO: 13973 - DNA, 21 bp, Artificial sequence
  SiRNA target sequence
attaaaatatcaactgatagg

SEQ ID NO: 13974 - DNA, 21 bp, Artificial sequence
  SiRNA target sequence
ttaaaatatcaactgataggg

SEQ ID NO: 13975 - DNA, 21 bp, Artificial sequence
  SiRNA target sequence
taaaatatcaactgataggga

SEQ ID NO: 13976 - DNA, 21 bp, Artificial sequence
  SiRNA target sequence
aaaatatcaactgatagggaa

SEQ ID NO: 13977 - DNA, 21 bp, Artificial sequence
  SiRNA target sequence
aaatatcaactgatagggaaa

SEQ ID NO: 13978 - DNA, 21 bp, Artificial sequence
  SiRNA target sequence
aatatcaactgatagggaaaa

SEQ ID NO: 13979 - DNA, 21 bp, Artificial sequence
  SiRNA target sequence
atatcaactgatagggaaaaa

SEQ ID NO: 13980 - DNA, 21 bp, Artificial sequence
  SiRNA target sequence
tatcaactgatagggaaaaat

SEQ ID NO: 13981 - DNA, 21 bp, Artificial sequence
  SiRNA target sequence
atcaactgatagggaaaaatc

SEQ ID NO: 13982 - DNA, 21 bp, Artificial sequence
  SiRNA target sequence
tcaactgatagggaaaaatca

SEQ ID NO: 13983 - DNA, 21 bp, Artificial sequence
  SiRNA target sequence
caactgatagggaaaaatcag

SEQ ID NO: 13984 - DNA, 21 bp, Artificial sequence
  SiRNA target sequence
aactgatagggaaaaatcagt

SEQ ID NO: 13985 - DNA, 21 bp, Artificial sequence
  SiRNA target sequence
actgatagggaaaaatcagtt

SEQ ID NO: 13986 - DNA, 21 bp, Artificial sequence
  SiRNA target sequence
ctgatagggaaaaatcagtta

SEQ ID NO: 13987 - DNA, 21 bp, Artificial sequence
  SiRNA target sequence
tgatagggaaaaatcagttaa

SEQ ID NO: 13988 - DNA, 21 bp, Artificial sequence
  SiRNA target sequence
gatagggaaaaatcagttaat

SEQ ID NO: 13989 - DNA, 21 bp, Artificial sequence
  SiRNA target sequence
atagggaaaaatcagttaatt

SEQ ID NO: 13990 - DNA, 21 bp, Artificial sequence
  SiRNA target sequence
tagggaaaaatcagttaatta

SEQ ID NO: 13991 - DNA, 21 bp, Artificial sequence
  SiRNA target sequence
agggaaaaatcagttaattat

SEQ ID NO: 13992 - DNA, 21 bp, Artificial sequence
  SiRNA target sequence
gggaaaaatcagttaattatg

SEQ ID NO: 13993 - DNA, 21 bp, Artificial sequence
  SiRNA target sequence
ggaaaaatcagttaattatgg

SEQ ID NO: 13994 - DNA, 21 bp, Artificial sequence
  SiRNA target sequence
gaaaaatcagttaattatgga

SEQ ID NO: 13995 - DNA, 21 bp, Artificial sequence
  SiRNA target sequence
aaaaatcagttaattatggat

SEQ ID NO: 13996 - DNA, 21 bp, Artificial sequence
  SiRNA target sequence
aaaatcagttaattatggatt

SEQ ID NO: 13997 - DNA, 21 bp, Artificial sequence
  SiRNA target sequence
aaatcagttaattatggatta

SEQ ID NO: 13998 - DNA, 21 bp, Artificial sequence
  SiRNA target sequence
aatcagttaattatggattag

SEQ ID NO: 13999 - DNA, 21 bp, Artificial sequence
  SiRNA target sequence
atcagttaattatggattagg

SEQ ID NO: 14000 - DNA, 21 bp, Artificial sequence
  SiRNA target sequence
tcagttaattatggattagga

SEQ ID NO: 14001 - DNA, 21 bp, Artificial sequence
  SiRNA target sequence
cagttaattatggattaggag

SEQ ID NO: 14002 - DNA, 21 bp, Artificial sequence
  SiRNA target sequence
agttaattatggattaggagt

SEQ ID NO: 14003 - DNA, 21 bp, Artificial sequence
  SiRNA target sequence
gttaattatggattaggagtt

SEQ ID NO: 14004 - DNA, 21 bp, Artificial sequence
  SiRNA target sequence
ttaattatggattaggagtta

SEQ ID NO: 14005 - DNA, 21 bp, Artificial sequence
  SiRNA target sequence
taattatggattaggagttaa

SEQ ID NO: 14006 - DNA, 21 bp, Artificial sequence
  SiRNA target sequence
aattatggattaggagttaaa

SEQ ID NO: 14007 - DNA, 21 bp, Artificial sequence
  SiRNA target sequence
attatggattaggagttaaac

SEQ ID NO: 14008 - DNA, 21 bp, Artificial sequence
  SiRNA target sequence
ttatggattaggagttaaact

SEQ ID NO: 14009 - DNA, 21 bp, Artificial sequence
  SiRNA target sequence
tatggattaggagttaaacta

SEQ ID NO: 14010 - DNA, 21 bp, Artificial sequence
  SiRNA target sequence
atggattaggagttaaactac

SEQ ID NO: 14011 - DNA, 21 bp, Artificial sequence
  SiRNA target sequence
tggattaggagttaaactaca

SEQ ID NO: 14012 - DNA, 21 bp, Artificial sequence
  SiRNA target sequence
ggattaggagttaaactacac

SEQ ID NO: 14013 - DNA, 21 bp, Artificial sequence
  SiRNA target sequence
gattaggagttaaactacaca

SEQ ID NO: 14014 - DNA, 21 bp, Artificial sequence
  SiRNA target sequence
attaggagttaaactacacag

SEQ ID NO: 14015 - DNA, 21 bp, Artificial sequence
  SiRNA target sequence
ttaggagttaaactacacagt

SEQ ID NO: 14016 - DNA, 21 bp, Artificial sequence
  SiRNA target sequence
taggagttaaactacacagta

SEQ ID NO: 14017 - DNA, 21 bp, Artificial sequence
  SiRNA target sequence
aggagttaaactacacagtaa

SEQ ID NO: 14018 - DNA, 21 bp, Artificial sequence
  SiRNA target sequence
ggagttaaactacacagtaaa

SEQ ID NO: 14019 - DNA, 21 bp, Artificial sequence
  SiRNA target sequence
gagttaaactacacagtaaaa

SEQ ID NO: 14020 - DNA, 21 bp, Artificial sequence
  SiRNA target sequence
agttaaactacacagtaaaaa

SEQ ID NO: 14021 - DNA, 21 bp, Artificial sequence
  SiRNA target sequence
gttaaactacacagtaaaaaa

SEQ ID NO: 14022 - DNA, 21 bp, Artificial sequence
  SiRNA target sequence
ttaaactacacagtaaaaaag

SEQ ID NO: 14023 - DNA, 21 bp, Artificial sequence
  SiRNA target sequence
taaactacacagtaaaaaagg

SEQ ID NO: 14024 - DNA, 21 bp, Artificial sequence
  SiRNA target sequence
aaactacacagtaaaaaagga

SEQ ID NO: 14025 - DNA, 21 bp, Artificial sequence
  SiRNA target sequence
aactacacagtaaaaaaggag

SEQ ID NO: 14026 - DNA, 21 bp, Artificial sequence
  SiRNA target sequence
actacacagtaaaaaaggaga

SEQ ID NO: 14027 - DNA, 21 bp, Artificial sequence
  SiRNA target sequence
ctacacagtaaaaaaggagaa

SEQ ID NO: 14028 - DNA, 21 bp, Artificial sequence
  SiRNA target sequence
tacacagtaaaaaaggagaaa

SEQ ID NO: 14029 - DNA, 21 bp, Artificial sequence
  SiRNA target sequence
acacagtaaaaaaggagaaat

SEQ ID NO: 14030 - DNA, 21 bp, Artificial sequence
  SiRNA target sequence
cacagtaaaaaaggagaaatt

SEQ ID NO: 14031 - DNA, 21 bp, Artificial sequence
  SiRNA target sequence
acagtaaaaaaggagaaatta

SEQ ID NO: 14032 - DNA, 21 bp, Artificial sequence
  SiRNA target sequence
cagtaaaaaaggagaaattat

SEQ ID NO: 14033 - DNA, 21 bp, Artificial sequence
  SiRNA target sequence
agtaaaaaaggagaaattatc

SEQ ID NO: 14034 - DNA, 21 bp, Artificial sequence
  SiRNA target sequence
gtaaaaaaggagaaattatcg

SEQ ID NO: 14035 - DNA, 21 bp, Artificial sequence
  SiRNA target sequence
taaaaaaggagaaattatcgg

SEQ ID NO: 14036 - DNA, 21 bp, Artificial sequence
  SiRNA target sequence
aaaaaaggagaaattatcgga

SEQ ID NO: 14037 - DNA, 21 bp, Artificial sequence
  SiRNA target sequence
aaaaaggagaaattatcggat

SEQ ID NO: 14038 - DNA, 21 bp, Artificial sequence
  SiRNA target sequence
aaaaggagaaattatcggatg

SEQ ID NO: 14039 - DNA, 21 bp, Artificial sequence
  SiRNA target sequence
aaaggagaaattatcggatgt

SEQ ID NO: 14040 - DNA, 21 bp, Artificial sequence
  SiRNA target sequence
aaggagaaattatcggatgtg

SEQ ID NO: 14041 - DNA, 21 bp, Artificial sequence
  SiRNA target sequence
aggagaaattatcggatgtgt

SEQ ID NO: 14042 - DNA, 21 bp, Artificial sequence
  SiRNA target sequence
ggagaaattatcggatgtgta

SEQ ID NO: 14043 - DNA, 21 bp, Artificial sequence
  SiRNA target sequence
gagaaattatcggatgtgtag

SEQ ID NO: 14044 - DNA, 21 bp, Artificial sequence
  SiRNA target sequence
agaaattatcggatgtgtaga

SEQ ID NO: 14045 - DNA, 21 bp, Artificial sequence
  SiRNA target sequence
gaaattatcggatgtgtagat

SEQ ID NO: 14046 - DNA, 21 bp, Artificial sequence
  SiRNA target sequence
aaattatcggatgtgtagata

SEQ ID NO: 14047 - DNA, 21 bp, Artificial sequence
  SiRNA target sequence
aattatcggatgtgtagataa

SEQ ID NO: 14048 - DNA, 21 bp, Artificial sequence
  SiRNA target sequence
attatcggatgtgtagataac

SEQ ID NO: 14049 - DNA, 21 bp, Artificial sequence
  SiRNA target sequence
ttatcggatgtgtagataaca

SEQ ID NO: 14050 - DNA, 21 bp, Artificial sequence
  SiRNA target sequence
tatcggatgtgtagataacaa

SEQ ID NO: 14051 - DNA, 21 bp, Artificial sequence
  SiRNA target sequence
atcggatgtgtagataacaat

SEQ ID NO: 14052 - DNA, 21 bp, Artificial sequence
  SiRNA target sequence
tcggatgtgtagataacaatc

SEQ ID NO: 14053 - DNA, 21 bp, Artificial sequence
  SiRNA target sequence
cggatgtgtagataacaatca

SEQ ID NO: 14054 - DNA, 21 bp, Artificial sequence
  SiRNA target sequence
ggatgtgtagataacaatcat

SEQ ID NO: 14055 - DNA, 21 bp, Artificial sequence
  SiRNA target sequence
gatgtgtagataacaatcata

SEQ ID NO: 14056 - DNA, 21 bp, Artificial sequence
  SiRNA target sequence
atgtgtagataacaatcatat

SEQ ID NO: 14057 - DNA, 21 bp, Artificial sequence
  SiRNA target sequence
tgtgtagataacaatcatatt

SEQ ID NO: 14058 - DNA, 21 bp, Artificial sequence
  SiRNA target sequence
gtgtagataacaatcatattt

SEQ ID NO: 14059 - DNA, 21 bp, Artificial sequence
  SiRNA target sequence
tgtagataacaatcatatttt

SEQ ID NO: 14060 - DNA, 21 bp, Artificial sequence
  SiRNA target sequence
gtagataacaatcatatttta

SEQ ID NO: 14061 - DNA, 21 bp, Artificial sequence
  SiRNA target sequence
tagataacaatcatattttaa

SEQ ID NO: 14062 - DNA, 21 bp, Artificial sequence
  SiRNA target sequence
agataacaatcatattttaag

SEQ ID NO: 14063 - DNA, 21 bp, Artificial sequence
  SiRNA target sequence
gataacaatcatattttaagc

SEQ ID NO: 14064 - DNA, 21 bp, Artificial sequence
  SiRNA target sequence
ataacaatcatattttaagca

SEQ ID NO: 14065 - DNA, 21 bp, Artificial sequence
  SiRNA target sequence
taacaatcatattttaagcat

SEQ ID NO: 14066 - DNA, 21 bp, Artificial sequence
  SiRNA target sequence
aacaatcatattttaagcata

SEQ ID NO: 14067 - DNA, 21 bp, Artificial sequence
  SiRNA target sequence
acaatcatattttaagcataa

SEQ ID NO: 14068 - DNA, 21 bp, Artificial sequence
  SiRNA target sequence
caatcatattttaagcataat

SEQ ID NO: 14069 - DNA, 21 bp, Artificial sequence
  SiRNA target sequence
aatcatattttaagcataatt

SEQ ID NO: 14070 - DNA, 21 bp, Artificial sequence
  SiRNA target sequence
atcatattttaagcataattt

SEQ ID NO: 14071 - DNA, 21 bp, Artificial sequence
  SiRNA target sequence
tcatattttaagcataattta

SEQ ID NO: 14072 - DNA, 21 bp, Artificial sequence
  SiRNA target sequence
catattttaagcataatttat

SEQ ID NO: 14073 - DNA, 21 bp, Artificial sequence
  SiRNA target sequence
atattttaagcataatttata

SEQ ID NO: 14074 - DNA, 21 bp, Artificial sequence
  SiRNA target sequence
tattttaagcataatttataa

SEQ ID NO: 14075 - DNA, 21 bp, Artificial sequence
  SiRNA target sequence
attttaagcataatttataat

SEQ ID NO: 14076 - DNA, 21 bp, Artificial sequence
  SiRNA target sequence
ttttaagcataatttataatg

SEQ ID NO: 14077 - DNA, 21 bp, Artificial sequence
  SiRNA target sequence
tttaagcataatttataatga

SEQ ID NO: 14078 - DNA, 21 bp, Artificial sequence
  SiRNA target sequence
ttaagcataatttataatgat

SEQ ID NO: 14079 - DNA, 21 bp, Artificial sequence
  SiRNA target sequence
taagcataatttataatgata

SEQ ID NO: 14080 - DNA, 21 bp, Artificial sequence
  SiRNA target sequence
aagcataatttataatgataa

SEQ ID NO: 14081 - DNA, 21 bp, Artificial sequence
  SiRNA target sequence
agcataatttataatgataaa

SEQ ID NO: 14082 - DNA, 21 bp, Artificial sequence
  SiRNA target sequence
gcataatttataatgataaat

SEQ ID NO: 14083 - DNA, 21 bp, Artificial sequence
  SiRNA target sequence
cataatttataatgataaatt

SEQ ID NO: 14084 - DNA, 21 bp, Artificial sequence
  SiRNA target sequence
ataatttataatgataaatta

SEQ ID NO: 14085 - DNA, 21 bp, Artificial sequence
  SiRNA target sequence
taatttataatgataaattat

SEQ ID NO: 14086 - DNA, 21 bp, Artificial sequence
  SiRNA target sequence
aatttataatgataaattatc

SEQ ID NO: 14087 - DNA, 21 bp, Artificial sequence
  SiRNA target sequence
atttataatgataaattatct

SEQ ID NO: 14088 - DNA, 21 bp, Artificial sequence
  SiRNA target sequence
tttataatgataaattatctg

SEQ ID NO: 14089 - DNA, 21 bp, Artificial sequence
  SiRNA target sequence
ttataatgataaattatctga

SEQ ID NO: 14090 - DNA, 21 bp, Artificial sequence
  SiRNA target sequence
tataatgataaattatctgaa

SEQ ID NO: 14091 - DNA, 21 bp, Artificial sequence
  SiRNA target sequence
ataatgataaattatctgaag

SEQ ID NO: 14092 - DNA, 21 bp, Artificial sequence
  SiRNA target sequence
taatgataaattatctgaagg

SEQ ID NO: 14093 - DNA, 21 bp, Artificial sequence
  SiRNA target sequence
aatgataaattatctgaaggg

SEQ ID NO: 14094 - DNA, 21 bp, Artificial sequence
  SiRNA target sequence
atgataaattatctgaagggt

SEQ ID NO: 14095 - DNA, 21 bp, Artificial sequence
  SiRNA target sequence
tgataaattatctgaagggtt

SEQ ID NO: 14096 - DNA, 21 bp, Artificial sequence
  SiRNA target sequence
gataaattatctgaagggtta

SEQ ID NO: 14097 - DNA, 21 bp, Artificial sequence
  SiRNA target sequence
ataaattatctgaagggttaa

SEQ ID NO: 14098 - DNA, 21 bp, Artificial sequence
  SiRNA target sequence
taaattatctgaagggttaac

SEQ ID NO: 14099 - DNA, 21 bp, Artificial sequence
  SiRNA target sequence
aaattatctgaagggttaaca

SEQ ID NO: 14100 - DNA, 21 bp, Artificial sequence
  SiRNA target sequence
aattatctgaagggttaacac

SEQ ID NO: 14101 - DNA, 21 bp, Artificial sequence
  SiRNA target sequence
attatctgaagggttaacact

SEQ ID NO: 14102 - DNA, 21 bp, Artificial sequence
  SiRNA target sequence
ttatctgaagggttaacactt

SEQ ID NO: 14103 - DNA, 21 bp, Artificial sequence
  SiRNA target sequence
tatctgaagggttaacactta

SEQ ID NO: 14104 - DNA, 21 bp, Artificial sequence
  SiRNA target sequence
atctgaagggttaacacttaa

SEQ ID NO: 14105 - DNA, 21 bp, Artificial sequence
  SiRNA target sequence
tctgaagggttaacacttaat

SEQ ID NO: 14106 - DNA, 21 bp, Artificial sequence
  SiRNA target sequence
ctgaagggttaacacttaatt

SEQ ID NO: 14107 - DNA, 21 bp, Artificial sequence
  SiRNA target sequence
tgaagggttaacacttaattt

SEQ ID NO: 14108 - DNA, 21 bp, Artificial sequence
  SiRNA target sequence
gaagggttaacacttaatttg

SEQ ID NO: 14109 - DNA, 21 bp, Artificial sequence
  SiRNA target sequence
aagggttaacacttaatttga

SEQ ID NO: 14110 - DNA, 21 bp, Artificial sequence
  SiRNA target sequence
agggttaacacttaatttgag

SEQ ID NO: 14111 - DNA, 21 bp, Artificial sequence
  SiRNA target sequence
gggttaacacttaatttgagt

SEQ ID NO: 14112 - DNA, 21 bp, Artificial sequence
  SiRNA target sequence
ggttaacacttaatttgagtt

SEQ ID NO: 14113 - DNA, 21 bp, Artificial sequence
  SiRNA target sequence
gttaacacttaatttgagttg

SEQ ID NO: 14114 - DNA, 21 bp, Artificial sequence
  SiRNA target sequence
ttaacacttaatttgagttgt

SEQ ID NO: 14115 - DNA, 21 bp, Artificial sequence
  SiRNA target sequence
taacacttaatttgagttgta

SEQ ID NO: 14116 - DNA, 21 bp, Artificial sequence
  SiRNA target sequence
aacacttaatttgagttgtag

SEQ ID NO: 14117 - DNA, 21 bp, Artificial sequence
  SiRNA target sequence
acacttaatttgagttgtaga

SEQ ID NO: 14118 - DNA, 21 bp, Artificial sequence
  SiRNA target sequence
cacttaatttgagttgtagat

SEQ ID NO: 14119 - DNA, 21 bp, Artificial sequence
  SiRNA target sequence
acttaatttgagttgtagatt

SEQ ID NO: 14120 - DNA, 21 bp, Artificial sequence
  SiRNA target sequence
cttaatttgagttgtagattt

SEQ ID NO: 14121 - DNA, 21 bp, Artificial sequence
  SiRNA target sequence
ttaatttgagttgtagatttg

SEQ ID NO: 14122 - DNA, 21 bp, Artificial sequence
  SiRNA target sequence
taatttgagttgtagatttgg

SEQ ID NO: 14123 - DNA, 21 bp, Artificial sequence
  SiRNA target sequence
aatttgagttgtagatttggt

SEQ ID NO: 14124 - DNA, 21 bp, Artificial sequence
  SiRNA target sequence
atttgagttgtagatttggta

SEQ ID NO: 14125 - DNA, 21 bp, Artificial sequence
  SiRNA target sequence
tttgagttgtagatttggtaa

SEQ ID NO: 14126 - DNA, 21 bp, Artificial sequence
  SiRNA target sequence
ttgagttgtagatttggtaag

SEQ ID NO: 14127 - DNA, 21 bp, Artificial sequence
  SiRNA target sequence
tgagttgtagatttggtaaga

SEQ ID NO: 14128 - DNA, 21 bp, Artificial sequence
  SiRNA target sequence
gagttgtagatttggtaagaa

SEQ ID NO: 14129 - DNA, 21 bp, Artificial sequence
  SiRNA target sequence
agttgtagatttggtaagaaa

SEQ ID NO: 14130 - DNA, 21 bp, Artificial sequence
  SiRNA target sequence
gttgtagatttggtaagaaag

SEQ ID NO: 14131 - DNA, 21 bp, Artificial sequence
  SiRNA target sequence
ttgtagatttggtaagaaagt

SEQ ID NO: 14132 - DNA, 21 bp, Artificial sequence
  SiRNA target sequence
tgtagatttggtaagaaagta

SEQ ID NO: 14133 - DNA, 21 bp, Artificial sequence
  SiRNA target sequence
gtagatttggtaagaaagtat

SEQ ID NO: 14134 - DNA, 21 bp, Artificial sequence
  SiRNA target sequence
tagatttggtaagaaagtatt

SEQ ID NO: 14135 - DNA, 21 bp, Artificial sequence
  SiRNA target sequence
agatttggtaagaaagtattt

SEQ ID NO: 14136 - DNA, 21 bp, Artificial sequence
  SiRNA target sequence
gatttggtaagaaagtatttg

SEQ ID NO: 14137 - DNA, 21 bp, Artificial sequence
  SiRNA target sequence
atttggtaagaaagtatttga

SEQ ID NO: 14138 - DNA, 21 bp, Artificial sequence
  SiRNA target sequence
tttggtaagaaagtatttgat

SEQ ID NO: 14139 - DNA, 21 bp, Artificial sequence
  SiRNA target sequence
ttggtaagaaagtatttgatt

SEQ ID NO: 14140 - DNA, 21 bp, Artificial sequence
  SiRNA target sequence
tggtaagaaagtatttgatta

SEQ ID NO: 14141 - DNA, 21 bp, Artificial sequence
  SiRNA target sequence
ggtaagaaagtatttgattat

SEQ ID NO: 14142 - DNA, 21 bp, Artificial sequence
  SiRNA target sequence
gtaagaaagtatttgattatg

SEQ ID NO: 14143 - DNA, 21 bp, Artificial sequence
  SiRNA target sequence
taagaaagtatttgattatgg

SEQ ID NO: 14144 - DNA, 21 bp, Artificial sequence
  SiRNA target sequence
aagaaagtatttgattatggc

SEQ ID NO: 14145 - DNA, 21 bp, Artificial sequence
  SiRNA target sequence
agaaagtatttgattatggct

SEQ ID NO: 14146 - DNA, 21 bp, Artificial sequence
  SiRNA target sequence
gaaagtatttgattatggcta

SEQ ID NO: 14147 - DNA, 21 bp, Artificial sequence
  SiRNA target sequence
aaagtatttgattatggctat

SEQ ID NO: 14148 - DNA, 21 bp, Artificial sequence
  SiRNA target sequence
aagtatttgattatggctatg

SEQ ID NO: 14149 - DNA, 21 bp, Artificial sequence
  SiRNA target sequence
agtatttgattatggctatgg

SEQ ID NO: 14150 - DNA, 21 bp, Artificial sequence
  SiRNA target sequence
gtatttgattatggctatggg

SEQ ID NO: 14151 - DNA, 21 bp, Artificial sequence
  SiRNA target sequence
tatttgattatggctatgggt

SEQ ID NO: 14152 - DNA, 21 bp, Artificial sequence
  SiRNA target sequence
atttgattatggctatgggtt

SEQ ID NO: 14153 - DNA, 21 bp, Artificial sequence
  SiRNA target sequence
tttgattatggctatgggttt

SEQ ID NO: 14154 - DNA, 21 bp, Artificial sequence
  SiRNA target sequence
ttgattatggctatgggttta

SEQ ID NO: 14155 - DNA, 21 bp, Artificial sequence
  SiRNA target sequence
tgattatggctatgggtttat

SEQ ID NO: 14156 - DNA, 21 bp, Artificial sequence
  SiRNA target sequence
gattatggctatgggtttatt

SEQ ID NO: 14157 - DNA, 21 bp, Artificial sequence
  SiRNA target sequence
attatggctatgggtttattt

SEQ ID NO: 14158 - DNA, 21 bp, Artificial sequence
  SiRNA target sequence
ttatggctatgggtttattta

SEQ ID NO: 14159 - DNA, 21 bp, Artificial sequence
  SiRNA target sequence
tatggctatgggtttatttat

SEQ ID NO: 14160 - DNA, 21 bp, Artificial sequence
  SiRNA target sequence
atggctatgggtttatttatg

SEQ ID NO: 14161 - DNA, 21 bp, Artificial sequence
  SiRNA target sequence
tggctatgggtttatttatga

SEQ ID NO: 14162 - DNA, 21 bp, Artificial sequence
  SiRNA target sequence
ggctatgggtttatttatgaa

SEQ ID NO: 14163 - DNA, 21 bp, Artificial sequence
  SiRNA target sequence
gctatgggtttatttatgaat

SEQ ID NO: 14164 - DNA, 21 bp, Artificial sequence
  SiRNA target sequence
ctatgggtttatttatgaatt

SEQ ID NO: 14165 - DNA, 21 bp, Artificial sequence
  SiRNA target sequence
tatgggtttatttatgaattt

SEQ ID NO: 14166 - DNA, 21 bp, Artificial sequence
  SiRNA target sequence
atgggtttatttatgaatttt

SEQ ID NO: 14167 - DNA, 21 bp, Artificial sequence
  SiRNA target sequence
tgggtttatttatgaatttta

SEQ ID NO: 14168 - DNA, 21 bp, Artificial sequence
  SiRNA target sequence
gggtttatttatgaattttaa

SEQ ID NO: 14169 - DNA, 22 bp, Artificial sequence
  SiRNA target sequence
atgaaatctttctacaaaaaaa

SEQ ID NO: 14170 - DNA, 22 bp, Artificial sequence
  SiRNA target sequence
tgaaatctttctacaaaaaaat

SEQ ID NO: 14171 - DNA, 22 bp, Artificial sequence
  SiRNA target sequence
gaaatctttctacaaaaaaata

SEQ ID NO: 14172 - DNA, 22 bp, Artificial sequence
  SiRNA target sequence
aaatctttctacaaaaaaataa

SEQ ID NO: 14173 - DNA, 22 bp, Artificial sequence
  SiRNA target sequence
aatctttctacaaaaaaataaa

SEQ ID NO: 14174 - DNA, 22 bp, Artificial sequence
  SiRNA target sequence
atctttctacaaaaaaataaaa

SEQ ID NO: 14175 - DNA, 22 bp, Artificial sequence
  SiRNA target sequence
tctttctacaaaaaaataaaaa

SEQ ID NO: 14176 - DNA, 22 bp, Artificial sequence
  SiRNA target sequence
ctttctacaaaaaaataaaaag

SEQ ID NO: 14177 - DNA, 22 bp, Artificial sequence
  SiRNA target sequence
tttctacaaaaaaataaaaagt

SEQ ID NO: 14178 - DNA, 22 bp, Artificial sequence
  SiRNA target sequence
ttctacaaaaaaataaaaagtt

SEQ ID NO: 14179 - DNA, 22 bp, Artificial sequence
  SiRNA target sequence
tctacaaaaaaataaaaagtta

SEQ ID NO: 14180 - DNA, 22 bp, Artificial sequence
  SiRNA target sequence
ctacaaaaaaataaaaagttat

SEQ ID NO: 14181 - DNA, 22 bp, Artificial sequence
  SiRNA target sequence
tacaaaaaaataaaaagttatt

SEQ ID NO: 14182 - DNA, 22 bp, Artificial sequence
  SiRNA target sequence
acaaaaaaataaaaagttattt

SEQ ID NO: 14183 - DNA, 22 bp, Artificial sequence
  SiRNA target sequence
caaaaaaataaaaagttattta

SEQ ID NO: 14184 - DNA, 22 bp, Artificial sequence
  SiRNA target sequence
aaaaaaataaaaagttatttat

SEQ ID NO: 14185 - DNA, 22 bp, Artificial sequence
  SiRNA target sequence
aaaaaataaaaagttatttatt

SEQ ID NO: 14186 - DNA, 22 bp, Artificial sequence
  SiRNA target sequence
aaaaataaaaagttatttattc

SEQ ID NO: 14187 - DNA, 22 bp, Artificial sequence
  SiRNA target sequence
aaaataaaaagttatttattca

SEQ ID NO: 14188 - DNA, 22 bp, Artificial sequence
  SiRNA target sequence
aaataaaaagttatttattcaa

SEQ ID NO: 14189 - DNA, 22 bp, Artificial sequence
  SiRNA target sequence
aataaaaagttatttattcaaa

SEQ ID NO: 14190 - DNA, 22 bp, Artificial sequence
  SiRNA target sequence
ataaaaagttatttattcaaat

SEQ ID NO: 14191 - DNA, 22 bp, Artificial sequence
  SiRNA target sequence
taaaaagttatttattcaaatc

SEQ ID NO: 14192 - DNA, 22 bp, Artificial sequence
  SiRNA target sequence
aaaaagttatttattcaaatct

SEQ ID NO: 14193 - DNA, 22 bp, Artificial sequence
  SiRNA target sequence
aaaagttatttattcaaatctg

SEQ ID NO: 14194 - DNA, 22 bp, Artificial sequence
  SiRNA target sequence
aaagttatttattcaaatctgc

SEQ ID NO: 14195 - DNA, 22 bp, Artificial sequence
  SiRNA target sequence
aagttatttattcaaatctgcc

SEQ ID NO: 14196 - DNA, 22 bp, Artificial sequence
  SiRNA target sequence
agttatttattcaaatctgcca

SEQ ID NO: 14197 - DNA, 22 bp, Artificial sequence
  SiRNA target sequence
gttatttattcaaatctgccat

SEQ ID NO: 14198 - DNA, 22 bp, Artificial sequence
  SiRNA target sequence
ttatttattcaaatctgccatt

SEQ ID NO: 14199 - DNA, 22 bp, Artificial sequence
  SiRNA target sequence
tatttattcaaatctgccatta

SEQ ID NO: 14200 - DNA, 22 bp, Artificial sequence
  SiRNA target sequence
atttattcaaatctgccattaa

SEQ ID NO: 14201 - DNA, 22 bp, Artificial sequence
  SiRNA target sequence
tttattcaaatctgccattaat

SEQ ID NO: 14202 - DNA, 22 bp, Artificial sequence
  SiRNA target sequence
ttattcaaatctgccattaata

SEQ ID NO: 14203 - DNA, 22 bp, Artificial sequence
  SiRNA target sequence
tattcaaatctgccattaatac

SEQ ID NO: 14204 - DNA, 22 bp, Artificial sequence
  SiRNA target sequence
attcaaatctgccattaataca

SEQ ID NO: 14205 - DNA, 22 bp, Artificial sequence
  SiRNA target sequence
ttcaaatctgccattaatacat

SEQ ID NO: 14206 - DNA, 22 bp, Artificial sequence
  SiRNA target sequence
tcaaatctgccattaatacatc

SEQ ID NO: 14207 - DNA, 22 bp, Artificial sequence
  SiRNA target sequence
caaatctgccattaatacatct

SEQ ID NO: 14208 - DNA, 22 bp, Artificial sequence
  SiRNA target sequence
aaatctgccattaatacatctt

SEQ ID NO: 14209 - DNA, 22 bp, Artificial sequence
  SiRNA target sequence
aatctgccattaatacatcttt

SEQ ID NO: 14210 - DNA, 22 bp, Artificial sequence
  SiRNA target sequence
atctgccattaatacatctttt

SEQ ID NO: 14211 - DNA, 22 bp, Artificial sequence
  SiRNA target sequence
tctgccattaatacatcttttg

SEQ ID NO: 14212 - DNA, 22 bp, Artificial sequence
  SiRNA target sequence
ctgccattaatacatcttttga

SEQ ID NO: 14213 - DNA, 22 bp, Artificial sequence
  SiRNA target sequence
tgccattaatacatcttttgat

SEQ ID NO: 14214 - DNA, 22 bp, Artificial sequence
  SiRNA target sequence
gccattaatacatcttttgata

SEQ ID NO: 14215 - DNA, 22 bp, Artificial sequence
  SiRNA target sequence
ccattaatacatcttttgatac

SEQ ID NO: 14216 - DNA, 22 bp, Artificial sequence
  SiRNA target sequence
cattaatacatcttttgatact

SEQ ID NO: 14217 - DNA, 22 bp, Artificial sequence
  SiRNA target sequence
attaatacatcttttgatactt

SEQ ID NO: 14218 - DNA, 22 bp, Artificial sequence
  SiRNA target sequence
ttaatacatcttttgatacttt

SEQ ID NO: 14219 - DNA, 22 bp, Artificial sequence
  SiRNA target sequence
taatacatcttttgatactttt

SEQ ID NO: 14220 - DNA, 22 bp, Artificial sequence
  SiRNA target sequence
aatacatcttttgatactttta

SEQ ID NO: 14221 - DNA, 22 bp, Artificial sequence
  SiRNA target sequence
atacatcttttgatacttttaa

SEQ ID NO: 14222 - DNA, 22 bp, Artificial sequence
  SiRNA target sequence
tacatcttttgatacttttaat

SEQ ID NO: 14223 - DNA, 22 bp, Artificial sequence
  SiRNA target sequence
acatcttttgatacttttaatt

SEQ ID NO: 14224 - DNA, 22 bp, Artificial sequence
  SiRNA target sequence
catcttttgatacttttaattt

SEQ ID NO: 14225 - DNA, 22 bp, Artificial sequence
  SiRNA target sequence
atcttttgatacttttaattta

SEQ ID NO: 14226 - DNA, 22 bp, Artificial sequence
  SiRNA target sequence
tcttttgatacttttaatttag

SEQ ID NO: 14227 - DNA, 22 bp, Artificial sequence
  SiRNA target sequence
cttttgatacttttaatttaga

SEQ ID NO: 14228 - DNA, 22 bp, Artificial sequence
  SiRNA target sequence
ttttgatacttttaatttagaa

SEQ ID NO: 14229 - DNA, 22 bp, Artificial sequence
  SiRNA target sequence
tttgatacttttaatttagaaa

SEQ ID NO: 14230 - DNA, 22 bp, Artificial sequence
  SiRNA target sequence
ttgatacttttaatttagaaaa

SEQ ID NO: 14231 - DNA, 22 bp, Artificial sequence
  SiRNA target sequence
tgatacttttaatttagaaaat

SEQ ID NO: 14232 - DNA, 22 bp, Artificial sequence
  SiRNA target sequence
gatacttttaatttagaaaatg

SEQ ID NO: 14233 - DNA, 22 bp, Artificial sequence
  SiRNA target sequence
atacttttaatttagaaaatgt

SEQ ID NO: 14234 - DNA, 22 bp, Artificial sequence
  SiRNA target sequence
tacttttaatttagaaaatgta

SEQ ID NO: 14235 - DNA, 22 bp, Artificial sequence
  SiRNA target sequence
acttttaatttagaaaatgtaa

SEQ ID NO: 14236 - DNA, 22 bp, Artificial sequence
  SiRNA target sequence
cttttaatttagaaaatgtaag

SEQ ID NO: 14237 - DNA, 22 bp, Artificial sequence
  SiRNA target sequence
ttttaatttagaaaatgtaagc

SEQ ID NO: 14238 - DNA, 22 bp, Artificial sequence
  SiRNA target sequence
tttaatttagaaaatgtaagca

SEQ ID NO: 14239 - DNA, 22 bp, Artificial sequence
  SiRNA target sequence
ttaatttagaaaatgtaagcat

SEQ ID NO: 14240 - DNA, 22 bp, Artificial sequence
  SiRNA target sequence
taatttagaaaatgtaagcatt

SEQ ID NO: 14241 - DNA, 22 bp, Artificial sequence
  SiRNA target sequence
aatttagaaaatgtaagcatta

SEQ ID NO: 14242 - DNA, 22 bp, Artificial sequence
  SiRNA target sequence
atttagaaaatgtaagcattac

SEQ ID NO: 14243 - DNA, 22 bp, Artificial sequence
  SiRNA target sequence
tttagaaaatgtaagcattact

SEQ ID NO: 14244 - DNA, 22 bp, Artificial sequence
  SiRNA target sequence
ttagaaaatgtaagcattacta

SEQ ID NO: 14245 - DNA, 22 bp, Artificial sequence
  SiRNA target sequence
tagaaaatgtaagcattactag

SEQ ID NO: 14246 - DNA, 22 bp, Artificial sequence
  SiRNA target sequence
agaaaatgtaagcattactagc

SEQ ID NO: 14247 - DNA, 22 bp, Artificial sequence
  SiRNA target sequence
gaaaatgtaagcattactagct

SEQ ID NO: 14248 - DNA, 22 bp, Artificial sequence
  SiRNA target sequence
aaaatgtaagcattactagctt

SEQ ID NO: 14249 - DNA, 22 bp, Artificial sequence
  SiRNA target sequence
aaatgtaagcattactagctta

SEQ ID NO: 14250 - DNA, 22 bp, Artificial sequence
  SiRNA target sequence
aatgtaagcattactagcttaa

SEQ ID NO: 14251 - DNA, 22 bp, Artificial sequence
  SiRNA target sequence
atgtaagcattactagcttaaa

SEQ ID NO: 14252 - DNA, 22 bp, Artificial sequence
  SiRNA target sequence
tgtaagcattactagcttaaat

SEQ ID NO: 14253 - DNA, 22 bp, Artificial sequence
  SiRNA target sequence
gtaagcattactagcttaaata

SEQ ID NO: 14254 - DNA, 22 bp, Artificial sequence
  SiRNA target sequence
taagcattactagcttaaatac

SEQ ID NO: 14255 - DNA, 22 bp, Artificial sequence
  SiRNA target sequence
aagcattactagcttaaatacg

SEQ ID NO: 14256 - DNA, 22 bp, Artificial sequence
  SiRNA target sequence
agcattactagcttaaatacgt

SEQ ID NO: 14257 - DNA, 22 bp, Artificial sequence
  SiRNA target sequence
gcattactagcttaaatacgta

SEQ ID NO: 14258 - DNA, 22 bp, Artificial sequence
  SiRNA target sequence
cattactagcttaaatacgtac

SEQ ID NO: 14259 - DNA, 22 bp, Artificial sequence
  SiRNA target sequence
attactagcttaaatacgtaca

SEQ ID NO: 14260 - DNA, 22 bp, Artificial sequence
  SiRNA target sequence
ttactagcttaaatacgtacac

SEQ ID NO: 14261 - DNA, 22 bp, Artificial sequence
  SiRNA target sequence
tactagcttaaatacgtacacc

SEQ ID NO: 14262 - DNA, 22 bp, Artificial sequence
  SiRNA target sequence
actagcttaaatacgtacaccg

SEQ ID NO: 14263 - DNA, 22 bp, Artificial sequence
  SiRNA target sequence
ctagcttaaatacgtacaccgg

SEQ ID NO: 14264 - DNA, 22 bp, Artificial sequence
  SiRNA target sequence
tagcttaaatacgtacaccggt

SEQ ID NO: 14265 - DNA, 22 bp, Artificial sequence
  SiRNA target sequence
agcttaaatacgtacaccggtg

SEQ ID NO: 14266 - DNA, 22 bp, Artificial sequence
  SiRNA target sequence
gcttaaatacgtacaccggtgt

SEQ ID NO: 14267 - DNA, 22 bp, Artificial sequence
  SiRNA target sequence
cttaaatacgtacaccggtgtt

SEQ ID NO: 14268 - DNA, 22 bp, Artificial sequence
  SiRNA target sequence
ttaaatacgtacaccggtgtta

SEQ ID NO: 14269 - DNA, 22 bp, Artificial sequence
  SiRNA target sequence
taaatacgtacaccggtgttaa

SEQ ID NO: 14270 - DNA, 22 bp, Artificial sequence
  SiRNA target sequence
aaatacgtacaccggtgttaaa

SEQ ID NO: 14271 - DNA, 22 bp, Artificial sequence
  SiRNA target sequence
aatacgtacaccggtgttaaaa

SEQ ID NO: 14272 - DNA, 22 bp, Artificial sequence
  SiRNA target sequence
atacgtacaccggtgttaaaac

SEQ ID NO: 14273 - DNA, 22 bp, Artificial sequence
  SiRNA target sequence
tacgtacaccggtgttaaaacc

SEQ ID NO: 14274 - DNA, 22 bp, Artificial sequence
  SiRNA target sequence
acgtacaccggtgttaaaaccg

SEQ ID NO: 14275 - DNA, 22 bp, Artificial sequence
  SiRNA target sequence
cgtacaccggtgttaaaaccga

SEQ ID NO: 14276 - DNA, 22 bp, Artificial sequence
  SiRNA target sequence
gtacaccggtgttaaaaccgaa

SEQ ID NO: 14277 - DNA, 22 bp, Artificial sequence
  SiRNA target sequence
tacaccggtgttaaaaccgaaa

SEQ ID NO: 14278 - DNA, 22 bp, Artificial sequence
  SiRNA target sequence
acaccggtgttaaaaccgaaat

SEQ ID NO: 14279 - DNA, 22 bp, Artificial sequence
  SiRNA target sequence
caccggtgttaaaaccgaaata

SEQ ID NO: 14280 - DNA, 22 bp, Artificial sequence
  SiRNA target sequence
accggtgttaaaaccgaaatat

SEQ ID NO: 14281 - DNA, 22 bp, Artificial sequence
  SiRNA target sequence
ccggtgttaaaaccgaaatatc

SEQ ID NO: 14282 - DNA, 22 bp, Artificial sequence
  SiRNA target sequence
cggtgttaaaaccgaaatatca

SEQ ID NO: 14283 - DNA, 22 bp, Artificial sequence
  SiRNA target sequence
ggtgttaaaaccgaaatatcaa

SEQ ID NO: 14284 - DNA, 22 bp, Artificial sequence
  SiRNA target sequence
gtgttaaaaccgaaatatcaaa

SEQ ID NO: 14285 - DNA, 22 bp, Artificial sequence
  SiRNA target sequence
tgttaaaaccgaaatatcaaaa

SEQ ID NO: 14286 - DNA, 22 bp, Artificial sequence
  SiRNA target sequence
gttaaaaccgaaatatcaaaaa

SEQ ID NO: 14287 - DNA, 22 bp, Artificial sequence
  SiRNA target sequence
ttaaaaccgaaatatcaaaaac

SEQ ID NO: 14288 - DNA, 22 bp, Artificial sequence
  SiRNA target sequence
taaaaccgaaatatcaaaaacc

SEQ ID NO: 14289 - DNA, 22 bp, Artificial sequence
  SiRNA target sequence
aaaaccgaaatatcaaaaaccg

SEQ ID NO: 14290 - DNA, 22 bp, Artificial sequence
  SiRNA target sequence
aaaccgaaatatcaaaaaccgt

SEQ ID NO: 14291 - DNA, 22 bp, Artificial sequence
  SiRNA target sequence
aaccgaaatatcaaaaaccgta

SEQ ID NO: 14292 - DNA, 22 bp, Artificial sequence
  SiRNA target sequence
accgaaatatcaaaaaccgtat

SEQ ID NO: 14293 - DNA, 22 bp, Artificial sequence
  SiRNA target sequence
ccgaaatatcaaaaaccgtatc

SEQ ID NO: 14294 - DNA, 22 bp, Artificial sequence
  SiRNA target sequence
cgaaatatcaaaaaccgtatca

SEQ ID NO: 14295 - DNA, 22 bp, Artificial sequence
  SiRNA target sequence
gaaatatcaaaaaccgtatcac

SEQ ID NO: 14296 - DNA, 22 bp, Artificial sequence
  SiRNA target sequence
aaatatcaaaaaccgtatcacc

SEQ ID NO: 14297 - DNA, 22 bp, Artificial sequence
  SiRNA target sequence
aatatcaaaaaccgtatcacca

SEQ ID NO: 14298 - DNA, 22 bp, Artificial sequence
  SiRNA target sequence
atatcaaaaaccgtatcaccac

SEQ ID NO: 14299 - DNA, 22 bp, Artificial sequence
  SiRNA target sequence
tatcaaaaaccgtatcaccaca

SEQ ID NO: 14300 - DNA, 22 bp, Artificial sequence
  SiRNA target sequence
atcaaaaaccgtatcaccacac

SEQ ID NO: 14301 - DNA, 22 bp, Artificial sequence
  SiRNA target sequence
tcaaaaaccgtatcaccacact

SEQ ID NO: 14302 - DNA, 22 bp, Artificial sequence
  SiRNA target sequence
caaaaaccgtatcaccacactt

SEQ ID NO: 14303 - DNA, 22 bp, Artificial sequence
  SiRNA target sequence
aaaaaccgtatcaccacacttc

SEQ ID NO: 14304 - DNA, 22 bp, Artificial sequence
  SiRNA target sequence
aaaaccgtatcaccacacttcc

SEQ ID NO: 14305 - DNA, 22 bp, Artificial sequence
  SiRNA target sequence
aaaccgtatcaccacacttcca

SEQ ID NO: 14306 - DNA, 22 bp, Artificial sequence
  SiRNA target sequence
aaccgtatcaccacacttccag

SEQ ID NO: 14307 - DNA, 22 bp, Artificial sequence
  SiRNA target sequence
accgtatcaccacacttccaga

SEQ ID NO: 14308 - DNA, 22 bp, Artificial sequence
  SiRNA target sequence
ccgtatcaccacacttccagat

SEQ ID NO: 14309 - DNA, 22 bp, Artificial sequence
  SiRNA target sequence
cgtatcaccacacttccagatt

SEQ ID NO: 14310 - DNA, 22 bp, Artificial sequence
  SiRNA target sequence
gtatcaccacacttccagattt

SEQ ID NO: 14311 - DNA, 22 bp, Artificial sequence
  SiRNA target sequence
tatcaccacacttccagatttc

SEQ ID NO: 14312 - DNA, 22 bp, Artificial sequence
  SiRNA target sequence
atcaccacacttccagatttct

SEQ ID NO: 14313 - DNA, 22 bp, Artificial sequence
  SiRNA target sequence
tcaccacacttccagatttctc

SEQ ID NO: 14314 - DNA, 22 bp, Artificial sequence
  SiRNA target sequence
caccacacttccagatttctca

SEQ ID NO: 14315 - DNA, 22 bp, Artificial sequence
  SiRNA target sequence
accacacttccagatttctcat

SEQ ID NO: 14316 - DNA, 22 bp, Artificial sequence
  SiRNA target sequence
ccacacttccagatttctcatg

SEQ ID NO: 14317 - DNA, 22 bp, Artificial sequence
  SiRNA target sequence
cacacttccagatttctcatgt

SEQ ID NO: 14318 - DNA, 22 bp, Artificial sequence
  SiRNA target sequence
acacttccagatttctcatgtc

SEQ ID NO: 14319 - DNA, 22 bp, Artificial sequence
  SiRNA target sequence
cacttccagatttctcatgtct

SEQ ID NO: 14320 - DNA, 22 bp, Artificial sequence
  SiRNA target sequence
acttccagatttctcatgtctc

SEQ ID NO: 14321 - DNA, 22 bp, Artificial sequence
  SiRNA target sequence
cttccagatttctcatgtctct

SEQ ID NO: 14322 - DNA, 22 bp, Artificial sequence
  SiRNA target sequence
ttccagatttctcatgtctctt

SEQ ID NO: 14323 - DNA, 22 bp, Artificial sequence
  SiRNA target sequence
tccagatttctcatgtctcttc

SEQ ID NO: 14324 - DNA, 22 bp, Artificial sequence
  SiRNA target sequence
ccagatttctcatgtctcttct

SEQ ID NO: 14325 - DNA, 22 bp, Artificial sequence
  SiRNA target sequence
cagatttctcatgtctcttcta

SEQ ID NO: 14326 - DNA, 22 bp, Artificial sequence
  SiRNA target sequence
agatttctcatgtctcttctat

SEQ ID NO: 14327 - DNA, 22 bp, Artificial sequence
  SiRNA target sequence
gatttctcatgtctcttctatg

SEQ ID NO: 14328 - DNA, 22 bp, Artificial sequence
  SiRNA target sequence
atttctcatgtctcttctatgg

SEQ ID NO: 14329 - DNA, 22 bp, Artificial sequence
  SiRNA target sequence
tttctcatgtctcttctatggg

SEQ ID NO: 14330 - DNA, 22 bp, Artificial sequence
  SiRNA target sequence
ttctcatgtctcttctatgggc

SEQ ID NO: 14331 - DNA, 22 bp, Artificial sequence
  SiRNA target sequence
tctcatgtctcttctatgggcg

SEQ ID NO: 14332 - DNA, 22 bp, Artificial sequence
  SiRNA target sequence
ctcatgtctcttctatgggcgc

SEQ ID NO: 14333 - DNA, 22 bp, Artificial sequence
  SiRNA target sequence
tcatgtctcttctatgggcgca

SEQ ID NO: 14334 - DNA, 22 bp, Artificial sequence
  SiRNA target sequence
catgtctcttctatgggcgcag

SEQ ID NO: 14335 - DNA, 22 bp, Artificial sequence
  SiRNA target sequence
atgtctcttctatgggcgcaga

SEQ ID NO: 14336 - DNA, 22 bp, Artificial sequence
  SiRNA target sequence
tgtctcttctatgggcgcagat

SEQ ID NO: 14337 - DNA, 22 bp, Artificial sequence
  SiRNA target sequence
gtctcttctatgggcgcagatt

SEQ ID NO: 14338 - DNA, 22 bp, Artificial sequence
  SiRNA target sequence
tctcttctatgggcgcagattt

SEQ ID NO: 14339 - DNA, 22 bp, Artificial sequence
  SiRNA target sequence
ctcttctatgggcgcagatttc

SEQ ID NO: 14340 - DNA, 22 bp, Artificial sequence
  SiRNA target sequence
tcttctatgggcgcagatttcg

SEQ ID NO: 14341 - DNA, 22 bp, Artificial sequence
  SiRNA target sequence
cttctatgggcgcagatttcga

SEQ ID NO: 14342 - DNA, 22 bp, Artificial sequence
  SiRNA target sequence
ttctatgggcgcagatttcgac

SEQ ID NO: 14343 - DNA, 22 bp, Artificial sequence
  SiRNA target sequence
tctatgggcgcagatttcgaca

SEQ ID NO: 14344 - DNA, 22 bp, Artificial sequence
  SiRNA target sequence
ctatgggcgcagatttcgacat

SEQ ID NO: 14345 - DNA, 22 bp, Artificial sequence
  SiRNA target sequence
tatgggcgcagatttcgacata

SEQ ID NO: 14346 - DNA, 22 bp, Artificial sequence
  SiRNA target sequence
atgggcgcagatttcgacataa

SEQ ID NO: 14347 - DNA, 22 bp, Artificial sequence
  SiRNA target sequence
tgggcgcagatttcgacataaa

SEQ ID NO: 14348 - DNA, 22 bp, Artificial sequence
  SiRNA target sequence
gggcgcagatttcgacataaaa

SEQ ID NO: 14349 - DNA, 22 bp, Artificial sequence
  SiRNA target sequence
ggcgcagatttcgacataaaac

SEQ ID NO: 14350 - DNA, 22 bp, Artificial sequence
  SiRNA target sequence
gcgcagatttcgacataaaaca

SEQ ID NO: 14351 - DNA, 22 bp, Artificial sequence
  SiRNA target sequence
cgcagatttcgacataaaacag

SEQ ID NO: 14352 - DNA, 22 bp, Artificial sequence
  SiRNA target sequence
gcagatttcgacataaaacaga

SEQ ID NO: 14353 - DNA, 22 bp, Artificial sequence
  SiRNA target sequence
cagatttcgacataaaacagac

SEQ ID NO: 14354 - DNA, 22 bp, Artificial sequence
  SiRNA target sequence
agatttcgacataaaacagaca

SEQ ID NO: 14355 - DNA, 22 bp, Artificial sequence
  SiRNA target sequence
gatttcgacataaaacagacat

SEQ ID NO: 14356 - DNA, 22 bp, Artificial sequence
  SiRNA target sequence
atttcgacataaaacagacata

SEQ ID NO: 14357 - DNA, 22 bp, Artificial sequence
  SiRNA target sequence
tttcgacataaaacagacatac

SEQ ID NO: 14358 - DNA, 22 bp, Artificial sequence
  SiRNA target sequence
ttcgacataaaacagacatacg

SEQ ID NO: 14359 - DNA, 22 bp, Artificial sequence
  SiRNA target sequence
tcgacataaaacagacatacgc

SEQ ID NO: 14360 - DNA, 22 bp, Artificial sequence
  SiRNA target sequence
cgacataaaacagacatacgcc

SEQ ID NO: 14361 - DNA, 22 bp, Artificial sequence
  SiRNA target sequence
gacataaaacagacatacgcca

SEQ ID NO: 14362 - DNA, 22 bp, Artificial sequence
  SiRNA target sequence
acataaaacagacatacgccac

SEQ ID NO: 14363 - DNA, 22 bp, Artificial sequence
  SiRNA target sequence
cataaaacagacatacgccacg

SEQ ID NO: 14364 - DNA, 22 bp, Artificial sequence
  SiRNA target sequence
ataaaacagacatacgccacgt

SEQ ID NO: 14365 - DNA, 22 bp, Artificial sequence
  SiRNA target sequence
taaaacagacatacgccacgtt

SEQ ID NO: 14366 - DNA, 22 bp, Artificial sequence
  SiRNA target sequence
aaaacagacatacgccacgttc

SEQ ID NO: 14367 - DNA, 22 bp, Artificial sequence
  SiRNA target sequence
aaacagacatacgccacgttct

SEQ ID NO: 14368 - DNA, 22 bp, Artificial sequence
  SiRNA target sequence
aacagacatacgccacgttctg

SEQ ID NO: 14369 - DNA, 22 bp, Artificial sequence
  SiRNA target sequence
acagacatacgccacgttctgc

SEQ ID NO: 14370 - DNA, 22 bp, Artificial sequence
  SiRNA target sequence
cagacatacgccacgttctgct

SEQ ID NO: 14371 - DNA, 22 bp, Artificial sequence
  SiRNA target sequence
agacatacgccacgttctgctt

SEQ ID NO: 14372 - DNA, 22 bp, Artificial sequence
  SiRNA target sequence
gacatacgccacgttctgcttt

SEQ ID NO: 14373 - DNA, 22 bp, Artificial sequence
  SiRNA target sequence
acatacgccacgttctgcttta

SEQ ID NO: 14374 - DNA, 22 bp, Artificial sequence
  SiRNA target sequence
catacgccacgttctgctttaa

SEQ ID NO: 14375 - DNA, 22 bp, Artificial sequence
  SiRNA target sequence
atacgccacgttctgctttaac

SEQ ID NO: 14376 - DNA, 22 bp, Artificial sequence
  SiRNA target sequence
tacgccacgttctgctttaaca

SEQ ID NO: 14377 - DNA, 22 bp, Artificial sequence
  SiRNA target sequence
acgccacgttctgctttaacaa

SEQ ID NO: 14378 - DNA, 22 bp, Artificial sequence
  SiRNA target sequence
cgccacgttctgctttaacaat

SEQ ID NO: 14379 - DNA, 22 bp, Artificial sequence
  SiRNA target sequence
gccacgttctgctttaacaatc

SEQ ID NO: 14380 - DNA, 22 bp, Artificial sequence
  SiRNA target sequence
ccacgttctgctttaacaatct

SEQ ID NO: 14381 - DNA, 22 bp, Artificial sequence
  SiRNA target sequence
cacgttctgctttaacaatctt

SEQ ID NO: 14382 - DNA, 22 bp, Artificial sequence
  SiRNA target sequence
acgttctgctttaacaatcttt

SEQ ID NO: 14383 - DNA, 22 bp, Artificial sequence
  SiRNA target sequence
cgttctgctttaacaatctttt

SEQ ID NO: 14384 - DNA, 22 bp, Artificial sequence
  SiRNA target sequence
gttctgctttaacaatcttttg

SEQ ID NO: 14385 - DNA, 22 bp, Artificial sequence
  SiRNA target sequence
ttctgctttaacaatcttttgc

SEQ ID NO: 14386 - DNA, 22 bp, Artificial sequence
  SiRNA target sequence
tctgctttaacaatcttttgct

SEQ ID NO: 14387 - DNA, 22 bp, Artificial sequence
  SiRNA target sequence
ctgctttaacaatcttttgcta

SEQ ID NO: 14388 - DNA, 22 bp, Artificial sequence
  SiRNA target sequence
tgctttaacaatcttttgctac

SEQ ID NO: 14389 - DNA, 22 bp, Artificial sequence
  SiRNA target sequence
gctttaacaatcttttgctaca

SEQ ID NO: 14390 - DNA, 22 bp, Artificial sequence
  SiRNA target sequence
ctttaacaatcttttgctacaa

SEQ ID NO: 14391 - DNA, 22 bp, Artificial sequence
  SiRNA target sequence
tttaacaatcttttgctacaaa

SEQ ID NO: 14392 - DNA, 22 bp, Artificial sequence
  SiRNA target sequence
ttaacaatcttttgctacaaac

SEQ ID NO: 14393 - DNA, 22 bp, Artificial sequence
  SiRNA target sequence
taacaatcttttgctacaaacg

SEQ ID NO: 14394 - DNA, 22 bp, Artificial sequence
  SiRNA target sequence
aacaatcttttgctacaaacga

SEQ ID NO: 14395 - DNA, 22 bp, Artificial sequence
  SiRNA target sequence
acaatcttttgctacaaacgag

SEQ ID NO: 14396 - DNA, 22 bp, Artificial sequence
  SiRNA target sequence
caatcttttgctacaaacgagc

SEQ ID NO: 14397 - DNA, 22 bp, Artificial sequence
  SiRNA target sequence
aatcttttgctacaaacgagca

SEQ ID NO: 14398 - DNA, 22 bp, Artificial sequence
  SiRNA target sequence
atcttttgctacaaacgagcat

SEQ ID NO: 14399 - DNA, 22 bp, Artificial sequence
  SiRNA target sequence
tcttttgctacaaacgagcata

SEQ ID NO: 14400 - DNA, 22 bp, Artificial sequence
  SiRNA target sequence
cttttgctacaaacgagcatag

SEQ ID NO: 14401 - DNA, 22 bp, Artificial sequence
  SiRNA target sequence
ttttgctacaaacgagcataga

SEQ ID NO: 14402 - DNA, 22 bp, Artificial sequence
  SiRNA target sequence
tttgctacaaacgagcatagac

SEQ ID NO: 14403 - DNA, 22 bp, Artificial sequence
  SiRNA target sequence
ttgctacaaacgagcatagacc

SEQ ID NO: 14404 - DNA, 22 bp, Artificial sequence
  SiRNA target sequence
tgctacaaacgagcatagacca

SEQ ID NO: 14405 - DNA, 22 bp, Artificial sequence
  SiRNA target sequence
gctacaaacgagcatagaccaa

SEQ ID NO: 14406 - DNA, 22 bp, Artificial sequence
  SiRNA target sequence
ctacaaacgagcatagaccaag

SEQ ID NO: 14407 - DNA, 22 bp, Artificial sequence
  SiRNA target sequence
tacaaacgagcatagaccaaga

SEQ ID NO: 14408 - DNA, 22 bp, Artificial sequence
  SiRNA target sequence
acaaacgagcatagaccaagac

SEQ ID NO: 14409 - DNA, 22 bp, Artificial sequence
  SiRNA target sequence
caaacgagcatagaccaagaca

SEQ ID NO: 14410 - DNA, 22 bp, Artificial sequence
  SiRNA target sequence
aaacgagcatagaccaagacaa

SEQ ID NO: 14411 - DNA, 22 bp, Artificial sequence
  SiRNA target sequence
aacgagcatagaccaagacaaa

SEQ ID NO: 14412 - DNA, 22 bp, Artificial sequence
  SiRNA target sequence
acgagcatagaccaagacaaaa

SEQ ID NO: 14413 - DNA, 22 bp, Artificial sequence
  SiRNA target sequence
cgagcatagaccaagacaaaat

SEQ ID NO: 14414 - DNA, 22 bp, Artificial sequence
  SiRNA target sequence
gagcatagaccaagacaaaata

SEQ ID NO: 14415 - DNA, 22 bp, Artificial sequence
  SiRNA target sequence
agcatagaccaagacaaaatat

SEQ ID NO: 14416 - DNA, 22 bp, Artificial sequence
  SiRNA target sequence
gcatagaccaagacaaaatatt

SEQ ID NO: 14417 - DNA, 22 bp, Artificial sequence
  SiRNA target sequence
catagaccaagacaaaatattt

SEQ ID NO: 14418 - DNA, 22 bp, Artificial sequence
  SiRNA target sequence
atagaccaagacaaaatattta

SEQ ID NO: 14419 - DNA, 22 bp, Artificial sequence
  SiRNA target sequence
tagaccaagacaaaatatttag

SEQ ID NO: 14420 - DNA, 22 bp, Artificial sequence
  SiRNA target sequence
agaccaagacaaaatatttaga

SEQ ID NO: 14421 - DNA, 22 bp, Artificial sequence
  SiRNA target sequence
gaccaagacaaaatatttagaa

SEQ ID NO: 14422 - DNA, 22 bp, Artificial sequence
  SiRNA target sequence
accaagacaaaatatttagaat

SEQ ID NO: 14423 - DNA, 22 bp, Artificial sequence
  SiRNA target sequence
ccaagacaaaatatttagaata

SEQ ID NO: 14424 - DNA, 22 bp, Artificial sequence
  SiRNA target sequence
caagacaaaatatttagaataa

SEQ ID NO: 14425 - DNA, 22 bp, Artificial sequence
  SiRNA target sequence
aagacaaaatatttagaataag

SEQ ID NO: 14426 - DNA, 22 bp, Artificial sequence
  SiRNA target sequence
agacaaaatatttagaataaga

SEQ ID NO: 14427 - DNA, 22 bp, Artificial sequence
  SiRNA target sequence
gacaaaatatttagaataagag

SEQ ID NO: 14428 - DNA, 22 bp, Artificial sequence
  SiRNA target sequence
acaaaatatttagaataagagg

SEQ ID NO: 14429 - DNA, 22 bp, Artificial sequence
  SiRNA target sequence
caaaatatttagaataagaggt

SEQ ID NO: 14430 - DNA, 22 bp, Artificial sequence
  SiRNA target sequence
aaaatatttagaataagaggta

SEQ ID NO: 14431 - DNA, 22 bp, Artificial sequence
  SiRNA target sequence
aaatatttagaataagaggtac

SEQ ID NO: 14432 - DNA, 22 bp, Artificial sequence
  SiRNA target sequence
aatatttagaataagaggtacc

SEQ ID NO: 14433 - DNA, 22 bp, Artificial sequence
  SiRNA target sequence
atatttagaataagaggtaccc

SEQ ID NO: 14434 - DNA, 22 bp, Artificial sequence
  SiRNA target sequence
tatttagaataagaggtaccca

SEQ ID NO: 14435 - DNA, 22 bp, Artificial sequence
  SiRNA target sequence
atttagaataagaggtacccac

SEQ ID NO: 14436 - DNA, 22 bp, Artificial sequence
  SiRNA target sequence
tttagaataagaggtacccaca

SEQ ID NO: 14437 - DNA, 22 bp, Artificial sequence
  SiRNA target sequence
ttagaataagaggtacccacat

SEQ ID NO: 14438 - DNA, 22 bp, Artificial sequence
  SiRNA target sequence
tagaataagaggtacccacatg

SEQ ID NO: 14439 - DNA, 22 bp, Artificial sequence
  SiRNA target sequence
agaataagaggtacccacatgt

SEQ ID NO: 14440 - DNA, 22 bp, Artificial sequence
  SiRNA target sequence
gaataagaggtacccacatgtt

SEQ ID NO: 14441 - DNA, 22 bp, Artificial sequence
  SiRNA target sequence
aataagaggtacccacatgttt

SEQ ID NO: 14442 - DNA, 22 bp, Artificial sequence
  SiRNA target sequence
ataagaggtacccacatgttta

SEQ ID NO: 14443 - DNA, 22 bp, Artificial sequence
  SiRNA target sequence
taagaggtacccacatgtttaa

SEQ ID NO: 14444 - DNA, 22 bp, Artificial sequence
  SiRNA target sequence
aagaggtacccacatgtttaaa

SEQ ID NO: 14445 - DNA, 22 bp, Artificial sequence
  SiRNA target sequence
agaggtacccacatgtttaaaa

SEQ ID NO: 14446 - DNA, 22 bp, Artificial sequence
  SiRNA target sequence
gaggtacccacatgtttaaaaa

SEQ ID NO: 14447 - DNA, 22 bp, Artificial sequence
  SiRNA target sequence
aggtacccacatgtttaaaaat

SEQ ID NO: 14448 - DNA, 22 bp, Artificial sequence
  SiRNA target sequence
ggtacccacatgtttaaaaatc

SEQ ID NO: 14449 - DNA, 22 bp, Artificial sequence
  SiRNA target sequence
gtacccacatgtttaaaaatct

SEQ ID NO: 14450 - DNA, 22 bp, Artificial sequence
  SiRNA target sequence
tacccacatgtttaaaaatcta

SEQ ID NO: 14451 - DNA, 22 bp, Artificial sequence
  SiRNA target sequence
acccacatgtttaaaaatctac

SEQ ID NO: 14452 - DNA, 22 bp, Artificial sequence
  SiRNA target sequence
cccacatgtttaaaaatctact

SEQ ID NO: 14453 - DNA, 22 bp, Artificial sequence
  SiRNA target sequence
ccacatgtttaaaaatctactt

SEQ ID NO: 14454 - DNA, 22 bp, Artificial sequence
  SiRNA target sequence
cacatgtttaaaaatctactta

SEQ ID NO: 14455 - DNA, 22 bp, Artificial sequence
  SiRNA target sequence
acatgtttaaaaatctacttac

SEQ ID NO: 14456 - DNA, 22 bp, Artificial sequence
  SiRNA target sequence
catgtttaaaaatctacttact

SEQ ID NO: 14457 - DNA, 22 bp, Artificial sequence
  SiRNA target sequence
atgtttaaaaatctacttacta

SEQ ID NO: 14458 - DNA, 22 bp, Artificial sequence
  SiRNA target sequence
tgtttaaaaatctacttactaa

SEQ ID NO: 14459 - DNA, 22 bp, Artificial sequence
  SiRNA target sequence
gtttaaaaatctacttactaaa

SEQ ID NO: 14460 - DNA, 22 bp, Artificial sequence
  SiRNA target sequence
tttaaaaatctacttactaaat

SEQ ID NO: 14461 - DNA, 22 bp, Artificial sequence
  SiRNA target sequence
ttaaaaatctacttactaaatt

SEQ ID NO: 14462 - DNA, 22 bp, Artificial sequence
  SiRNA target sequence
taaaaatctacttactaaattc

SEQ ID NO: 14463 - DNA, 22 bp, Artificial sequence
  SiRNA target sequence
aaaaatctacttactaaattcc

SEQ ID NO: 14464 - DNA, 22 bp, Artificial sequence
  SiRNA target sequence
aaaatctacttactaaattcca

SEQ ID NO: 14465 - DNA, 22 bp, Artificial sequence
  SiRNA target sequence
aaatctacttactaaattccat

SEQ ID NO: 14466 - DNA, 22 bp, Artificial sequence
  SiRNA target sequence
aatctacttactaaattccata

SEQ ID NO: 14467 - DNA, 22 bp, Artificial sequence
  SiRNA target sequence
atctacttactaaattccatac

SEQ ID NO: 14468 - DNA, 22 bp, Artificial sequence
  SiRNA target sequence
tctacttactaaattccataca

SEQ ID NO: 14469 - DNA, 22 bp, Artificial sequence
  SiRNA target sequence
ctacttactaaattccatacag

SEQ ID NO: 14470 - DNA, 22 bp, Artificial sequence
  SiRNA target sequence
tacttactaaattccatacagt

SEQ ID NO: 14471 - DNA, 22 bp, Artificial sequence
  SiRNA target sequence
acttactaaattccatacagta

SEQ ID NO: 14472 - DNA, 22 bp, Artificial sequence
  SiRNA target sequence
cttactaaattccatacagtaa

SEQ ID NO: 14473 - DNA, 22 bp, Artificial sequence
  SiRNA target sequence
ttactaaattccatacagtaat

SEQ ID NO: 14474 - DNA, 22 bp, Artificial sequence
  SiRNA target sequence
tactaaattccatacagtaatt

SEQ ID NO: 14475 - DNA, 22 bp, Artificial sequence
  SiRNA target sequence
actaaattccatacagtaattg

SEQ ID NO: 14476 - DNA, 22 bp, Artificial sequence
  SiRNA target sequence
ctaaattccatacagtaattgg

SEQ ID NO: 14477 - DNA, 22 bp, Artificial sequence
  SiRNA target sequence
taaattccatacagtaattggt

SEQ ID NO: 14478 - DNA, 22 bp, Artificial sequence
  SiRNA target sequence
aaattccatacagtaattggta

SEQ ID NO: 14479 - DNA, 22 bp, Artificial sequence
  SiRNA target sequence
aattccatacagtaattggtag

SEQ ID NO: 14480 - DNA, 22 bp, Artificial sequence
  SiRNA target sequence
attccatacagtaattggtaga

SEQ ID NO: 14481 - DNA, 22 bp, Artificial sequence
  SiRNA target sequence
ttccatacagtaattggtagaa

SEQ ID NO: 14482 - DNA, 22 bp, Artificial sequence
  SiRNA target sequence
tccatacagtaattggtagaag

SEQ ID NO: 14483 - DNA, 22 bp, Artificial sequence
  SiRNA target sequence
ccatacagtaattggtagaagt

SEQ ID NO: 14484 - DNA, 22 bp, Artificial sequence
  SiRNA target sequence
catacagtaattggtagaagta

SEQ ID NO: 14485 - DNA, 22 bp, Artificial sequence
  SiRNA target sequence
atacagtaattggtagaagtaa

SEQ ID NO: 14486 - DNA, 22 bp, Artificial sequence
  SiRNA target sequence
tacagtaattggtagaagtaaa

SEQ ID NO: 14487 - DNA, 22 bp, Artificial sequence
  SiRNA target sequence
acagtaattggtagaagtaaag

SEQ ID NO: 14488 - DNA, 22 bp, Artificial sequence
  SiRNA target sequence
cagtaattggtagaagtaaaga

SEQ ID NO: 14489 - DNA, 22 bp, Artificial sequence
  SiRNA target sequence
agtaattggtagaagtaaagat

SEQ ID NO: 14490 - DNA, 22 bp, Artificial sequence
  SiRNA target sequence
gtaattggtagaagtaaagata

SEQ ID NO: 14491 - DNA, 22 bp, Artificial sequence
  SiRNA target sequence
taattggtagaagtaaagatat

SEQ ID NO: 14492 - DNA, 22 bp, Artificial sequence
  SiRNA target sequence
aattggtagaagtaaagatatc

SEQ ID NO: 14493 - DNA, 22 bp, Artificial sequence
  SiRNA target sequence
attggtagaagtaaagatatct

SEQ ID NO: 14494 - DNA, 22 bp, Artificial sequence
  SiRNA target sequence
ttggtagaagtaaagatatctt

SEQ ID NO: 14495 - DNA, 22 bp, Artificial sequence
  SiRNA target sequence
tggtagaagtaaagatatcttt

SEQ ID NO: 14496 - DNA, 22 bp, Artificial sequence
  SiRNA target sequence
ggtagaagtaaagatatcttta

SEQ ID NO: 14497 - DNA, 22 bp, Artificial sequence
  SiRNA target sequence
gtagaagtaaagatatctttac

SEQ ID NO: 14498 - DNA, 22 bp, Artificial sequence
  SiRNA target sequence
tagaagtaaagatatctttaca

SEQ ID NO: 14499 - DNA, 22 bp, Artificial sequence
  SiRNA target sequence
agaagtaaagatatctttacac

SEQ ID NO: 14500 - DNA, 22 bp, Artificial sequence
  SiRNA target sequence
gaagtaaagatatctttacaca

SEQ ID NO: 14501 - DNA, 22 bp, Artificial sequence
  SiRNA target sequence
aagtaaagatatctttacacaa

SEQ ID NO: 14502 - DNA, 22 bp, Artificial sequence
  SiRNA target sequence
agtaaagatatctttacacaaa

SEQ ID NO: 14503 - DNA, 22 bp, Artificial sequence
  SiRNA target sequence
gtaaagatatctttacacaaat

SEQ ID NO: 14504 - DNA, 22 bp, Artificial sequence
  SiRNA target sequence
taaagatatctttacacaaata

SEQ ID NO: 14505 - DNA, 22 bp, Artificial sequence
  SiRNA target sequence
aaagatatctttacacaaatag

SEQ ID NO: 14506 - DNA, 22 bp, Artificial sequence
  SiRNA target sequence
aagatatctttacacaaataga

SEQ ID NO: 14507 - DNA, 22 bp, Artificial sequence
  SiRNA target sequence
agatatctttacacaaatagag

SEQ ID NO: 14508 - DNA, 22 bp, Artificial sequence
  SiRNA target sequence
gatatctttacacaaatagagg

SEQ ID NO: 14509 - DNA, 22 bp, Artificial sequence
  SiRNA target sequence
atatctttacacaaatagaggt

SEQ ID NO: 14510 - DNA, 22 bp, Artificial sequence
  SiRNA target sequence
tatctttacacaaatagaggta

SEQ ID NO: 14511 - DNA, 22 bp, Artificial sequence
  SiRNA target sequence
atctttacacaaatagaggtag

SEQ ID NO: 14512 - DNA, 22 bp, Artificial sequence
  SiRNA target sequence
tctttacacaaatagaggtaga

SEQ ID NO: 14513 - DNA, 22 bp, Artificial sequence
  SiRNA target sequence
ctttacacaaatagaggtagac

SEQ ID NO: 14514 - DNA, 22 bp, Artificial sequence
  SiRNA target sequence
tttacacaaatagaggtagaca

SEQ ID NO: 14515 - DNA, 22 bp, Artificial sequence
  SiRNA target sequence
ttacacaaatagaggtagacat

SEQ ID NO: 14516 - DNA, 22 bp, Artificial sequence
  SiRNA target sequence
tacacaaatagaggtagacata

SEQ ID NO: 14517 - DNA, 22 bp, Artificial sequence
  SiRNA target sequence
acacaaatagaggtagacataa

SEQ ID NO: 14518 - DNA, 22 bp, Artificial sequence
  SiRNA target sequence
cacaaatagaggtagacataaa

SEQ ID NO: 14519 - DNA, 22 bp, Artificial sequence
  SiRNA target sequence
acaaatagaggtagacataaaa

SEQ ID NO: 14520 - DNA, 22 bp, Artificial sequence
  SiRNA target sequence
caaatagaggtagacataaaaa

SEQ ID NO: 14521 - DNA, 22 bp, Artificial sequence
  SiRNA target sequence
aaatagaggtagacataaaaaa

SEQ ID NO: 14522 - DNA, 22 bp, Artificial sequence
  SiRNA target sequence
aatagaggtagacataaaaaat

SEQ ID NO: 14523 - DNA, 22 bp, Artificial sequence
  SiRNA target sequence
atagaggtagacataaaaaata

SEQ ID NO: 14524 - DNA, 22 bp, Artificial sequence
  SiRNA target sequence
tagaggtagacataaaaaataa

SEQ ID NO: 14525 - DNA, 22 bp, Artificial sequence
  SiRNA target sequence
agaggtagacataaaaaataaa

SEQ ID NO: 14526 - DNA, 22 bp, Artificial sequence
  SiRNA target sequence
gaggtagacataaaaaataaat

SEQ ID NO: 14527 - DNA, 22 bp, Artificial sequence
  SiRNA target sequence
aggtagacataaaaaataaata

SEQ ID NO: 14528 - DNA, 22 bp, Artificial sequence
  SiRNA target sequence
ggtagacataaaaaataaatac

SEQ ID NO: 14529 - DNA, 22 bp, Artificial sequence
  SiRNA target sequence
gtagacataaaaaataaataca

SEQ ID NO: 14530 - DNA, 22 bp, Artificial sequence
  SiRNA target sequence
tagacataaaaaataaatacaa

SEQ ID NO: 14531 - DNA, 22 bp, Artificial sequence
  SiRNA target sequence
agacataaaaaataaatacaat

SEQ ID NO: 14532 - DNA, 22 bp, Artificial sequence
  SiRNA target sequence
gacataaaaaataaatacaata

SEQ ID NO: 14533 - DNA, 22 bp, Artificial sequence
  SiRNA target sequence
acataaaaaataaatacaataa

SEQ ID NO: 14534 - DNA, 22 bp, Artificial sequence
  SiRNA target sequence
cataaaaaataaatacaataat

SEQ ID NO: 14535 - DNA, 22 bp, Artificial sequence
  SiRNA target sequence
ataaaaaataaatacaataata

SEQ ID NO: 14536 - DNA, 22 bp, Artificial sequence
  SiRNA target sequence
taaaaaataaatacaataatat

SEQ ID NO: 14537 - DNA, 22 bp, Artificial sequence
  SiRNA target sequence
aaaaaataaatacaataatatg

SEQ ID NO: 14538 - DNA, 22 bp, Artificial sequence
  SiRNA target sequence
aaaaataaatacaataatatgt

SEQ ID NO: 14539 - DNA, 22 bp, Artificial sequence
  SiRNA target sequence
aaaataaatacaataatatgtg

SEQ ID NO: 14540 - DNA, 22 bp, Artificial sequence
  SiRNA target sequence
aaataaatacaataatatgtgt

SEQ ID NO: 14541 - DNA, 22 bp, Artificial sequence
  SiRNA target sequence
aataaatacaataatatgtgta

SEQ ID NO: 14542 - DNA, 22 bp, Artificial sequence
  SiRNA target sequence
ataaatacaataatatgtgtat

SEQ ID NO: 14543 - DNA, 22 bp, Artificial sequence
  SiRNA target sequence
taaatacaataatatgtgtata

SEQ ID NO: 14544 - DNA, 22 bp, Artificial sequence
  SiRNA target sequence
aaatacaataatatgtgtataa

SEQ ID NO: 14545 - DNA, 22 bp, Artificial sequence
  SiRNA target sequence
aatacaataatatgtgtataaa

SEQ ID NO: 14546 - DNA, 22 bp, Artificial sequence
  SiRNA target sequence
atacaataatatgtgtataaaa

SEQ ID NO: 14547 - DNA, 22 bp, Artificial sequence
  SiRNA target sequence
tacaataatatgtgtataaaaa

SEQ ID NO: 14548 - DNA, 22 bp, Artificial sequence
  SiRNA target sequence
acaataatatgtgtataaaaat

SEQ ID NO: 14549 - DNA, 22 bp, Artificial sequence
  SiRNA target sequence
caataatatgtgtataaaaatg

SEQ ID NO: 14550 - DNA, 22 bp, Artificial sequence
  SiRNA target sequence
aataatatgtgtataaaaatga

SEQ ID NO: 14551 - DNA, 22 bp, Artificial sequence
  SiRNA target sequence
ataatatgtgtataaaaatgat

SEQ ID NO: 14552 - DNA, 22 bp, Artificial sequence
  SiRNA target sequence
taatatgtgtataaaaatgata

SEQ ID NO: 14553 - DNA, 22 bp, Artificial sequence
  SiRNA target sequence
aatatgtgtataaaaatgatac

SEQ ID NO: 14554 - DNA, 22 bp, Artificial sequence
  SiRNA target sequence
atatgtgtataaaaatgataca

SEQ ID NO: 14555 - DNA, 22 bp, Artificial sequence
  SiRNA target sequence
tatgtgtataaaaatgatacag

SEQ ID NO: 14556 - DNA, 22 bp, Artificial sequence
  SiRNA target sequence
atgtgtataaaaatgatacagc

SEQ ID NO: 14557 - DNA, 22 bp, Artificial sequence
  SiRNA target sequence
tgtgtataaaaatgatacagcc

SEQ ID NO: 14558 - DNA, 22 bp, Artificial sequence
  SiRNA target sequence
gtgtataaaaatgatacagcca

SEQ ID NO: 14559 - DNA, 22 bp, Artificial sequence
  SiRNA target sequence
tgtataaaaatgatacagccag

SEQ ID NO: 14560 - DNA, 22 bp, Artificial sequence
  SiRNA target sequence
gtataaaaatgatacagccagc

SEQ ID NO: 14561 - DNA, 22 bp, Artificial sequence
  SiRNA target sequence
tataaaaatgatacagccagct

SEQ ID NO: 14562 - DNA, 22 bp, Artificial sequence
  SiRNA target sequence
ataaaaatgatacagccagcta

SEQ ID NO: 14563 - DNA, 22 bp, Artificial sequence
  SiRNA target sequence
taaaaatgatacagccagctat

SEQ ID NO: 14564 - DNA, 22 bp, Artificial sequence
  SiRNA target sequence
aaaaatgatacagccagctatt

SEQ ID NO: 14565 - DNA, 22 bp, Artificial sequence
  SiRNA target sequence
aaaatgatacagccagctatta

SEQ ID NO: 14566 - DNA, 22 bp, Artificial sequence
  SiRNA target sequence
aaatgatacagccagctattaa

SEQ ID NO: 14567 - DNA, 22 bp, Artificial sequence
  SiRNA target sequence
aatgatacagccagctattaaa

SEQ ID NO: 14568 - DNA, 22 bp, Artificial sequence
  SiRNA target sequence
atgatacagccagctattaaag

SEQ ID NO: 14569 - DNA, 22 bp, Artificial sequence
  SiRNA target sequence
tgatacagccagctattaaagg

SEQ ID NO: 14570 - DNA, 22 bp, Artificial sequence
  SiRNA target sequence
gatacagccagctattaaaggt

SEQ ID NO: 14571 - DNA, 22 bp, Artificial sequence
  SiRNA target sequence
atacagccagctattaaaggtg

SEQ ID NO: 14572 - DNA, 22 bp, Artificial sequence
  SiRNA target sequence
tacagccagctattaaaggtgc

SEQ ID NO: 14573 - DNA, 22 bp, Artificial sequence
  SiRNA target sequence
acagccagctattaaaggtgct

SEQ ID NO: 14574 - DNA, 22 bp, Artificial sequence
  SiRNA target sequence
cagccagctattaaaggtgctt

SEQ ID NO: 14575 - DNA, 22 bp, Artificial sequence
  SiRNA target sequence
agccagctattaaaggtgcttc

SEQ ID NO: 14576 - DNA, 22 bp, Artificial sequence
  SiRNA target sequence
gccagctattaaaggtgcttca

SEQ ID NO: 14577 - DNA, 22 bp, Artificial sequence
  SiRNA target sequence
ccagctattaaaggtgcttcat

SEQ ID NO: 14578 - DNA, 22 bp, Artificial sequence
  SiRNA target sequence
cagctattaaaggtgcttcatg

SEQ ID NO: 14579 - DNA, 22 bp, Artificial sequence
  SiRNA target sequence
agctattaaaggtgcttcatgt

SEQ ID NO: 14580 - DNA, 22 bp, Artificial sequence
  SiRNA target sequence
gctattaaaggtgcttcatgta

SEQ ID NO: 14581 - DNA, 22 bp, Artificial sequence
  SiRNA target sequence
ctattaaaggtgcttcatgtat

SEQ ID NO: 14582 - DNA, 22 bp, Artificial sequence
  SiRNA target sequence
tattaaaggtgcttcatgtata

SEQ ID NO: 14583 - DNA, 22 bp, Artificial sequence
  SiRNA target sequence
attaaaggtgcttcatgtatat

SEQ ID NO: 14584 - DNA, 22 bp, Artificial sequence
  SiRNA target sequence
ttaaaggtgcttcatgtatata

SEQ ID NO: 14585 - DNA, 22 bp, Artificial sequence
  SiRNA target sequence
taaaggtgcttcatgtatatac

SEQ ID NO: 14586 - DNA, 22 bp, Artificial sequence
  SiRNA target sequence
aaaggtgcttcatgtatatacg

SEQ ID NO: 14587 - DNA, 22 bp, Artificial sequence
  SiRNA target sequence
aaggtgcttcatgtatatacgt

SEQ ID NO: 14588 - DNA, 22 bp, Artificial sequence
  SiRNA target sequence
aggtgcttcatgtatatacgtg

SEQ ID NO: 14589 - DNA, 22 bp, Artificial sequence
  SiRNA target sequence
ggtgcttcatgtatatacgtgg

SEQ ID NO: 14590 - DNA, 22 bp, Artificial sequence
  SiRNA target sequence
gtgcttcatgtatatacgtggg

SEQ ID NO: 14591 - DNA, 22 bp, Artificial sequence
  SiRNA target sequence
tgcttcatgtatatacgtgggt

SEQ ID NO: 14592 - DNA, 22 bp, Artificial sequence
  SiRNA target sequence
gcttcatgtatatacgtgggta

SEQ ID NO: 14593 - DNA, 22 bp, Artificial sequence
  SiRNA target sequence
cttcatgtatatacgtgggtaa

SEQ ID NO: 14594 - DNA, 22 bp, Artificial sequence
  SiRNA target sequence
ttcatgtatatacgtgggtaat

SEQ ID NO: 14595 - DNA, 22 bp, Artificial sequence
  SiRNA target sequence
tcatgtatatacgtgggtaatt

SEQ ID NO: 14596 - DNA, 22 bp, Artificial sequence
  SiRNA target sequence
catgtatatacgtgggtaatta

SEQ ID NO: 14597 - DNA, 22 bp, Artificial sequence
  SiRNA target sequence
atgtatatacgtgggtaattat

SEQ ID NO: 14598 - DNA, 22 bp, Artificial sequence
  SiRNA target sequence
tgtatatacgtgggtaattata

SEQ ID NO: 14599 - DNA, 22 bp, Artificial sequence
  SiRNA target sequence
gtatatacgtgggtaattatat

SEQ ID NO: 14600 - DNA, 22 bp, Artificial sequence
  SiRNA target sequence
tatatacgtgggtaattatatg

SEQ ID NO: 14601 - DNA, 22 bp, Artificial sequence
  SiRNA target sequence
atatacgtgggtaattatatgc

SEQ ID NO: 14602 - DNA, 22 bp, Artificial sequence
  SiRNA target sequence
tatacgtgggtaattatatgca

SEQ ID NO: 14603 - DNA, 22 bp, Artificial sequence
  SiRNA target sequence
atacgtgggtaattatatgcag

SEQ ID NO: 14604 - DNA, 22 bp, Artificial sequence
  SiRNA target sequence
tacgtgggtaattatatgcagc

SEQ ID NO: 14605 - DNA, 22 bp, Artificial sequence
  SiRNA target sequence
acgtgggtaattatatgcagca

SEQ ID NO: 14606 - DNA, 22 bp, Artificial sequence
  SiRNA target sequence
cgtgggtaattatatgcagcag

SEQ ID NO: 14607 - DNA, 22 bp, Artificial sequence
  SiRNA target sequence
gtgggtaattatatgcagcagc

SEQ ID NO: 14608 - DNA, 22 bp, Artificial sequence
  SiRNA target sequence
tgggtaattatatgcagcagct

SEQ ID NO: 14609 - DNA, 22 bp, Artificial sequence
  SiRNA target sequence
gggtaattatatgcagcagcta

SEQ ID NO: 14610 - DNA, 22 bp, Artificial sequence
  SiRNA target sequence
ggtaattatatgcagcagctag

SEQ ID NO: 14611 - DNA, 22 bp, Artificial sequence
  SiRNA target sequence
gtaattatatgcagcagctagg

SEQ ID NO: 14612 - DNA, 22 bp, Artificial sequence
  SiRNA target sequence
taattatatgcagcagctagga

SEQ ID NO: 14613 - DNA, 22 bp, Artificial sequence
  SiRNA target sequence
aattatatgcagcagctaggag

SEQ ID NO: 14614 - DNA, 22 bp, Artificial sequence
  SiRNA target sequence
attatatgcagcagctaggagt

SEQ ID NO: 14615 - DNA, 22 bp, Artificial sequence
  SiRNA target sequence
ttatatgcagcagctaggagta

SEQ ID NO: 14616 - DNA, 22 bp, Artificial sequence
  SiRNA target sequence
tatatgcagcagctaggagtaa

SEQ ID NO: 14617 - DNA, 22 bp, Artificial sequence
  SiRNA target sequence
atatgcagcagctaggagtaat

SEQ ID NO: 14618 - DNA, 22 bp, Artificial sequence
  SiRNA target sequence
tatgcagcagctaggagtaatt

SEQ ID NO: 14619 - DNA, 22 bp, Artificial sequence
  SiRNA target sequence
atgcagcagctaggagtaatta

SEQ ID NO: 14620 - DNA, 22 bp, Artificial sequence
  SiRNA target sequence
tgcagcagctaggagtaattag

SEQ ID NO: 14621 - DNA, 22 bp, Artificial sequence
  SiRNA target sequence
gcagcagctaggagtaattagt

SEQ ID NO: 14622 - DNA, 22 bp, Artificial sequence
  SiRNA target sequence
cagcagctaggagtaattagtc

SEQ ID NO: 14623 - DNA, 22 bp, Artificial sequence
  SiRNA target sequence
agcagctaggagtaattagtct

SEQ ID NO: 14624 - DNA, 22 bp, Artificial sequence
  SiRNA target sequence
gcagctaggagtaattagtctt

SEQ ID NO: 14625 - DNA, 22 bp, Artificial sequence
  SiRNA target sequence
cagctaggagtaattagtcttg

SEQ ID NO: 14626 - DNA, 22 bp, Artificial sequence
  SiRNA target sequence
agctaggagtaattagtcttgg

SEQ ID NO: 14627 - DNA, 22 bp, Artificial sequence
  SiRNA target sequence
gctaggagtaattagtcttggt

SEQ ID NO: 14628 - DNA, 22 bp, Artificial sequence
  SiRNA target sequence
ctaggagtaattagtcttggtg

SEQ ID NO: 14629 - DNA, 22 bp, Artificial sequence
  SiRNA target sequence
taggagtaattagtcttggtgg

SEQ ID NO: 14630 - DNA, 22 bp, Artificial sequence
  SiRNA target sequence
aggagtaattagtcttggtggg

SEQ ID NO: 14631 - DNA, 22 bp, Artificial sequence
  SiRNA target sequence
ggagtaattagtcttggtgggg

SEQ ID NO: 14632 - DNA, 22 bp, Artificial sequence
  SiRNA target sequence
gagtaattagtcttggtgggga

SEQ ID NO: 14633 - DNA, 22 bp, Artificial sequence
  SiRNA target sequence
agtaattagtcttggtggggag

SEQ ID NO: 14634 - DNA, 22 bp, Artificial sequence
  SiRNA target sequence
gtaattagtcttggtggggaga

SEQ ID NO: 14635 - DNA, 22 bp, Artificial sequence
  SiRNA target sequence
taattagtcttggtggggagat

SEQ ID NO: 14636 - DNA, 22 bp, Artificial sequence
  SiRNA target sequence
aattagtcttggtggggagatt

SEQ ID NO: 14637 - DNA, 22 bp, Artificial sequence
  SiRNA target sequence
attagtcttggtggggagatta

SEQ ID NO: 14638 - DNA, 22 bp, Artificial sequence
  SiRNA target sequence
ttagtcttggtggggagattat

SEQ ID NO: 14639 - DNA, 22 bp, Artificial sequence
  SiRNA target sequence
tagtcttggtggggagattatt

SEQ ID NO: 14640 - DNA, 22 bp, Artificial sequence
  SiRNA target sequence
agtcttggtggggagattatta

SEQ ID NO: 14641 - DNA, 22 bp, Artificial sequence
  SiRNA target sequence
gtcttggtggggagattattaa

SEQ ID NO: 14642 - DNA, 22 bp, Artificial sequence
  SiRNA target sequence
tcttggtggggagattattaaa

SEQ ID NO: 14643 - DNA, 22 bp, Artificial sequence
  SiRNA target sequence
cttggtggggagattattaaag

SEQ ID NO: 14644 - DNA, 22 bp, Artificial sequence
  SiRNA target sequence
ttggtggggagattattaaagc

SEQ ID NO: 14645 - DNA, 22 bp, Artificial sequence
  SiRNA target sequence
tggtggggagattattaaagct

SEQ ID NO: 14646 - DNA, 22 bp, Artificial sequence
  SiRNA target sequence
ggtggggagattattaaagctg

SEQ ID NO: 14647 - DNA, 22 bp, Artificial sequence
  SiRNA target sequence
gtggggagattattaaagctga

SEQ ID NO: 14648 - DNA, 22 bp, Artificial sequence
  SiRNA target sequence
tggggagattattaaagctgat

SEQ ID NO: 14649 - DNA, 22 bp, Artificial sequence
  SiRNA target sequence
ggggagattattaaagctgatg

SEQ ID NO: 14650 - DNA, 22 bp, Artificial sequence
  SiRNA target sequence
gggagattattaaagctgatga

SEQ ID NO: 14651 - DNA, 22 bp, Artificial sequence
  SiRNA target sequence
ggagattattaaagctgatgaa

SEQ ID NO: 14652 - DNA, 22 bp, Artificial sequence
  SiRNA target sequence
gagattattaaagctgatgaat

SEQ ID NO: 14653 - DNA, 22 bp, Artificial sequence
  SiRNA target sequence
agattattaaagctgatgaata

SEQ ID NO: 14654 - DNA, 22 bp, Artificial sequence
  SiRNA target sequence
gattattaaagctgatgaatac

SEQ ID NO: 14655 - DNA, 22 bp, Artificial sequence
  SiRNA target sequence
attattaaagctgatgaataca

SEQ ID NO: 14656 - DNA, 22 bp, Artificial sequence
  SiRNA target sequence
ttattaaagctgatgaatacat

SEQ ID NO: 14657 - DNA, 22 bp, Artificial sequence
  SiRNA target sequence
tattaaagctgatgaatacatt

SEQ ID NO: 14658 - DNA, 22 bp, Artificial sequence
  SiRNA target sequence
attaaagctgatgaatacattg

SEQ ID NO: 14659 - DNA, 22 bp, Artificial sequence
  SiRNA target sequence
ttaaagctgatgaatacattgg

SEQ ID NO: 14660 - DNA, 22 bp, Artificial sequence
  SiRNA target sequence
taaagctgatgaatacattgga

SEQ ID NO: 14661 - DNA, 22 bp, Artificial sequence
  SiRNA target sequence
aaagctgatgaatacattggac

SEQ ID NO: 14662 - DNA, 22 bp, Artificial sequence
  SiRNA target sequence
aagctgatgaatacattggact

SEQ ID NO: 14663 - DNA, 22 bp, Artificial sequence
  SiRNA target sequence
agctgatgaatacattggacta

SEQ ID NO: 14664 - DNA, 22 bp, Artificial sequence
  SiRNA target sequence
gctgatgaatacattggactat

SEQ ID NO: 14665 - DNA, 22 bp, Artificial sequence
  SiRNA target sequence
ctgatgaatacattggactatc

SEQ ID NO: 14666 - DNA, 22 bp, Artificial sequence
  SiRNA target sequence
tgatgaatacattggactatct

SEQ ID NO: 14667 - DNA, 22 bp, Artificial sequence
  SiRNA target sequence
gatgaatacattggactatctt

SEQ ID NO: 14668 - DNA, 22 bp, Artificial sequence
  SiRNA target sequence
atgaatacattggactatcttt

SEQ ID NO: 14669 - DNA, 22 bp, Artificial sequence
  SiRNA target sequence
tgaatacattggactatctttt

SEQ ID NO: 14670 - DNA, 22 bp, Artificial sequence
  SiRNA target sequence
gaatacattggactatcttttg

SEQ ID NO: 14671 - DNA, 22 bp, Artificial sequence
  SiRNA target sequence
aatacattggactatcttttgt

SEQ ID NO: 14672 - DNA, 22 bp, Artificial sequence
  SiRNA target sequence
atacattggactatcttttgta

SEQ ID NO: 14673 - DNA, 22 bp, Artificial sequence
  SiRNA target sequence
tacattggactatcttttgtag

SEQ ID NO: 14674 - DNA, 22 bp, Artificial sequence
  SiRNA target sequence
acattggactatcttttgtagg

SEQ ID NO: 14675 - DNA, 22 bp, Artificial sequence
  SiRNA target sequence
cattggactatcttttgtaggg

SEQ ID NO: 14676 - DNA, 22 bp, Artificial sequence
  SiRNA target sequence
attggactatcttttgtaggga

SEQ ID NO: 14677 - DNA, 22 bp, Artificial sequence
  SiRNA target sequence
ttggactatcttttgtagggag

SEQ ID NO: 14678 - DNA, 22 bp, Artificial sequence
  SiRNA target sequence
tggactatcttttgtagggaga

SEQ ID NO: 14679 - DNA, 22 bp, Artificial sequence
  SiRNA target sequence
ggactatcttttgtagggagat

SEQ ID NO: 14680 - DNA, 22 bp, Artificial sequence
  SiRNA target sequence
gactatcttttgtagggagata

SEQ ID NO: 14681 - DNA, 22 bp, Artificial sequence
  SiRNA target sequence
actatcttttgtagggagatat

SEQ ID NO: 14682 - DNA, 22 bp, Artificial sequence
  SiRNA target sequence
ctatcttttgtagggagatatg

SEQ ID NO: 14683 - DNA, 22 bp, Artificial sequence
  SiRNA target sequence
tatcttttgtagggagatatga

SEQ ID NO: 14684 - DNA, 22 bp, Artificial sequence
  SiRNA target sequence
atcttttgtagggagatatgaa

SEQ ID NO: 14685 - DNA, 22 bp, Artificial sequence
  SiRNA target sequence
tcttttgtagggagatatgaag

SEQ ID NO: 14686 - DNA, 22 bp, Artificial sequence
  SiRNA target sequence
cttttgtagggagatatgaagg

SEQ ID NO: 14687 - DNA, 22 bp, Artificial sequence
  SiRNA target sequence
ttttgtagggagatatgaaggg

SEQ ID NO: 14688 - DNA, 22 bp, Artificial sequence
  SiRNA target sequence
tttgtagggagatatgaaggga

SEQ ID NO: 14689 - DNA, 22 bp, Artificial sequence
  SiRNA target sequence
ttgtagggagatatgaagggat

SEQ ID NO: 14690 - DNA, 22 bp, Artificial sequence
  SiRNA target sequence
tgtagggagatatgaagggatt

SEQ ID NO: 14691 - DNA, 22 bp, Artificial sequence
  SiRNA target sequence
gtagggagatatgaagggattg

SEQ ID NO: 14692 - DNA, 22 bp, Artificial sequence
  SiRNA target sequence
tagggagatatgaagggattgg

SEQ ID NO: 14693 - DNA, 22 bp, Artificial sequence
  SiRNA target sequence
agggagatatgaagggattggt

SEQ ID NO: 14694 - DNA, 22 bp, Artificial sequence
  SiRNA target sequence
gggagatatgaagggattggtt

SEQ ID NO: 14695 - DNA, 22 bp, Artificial sequence
  SiRNA target sequence
ggagatatgaagggattggttc

SEQ ID NO: 14696 - DNA, 22 bp, Artificial sequence
  SiRNA target sequence
gagatatgaagggattggttct

SEQ ID NO: 14697 - DNA, 22 bp, Artificial sequence
  SiRNA target sequence
agatatgaagggattggttcta

SEQ ID NO: 14698 - DNA, 22 bp, Artificial sequence
  SiRNA target sequence
gatatgaagggattggttctat

SEQ ID NO: 14699 - DNA, 22 bp, Artificial sequence
  SiRNA target sequence
atatgaagggattggttctatt

SEQ ID NO: 14700 - DNA, 22 bp, Artificial sequence
  SiRNA target sequence
tatgaagggattggttctattt

SEQ ID NO: 14701 - DNA, 22 bp, Artificial sequence
  SiRNA target sequence
atgaagggattggttctatttc

SEQ ID NO: 14702 - DNA, 22 bp, Artificial sequence
  SiRNA target sequence
tgaagggattggttctatttct

SEQ ID NO: 14703 - DNA, 22 bp, Artificial sequence
  SiRNA target sequence
gaagggattggttctatttcta

SEQ ID NO: 14704 - DNA, 22 bp, Artificial sequence
  SiRNA target sequence
aagggattggttctatttctac

SEQ ID NO: 14705 - DNA, 22 bp, Artificial sequence
  SiRNA target sequence
agggattggttctatttctact

SEQ ID NO: 14706 - DNA, 22 bp, Artificial sequence
  SiRNA target sequence
gggattggttctatttctacta

SEQ ID NO: 14707 - DNA, 22 bp, Artificial sequence
  SiRNA target sequence
ggattggttctatttctactat

SEQ ID NO: 14708 - DNA, 22 bp, Artificial sequence
  SiRNA target sequence
gattggttctatttctactata

SEQ ID NO: 14709 - DNA, 22 bp, Artificial sequence
  SiRNA target sequence
attggttctatttctactatat

SEQ ID NO: 14710 - DNA, 22 bp, Artificial sequence
  SiRNA target sequence
ttggttctatttctactatatc

SEQ ID NO: 14711 - DNA, 22 bp, Artificial sequence
  SiRNA target sequence
tggttctatttctactatatca

SEQ ID NO: 14712 - DNA, 22 bp, Artificial sequence
  SiRNA target sequence
ggttctatttctactatatcac

SEQ ID NO: 14713 - DNA, 22 bp, Artificial sequence
  SiRNA target sequence
gttctatttctactatatcact

SEQ ID NO: 14714 - DNA, 22 bp, Artificial sequence
  SiRNA target sequence
ttctatttctactatatcactt

SEQ ID NO: 14715 - DNA, 22 bp, Artificial sequence
  SiRNA target sequence
tctatttctactatatcacttc

SEQ ID NO: 14716 - DNA, 22 bp, Artificial sequence
  SiRNA target sequence
ctatttctactatatcacttca

SEQ ID NO: 14717 - DNA, 22 bp, Artificial sequence
  SiRNA target sequence
tatttctactatatcacttcag

SEQ ID NO: 14718 - DNA, 22 bp, Artificial sequence
  SiRNA target sequence
atttctactatatcacttcagc

SEQ ID NO: 14719 - DNA, 22 bp, Artificial sequence
  SiRNA target sequence
tttctactatatcacttcagca

SEQ ID NO: 14720 - DNA, 22 bp, Artificial sequence
  SiRNA target sequence
ttctactatatcacttcagcag

SEQ ID NO: 14721 - DNA, 22 bp, Artificial sequence
  SiRNA target sequence
tctactatatcacttcagcagt

SEQ ID NO: 14722 - DNA, 22 bp, Artificial sequence
  SiRNA target sequence
ctactatatcacttcagcagtt

SEQ ID NO: 14723 - DNA, 22 bp, Artificial sequence
  SiRNA target sequence
tactatatcacttcagcagttt

SEQ ID NO: 14724 - DNA, 22 bp, Artificial sequence
  SiRNA target sequence
actatatcacttcagcagttta

SEQ ID NO: 14725 - DNA, 22 bp, Artificial sequence
  SiRNA target sequence
ctatatcacttcagcagtttaa

SEQ ID NO: 14726 - DNA, 22 bp, Artificial sequence
  SiRNA target sequence
tatatcacttcagcagtttaat

SEQ ID NO: 14727 - DNA, 22 bp, Artificial sequence
  SiRNA target sequence
atatcacttcagcagtttaata

SEQ ID NO: 14728 - DNA, 22 bp, Artificial sequence
  SiRNA target sequence
tatcacttcagcagtttaatac

SEQ ID NO: 14729 - DNA, 22 bp, Artificial sequence
  SiRNA target sequence
atcacttcagcagtttaataca

SEQ ID NO: 14730 - DNA, 22 bp, Artificial sequence
  SiRNA target sequence
tcacttcagcagtttaatacac

SEQ ID NO: 14731 - DNA, 22 bp, Artificial sequence
  SiRNA target sequence
cacttcagcagtttaatacact

SEQ ID NO: 14732 - DNA, 22 bp, Artificial sequence
  SiRNA target sequence
acttcagcagtttaatacactg

SEQ ID NO: 14733 - DNA, 22 bp, Artificial sequence
  SiRNA target sequence
cttcagcagtttaatacactgt

SEQ ID NO: 14734 - DNA, 22 bp, Artificial sequence
  SiRNA target sequence
ttcagcagtttaatacactgtc

SEQ ID NO: 14735 - DNA, 22 bp, Artificial sequence
  SiRNA target sequence
tcagcagtttaatacactgtct

SEQ ID NO: 14736 - DNA, 22 bp, Artificial sequence
  SiRNA target sequence
cagcagtttaatacactgtcta

SEQ ID NO: 14737 - DNA, 22 bp, Artificial sequence
  SiRNA target sequence
agcagtttaatacactgtctat

SEQ ID NO: 14738 - DNA, 22 bp, Artificial sequence
  SiRNA target sequence
gcagtttaatacactgtctata

SEQ ID NO: 14739 - DNA, 22 bp, Artificial sequence
  SiRNA target sequence
cagtttaatacactgtctatag

SEQ ID NO: 14740 - DNA, 22 bp, Artificial sequence
  SiRNA target sequence
agtttaatacactgtctataga

SEQ ID NO: 14741 - DNA, 22 bp, Artificial sequence
  SiRNA target sequence
gtttaatacactgtctatagat

SEQ ID NO: 14742 - DNA, 22 bp, Artificial sequence
  SiRNA target sequence
tttaatacactgtctatagatt

SEQ ID NO: 14743 - DNA, 22 bp, Artificial sequence
  SiRNA target sequence
ttaatacactgtctatagatta

SEQ ID NO: 14744 - DNA, 22 bp, Artificial sequence
  SiRNA target sequence
taatacactgtctatagattat

SEQ ID NO: 14745 - DNA, 22 bp, Artificial sequence
  SiRNA target sequence
aatacactgtctatagattatt

SEQ ID NO: 14746 - DNA, 22 bp, Artificial sequence
  SiRNA target sequence
atacactgtctatagattatta

SEQ ID NO: 14747 - DNA, 22 bp, Artificial sequence
  SiRNA target sequence
tacactgtctatagattattac

SEQ ID NO: 14748 - DNA, 22 bp, Artificial sequence
  SiRNA target sequence
acactgtctatagattattaca

SEQ ID NO: 14749 - DNA, 22 bp, Artificial sequence
  SiRNA target sequence
cactgtctatagattattacaa

SEQ ID NO: 14750 - DNA, 22 bp, Artificial sequence
  SiRNA target sequence
actgtctatagattattacaag

SEQ ID NO: 14751 - DNA, 22 bp, Artificial sequence
  SiRNA target sequence
ctgtctatagattattacaaga

SEQ ID NO: 14752 - DNA, 22 bp, Artificial sequence
  SiRNA target sequence
tgtctatagattattacaagac

SEQ ID NO: 14753 - DNA, 22 bp, Artificial sequence
  SiRNA target sequence
gtctatagattattacaagaca

SEQ ID NO: 14754 - DNA, 22 bp, Artificial sequence
  SiRNA target sequence
tctatagattattacaagacat

SEQ ID NO: 14755 - DNA, 22 bp, Artificial sequence
  SiRNA target sequence
ctatagattattacaagacatt

SEQ ID NO: 14756 - DNA, 22 bp, Artificial sequence
  SiRNA target sequence
tatagattattacaagacattg

SEQ ID NO: 14757 - DNA, 22 bp, Artificial sequence
  SiRNA target sequence
atagattattacaagacattgt

SEQ ID NO: 14758 - DNA, 22 bp, Artificial sequence
  SiRNA target sequence
tagattattacaagacattgtc

SEQ ID NO: 14759 - DNA, 22 bp, Artificial sequence
  SiRNA target sequence
agattattacaagacattgtct

SEQ ID NO: 14760 - DNA, 22 bp, Artificial sequence
  SiRNA target sequence
gattattacaagacattgtctt

SEQ ID NO: 14761 - DNA, 22 bp, Artificial sequence
  SiRNA target sequence
attattacaagacattgtcttc

SEQ ID NO: 14762 - DNA, 22 bp, Artificial sequence
  SiRNA target sequence
ttattacaagacattgtcttct

SEQ ID NO: 14763 - DNA, 22 bp, Artificial sequence
  SiRNA target sequence
tattacaagacattgtcttcta

SEQ ID NO: 14764 - DNA, 22 bp, Artificial sequence
  SiRNA target sequence
attacaagacattgtcttctat

SEQ ID NO: 14765 - DNA, 22 bp, Artificial sequence
  SiRNA target sequence
ttacaagacattgtcttctatt

SEQ ID NO: 14766 - DNA, 22 bp, Artificial sequence
  SiRNA target sequence
tacaagacattgtcttctattt

SEQ ID NO: 14767 - DNA, 22 bp, Artificial sequence
  SiRNA target sequence
acaagacattgtcttctatttg

SEQ ID NO: 14768 - DNA, 22 bp, Artificial sequence
  SiRNA target sequence
caagacattgtcttctatttgt

SEQ ID NO: 14769 - DNA, 22 bp, Artificial sequence
  SiRNA target sequence
aagacattgtcttctatttgtg

SEQ ID NO: 14770 - DNA, 22 bp, Artificial sequence
  SiRNA target sequence
agacattgtcttctatttgtga

SEQ ID NO: 14771 - DNA, 22 bp, Artificial sequence
  SiRNA target sequence
gacattgtcttctatttgtgac

SEQ ID NO: 14772 - DNA, 22 bp, Artificial sequence
  SiRNA target sequence
acattgtcttctatttgtgacg

SEQ ID NO: 14773 - DNA, 22 bp, Artificial sequence
  SiRNA target sequence
cattgtcttctatttgtgacgt

SEQ ID NO: 14774 - DNA, 22 bp, Artificial sequence
  SiRNA target sequence
attgtcttctatttgtgacgta

SEQ ID NO: 14775 - DNA, 22 bp, Artificial sequence
  SiRNA target sequence
ttgtcttctatttgtgacgtag

SEQ ID NO: 14776 - DNA, 22 bp, Artificial sequence
  SiRNA target sequence
tgtcttctatttgtgacgtagg

SEQ ID NO: 14777 - DNA, 22 bp, Artificial sequence
  SiRNA target sequence
gtcttctatttgtgacgtaggt

SEQ ID NO: 14778 - DNA, 22 bp, Artificial sequence
  SiRNA target sequence
tcttctatttgtgacgtaggta

SEQ ID NO: 14779 - DNA, 22 bp, Artificial sequence
  SiRNA target sequence
cttctatttgtgacgtaggtat

SEQ ID NO: 14780 - DNA, 22 bp, Artificial sequence
  SiRNA target sequence
ttctatttgtgacgtaggtatt

SEQ ID NO: 14781 - DNA, 22 bp, Artificial sequence
  SiRNA target sequence
tctatttgtgacgtaggtatta

SEQ ID NO: 14782 - DNA, 22 bp, Artificial sequence
  SiRNA target sequence
ctatttgtgacgtaggtattaa

SEQ ID NO: 14783 - DNA, 22 bp, Artificial sequence
  SiRNA target sequence
tatttgtgacgtaggtattaaa

SEQ ID NO: 14784 - DNA, 22 bp, Artificial sequence
  SiRNA target sequence
atttgtgacgtaggtattaaaa

SEQ ID NO: 14785 - DNA, 22 bp, Artificial sequence
  SiRNA target sequence
tttgtgacgtaggtattaaaat

SEQ ID NO: 14786 - DNA, 22 bp, Artificial sequence
  SiRNA target sequence
ttgtgacgtaggtattaaaata

SEQ ID NO: 14787 - DNA, 22 bp, Artificial sequence
  SiRNA target sequence
tgtgacgtaggtattaaaatat

SEQ ID NO: 14788 - DNA, 22 bp, Artificial sequence
  SiRNA target sequence
gtgacgtaggtattaaaatatc

SEQ ID NO: 14789 - DNA, 22 bp, Artificial sequence
  SiRNA target sequence
tgacgtaggtattaaaatatca

SEQ ID NO: 14790 - DNA, 22 bp, Artificial sequence
  SiRNA target sequence
gacgtaggtattaaaatatcaa

SEQ ID NO: 14791 - DNA, 22 bp, Artificial sequence
  SiRNA target sequence
acgtaggtattaaaatatcaac

SEQ ID NO: 14792 - DNA, 22 bp, Artificial sequence
  SiRNA target sequence
cgtaggtattaaaatatcaact

SEQ ID NO: 14793 - DNA, 22 bp, Artificial sequence
  SiRNA target sequence
gtaggtattaaaatatcaactg

SEQ ID NO: 14794 - DNA, 22 bp, Artificial sequence
  SiRNA target sequence
taggtattaaaatatcaactga

SEQ ID NO: 14795 - DNA, 22 bp, Artificial sequence
  SiRNA target sequence
aggtattaaaatatcaactgat

SEQ ID NO: 14796 - DNA, 22 bp, Artificial sequence
  SiRNA target sequence
ggtattaaaatatcaactgata

SEQ ID NO: 14797 - DNA, 22 bp, Artificial sequence
  SiRNA target sequence
gtattaaaatatcaactgatag

SEQ ID NO: 14798 - DNA, 22 bp, Artificial sequence
  SiRNA target sequence
tattaaaatatcaactgatagg

SEQ ID NO: 14799 - DNA, 22 bp, Artificial sequence
  SiRNA target sequence
attaaaatatcaactgataggg

SEQ ID NO: 14800 - DNA, 22 bp, Artificial sequence
  SiRNA target sequence
ttaaaatatcaactgataggga

SEQ ID NO: 14801 - DNA, 22 bp, Artificial sequence
  SiRNA target sequence
taaaatatcaactgatagggaa

SEQ ID NO: 14802 - DNA, 22 bp, Artificial sequence
  SiRNA target sequence
aaaatatcaactgatagggaaa

SEQ ID NO: 14803 - DNA, 22 bp, Artificial sequence
  SiRNA target sequence
aaatatcaactgatagggaaaa

SEQ ID NO: 14804 - DNA, 22 bp, Artificial sequence
  SiRNA target sequence
aatatcaactgatagggaaaaa

SEQ ID NO: 14805 - DNA, 22 bp, Artificial sequence
  SiRNA target sequence
atatcaactgatagggaaaaat

SEQ ID NO: 14806 - DNA, 22 bp, Artificial sequence
  SiRNA target sequence
tatcaactgatagggaaaaatc

SEQ ID NO: 14807 - DNA, 22 bp, Artificial sequence
  SiRNA target sequence
atcaactgatagggaaaaatca

SEQ ID NO: 14808 - DNA, 22 bp, Artificial sequence
  SiRNA target sequence
tcaactgatagggaaaaatcag

SEQ ID NO: 14809 - DNA, 22 bp, Artificial sequence
  SiRNA target sequence
caactgatagggaaaaatcagt

SEQ ID NO: 14810 - DNA, 22 bp, Artificial sequence
  SiRNA target sequence
aactgatagggaaaaatcagtt

SEQ ID NO: 14811 - DNA, 22 bp, Artificial sequence
  SiRNA target sequence
actgatagggaaaaatcagtta

SEQ ID NO: 14812 - DNA, 22 bp, Artificial sequence
  SiRNA target sequence
ctgatagggaaaaatcagttaa

SEQ ID NO: 14813 - DNA, 22 bp, Artificial sequence
  SiRNA target sequence
tgatagggaaaaatcagttaat

SEQ ID NO: 14814 - DNA, 22 bp, Artificial sequence
  SiRNA target sequence
gatagggaaaaatcagttaatt

SEQ ID NO: 14815 - DNA, 22 bp, Artificial sequence
  SiRNA target sequence
atagggaaaaatcagttaatta

SEQ ID NO: 14816 - DNA, 22 bp, Artificial sequence
  SiRNA target sequence
tagggaaaaatcagttaattat

SEQ ID NO: 14817 - DNA, 22 bp, Artificial sequence
  SiRNA target sequence
agggaaaaatcagttaattatg

SEQ ID NO: 14818 - DNA, 22 bp, Artificial sequence
  SiRNA target sequence
gggaaaaatcagttaattatgg

SEQ ID NO: 14819 - DNA, 22 bp, Artificial sequence
  SiRNA target sequence
ggaaaaatcagttaattatgga

SEQ ID NO: 14820 - DNA, 22 bp, Artificial sequence
  SiRNA target sequence
gaaaaatcagttaattatggat

SEQ ID NO: 14821 - DNA, 22 bp, Artificial sequence
  SiRNA target sequence
aaaaatcagttaattatggatt

SEQ ID NO: 14822 - DNA, 22 bp, Artificial sequence
  SiRNA target sequence
aaaatcagttaattatggatta

SEQ ID NO: 14823 - DNA, 22 bp, Artificial sequence
  SiRNA target sequence
aaatcagttaattatggattag

SEQ ID NO: 14824 - DNA, 22 bp, Artificial sequence
  SiRNA target sequence
aatcagttaattatggattagg

SEQ ID NO: 14825 - DNA, 22 bp, Artificial sequence
  SiRNA target sequence
atcagttaattatggattagga

SEQ ID NO: 14826 - DNA, 22 bp, Artificial sequence
  SiRNA target sequence
tcagttaattatggattaggag

SEQ ID NO: 14827 - DNA, 22 bp, Artificial sequence
  SiRNA target sequence
cagttaattatggattaggagt

SEQ ID NO: 14828 - DNA, 22 bp, Artificial sequence
  SiRNA target sequence
agttaattatggattaggagtt

SEQ ID NO: 14829 - DNA, 22 bp, Artificial sequence
  SiRNA target sequence
gttaattatggattaggagtta

SEQ ID NO: 14830 - DNA, 22 bp, Artificial sequence
  SiRNA target sequence
ttaattatggattaggagttaa

SEQ ID NO: 14831 - DNA, 22 bp, Artificial sequence
  SiRNA target sequence
taattatggattaggagttaaa

SEQ ID NO: 14832 - DNA, 22 bp, Artificial sequence
  SiRNA target sequence
aattatggattaggagttaaac

SEQ ID NO: 14833 - DNA, 22 bp, Artificial sequence
  SiRNA target sequence
attatggattaggagttaaact

SEQ ID NO: 14834 - DNA, 22 bp, Artificial sequence
  SiRNA target sequence
ttatggattaggagttaaacta

SEQ ID NO: 14835 - DNA, 22 bp, Artificial sequence
  SiRNA target sequence
tatggattaggagttaaactac

SEQ ID NO: 14836 - DNA, 22 bp, Artificial sequence
  SiRNA target sequence
atggattaggagttaaactaca

SEQ ID NO: 14837 - DNA, 22 bp, Artificial sequence
  SiRNA target sequence
tggattaggagttaaactacac

SEQ ID NO: 14838 - DNA, 22 bp, Artificial sequence
  SiRNA target sequence
ggattaggagttaaactacaca

SEQ ID NO: 14839 - DNA, 22 bp, Artificial sequence
  SiRNA target sequence
gattaggagttaaactacacag

SEQ ID NO: 14840 - DNA, 22 bp, Artificial sequence
  SiRNA target sequence
attaggagttaaactacacagt

SEQ ID NO: 14841 - DNA, 22 bp, Artificial sequence
  SiRNA target sequence
ttaggagttaaactacacagta

SEQ ID NO: 14842 - DNA, 22 bp, Artificial sequence
  SiRNA target sequence
taggagttaaactacacagtaa

SEQ ID NO: 14843 - DNA, 22 bp, Artificial sequence
  SiRNA target sequence
aggagttaaactacacagtaaa

SEQ ID NO: 14844 - DNA, 22 bp, Artificial sequence
  SiRNA target sequence
ggagttaaactacacagtaaaa

SEQ ID NO: 14845 - DNA, 22 bp, Artificial sequence
  SiRNA target sequence
gagttaaactacacagtaaaaa

SEQ ID NO: 14846 - DNA, 22 bp, Artificial sequence
  SiRNA target sequence
agttaaactacacagtaaaaaa

SEQ ID NO: 14847 - DNA, 22 bp, Artificial sequence
  SiRNA target sequence
gttaaactacacagtaaaaaag

SEQ ID NO: 14848 - DNA, 22 bp, Artificial sequence
  SiRNA target sequence
ttaaactacacagtaaaaaagg

SEQ ID NO: 14849 - DNA, 22 bp, Artificial sequence
  SiRNA target sequence
taaactacacagtaaaaaagga

SEQ ID NO: 14850 - DNA, 22 bp, Artificial sequence
  SiRNA target sequence
aaactacacagtaaaaaaggag

SEQ ID NO: 14851 - DNA, 22 bp, Artificial sequence
  SiRNA target sequence
aactacacagtaaaaaaggaga

SEQ ID NO: 14852 - DNA, 22 bp, Artificial sequence
  SiRNA target sequence
actacacagtaaaaaaggagaa

SEQ ID NO: 14853 - DNA, 22 bp, Artificial sequence
  SiRNA target sequence
ctacacagtaaaaaaggagaaa

SEQ ID NO: 14854 - DNA, 22 bp, Artificial sequence
  SiRNA target sequence
tacacagtaaaaaaggagaaat

SEQ ID NO: 14855 - DNA, 22 bp, Artificial sequence
  SiRNA target sequence
acacagtaaaaaaggagaaatt

SEQ ID NO: 14856 - DNA, 22 bp, Artificial sequence
  SiRNA target sequence
cacagtaaaaaaggagaaatta

SEQ ID NO: 14857 - DNA, 22 bp, Artificial sequence
  SiRNA target sequence
acagtaaaaaaggagaaattat

SEQ ID NO: 14858 - DNA, 22 bp, Artificial sequence
  SiRNA target sequence
cagtaaaaaaggagaaattatc

SEQ ID NO: 14859 - DNA, 22 bp, Artificial sequence
  SiRNA target sequence
agtaaaaaaggagaaattatcg

SEQ ID NO: 14860 - DNA, 22 bp, Artificial sequence
  SiRNA target sequence
gtaaaaaaggagaaattatcgg

SEQ ID NO: 14861 - DNA, 22 bp, Artificial sequence
  SiRNA target sequence
taaaaaaggagaaattatcgga

SEQ ID NO: 14862 - DNA, 22 bp, Artificial sequence
  SiRNA target sequence
aaaaaaggagaaattatcggat

SEQ ID NO: 14863 - DNA, 22 bp, Artificial sequence
  SiRNA target sequence
aaaaaggagaaattatcggatg

SEQ ID NO: 14864 - DNA, 22 bp, Artificial sequence
  SiRNA target sequence
aaaaggagaaattatcggatgt

SEQ ID NO: 14865 - DNA, 22 bp, Artificial sequence
  SiRNA target sequence
aaaggagaaattatcggatgtg

SEQ ID NO: 14866 - DNA, 22 bp, Artificial sequence
  SiRNA target sequence
aaggagaaattatcggatgtgt

SEQ ID NO: 14867 - DNA, 22 bp, Artificial sequence
  SiRNA target sequence
aggagaaattatcggatgtgta

SEQ ID NO: 14868 - DNA, 22 bp, Artificial sequence
  SiRNA target sequence
ggagaaattatcggatgtgtag

SEQ ID NO: 14869 - DNA, 22 bp, Artificial sequence
  SiRNA target sequence
gagaaattatcggatgtgtaga

SEQ ID NO: 14870 - DNA, 22 bp, Artificial sequence
  SiRNA target sequence
agaaattatcggatgtgtagat

SEQ ID NO: 14871 - DNA, 22 bp, Artificial sequence
  SiRNA target sequence
gaaattatcggatgtgtagata

SEQ ID NO: 14872 - DNA, 22 bp, Artificial sequence
  SiRNA target sequence
aaattatcggatgtgtagataa

SEQ ID NO: 14873 - DNA, 22 bp, Artificial sequence
  SiRNA target sequence
aattatcggatgtgtagataac

SEQ ID NO: 14874 - DNA, 22 bp, Artificial sequence
  SiRNA target sequence
attatcggatgtgtagataaca

SEQ ID NO: 14875 - DNA, 22 bp, Artificial sequence
  SiRNA target sequence
ttatcggatgtgtagataacaa

SEQ ID NO: 14876 - DNA, 22 bp, Artificial sequence
  SiRNA target sequence
tatcggatgtgtagataacaat

SEQ ID NO: 14877 - DNA, 22 bp, Artificial sequence
  SiRNA target sequence
atcggatgtgtagataacaatc

SEQ ID NO: 14878 - DNA, 22 bp, Artificial sequence
  SiRNA target sequence
tcggatgtgtagataacaatca

SEQ ID NO: 14879 - DNA, 22 bp, Artificial sequence
  SiRNA target sequence
cggatgtgtagataacaatcat

SEQ ID NO: 14880 - DNA, 22 bp, Artificial sequence
  SiRNA target sequence
ggatgtgtagataacaatcata

SEQ ID NO: 14881 - DNA, 22 bp, Artificial sequence
  SiRNA target sequence
gatgtgtagataacaatcatat

SEQ ID NO: 14882 - DNA, 22 bp, Artificial sequence
  SiRNA target sequence
atgtgtagataacaatcatatt

SEQ ID NO: 14883 - DNA, 22 bp, Artificial sequence
  SiRNA target sequence
tgtgtagataacaatcatattt

SEQ ID NO: 14884 - DNA, 22 bp, Artificial sequence
  SiRNA target sequence
gtgtagataacaatcatatttt

SEQ ID NO: 14885 - DNA, 22 bp, Artificial sequence
  SiRNA target sequence
tgtagataacaatcatatttta

SEQ ID NO: 14886 - DNA, 22 bp, Artificial sequence
  SiRNA target sequence
gtagataacaatcatattttaa

SEQ ID NO: 14887 - DNA, 22 bp, Artificial sequence
  SiRNA target sequence
tagataacaatcatattttaag

SEQ ID NO: 14888 - DNA, 22 bp, Artificial sequence
  SiRNA target sequence
agataacaatcatattttaagc

SEQ ID NO: 14889 - DNA, 22 bp, Artificial sequence
  SiRNA target sequence
gataacaatcatattttaagca

SEQ ID NO: 14890 - DNA, 22 bp, Artificial sequence
  SiRNA target sequence
ataacaatcatattttaagcat

SEQ ID NO: 14891 - DNA, 22 bp, Artificial sequence
  SiRNA target sequence
taacaatcatattttaagcata

SEQ ID NO: 14892 - DNA, 22 bp, Artificial sequence
  SiRNA target sequence
aacaatcatattttaagcataa

SEQ ID NO: 14893 - DNA, 22 bp, Artificial sequence
  SiRNA target sequence
acaatcatattttaagcataat

SEQ ID NO: 14894 - DNA, 22 bp, Artificial sequence
  SiRNA target sequence
caatcatattttaagcataatt

SEQ ID NO: 14895 - DNA, 22 bp, Artificial sequence
  SiRNA target sequence
aatcatattttaagcataattt

SEQ ID NO: 14896 - DNA, 22 bp, Artificial sequence
  SiRNA target sequence
atcatattttaagcataattta

SEQ ID NO: 14897 - DNA, 22 bp, Artificial sequence
  SiRNA target sequence
tcatattttaagcataatttat

SEQ ID NO: 14898 - DNA, 22 bp, Artificial sequence
  SiRNA target sequence
catattttaagcataatttata

SEQ ID NO: 14899 - DNA, 22 bp, Artificial sequence
  SiRNA target sequence
atattttaagcataatttataa

SEQ ID NO: 14900 - DNA, 22 bp, Artificial sequence
  SiRNA target sequence
tattttaagcataatttataat

SEQ ID NO: 14901 - DNA, 22 bp, Artificial sequence
  SiRNA target sequence
attttaagcataatttataatg

SEQ ID NO: 14902 - DNA, 22 bp, Artificial sequence
  SiRNA target sequence
ttttaagcataatttataatga

SEQ ID NO: 14903 - DNA, 22 bp, Artificial sequence
  SiRNA target sequence
tttaagcataatttataatgat

SEQ ID NO: 14904 - DNA, 22 bp, Artificial sequence
  SiRNA target sequence
ttaagcataatttataatgata

SEQ ID NO: 14905 - DNA, 22 bp, Artificial sequence
  SiRNA target sequence
taagcataatttataatgataa

SEQ ID NO: 14906 - DNA, 22 bp, Artificial sequence
  SiRNA target sequence
aagcataatttataatgataaa

SEQ ID NO: 14907 - DNA, 22 bp, Artificial sequence
  SiRNA target sequence
agcataatttataatgataaat

SEQ ID NO: 14908 - DNA, 22 bp, Artificial sequence
  SiRNA target sequence
gcataatttataatgataaatt

SEQ ID NO: 14909 - DNA, 22 bp, Artificial sequence
  SiRNA target sequence
cataatttataatgataaatta

SEQ ID NO: 14910 - DNA, 22 bp, Artificial sequence
  SiRNA target sequence
ataatttataatgataaattat

SEQ ID NO: 14911 - DNA, 22 bp, Artificial sequence
  SiRNA target sequence
taatttataatgataaattatc

SEQ ID NO: 14912 - DNA, 22 bp, Artificial sequence
  SiRNA target sequence
aatttataatgataaattatct

SEQ ID NO: 14913 - DNA, 22 bp, Artificial sequence
  SiRNA target sequence
atttataatgataaattatctg

SEQ ID NO: 14914 - DNA, 22 bp, Artificial sequence
  SiRNA target sequence
tttataatgataaattatctga

SEQ ID NO: 14915 - DNA, 22 bp, Artificial sequence
  SiRNA target sequence
ttataatgataaattatctgaa

SEQ ID NO: 14916 - DNA, 22 bp, Artificial sequence
  SiRNA target sequence
tataatgataaattatctgaag

SEQ ID NO: 14917 - DNA, 22 bp, Artificial sequence
  SiRNA target sequence
ataatgataaattatctgaagg

SEQ ID NO: 14918 - DNA, 22 bp, Artificial sequence
  SiRNA target sequence
taatgataaattatctgaaggg

SEQ ID NO: 14919 - DNA, 22 bp, Artificial sequence
  SiRNA target sequence
aatgataaattatctgaagggt

SEQ ID NO: 14920 - DNA, 22 bp, Artificial sequence
  SiRNA target sequence
atgataaattatctgaagggtt

SEQ ID NO: 14921 - DNA, 22 bp, Artificial sequence
  SiRNA target sequence
tgataaattatctgaagggtta

SEQ ID NO: 14922 - DNA, 22 bp, Artificial sequence
  SiRNA target sequence
gataaattatctgaagggttaa

SEQ ID NO: 14923 - DNA, 22 bp, Artificial sequence
  SiRNA target sequence
ataaattatctgaagggttaac

SEQ ID NO: 14924 - DNA, 22 bp, Artificial sequence
  SiRNA target sequence
taaattatctgaagggttaaca

SEQ ID NO: 14925 - DNA, 22 bp, Artificial sequence
  SiRNA target sequence
aaattatctgaagggttaacac

SEQ ID NO: 14926 - DNA, 22 bp, Artificial sequence
  SiRNA target sequence
aattatctgaagggttaacact

SEQ ID NO: 14927 - DNA, 22 bp, Artificial sequence
  SiRNA target sequence
attatctgaagggttaacactt

SEQ ID NO: 14928 - DNA, 22 bp, Artificial sequence
  SiRNA target sequence
ttatctgaagggttaacactta

SEQ ID NO: 14929 - DNA, 22 bp, Artificial sequence
  SiRNA target sequence
tatctgaagggttaacacttaa

SEQ ID NO: 14930 - DNA, 22 bp, Artificial sequence
  SiRNA target sequence
atctgaagggttaacacttaat

SEQ ID NO: 14931 - DNA, 22 bp, Artificial sequence
  SiRNA target sequence
tctgaagggttaacacttaatt

SEQ ID NO: 14932 - DNA, 22 bp, Artificial sequence
  SiRNA target sequence
ctgaagggttaacacttaattt

SEQ ID NO: 14933 - DNA, 22 bp, Artificial sequence
  SiRNA target sequence
tgaagggttaacacttaatttg

SEQ ID NO: 14934 - DNA, 22 bp, Artificial sequence
  SiRNA target sequence
gaagggttaacacttaatttga

SEQ ID NO: 14935 - DNA, 22 bp, Artificial sequence
  SiRNA target sequence
aagggttaacacttaatttgag

SEQ ID NO: 14936 - DNA, 22 bp, Artificial sequence
  SiRNA target sequence
agggttaacacttaatttgagt

SEQ ID NO: 14937 - DNA, 22 bp, Artificial sequence
  SiRNA target sequence
gggttaacacttaatttgagtt

SEQ ID NO: 14938 - DNA, 22 bp, Artificial sequence
  SiRNA target sequence
ggttaacacttaatttgagttg

SEQ ID NO: 14939 - DNA, 22 bp, Artificial sequence
  SiRNA target sequence
gttaacacttaatttgagttgt

SEQ ID NO: 14940 - DNA, 22 bp, Artificial sequence
  SiRNA target sequence
ttaacacttaatttgagttgta

SEQ ID NO: 14941 - DNA, 22 bp, Artificial sequence
  SiRNA target sequence
taacacttaatttgagttgtag

SEQ ID NO: 14942 - DNA, 22 bp, Artificial sequence
  SiRNA target sequence
aacacttaatttgagttgtaga

SEQ ID NO: 14943 - DNA, 22 bp, Artificial sequence
  SiRNA target sequence
acacttaatttgagttgtagat

SEQ ID NO: 14944 - DNA, 22 bp, Artificial sequence
  SiRNA target sequence
cacttaatttgagttgtagatt

SEQ ID NO: 14945 - DNA, 22 bp, Artificial sequence
  SiRNA target sequence
acttaatttgagttgtagattt

SEQ ID NO: 14946 - DNA, 22 bp, Artificial sequence
  SiRNA target sequence
cttaatttgagttgtagatttg

SEQ ID NO: 14947 - DNA, 22 bp, Artificial sequence
  SiRNA target sequence
ttaatttgagttgtagatttgg

SEQ ID NO: 14948 - DNA, 22 bp, Artificial sequence
  SiRNA target sequence
taatttgagttgtagatttggt

SEQ ID NO: 14949 - DNA, 22 bp, Artificial sequence
  SiRNA target sequence
aatttgagttgtagatttggta

SEQ ID NO: 14950 - DNA, 22 bp, Artificial sequence
  SiRNA target sequence
atttgagttgtagatttggtaa

SEQ ID NO: 14951 - DNA, 22 bp, Artificial sequence
  SiRNA target sequence
tttgagttgtagatttggtaag

SEQ ID NO: 14952 - DNA, 22 bp, Artificial sequence
  SiRNA target sequence
ttgagttgtagatttggtaaga

SEQ ID NO: 14953 - DNA, 22 bp, Artificial sequence
  SiRNA target sequence
tgagttgtagatttggtaagaa

SEQ ID NO: 14954 - DNA, 22 bp, Artificial sequence
  SiRNA target sequence
gagttgtagatttggtaagaaa

SEQ ID NO: 14955 - DNA, 22 bp, Artificial sequence
  SiRNA target sequence
agttgtagatttggtaagaaag

SEQ ID NO: 14956 - DNA, 22 bp, Artificial sequence
  SiRNA target sequence
gttgtagatttggtaagaaagt

SEQ ID NO: 14957 - DNA, 22 bp, Artificial sequence
  SiRNA target sequence
ttgtagatttggtaagaaagta

SEQ ID NO: 14958 - DNA, 22 bp, Artificial sequence
  SiRNA target sequence
tgtagatttggtaagaaagtat

SEQ ID NO: 14959 - DNA, 22 bp, Artificial sequence
  SiRNA target sequence
gtagatttggtaagaaagtatt

SEQ ID NO: 14960 - DNA, 22 bp, Artificial sequence
  SiRNA target sequence
tagatttggtaagaaagtattt

SEQ ID NO: 14961 - DNA, 22 bp, Artificial sequence
  SiRNA target sequence
agatttggtaagaaagtatttg

SEQ ID NO: 14962 - DNA, 22 bp, Artificial sequence
  SiRNA target sequence
gatttggtaagaaagtatttga

SEQ ID NO: 14963 - DNA, 22 bp, Artificial sequence
  SiRNA target sequence
atttggtaagaaagtatttgat

SEQ ID NO: 14964 - DNA, 22 bp, Artificial sequence
  SiRNA target sequence
tttggtaagaaagtatttgatt

SEQ ID NO: 14965 - DNA, 22 bp, Artificial sequence
  SiRNA target sequence
ttggtaagaaagtatttgatta

SEQ ID NO: 14966 - DNA, 22 bp, Artificial sequence
  SiRNA target sequence
tggtaagaaagtatttgattat

SEQ ID NO: 14967 - DNA, 22 bp, Artificial sequence
  SiRNA target sequence
ggtaagaaagtatttgattatg

SEQ ID NO: 14968 - DNA, 22 bp, Artificial sequence
  SiRNA target sequence
gtaagaaagtatttgattatgg

SEQ ID NO: 14969 - DNA, 22 bp, Artificial sequence
  SiRNA target sequence
taagaaagtatttgattatggc

SEQ ID NO: 14970 - DNA, 22 bp, Artificial sequence
  SiRNA target sequence
aagaaagtatttgattatggct

SEQ ID NO: 14971 - DNA, 22 bp, Artificial sequence
  SiRNA target sequence
agaaagtatttgattatggcta

SEQ ID NO: 14972 - DNA, 22 bp, Artificial sequence
  SiRNA target sequence
gaaagtatttgattatggctat

SEQ ID NO: 14973 - DNA, 22 bp, Artificial sequence
  SiRNA target sequence
aaagtatttgattatggctatg

SEQ ID NO: 14974 - DNA, 22 bp, Artificial sequence
  SiRNA target sequence
aagtatttgattatggctatgg

SEQ ID NO: 14975 - DNA, 22 bp, Artificial sequence
  SiRNA target sequence
agtatttgattatggctatggg

SEQ ID NO: 14976 - DNA, 22 bp, Artificial sequence
  SiRNA target sequence
gtatttgattatggctatgggt

SEQ ID NO: 14977 - DNA, 22 bp, Artificial sequence
  SiRNA target sequence
tatttgattatggctatgggtt

SEQ ID NO: 14978 - DNA, 22 bp, Artificial sequence
  SiRNA target sequence
atttgattatggctatgggttt

SEQ ID NO: 14979 - DNA, 22 bp, Artificial sequence
  SiRNA target sequence
tttgattatggctatgggttta

SEQ ID NO: 14980 - DNA, 22 bp, Artificial sequence
  SiRNA target sequence
ttgattatggctatgggtttat

SEQ ID NO: 14981 - DNA, 22 bp, Artificial sequence
  SiRNA target sequence
tgattatggctatgggtttatt

SEQ ID NO: 14982 - DNA, 22 bp, Artificial sequence
  SiRNA target sequence
gattatggctatgggtttattt

SEQ ID NO: 14983 - DNA, 22 bp, Artificial sequence
  SiRNA target sequence
attatggctatgggtttattta

SEQ ID NO: 14984 - DNA, 22 bp, Artificial sequence
  SiRNA target sequence
ttatggctatgggtttatttat

SEQ ID NO: 14985 - DNA, 22 bp, Artificial sequence
  SiRNA target sequence
tatggctatgggtttatttatg

SEQ ID NO: 14986 - DNA, 22 bp, Artificial sequence
  SiRNA target sequence
atggctatgggtttatttatga

SEQ ID NO: 14987 - DNA, 22 bp, Artificial sequence
  SiRNA target sequence
tggctatgggtttatttatgaa

SEQ ID NO: 14988 - DNA, 22 bp, Artificial sequence
  SiRNA target sequence
ggctatgggtttatttatgaat

SEQ ID NO: 14989 - DNA, 22 bp, Artificial sequence
  SiRNA target sequence
gctatgggtttatttatgaatt

SEQ ID NO: 14990 - DNA, 22 bp, Artificial sequence
  SiRNA target sequence
ctatgggtttatttatgaattt

SEQ ID NO: 14991 - DNA, 22 bp, Artificial sequence
  SiRNA target sequence
tatgggtttatttatgaatttt

SEQ ID NO: 14992 - DNA, 22 bp, Artificial sequence
  SiRNA target sequence
atgggtttatttatgaatttta

SEQ ID NO: 14993 - DNA, 22 bp, Artificial sequence
  SiRNA target sequence
tgggtttatttatgaattttaa

SEQ ID NO: 14994 - DNA, 23 bp, Artificial sequence
  SiRNA target sequence
atgaaatctttctacaaaaaaat

SEQ ID NO: 14995 - DNA, 23 bp, Artificial sequence
  SiRNA target sequence
tgaaatctttctacaaaaaaata

SEQ ID NO: 14996 - DNA, 23 bp, Artificial sequence
  SiRNA target sequence
gaaatctttctacaaaaaaataa

SEQ ID NO: 14997 - DNA, 23 bp, Artificial sequence
  SiRNA target sequence
aaatctttctacaaaaaaataaa

SEQ ID NO: 14998 - DNA, 23 bp, Artificial sequence
  SiRNA target sequence
aatctttctacaaaaaaataaaa

SEQ ID NO: 14999 - DNA, 23 bp, Artificial sequence
  SiRNA target sequence
atctttctacaaaaaaataaaaa

SEQ ID NO: 15000 - DNA, 23 bp, Artificial sequence
  SiRNA target sequence
tctttctacaaaaaaataaaaag

SEQ ID NO: 15001 - DNA, 23 bp, Artificial sequence
  SiRNA target sequence
ctttctacaaaaaaataaaaagt

SEQ ID NO: 15002 - DNA, 23 bp, Artificial sequence
  SiRNA target sequence
tttctacaaaaaaataaaaagtt

SEQ ID NO: 15003 - DNA, 23 bp, Artificial sequence
  SiRNA target sequence
ttctacaaaaaaataaaaagtta

SEQ ID NO: 15004 - DNA, 23 bp, Artificial sequence
  SiRNA target sequence
tctacaaaaaaataaaaagttat

SEQ ID NO: 15005 - DNA, 23 bp, Artificial sequence
  SiRNA target sequence
ctacaaaaaaataaaaagttatt

SEQ ID NO: 15006 - DNA, 23 bp, Artificial sequence
  SiRNA target sequence
tacaaaaaaataaaaagttattt

SEQ ID NO: 15007 - DNA, 23 bp, Artificial sequence
  SiRNA target sequence
acaaaaaaataaaaagttattta

SEQ ID NO: 15008 - DNA, 23 bp, Artificial sequence
  SiRNA target sequence
caaaaaaataaaaagttatttat

SEQ ID NO: 15009 - DNA, 23 bp, Artificial sequence
  SiRNA target sequence
aaaaaaataaaaagttatttatt

SEQ ID NO: 15010 - DNA, 23 bp, Artificial sequence
  SiRNA target sequence
aaaaaataaaaagttatttattc

SEQ ID NO: 15011 - DNA, 23 bp, Artificial sequence
  SiRNA target sequence
aaaaataaaaagttatttattca

SEQ ID NO: 15012 - DNA, 23 bp, Artificial sequence
  SiRNA target sequence
aaaataaaaagttatttattcaa

SEQ ID NO: 15013 - DNA, 23 bp, Artificial sequence
  SiRNA target sequence
aaataaaaagttatttattcaaa

SEQ ID NO: 15014 - DNA, 23 bp, Artificial sequence
  SiRNA target sequence
aataaaaagttatttattcaaat

SEQ ID NO: 15015 - DNA, 23 bp, Artificial sequence
  SiRNA target sequence
ataaaaagttatttattcaaatc

SEQ ID NO: 15016 - DNA, 23 bp, Artificial sequence
  SiRNA target sequence
taaaaagttatttattcaaatct

SEQ ID NO: 15017 - DNA, 23 bp, Artificial sequence
  SiRNA target sequence
aaaaagttatttattcaaatctg

SEQ ID NO: 15018 - DNA, 23 bp, Artificial sequence
  SiRNA target sequence
aaaagttatttattcaaatctgc

SEQ ID NO: 15019 - DNA, 23 bp, Artificial sequence
  SiRNA target sequence
aaagttatttattcaaatctgcc

SEQ ID NO: 15020 - DNA, 23 bp, Artificial sequence
  SiRNA target sequence
aagttatttattcaaatctgcca

SEQ ID NO: 15021 - DNA, 23 bp, Artificial sequence
  SiRNA target sequence
agttatttattcaaatctgccat

SEQ ID NO: 15022 - DNA, 23 bp, Artificial sequence
  SiRNA target sequence
gttatttattcaaatctgccatt

SEQ ID NO: 15023 - DNA, 23 bp, Artificial sequence
  SiRNA target sequence
ttatttattcaaatctgccatta

SEQ ID NO: 15024 - DNA, 23 bp, Artificial sequence
  SiRNA target sequence
tatttattcaaatctgccattaa

SEQ ID NO: 15025 - DNA, 23 bp, Artificial sequence
  SiRNA target sequence
atttattcaaatctgccattaat

SEQ ID NO: 15026 - DNA, 23 bp, Artificial sequence
  SiRNA target sequence
tttattcaaatctgccattaata

SEQ ID NO: 15027 - DNA, 23 bp, Artificial sequence
  SiRNA target sequence
ttattcaaatctgccattaatac

SEQ ID NO: 15028 - DNA, 23 bp, Artificial sequence
  SiRNA target sequence
tattcaaatctgccattaataca

SEQ ID NO: 15029 - DNA, 23 bp, Artificial sequence
  SiRNA target sequence
attcaaatctgccattaatacat

SEQ ID NO: 15030 - DNA, 23 bp, Artificial sequence
  SiRNA target sequence
ttcaaatctgccattaatacatc

SEQ ID NO: 15031 - DNA, 23 bp, Artificial sequence
  SiRNA target sequence
tcaaatctgccattaatacatct

SEQ ID NO: 15032 - DNA, 23 bp, Artificial sequence
  SiRNA target sequence
caaatctgccattaatacatctt

SEQ ID NO: 15033 - DNA, 23 bp, Artificial sequence
  SiRNA target sequence
aaatctgccattaatacatcttt

SEQ ID NO: 15034 - DNA, 23 bp, Artificial sequence
  SiRNA target sequence
aatctgccattaatacatctttt

SEQ ID NO: 15035 - DNA, 23 bp, Artificial sequence
  SiRNA target sequence
atctgccattaatacatcttttg

SEQ ID NO: 15036 - DNA, 23 bp, Artificial sequence
  SiRNA target sequence
tctgccattaatacatcttttga

SEQ ID NO: 15037 - DNA, 23 bp, Artificial sequence
  SiRNA target sequence
ctgccattaatacatcttttgat

SEQ ID NO: 15038 - DNA, 23 bp, Artificial sequence
  SiRNA target sequence
tgccattaatacatcttttgata

SEQ ID NO: 15039 - DNA, 23 bp, Artificial sequence
  SiRNA target sequence
gccattaatacatcttttgatac

SEQ ID NO: 15040 - DNA, 23 bp, Artificial sequence
  SiRNA target sequence
ccattaatacatcttttgatact

SEQ ID NO: 15041 - DNA, 23 bp, Artificial sequence
  SiRNA target sequence
cattaatacatcttttgatactt

SEQ ID NO: 15042 - DNA, 23 bp, Artificial sequence
  SiRNA target sequence
attaatacatcttttgatacttt

SEQ ID NO: 15043 - DNA, 23 bp, Artificial sequence
  SiRNA target sequence
ttaatacatcttttgatactttt

SEQ ID NO: 15044 - DNA, 23 bp, Artificial sequence
  SiRNA target sequence
taatacatcttttgatactttta

SEQ ID NO: 15045 - DNA, 23 bp, Artificial sequence
  SiRNA target sequence
aatacatcttttgatacttttaa

SEQ ID NO: 15046 - DNA, 23 bp, Artificial sequence
  SiRNA target sequence
atacatcttttgatacttttaat

SEQ ID NO: 15047 - DNA, 23 bp, Artificial sequence
  SiRNA target sequence
tacatcttttgatacttttaatt

SEQ ID NO: 15048 - DNA, 23 bp, Artificial sequence
  SiRNA target sequence
acatcttttgatacttttaattt

SEQ ID NO: 15049 - DNA, 23 bp, Artificial sequence
  SiRNA target sequence
catcttttgatacttttaattta

SEQ ID NO: 15050 - DNA, 23 bp, Artificial sequence
  SiRNA target sequence
atcttttgatacttttaatttag

SEQ ID NO: 15051 - DNA, 23 bp, Artificial sequence
  SiRNA target sequence
tcttttgatacttttaatttaga

SEQ ID NO: 15052 - DNA, 23 bp, Artificial sequence
  SiRNA target sequence
cttttgatacttttaatttagaa

SEQ ID NO: 15053 - DNA, 23 bp, Artificial sequence
  SiRNA target sequence
ttttgatacttttaatttagaaa

SEQ ID NO: 15054 - DNA, 23 bp, Artificial sequence
  SiRNA target sequence
tttgatacttttaatttagaaaa

SEQ ID NO: 15055 - DNA, 23 bp, Artificial sequence
  SiRNA target sequence
ttgatacttttaatttagaaaat

SEQ ID NO: 15056 - DNA, 23 bp, Artificial sequence
  SiRNA target sequence
tgatacttttaatttagaaaatg

SEQ ID NO: 15057 - DNA, 23 bp, Artificial sequence
  SiRNA target sequence
gatacttttaatttagaaaatgt

SEQ ID NO: 15058 - DNA, 23 bp, Artificial sequence
  SiRNA target sequence
atacttttaatttagaaaatgta

SEQ ID NO: 15059 - DNA, 23 bp, Artificial sequence
  SiRNA target sequence
tacttttaatttagaaaatgtaa

SEQ ID NO: 15060 - DNA, 23 bp, Artificial sequence
  SiRNA target sequence
acttttaatttagaaaatgtaag

SEQ ID NO: 15061 - DNA, 23 bp, Artificial sequence
  SiRNA target sequence
cttttaatttagaaaatgtaagc

SEQ ID NO: 15062 - DNA, 23 bp, Artificial sequence
  SiRNA target sequence
ttttaatttagaaaatgtaagca

SEQ ID NO: 15063 - DNA, 23 bp, Artificial sequence
  SiRNA target sequence
tttaatttagaaaatgtaagcat

SEQ ID NO: 15064 - DNA, 23 bp, Artificial sequence
  SiRNA target sequence
ttaatttagaaaatgtaagcatt

SEQ ID NO: 15065 - DNA, 23 bp, Artificial sequence
  SiRNA target sequence
taatttagaaaatgtaagcatta

SEQ ID NO: 15066 - DNA, 23 bp, Artificial sequence
  SiRNA target sequence
aatttagaaaatgtaagcattac

SEQ ID NO: 15067 - DNA, 23 bp, Artificial sequence
  SiRNA target sequence
atttagaaaatgtaagcattact

SEQ ID NO: 15068 - DNA, 23 bp, Artificial sequence
  SiRNA target sequence
tttagaaaatgtaagcattacta

SEQ ID NO: 15069 - DNA, 23 bp, Artificial sequence
  SiRNA target sequence
ttagaaaatgtaagcattactag

SEQ ID NO: 15070 - DNA, 23 bp, Artificial sequence
  SiRNA target sequence
tagaaaatgtaagcattactagc

SEQ ID NO: 15071 - DNA, 23 bp, Artificial sequence
  SiRNA target sequence
agaaaatgtaagcattactagct

SEQ ID NO: 15072 - DNA, 23 bp, Artificial sequence
  SiRNA target sequence
gaaaatgtaagcattactagctt

SEQ ID NO: 15073 - DNA, 23 bp, Artificial sequence
  SiRNA target sequence
aaaatgtaagcattactagctta

SEQ ID NO: 15074 - DNA, 23 bp, Artificial sequence
  SiRNA target sequence
aaatgtaagcattactagcttaa

SEQ ID NO: 15075 - DNA, 23 bp, Artificial sequence
  SiRNA target sequence
aatgtaagcattactagcttaaa

SEQ ID NO: 15076 - DNA, 23 bp, Artificial sequence
  SiRNA target sequence
atgtaagcattactagcttaaat

SEQ ID NO: 15077 - DNA, 23 bp, Artificial sequence
  SiRNA target sequence
tgtaagcattactagcttaaata

SEQ ID NO: 15078 - DNA, 23 bp, Artificial sequence
  SiRNA target sequence
gtaagcattactagcttaaatac

SEQ ID NO: 15079 - DNA, 23 bp, Artificial sequence
  SiRNA target sequence
taagcattactagcttaaatacg

SEQ ID NO: 15080 - DNA, 23 bp, Artificial sequence
  SiRNA target sequence
aagcattactagcttaaatacgt

SEQ ID NO: 15081 - DNA, 23 bp, Artificial sequence
  SiRNA target sequence
agcattactagcttaaatacgta

SEQ ID NO: 15082 - DNA, 23 bp, Artificial sequence
  SiRNA target sequence
gcattactagcttaaatacgtac

SEQ ID NO: 15083 - DNA, 23 bp, Artificial sequence
  SiRNA target sequence
cattactagcttaaatacgtaca

SEQ ID NO: 15084 - DNA, 23 bp, Artificial sequence
  SiRNA target sequence
attactagcttaaatacgtacac

SEQ ID NO: 15085 - DNA, 23 bp, Artificial sequence
  SiRNA target sequence
ttactagcttaaatacgtacacc

SEQ ID NO: 15086 - DNA, 23 bp, Artificial sequence
  SiRNA target sequence
tactagcttaaatacgtacaccg

SEQ ID NO: 15087 - DNA, 23 bp, Artificial sequence
  SiRNA target sequence
actagcttaaatacgtacaccgg

SEQ ID NO: 15088 - DNA, 23 bp, Artificial sequence
  SiRNA target sequence
ctagcttaaatacgtacaccggt

SEQ ID NO: 15089 - DNA, 23 bp, Artificial sequence
  SiRNA target sequence
tagcttaaatacgtacaccggtg

SEQ ID NO: 15090 - DNA, 23 bp, Artificial sequence
  SiRNA target sequence
agcttaaatacgtacaccggtgt

SEQ ID NO: 15091 - DNA, 23 bp, Artificial sequence
  SiRNA target sequence
gcttaaatacgtacaccggtgtt

SEQ ID NO: 15092 - DNA, 23 bp, Artificial sequence
  SiRNA target sequence
cttaaatacgtacaccggtgtta

SEQ ID NO: 15093 - DNA, 23 bp, Artificial sequence
  SiRNA target sequence
ttaaatacgtacaccggtgttaa

SEQ ID NO: 15094 - DNA, 23 bp, Artificial sequence
  SiRNA target sequence
taaatacgtacaccggtgttaaa

SEQ ID NO: 15095 - DNA, 23 bp, Artificial sequence
  SiRNA target sequence
aaatacgtacaccggtgttaaaa

SEQ ID NO: 15096 - DNA, 23 bp, Artificial sequence
  SiRNA target sequence
aatacgtacaccggtgttaaaac

SEQ ID NO: 15097 - DNA, 23 bp, Artificial sequence
  SiRNA target sequence
atacgtacaccggtgttaaaacc

SEQ ID NO: 15098 - DNA, 23 bp, Artificial sequence
  SiRNA target sequence
tacgtacaccggtgttaaaaccg

SEQ ID NO: 15099 - DNA, 23 bp, Artificial sequence
  SiRNA target sequence
acgtacaccggtgttaaaaccga

SEQ ID NO: 15100 - DNA, 23 bp, Artificial sequence
  SiRNA target sequence
cgtacaccggtgttaaaaccgaa

SEQ ID NO: 15101 - DNA, 23 bp, Artificial sequence
  SiRNA target sequence
gtacaccggtgttaaaaccgaaa

SEQ ID NO: 15102 - DNA, 23 bp, Artificial sequence
  SiRNA target sequence
tacaccggtgttaaaaccgaaat

SEQ ID NO: 15103 - DNA, 23 bp, Artificial sequence
  SiRNA target sequence
acaccggtgttaaaaccgaaata

SEQ ID NO: 15104 - DNA, 23 bp, Artificial sequence
  SiRNA target sequence
caccggtgttaaaaccgaaatat

SEQ ID NO: 15105 - DNA, 23 bp, Artificial sequence
  SiRNA target sequence
accggtgttaaaaccgaaatatc

SEQ ID NO: 15106 - DNA, 23 bp, Artificial sequence
  SiRNA target sequence
ccggtgttaaaaccgaaatatca

SEQ ID NO: 15107 - DNA, 23 bp, Artificial sequence
  SiRNA target sequence
cggtgttaaaaccgaaatatcaa

SEQ ID NO: 15108 - DNA, 23 bp, Artificial sequence
  SiRNA target sequence
ggtgttaaaaccgaaatatcaaa

SEQ ID NO: 15109 - DNA, 23 bp, Artificial sequence
  SiRNA target sequence
gtgttaaaaccgaaatatcaaaa

SEQ ID NO: 15110 - DNA, 23 bp, Artificial sequence
  SiRNA target sequence
tgttaaaaccgaaatatcaaaaa

SEQ ID NO: 15111 - DNA, 23 bp, Artificial sequence
  SiRNA target sequence
gttaaaaccgaaatatcaaaaac

SEQ ID NO: 15112 - DNA, 23 bp, Artificial sequence
  SiRNA target sequence
ttaaaaccgaaatatcaaaaacc

SEQ ID NO: 15113 - DNA, 23 bp, Artificial sequence
  SiRNA target sequence
taaaaccgaaatatcaaaaaccg

SEQ ID NO: 15114 - DNA, 23 bp, Artificial sequence
  SiRNA target sequence
aaaaccgaaatatcaaaaaccgt

SEQ ID NO: 15115 - DNA, 23 bp, Artificial sequence
  SiRNA target sequence
aaaccgaaatatcaaaaaccgta

SEQ ID NO: 15116 - DNA, 23 bp, Artificial sequence
  SiRNA target sequence
aaccgaaatatcaaaaaccgtat

SEQ ID NO: 15117 - DNA, 23 bp, Artificial sequence
  SiRNA target sequence
accgaaatatcaaaaaccgtatc

SEQ ID NO: 15118 - DNA, 23 bp, Artificial sequence
  SiRNA target sequence
ccgaaatatcaaaaaccgtatca

SEQ ID NO: 15119 - DNA, 23 bp, Artificial sequence
  SiRNA target sequence
cgaaatatcaaaaaccgtatcac

SEQ ID NO: 15120 - DNA, 23 bp, Artificial sequence
  SiRNA target sequence
gaaatatcaaaaaccgtatcacc

SEQ ID NO: 15121 - DNA, 23 bp, Artificial sequence
  SiRNA target sequence
aaatatcaaaaaccgtatcacca

SEQ ID NO: 15122 - DNA, 23 bp, Artificial sequence
  SiRNA target sequence
aatatcaaaaaccgtatcaccac

SEQ ID NO: 15123 - DNA, 23 bp, Artificial sequence
  SiRNA target sequence
atatcaaaaaccgtatcaccaca

SEQ ID NO: 15124 - DNA, 23 bp, Artificial sequence
  SiRNA target sequence
tatcaaaaaccgtatcaccacac

SEQ ID NO: 15125 - DNA, 23 bp, Artificial sequence
  SiRNA target sequence
atcaaaaaccgtatcaccacact

SEQ ID NO: 15126 - DNA, 23 bp, Artificial sequence
  SiRNA target sequence
tcaaaaaccgtatcaccacactt

SEQ ID NO: 15127 - DNA, 23 bp, Artificial sequence
  SiRNA target sequence
caaaaaccgtatcaccacacttc

SEQ ID NO: 15128 - DNA, 23 bp, Artificial sequence
  SiRNA target sequence
aaaaaccgtatcaccacacttcc

SEQ ID NO: 15129 - DNA, 23 bp, Artificial sequence
  SiRNA target sequence
aaaaccgtatcaccacacttcca

SEQ ID NO: 15130 - DNA, 23 bp, Artificial sequence
  SiRNA target sequence
aaaccgtatcaccacacttccag

SEQ ID NO: 15131 - DNA, 23 bp, Artificial sequence
  SiRNA target sequence
aaccgtatcaccacacttccaga

SEQ ID NO: 15132 - DNA, 23 bp, Artificial sequence
  SiRNA target sequence
accgtatcaccacacttccagat

SEQ ID NO: 15133 - DNA, 23 bp, Artificial sequence
  SiRNA target sequence
ccgtatcaccacacttccagatt

SEQ ID NO: 15134 - DNA, 23 bp, Artificial sequence
  SiRNA target sequence
cgtatcaccacacttccagattt

SEQ ID NO: 15135 - DNA, 23 bp, Artificial sequence
  SiRNA target sequence
gtatcaccacacttccagatttc

SEQ ID NO: 15136 - DNA, 23 bp, Artificial sequence
  SiRNA target sequence
tatcaccacacttccagatttct

SEQ ID NO: 15137 - DNA, 23 bp, Artificial sequence
  SiRNA target sequence
atcaccacacttccagatttctc

SEQ ID NO: 15138 - DNA, 23 bp, Artificial sequence
  SiRNA target sequence
tcaccacacttccagatttctca

SEQ ID NO: 15139 - DNA, 23 bp, Artificial sequence
  SiRNA target sequence
caccacacttccagatttctcat

SEQ ID NO: 15140 - DNA, 23 bp, Artificial sequence
  SiRNA target sequence
accacacttccagatttctcatg

SEQ ID NO: 15141 - DNA, 23 bp, Artificial sequence
  SiRNA target sequence
ccacacttccagatttctcatgt

SEQ ID NO: 15142 - DNA, 23 bp, Artificial sequence
  SiRNA target sequence
cacacttccagatttctcatgtc

SEQ ID NO: 15143 - DNA, 23 bp, Artificial sequence
  SiRNA target sequence
acacttccagatttctcatgtct

SEQ ID NO: 15144 - DNA, 23 bp, Artificial sequence
  SiRNA target sequence
cacttccagatttctcatgtctc

SEQ ID NO: 15145 - DNA, 23 bp, Artificial sequence
  SiRNA target sequence
acttccagatttctcatgtctct

SEQ ID NO: 15146 - DNA, 23 bp, Artificial sequence
  SiRNA target sequence
cttccagatttctcatgtctctt

SEQ ID NO: 15147 - DNA, 23 bp, Artificial sequence
  SiRNA target sequence
ttccagatttctcatgtctcttc

SEQ ID NO: 15148 - DNA, 23 bp, Artificial sequence
  SiRNA target sequence
tccagatttctcatgtctcttct

SEQ ID NO: 15149 - DNA, 23 bp, Artificial sequence
  SiRNA target sequence
ccagatttctcatgtctcttcta

SEQ ID NO: 15150 - DNA, 23 bp, Artificial sequence
  SiRNA target sequence
cagatttctcatgtctcttctat

SEQ ID NO: 15151 - DNA, 23 bp, Artificial sequence
  SiRNA target sequence
agatttctcatgtctcttctatg

SEQ ID NO: 15152 - DNA, 23 bp, Artificial sequence
  SiRNA target sequence
gatttctcatgtctcttctatgg

SEQ ID NO: 15153 - DNA, 23 bp, Artificial sequence
  SiRNA target sequence
atttctcatgtctcttctatggg

SEQ ID NO: 15154 - DNA, 23 bp, Artificial sequence
  SiRNA target sequence
tttctcatgtctcttctatgggc

SEQ ID NO: 15155 - DNA, 23 bp, Artificial sequence
  SiRNA target sequence
ttctcatgtctcttctatgggcg

SEQ ID NO: 15156 - DNA, 23 bp, Artificial sequence
  SiRNA target sequence
tctcatgtctcttctatgggcgc

SEQ ID NO: 15157 - DNA, 23 bp, Artificial sequence
  SiRNA target sequence
ctcatgtctcttctatgggcgca

SEQ ID NO: 15158 - DNA, 23 bp, Artificial sequence
  SiRNA target sequence
tcatgtctcttctatgggcgcag

SEQ ID NO: 15159 - DNA, 23 bp, Artificial sequence
  SiRNA target sequence
catgtctcttctatgggcgcaga

SEQ ID NO: 15160 - DNA, 23 bp, Artificial sequence
  SiRNA target sequence
atgtctcttctatgggcgcagat

SEQ ID NO: 15161 - DNA, 23 bp, Artificial sequence
  SiRNA target sequence
tgtctcttctatgggcgcagatt

SEQ ID NO: 15162 - DNA, 23 bp, Artificial sequence
  SiRNA target sequence
gtctcttctatgggcgcagattt

SEQ ID NO: 15163 - DNA, 23 bp, Artificial sequence
  SiRNA target sequence
tctcttctatgggcgcagatttc

SEQ ID NO: 15164 - DNA, 23 bp, Artificial sequence
  SiRNA target sequence
ctcttctatgggcgcagatttcg

SEQ ID NO: 15165 - DNA, 23 bp, Artificial sequence
  SiRNA target sequence
tcttctatgggcgcagatttcga

SEQ ID NO: 15166 - DNA, 23 bp, Artificial sequence
  SiRNA target sequence
cttctatgggcgcagatttcgac

SEQ ID NO: 15167 - DNA, 23 bp, Artificial sequence
  SiRNA target sequence
ttctatgggcgcagatttcgaca

SEQ ID NO: 15168 - DNA, 23 bp, Artificial sequence
  SiRNA target sequence
tctatgggcgcagatttcgacat

SEQ ID NO: 15169 - DNA, 23 bp, Artificial sequence
  SiRNA target sequence
ctatgggcgcagatttcgacata

SEQ ID NO: 15170 - DNA, 23 bp, Artificial sequence
  SiRNA target sequence
tatgggcgcagatttcgacataa

SEQ ID NO: 15171 - DNA, 23 bp, Artificial sequence
  SiRNA target sequence
atgggcgcagatttcgacataaa

SEQ ID NO: 15172 - DNA, 23 bp, Artificial sequence
  SiRNA target sequence
tgggcgcagatttcgacataaaa

SEQ ID NO: 15173 - DNA, 23 bp, Artificial sequence
  SiRNA target sequence
gggcgcagatttcgacataaaac

SEQ ID NO: 15174 - DNA, 23 bp, Artificial sequence
  SiRNA target sequence
ggcgcagatttcgacataaaaca

SEQ ID NO: 15175 - DNA, 23 bp, Artificial sequence
  SiRNA target sequence
gcgcagatttcgacataaaacag

SEQ ID NO: 15176 - DNA, 23 bp, Artificial sequence
  SiRNA target sequence
cgcagatttcgacataaaacaga

SEQ ID NO: 15177 - DNA, 23 bp, Artificial sequence
  SiRNA target sequence
gcagatttcgacataaaacagac

SEQ ID NO: 15178 - DNA, 23 bp, Artificial sequence
  SiRNA target sequence
cagatttcgacataaaacagaca

SEQ ID NO: 15179 - DNA, 23 bp, Artificial sequence
  SiRNA target sequence
agatttcgacataaaacagacat

SEQ ID NO: 15180 - DNA, 23 bp, Artificial sequence
  SiRNA target sequence
gatttcgacataaaacagacata

SEQ ID NO: 15181 - DNA, 23 bp, Artificial sequence
  SiRNA target sequence
atttcgacataaaacagacatac

SEQ ID NO: 15182 - DNA, 23 bp, Artificial sequence
  SiRNA target sequence
tttcgacataaaacagacatacg

SEQ ID NO: 15183 - DNA, 23 bp, Artificial sequence
  SiRNA target sequence
ttcgacataaaacagacatacgc

SEQ ID NO: 15184 - DNA, 23 bp, Artificial sequence
  SiRNA target sequence
tcgacataaaacagacatacgcc

SEQ ID NO: 15185 - DNA, 23 bp, Artificial sequence
  SiRNA target sequence
cgacataaaacagacatacgcca

SEQ ID NO: 15186 - DNA, 23 bp, Artificial sequence
  SiRNA target sequence
gacataaaacagacatacgccac

SEQ ID NO: 15187 - DNA, 23 bp, Artificial sequence
  SiRNA target sequence
acataaaacagacatacgccacg

SEQ ID NO: 15188 - DNA, 23 bp, Artificial sequence
  SiRNA target sequence
cataaaacagacatacgccacgt

SEQ ID NO: 15189 - DNA, 23 bp, Artificial sequence
  SiRNA target sequence
ataaaacagacatacgccacgtt

SEQ ID NO: 15190 - DNA, 23 bp, Artificial sequence
  SiRNA target sequence
taaaacagacatacgccacgttc

SEQ ID NO: 15191 - DNA, 23 bp, Artificial sequence
  SiRNA target sequence
aaaacagacatacgccacgttct

SEQ ID NO: 15192 - DNA, 23 bp, Artificial sequence
  SiRNA target sequence
aaacagacatacgccacgttctg

SEQ ID NO: 15193 - DNA, 23 bp, Artificial sequence
  SiRNA target sequence
aacagacatacgccacgttctgc

SEQ ID NO: 15194 - DNA, 23 bp, Artificial sequence
  SiRNA target sequence
acagacatacgccacgttctgct

SEQ ID NO: 15195 - DNA, 23 bp, Artificial sequence
  SiRNA target sequence
cagacatacgccacgttctgctt

SEQ ID NO: 15196 - DNA, 23 bp, Artificial sequence
  SiRNA target sequence
agacatacgccacgttctgcttt

SEQ ID NO: 15197 - DNA, 23 bp, Artificial sequence
  SiRNA target sequence
gacatacgccacgttctgcttta

SEQ ID NO: 15198 - DNA, 23 bp, Artificial sequence
  SiRNA target sequence
acatacgccacgttctgctttaa

SEQ ID NO: 15199 - DNA, 23 bp, Artificial sequence
  SiRNA target sequence
catacgccacgttctgctttaac

SEQ ID NO: 15200 - DNA, 23 bp, Artificial sequence
  SiRNA target sequence
atacgccacgttctgctttaaca

SEQ ID NO: 15201 - DNA, 23 bp, Artificial sequence
  SiRNA target sequence
tacgccacgttctgctttaacaa

SEQ ID NO: 15202 - DNA, 23 bp, Artificial sequence
  SiRNA target sequence
acgccacgttctgctttaacaat

SEQ ID NO: 15203 - DNA, 23 bp, Artificial sequence
  SiRNA target sequence
cgccacgttctgctttaacaatc

SEQ ID NO: 15204 - DNA, 23 bp, Artificial sequence
  SiRNA target sequence
gccacgttctgctttaacaatct

SEQ ID NO: 15205 - DNA, 23 bp, Artificial sequence
  SiRNA target sequence
ccacgttctgctttaacaatctt

SEQ ID NO: 15206 - DNA, 23 bp, Artificial sequence
  SiRNA target sequence
cacgttctgctttaacaatcttt

SEQ ID NO: 15207 - DNA, 23 bp, Artificial sequence
  SiRNA target sequence
acgttctgctttaacaatctttt

SEQ ID NO: 15208 - DNA, 23 bp, Artificial sequence
  SiRNA target sequence
cgttctgctttaacaatcttttg

SEQ ID NO: 15209 - DNA, 23 bp, Artificial sequence
  SiRNA target sequence
gttctgctttaacaatcttttgc

SEQ ID NO: 15210 - DNA, 23 bp, Artificial sequence
  SiRNA target sequence
ttctgctttaacaatcttttgct

SEQ ID NO: 15211 - DNA, 23 bp, Artificial sequence
  SiRNA target sequence
tctgctttaacaatcttttgcta

SEQ ID NO: 15212 - DNA, 23 bp, Artificial sequence
  SiRNA target sequence
ctgctttaacaatcttttgctac

SEQ ID NO: 15213 - DNA, 23 bp, Artificial sequence
  SiRNA target sequence
tgctttaacaatcttttgctaca

SEQ ID NO: 15214 - DNA, 23 bp, Artificial sequence
  SiRNA target sequence
gctttaacaatcttttgctacaa

SEQ ID NO: 15215 - DNA, 23 bp, Artificial sequence
  SiRNA target sequence
ctttaacaatcttttgctacaaa

SEQ ID NO: 15216 - DNA, 23 bp, Artificial sequence
  SiRNA target sequence
tttaacaatcttttgctacaaac

SEQ ID NO: 15217 - DNA, 23 bp, Artificial sequence
  SiRNA target sequence
ttaacaatcttttgctacaaacg

SEQ ID NO: 15218 - DNA, 23 bp, Artificial sequence
  SiRNA target sequence
taacaatcttttgctacaaacga

SEQ ID NO: 15219 - DNA, 23 bp, Artificial sequence
  SiRNA target sequence
aacaatcttttgctacaaacgag

SEQ ID NO: 15220 - DNA, 23 bp, Artificial sequence
  SiRNA target sequence
acaatcttttgctacaaacgagc

SEQ ID NO: 15221 - DNA, 23 bp, Artificial sequence
  SiRNA target sequence
caatcttttgctacaaacgagca

SEQ ID NO: 15222 - DNA, 23 bp, Artificial sequence
  SiRNA target sequence
aatcttttgctacaaacgagcat

SEQ ID NO: 15223 - DNA, 23 bp, Artificial sequence
  SiRNA target sequence
atcttttgctacaaacgagcata

SEQ ID NO: 15224 - DNA, 23 bp, Artificial sequence
  SiRNA target sequence
tcttttgctacaaacgagcatag

SEQ ID NO: 15225 - DNA, 23 bp, Artificial sequence
  SiRNA target sequence
cttttgctacaaacgagcataga

SEQ ID NO: 15226 - DNA, 23 bp, Artificial sequence
  SiRNA target sequence
ttttgctacaaacgagcatagac

SEQ ID NO: 15227 - DNA, 23 bp, Artificial sequence
  SiRNA target sequence
tttgctacaaacgagcatagacc

SEQ ID NO: 15228 - DNA, 23 bp, Artificial sequence
  SiRNA target sequence
ttgctacaaacgagcatagacca

SEQ ID NO: 15229 - DNA, 23 bp, Artificial sequence
  SiRNA target sequence
tgctacaaacgagcatagaccaa

SEQ ID NO: 15230 - DNA, 23 bp, Artificial sequence
  SiRNA target sequence
gctacaaacgagcatagaccaag

SEQ ID NO: 15231 - DNA, 23 bp, Artificial sequence
  SiRNA target sequence
ctacaaacgagcatagaccaaga

SEQ ID NO: 15232 - DNA, 23 bp, Artificial sequence
  SiRNA target sequence
tacaaacgagcatagaccaagac

SEQ ID NO: 15233 - DNA, 23 bp, Artificial sequence
  SiRNA target sequence
acaaacgagcatagaccaagaca

SEQ ID NO: 15234 - DNA, 23 bp, Artificial sequence
  SiRNA target sequence
caaacgagcatagaccaagacaa

SEQ ID NO: 15235 - DNA, 23 bp, Artificial sequence
  SiRNA target sequence
aaacgagcatagaccaagacaaa

SEQ ID NO: 15236 - DNA, 23 bp, Artificial sequence
  SiRNA target sequence
aacgagcatagaccaagacaaaa

SEQ ID NO: 15237 - DNA, 23 bp, Artificial sequence
  SiRNA target sequence
acgagcatagaccaagacaaaat

SEQ ID NO: 15238 - DNA, 23 bp, Artificial sequence
  SiRNA target sequence
cgagcatagaccaagacaaaata

SEQ ID NO: 15239 - DNA, 23 bp, Artificial sequence
  SiRNA target sequence
gagcatagaccaagacaaaatat

SEQ ID NO: 15240 - DNA, 23 bp, Artificial sequence
  SiRNA target sequence
agcatagaccaagacaaaatatt

SEQ ID NO: 15241 - DNA, 23 bp, Artificial sequence
  SiRNA target sequence
gcatagaccaagacaaaatattt

SEQ ID NO: 15242 - DNA, 23 bp, Artificial sequence
  SiRNA target sequence
catagaccaagacaaaatattta

SEQ ID NO: 15243 - DNA, 23 bp, Artificial sequence
  SiRNA target sequence
atagaccaagacaaaatatttag

SEQ ID NO: 15244 - DNA, 23 bp, Artificial sequence
  SiRNA target sequence
tagaccaagacaaaatatttaga

SEQ ID NO: 15245 - DNA, 23 bp, Artificial sequence
  SiRNA target sequence
agaccaagacaaaatatttagaa

SEQ ID NO: 15246 - DNA, 23 bp, Artificial sequence
  SiRNA target sequence
gaccaagacaaaatatttagaat

SEQ ID NO: 15247 - DNA, 23 bp, Artificial sequence
  SiRNA target sequence
accaagacaaaatatttagaata

SEQ ID NO: 15248 - DNA, 23 bp, Artificial sequence
  SiRNA target sequence
ccaagacaaaatatttagaataa

SEQ ID NO: 15249 - DNA, 23 bp, Artificial sequence
  SiRNA target sequence
caagacaaaatatttagaataag

SEQ ID NO: 15250 - DNA, 23 bp, Artificial sequence
  SiRNA target sequence
aagacaaaatatttagaataaga

SEQ ID NO: 15251 - DNA, 23 bp, Artificial sequence
  SiRNA target sequence
agacaaaatatttagaataagag

SEQ ID NO: 15252 - DNA, 23 bp, Artificial sequence
  SiRNA target sequence
gacaaaatatttagaataagagg

SEQ ID NO: 15253 - DNA, 23 bp, Artificial sequence
  SiRNA target sequence
acaaaatatttagaataagaggt

SEQ ID NO: 15254 - DNA, 23 bp, Artificial sequence
  SiRNA target sequence
caaaatatttagaataagaggta

SEQ ID NO: 15255 - DNA, 23 bp, Artificial sequence
  SiRNA target sequence
aaaatatttagaataagaggtac

SEQ ID NO: 15256 - DNA, 23 bp, Artificial sequence
  SiRNA target sequence
aaatatttagaataagaggtacc

SEQ ID NO: 15257 - DNA, 23 bp, Artificial sequence
  SiRNA target sequence
aatatttagaataagaggtaccc

SEQ ID NO: 15258 - DNA, 23 bp, Artificial sequence
  SiRNA target sequence
atatttagaataagaggtaccca

SEQ ID NO: 15259 - DNA, 23 bp, Artificial sequence
  SiRNA target sequence
tatttagaataagaggtacccac

SEQ ID NO: 15260 - DNA, 23 bp, Artificial sequence
  SiRNA target sequence
atttagaataagaggtacccaca

SEQ ID NO: 15261 - DNA, 23 bp, Artificial sequence
  SiRNA target sequence
tttagaataagaggtacccacat

SEQ ID NO: 15262 - DNA, 23 bp, Artificial sequence
  SiRNA target sequence
ttagaataagaggtacccacatg

SEQ ID NO: 15263 - DNA, 23 bp, Artificial sequence
  SiRNA target sequence
tagaataagaggtacccacatgt

SEQ ID NO: 15264 - DNA, 23 bp, Artificial sequence
  SiRNA target sequence
agaataagaggtacccacatgtt

SEQ ID NO: 15265 - DNA, 23 bp, Artificial sequence
  SiRNA target sequence
gaataagaggtacccacatgttt

SEQ ID NO: 15266 - DNA, 23 bp, Artificial sequence
  SiRNA target sequence
aataagaggtacccacatgttta

SEQ ID NO: 15267 - DNA, 23 bp, Artificial sequence
  SiRNA target sequence
ataagaggtacccacatgtttaa

SEQ ID NO: 15268 - DNA, 23 bp, Artificial sequence
  SiRNA target sequence
taagaggtacccacatgtttaaa

SEQ ID NO: 15269 - DNA, 23 bp, Artificial sequence
  SiRNA target sequence
aagaggtacccacatgtttaaaa

SEQ ID NO: 15270 - DNA, 23 bp, Artificial sequence
  SiRNA target sequence
agaggtacccacatgtttaaaaa

SEQ ID NO: 15271 - DNA, 23 bp, Artificial sequence
  SiRNA target sequence
gaggtacccacatgtttaaaaat

SEQ ID NO: 15272 - DNA, 23 bp, Artificial sequence
  SiRNA target sequence
aggtacccacatgtttaaaaatc

SEQ ID NO: 15273 - DNA, 23 bp, Artificial sequence
  SiRNA target sequence
ggtacccacatgtttaaaaatct

SEQ ID NO: 15274 - DNA, 23 bp, Artificial sequence
  SiRNA target sequence
gtacccacatgtttaaaaatcta

SEQ ID NO: 15275 - DNA, 23 bp, Artificial sequence
  SiRNA target sequence
tacccacatgtttaaaaatctac

SEQ ID NO: 15276 - DNA, 23 bp, Artificial sequence
  SiRNA target sequence
acccacatgtttaaaaatctact

SEQ ID NO: 15277 - DNA, 23 bp, Artificial sequence
  SiRNA target sequence
cccacatgtttaaaaatctactt

SEQ ID NO: 15278 - DNA, 23 bp, Artificial sequence
  SiRNA target sequence
ccacatgtttaaaaatctactta

SEQ ID NO: 15279 - DNA, 23 bp, Artificial sequence
  SiRNA target sequence
cacatgtttaaaaatctacttac

SEQ ID NO: 15280 - DNA, 23 bp, Artificial sequence
  SiRNA target sequence
acatgtttaaaaatctacttact

SEQ ID NO: 15281 - DNA, 23 bp, Artificial sequence
  SiRNA target sequence
catgtttaaaaatctacttacta

SEQ ID NO: 15282 - DNA, 23 bp, Artificial sequence
  SiRNA target sequence
atgtttaaaaatctacttactaa

SEQ ID NO: 15283 - DNA, 23 bp, Artificial sequence
  SiRNA target sequence
tgtttaaaaatctacttactaaa

SEQ ID NO: 15284 - DNA, 23 bp, Artificial sequence
  SiRNA target sequence
gtttaaaaatctacttactaaat

SEQ ID NO: 15285 - DNA, 23 bp, Artificial sequence
  SiRNA target sequence
tttaaaaatctacttactaaatt

SEQ ID NO: 15286 - DNA, 23 bp, Artificial sequence
  SiRNA target sequence
ttaaaaatctacttactaaattc

SEQ ID NO: 15287 - DNA, 23 bp, Artificial sequence
  SiRNA target sequence
taaaaatctacttactaaattcc

SEQ ID NO: 15288 - DNA, 23 bp, Artificial sequence
  SiRNA target sequence
aaaaatctacttactaaattcca

SEQ ID NO: 15289 - DNA, 23 bp, Artificial sequence
  SiRNA target sequence
aaaatctacttactaaattccat

SEQ ID NO: 15290 - DNA, 23 bp, Artificial sequence
  SiRNA target sequence
aaatctacttactaaattccata

SEQ ID NO: 15291 - DNA, 23 bp, Artificial sequence
  SiRNA target sequence
aatctacttactaaattccatac

SEQ ID NO: 15292 - DNA, 23 bp, Artificial sequence
  SiRNA target sequence
atctacttactaaattccataca

SEQ ID NO: 15293 - DNA, 23 bp, Artificial sequence
  SiRNA target sequence
tctacttactaaattccatacag

SEQ ID NO: 15294 - DNA, 23 bp, Artificial sequence
  SiRNA target sequence
ctacttactaaattccatacagt

SEQ ID NO: 15295 - DNA, 23 bp, Artificial sequence
  SiRNA target sequence
tacttactaaattccatacagta

SEQ ID NO: 15296 - DNA, 23 bp, Artificial sequence
  SiRNA target sequence
acttactaaattccatacagtaa

SEQ ID NO: 15297 - DNA, 23 bp, Artificial sequence
  SiRNA target sequence
cttactaaattccatacagtaat

SEQ ID NO: 15298 - DNA, 23 bp, Artificial sequence
  SiRNA target sequence
ttactaaattccatacagtaatt

SEQ ID NO: 15299 - DNA, 23 bp, Artificial sequence
  SiRNA target sequence
tactaaattccatacagtaattg

SEQ ID NO: 15300 - DNA, 23 bp, Artificial sequence
  SiRNA target sequence
actaaattccatacagtaattgg

SEQ ID NO: 15301 - DNA, 23 bp, Artificial sequence
  SiRNA target sequence
ctaaattccatacagtaattggt

SEQ ID NO: 15302 - DNA, 23 bp, Artificial sequence
  SiRNA target sequence
taaattccatacagtaattggta

SEQ ID NO: 15303 - DNA, 23 bp, Artificial sequence
  SiRNA target sequence
aaattccatacagtaattggtag

SEQ ID NO: 15304 - DNA, 23 bp, Artificial sequence
  SiRNA target sequence
aattccatacagtaattggtaga

SEQ ID NO: 15305 - DNA, 23 bp, Artificial sequence
  SiRNA target sequence
attccatacagtaattggtagaa

SEQ ID NO: 15306 - DNA, 23 bp, Artificial sequence
  SiRNA target sequence
ttccatacagtaattggtagaag

SEQ ID NO: 15307 - DNA, 23 bp, Artificial sequence
  SiRNA target sequence
tccatacagtaattggtagaagt

SEQ ID NO: 15308 - DNA, 23 bp, Artificial sequence
  SiRNA target sequence
ccatacagtaattggtagaagta

SEQ ID NO: 15309 - DNA, 23 bp, Artificial sequence
  SiRNA target sequence
catacagtaattggtagaagtaa

SEQ ID NO: 15310 - DNA, 23 bp, Artificial sequence
  SiRNA target sequence
atacagtaattggtagaagtaaa

SEQ ID NO: 15311 - DNA, 23 bp, Artificial sequence
  SiRNA target sequence
tacagtaattggtagaagtaaag

SEQ ID NO: 15312 - DNA, 23 bp, Artificial sequence
  SiRNA target sequence
acagtaattggtagaagtaaaga

SEQ ID NO: 15313 - DNA, 23 bp, Artificial sequence
  SiRNA target sequence
cagtaattggtagaagtaaagat

SEQ ID NO: 15314 - DNA, 23 bp, Artificial sequence
  SiRNA target sequence
agtaattggtagaagtaaagata

SEQ ID NO: 15315 - DNA, 23 bp, Artificial sequence
  SiRNA target sequence
gtaattggtagaagtaaagatat

SEQ ID NO: 15316 - DNA, 23 bp, Artificial sequence
  SiRNA target sequence
taattggtagaagtaaagatatc

SEQ ID NO: 15317 - DNA, 23 bp, Artificial sequence
  SiRNA target sequence
aattggtagaagtaaagatatct

SEQ ID NO: 15318 - DNA, 23 bp, Artificial sequence
  SiRNA target sequence
attggtagaagtaaagatatctt

SEQ ID NO: 15319 - DNA, 23 bp, Artificial sequence
  SiRNA target sequence
ttggtagaagtaaagatatcttt

SEQ ID NO: 15320 - DNA, 23 bp, Artificial sequence
  SiRNA target sequence
tggtagaagtaaagatatcttta

SEQ ID NO: 15321 - DNA, 23 bp, Artificial sequence
  SiRNA target sequence
ggtagaagtaaagatatctttac

SEQ ID NO: 15322 - DNA, 23 bp, Artificial sequence
  SiRNA target sequence
gtagaagtaaagatatctttaca

SEQ ID NO: 15323 - DNA, 23 bp, Artificial sequence
  SiRNA target sequence
tagaagtaaagatatctttacac

SEQ ID NO: 15324 - DNA, 23 bp, Artificial sequence
  SiRNA target sequence
agaagtaaagatatctttacaca

SEQ ID NO: 15325 - DNA, 23 bp, Artificial sequence
  SiRNA target sequence
gaagtaaagatatctttacacaa

SEQ ID NO: 15326 - DNA, 23 bp, Artificial sequence
  SiRNA target sequence
aagtaaagatatctttacacaaa

SEQ ID NO: 15327 - DNA, 23 bp, Artificial sequence
  SiRNA target sequence
agtaaagatatctttacacaaat

SEQ ID NO: 15328 - DNA, 23 bp, Artificial sequence
  SiRNA target sequence
gtaaagatatctttacacaaata

SEQ ID NO: 15329 - DNA, 23 bp, Artificial sequence
  SiRNA target sequence
taaagatatctttacacaaatag

SEQ ID NO: 15330 - DNA, 23 bp, Artificial sequence
  SiRNA target sequence
aaagatatctttacacaaataga

SEQ ID NO: 15331 - DNA, 23 bp, Artificial sequence
  SiRNA target sequence
aagatatctttacacaaatagag

SEQ ID NO: 15332 - DNA, 23 bp, Artificial sequence
  SiRNA target sequence
agatatctttacacaaatagagg

SEQ ID NO: 15333 - DNA, 23 bp, Artificial sequence
  SiRNA target sequence
gatatctttacacaaatagaggt

SEQ ID NO: 15334 - DNA, 23 bp, Artificial sequence
  SiRNA target sequence
atatctttacacaaatagaggta

SEQ ID NO: 15335 - DNA, 23 bp, Artificial sequence
  SiRNA target sequence
tatctttacacaaatagaggtag

SEQ ID NO: 15336 - DNA, 23 bp, Artificial sequence
  SiRNA target sequence
atctttacacaaatagaggtaga

SEQ ID NO: 15337 - DNA, 23 bp, Artificial sequence
  SiRNA target sequence
tctttacacaaatagaggtagac

SEQ ID NO: 15338 - DNA, 23 bp, Artificial sequence
  SiRNA target sequence
ctttacacaaatagaggtagaca

SEQ ID NO: 15339 - DNA, 23 bp, Artificial sequence
  SiRNA target sequence
tttacacaaatagaggtagacat

SEQ ID NO: 15340 - DNA, 23 bp, Artificial sequence
  SiRNA target sequence
ttacacaaatagaggtagacata

SEQ ID NO: 15341 - DNA, 23 bp, Artificial sequence
  SiRNA target sequence
tacacaaatagaggtagacataa

SEQ ID NO: 15342 - DNA, 23 bp, Artificial sequence
  SiRNA target sequence
acacaaatagaggtagacataaa

SEQ ID NO: 15343 - DNA, 23 bp, Artificial sequence
  SiRNA target sequence
cacaaatagaggtagacataaaa

SEQ ID NO: 15344 - DNA, 23 bp, Artificial sequence
  SiRNA target sequence
acaaatagaggtagacataaaaa

SEQ ID NO: 15345 - DNA, 23 bp, Artificial sequence
  SiRNA target sequence
caaatagaggtagacataaaaaa

SEQ ID NO: 15346 - DNA, 23 bp, Artificial sequence
  SiRNA target sequence
aaatagaggtagacataaaaaat

SEQ ID NO: 15347 - DNA, 23 bp, Artificial sequence
  SiRNA target sequence
aatagaggtagacataaaaaata

SEQ ID NO: 15348 - DNA, 23 bp, Artificial sequence
  SiRNA target sequence
atagaggtagacataaaaaataa

SEQ ID NO: 15349 - DNA, 23 bp, Artificial sequence
  SiRNA target sequence
tagaggtagacataaaaaataaa

SEQ ID NO: 15350 - DNA, 23 bp, Artificial sequence
  SiRNA target sequence
agaggtagacataaaaaataaat

SEQ ID NO: 15351 - DNA, 23 bp, Artificial sequence
  SiRNA target sequence
gaggtagacataaaaaataaata

SEQ ID NO: 15352 - DNA, 23 bp, Artificial sequence
  SiRNA target sequence
aggtagacataaaaaataaatac

SEQ ID NO: 15353 - DNA, 23 bp, Artificial sequence
  SiRNA target sequence
ggtagacataaaaaataaataca

SEQ ID NO: 15354 - DNA, 23 bp, Artificial sequence
  SiRNA target sequence
gtagacataaaaaataaatacaa

SEQ ID NO: 15355 - DNA, 23 bp, Artificial sequence
  SiRNA target sequence
tagacataaaaaataaatacaat

SEQ ID NO: 15356 - DNA, 23 bp, Artificial sequence
  SiRNA target sequence
agacataaaaaataaatacaata

SEQ ID NO: 15357 - DNA, 23 bp, Artificial sequence
  SiRNA target sequence
gacataaaaaataaatacaataa

SEQ ID NO: 15358 - DNA, 23 bp, Artificial sequence
  SiRNA target sequence
acataaaaaataaatacaataat

SEQ ID NO: 15359 - DNA, 23 bp, Artificial sequence
  SiRNA target sequence
cataaaaaataaatacaataata

SEQ ID NO: 15360 - DNA, 23 bp, Artificial sequence
  SiRNA target sequence
ataaaaaataaatacaataatat

SEQ ID NO: 15361 - DNA, 23 bp, Artificial sequence
  SiRNA target sequence
taaaaaataaatacaataatatg

SEQ ID NO: 15362 - DNA, 23 bp, Artificial sequence
  SiRNA target sequence
aaaaaataaatacaataatatgt

SEQ ID NO: 15363 - DNA, 23 bp, Artificial sequence
  SiRNA target sequence
aaaaataaatacaataatatgtg

SEQ ID NO: 15364 - DNA, 23 bp, Artificial sequence
  SiRNA target sequence
aaaataaatacaataatatgtgt

SEQ ID NO: 15365 - DNA, 23 bp, Artificial sequence
  SiRNA target sequence
aaataaatacaataatatgtgta

SEQ ID NO: 15366 - DNA, 23 bp, Artificial sequence
  SiRNA target sequence
aataaatacaataatatgtgtat

SEQ ID NO: 15367 - DNA, 23 bp, Artificial sequence
  SiRNA target sequence
ataaatacaataatatgtgtata

SEQ ID NO: 15368 - DNA, 23 bp, Artificial sequence
  SiRNA target sequence
taaatacaataatatgtgtataa

SEQ ID NO: 15369 - DNA, 23 bp, Artificial sequence
  SiRNA target sequence
aaatacaataatatgtgtataaa

SEQ ID NO: 15370 - DNA, 23 bp, Artificial sequence
  SiRNA target sequence
aatacaataatatgtgtataaaa

SEQ ID NO: 15371 - DNA, 23 bp, Artificial sequence
  SiRNA target sequence
atacaataatatgtgtataaaaa

SEQ ID NO: 15372 - DNA, 23 bp, Artificial sequence
  SiRNA target sequence
tacaataatatgtgtataaaaat

SEQ ID NO: 15373 - DNA, 23 bp, Artificial sequence
  SiRNA target sequence
acaataatatgtgtataaaaatg

SEQ ID NO: 15374 - DNA, 23 bp, Artificial sequence
  SiRNA target sequence
caataatatgtgtataaaaatga

SEQ ID NO: 15375 - DNA, 23 bp, Artificial sequence
  SiRNA target sequence
aataatatgtgtataaaaatgat

SEQ ID NO: 15376 - DNA, 23 bp, Artificial sequence
  SiRNA target sequence
ataatatgtgtataaaaatgata

SEQ ID NO: 15377 - DNA, 23 bp, Artificial sequence
  SiRNA target sequence
taatatgtgtataaaaatgatac

SEQ ID NO: 15378 - DNA, 23 bp, Artificial sequence
  SiRNA target sequence
aatatgtgtataaaaatgataca

SEQ ID NO: 15379 - DNA, 23 bp, Artificial sequence
  SiRNA target sequence
atatgtgtataaaaatgatacag

SEQ ID NO: 15380 - DNA, 23 bp, Artificial sequence
  SiRNA target sequence
tatgtgtataaaaatgatacagc

SEQ ID NO: 15381 - DNA, 23 bp, Artificial sequence
  SiRNA target sequence
atgtgtataaaaatgatacagcc

SEQ ID NO: 15382 - DNA, 23 bp, Artificial sequence
  SiRNA target sequence
tgtgtataaaaatgatacagcca

SEQ ID NO: 15383 - DNA, 23 bp, Artificial sequence
  SiRNA target sequence
gtgtataaaaatgatacagccag

SEQ ID NO: 15384 - DNA, 23 bp, Artificial sequence
  SiRNA target sequence
tgtataaaaatgatacagccagc

SEQ ID NO: 15385 - DNA, 23 bp, Artificial sequence
  SiRNA target sequence
gtataaaaatgatacagccagct

SEQ ID NO: 15386 - DNA, 23 bp, Artificial sequence
  SiRNA target sequence
tataaaaatgatacagccagcta

SEQ ID NO: 15387 - DNA, 23 bp, Artificial sequence
  SiRNA target sequence
ataaaaatgatacagccagctat

SEQ ID NO: 15388 - DNA, 23 bp, Artificial sequence
  SiRNA target sequence
taaaaatgatacagccagctatt

SEQ ID NO: 15389 - DNA, 23 bp, Artificial sequence
  SiRNA target sequence
aaaaatgatacagccagctatta

SEQ ID NO: 15390 - DNA, 23 bp, Artificial sequence
  SiRNA target sequence
aaaatgatacagccagctattaa

SEQ ID NO: 15391 - DNA, 23 bp, Artificial sequence
  SiRNA target sequence
aaatgatacagccagctattaaa

SEQ ID NO: 15392 - DNA, 23 bp, Artificial sequence
  SiRNA target sequence
aatgatacagccagctattaaag

SEQ ID NO: 15393 - DNA, 23 bp, Artificial sequence
  SiRNA target sequence
atgatacagccagctattaaagg

SEQ ID NO: 15394 - DNA, 23 bp, Artificial sequence
  SiRNA target sequence
tgatacagccagctattaaaggt

SEQ ID NO: 15395 - DNA, 23 bp, Artificial sequence
  SiRNA target sequence
gatacagccagctattaaaggtg

SEQ ID NO: 15396 - DNA, 23 bp, Artificial sequence
  SiRNA target sequence
atacagccagctattaaaggtgc

SEQ ID NO: 15397 - DNA, 23 bp, Artificial sequence
  SiRNA target sequence
tacagccagctattaaaggtgct

SEQ ID NO: 15398 - DNA, 23 bp, Artificial sequence
  SiRNA target sequence
acagccagctattaaaggtgctt

SEQ ID NO: 15399 - DNA, 23 bp, Artificial sequence
  SiRNA target sequence
cagccagctattaaaggtgcttc

SEQ ID NO: 15400 - DNA, 23 bp, Artificial sequence
  SiRNA target sequence
agccagctattaaaggtgcttca

SEQ ID NO: 15401 - DNA, 23 bp, Artificial sequence
  SiRNA target sequence
gccagctattaaaggtgcttcat

SEQ ID NO: 15402 - DNA, 23 bp, Artificial sequence
  SiRNA target sequence
ccagctattaaaggtgcttcatg

SEQ ID NO: 15403 - DNA, 23 bp, Artificial sequence
  SiRNA target sequence
cagctattaaaggtgcttcatgt

SEQ ID NO: 15404 - DNA, 23 bp, Artificial sequence
  SiRNA target sequence
agctattaaaggtgcttcatgta

SEQ ID NO: 15405 - DNA, 23 bp, Artificial sequence
  SiRNA target sequence
gctattaaaggtgcttcatgtat

SEQ ID NO: 15406 - DNA, 23 bp, Artificial sequence
  SiRNA target sequence
ctattaaaggtgcttcatgtata

SEQ ID NO: 15407 - DNA, 23 bp, Artificial sequence
  SiRNA target sequence
tattaaaggtgcttcatgtatat

SEQ ID NO: 15408 - DNA, 23 bp, Artificial sequence
  SiRNA target sequence
attaaaggtgcttcatgtatata

SEQ ID NO: 15409 - DNA, 23 bp, Artificial sequence
  SiRNA target sequence
ttaaaggtgcttcatgtatatac

SEQ ID NO: 15410 - DNA, 23 bp, Artificial sequence
  SiRNA target sequence
taaaggtgcttcatgtatatacg

SEQ ID NO: 15411 - DNA, 23 bp, Artificial sequence
  SiRNA target sequence
aaaggtgcttcatgtatatacgt

SEQ ID NO: 15412 - DNA, 23 bp, Artificial sequence
  SiRNA target sequence
aaggtgcttcatgtatatacgtg

SEQ ID NO: 15413 - DNA, 23 bp, Artificial sequence
  SiRNA target sequence
aggtgcttcatgtatatacgtgg

SEQ ID NO: 15414 - DNA, 23 bp, Artificial sequence
  SiRNA target sequence
ggtgcttcatgtatatacgtggg

SEQ ID NO: 15415 - DNA, 23 bp, Artificial sequence
  SiRNA target sequence
gtgcttcatgtatatacgtgggt

SEQ ID NO: 15416 - DNA, 23 bp, Artificial sequence
  SiRNA target sequence
tgcttcatgtatatacgtgggta

SEQ ID NO: 15417 - DNA, 23 bp, Artificial sequence
  SiRNA target sequence
gcttcatgtatatacgtgggtaa

SEQ ID NO: 15418 - DNA, 23 bp, Artificial sequence
  SiRNA target sequence
cttcatgtatatacgtgggtaat

SEQ ID NO: 15419 - DNA, 23 bp, Artificial sequence
  SiRNA target sequence
ttcatgtatatacgtgggtaatt

SEQ ID NO: 15420 - DNA, 23 bp, Artificial sequence
  SiRNA target sequence
tcatgtatatacgtgggtaatta

SEQ ID NO: 15421 - DNA, 23 bp, Artificial sequence
  SiRNA target sequence
catgtatatacgtgggtaattat

SEQ ID NO: 15422 - DNA, 23 bp, Artificial sequence
  SiRNA target sequence
atgtatatacgtgggtaattata

SEQ ID NO: 15423 - DNA, 23 bp, Artificial sequence
  SiRNA target sequence
tgtatatacgtgggtaattatat

SEQ ID NO: 15424 - DNA, 23 bp, Artificial sequence
  SiRNA target sequence
gtatatacgtgggtaattatatg

SEQ ID NO: 15425 - DNA, 23 bp, Artificial sequence
  SiRNA target sequence
tatatacgtgggtaattatatgc

SEQ ID NO: 15426 - DNA, 23 bp, Artificial sequence
  SiRNA target sequence
atatacgtgggtaattatatgca

SEQ ID NO: 15427 - DNA, 23 bp, Artificial sequence
  SiRNA target sequence
tatacgtgggtaattatatgcag

SEQ ID NO: 15428 - DNA, 23 bp, Artificial sequence
  SiRNA target sequence
atacgtgggtaattatatgcagc

SEQ ID NO: 15429 - DNA, 23 bp, Artificial sequence
  SiRNA target sequence
tacgtgggtaattatatgcagca

SEQ ID NO: 15430 - DNA, 23 bp, Artificial sequence
  SiRNA target sequence
acgtgggtaattatatgcagcag

SEQ ID NO: 15431 - DNA, 23 bp, Artificial sequence
  SiRNA target sequence
cgtgggtaattatatgcagcagc

SEQ ID NO: 15432 - DNA, 23 bp, Artificial sequence
  SiRNA target sequence
gtgggtaattatatgcagcagct

SEQ ID NO: 15433 - DNA, 23 bp, Artificial sequence
  SiRNA target sequence
tgggtaattatatgcagcagcta

SEQ ID NO: 15434 - DNA, 23 bp, Artificial sequence
  SiRNA target sequence
gggtaattatatgcagcagctag

SEQ ID NO: 15435 - DNA, 23 bp, Artificial sequence
  SiRNA target sequence
ggtaattatatgcagcagctagg

SEQ ID NO: 15436 - DNA, 23 bp, Artificial sequence
  SiRNA target sequence
gtaattatatgcagcagctagga

SEQ ID NO: 15437 - DNA, 23 bp, Artificial sequence
  SiRNA target sequence
taattatatgcagcagctaggag

SEQ ID NO: 15438 - DNA, 23 bp, Artificial sequence
  SiRNA target sequence
aattatatgcagcagctaggagt

SEQ ID NO: 15439 - DNA, 23 bp, Artificial sequence
  SiRNA target sequence
attatatgcagcagctaggagta

SEQ ID NO: 15440 - DNA, 23 bp, Artificial sequence
  SiRNA target sequence
ttatatgcagcagctaggagtaa

SEQ ID NO: 15441 - DNA, 23 bp, Artificial sequence
  SiRNA target sequence
tatatgcagcagctaggagtaat

SEQ ID NO: 15442 - DNA, 23 bp, Artificial sequence
  SiRNA target sequence
atatgcagcagctaggagtaatt

SEQ ID NO: 15443 - DNA, 23 bp, Artificial sequence
  SiRNA target sequence
tatgcagcagctaggagtaatta

SEQ ID NO: 15444 - DNA, 23 bp, Artificial sequence
  SiRNA target sequence
atgcagcagctaggagtaattag

SEQ ID NO: 15445 - DNA, 23 bp, Artificial sequence
  SiRNA target sequence
tgcagcagctaggagtaattagt

SEQ ID NO: 15446 - DNA, 23 bp, Artificial sequence
  SiRNA target sequence
gcagcagctaggagtaattagtc

SEQ ID NO: 15447 - DNA, 23 bp, Artificial sequence
  SiRNA target sequence
cagcagctaggagtaattagtct

SEQ ID NO: 15448 - DNA, 23 bp, Artificial sequence
  SiRNA target sequence
agcagctaggagtaattagtctt

SEQ ID NO: 15449 - DNA, 23 bp, Artificial sequence
  SiRNA target sequence
gcagctaggagtaattagtcttg

SEQ ID NO: 15450 - DNA, 23 bp, Artificial sequence
  SiRNA target sequence
cagctaggagtaattagtcttgg

SEQ ID NO: 15451 - DNA, 23 bp, Artificial sequence
  SiRNA target sequence
agctaggagtaattagtcttggt

SEQ ID NO: 15452 - DNA, 23 bp, Artificial sequence
  SiRNA target sequence
gctaggagtaattagtcttggtg

SEQ ID NO: 15453 - DNA, 23 bp, Artificial sequence
  SiRNA target sequence
ctaggagtaattagtcttggtgg

SEQ ID NO: 15454 - DNA, 23 bp, Artificial sequence
  SiRNA target sequence
taggagtaattagtcttggtggg

SEQ ID NO: 15455 - DNA, 23 bp, Artificial sequence
  SiRNA target sequence
aggagtaattagtcttggtgggg

SEQ ID NO: 15456 - DNA, 23 bp, Artificial sequence
  SiRNA target sequence
ggagtaattagtcttggtgggga

SEQ ID NO: 15457 - DNA, 23 bp, Artificial sequence
  SiRNA target sequence
gagtaattagtcttggtggggag

SEQ ID NO: 15458 - DNA, 23 bp, Artificial sequence
  SiRNA target sequence
agtaattagtcttggtggggaga

SEQ ID NO: 15459 - DNA, 23 bp, Artificial sequence
  SiRNA target sequence
gtaattagtcttggtggggagat

SEQ ID NO: 15460 - DNA, 23 bp, Artificial sequence
  SiRNA target sequence
taattagtcttggtggggagatt

SEQ ID NO: 15461 - DNA, 23 bp, Artificial sequence
  SiRNA target sequence
aattagtcttggtggggagatta

SEQ ID NO: 15462 - DNA, 23 bp, Artificial sequence
  SiRNA target sequence
attagtcttggtggggagattat

SEQ ID NO: 15463 - DNA, 23 bp, Artificial sequence
  SiRNA target sequence
ttagtcttggtggggagattatt

SEQ ID NO: 15464 - DNA, 23 bp, Artificial sequence
  SiRNA target sequence
tagtcttggtggggagattatta

SEQ ID NO: 15465 - DNA, 23 bp, Artificial sequence
  SiRNA target sequence
agtcttggtggggagattattaa

SEQ ID NO: 15466 - DNA, 23 bp, Artificial sequence
  SiRNA target sequence
gtcttggtggggagattattaaa

SEQ ID NO: 15467 - DNA, 23 bp, Artificial sequence
  SiRNA target sequence
tcttggtggggagattattaaag

SEQ ID NO: 15468 - DNA, 23 bp, Artificial sequence
  SiRNA target sequence
cttggtggggagattattaaagc

SEQ ID NO: 15469 - DNA, 23 bp, Artificial sequence
  SiRNA target sequence
ttggtggggagattattaaagct

SEQ ID NO: 15470 - DNA, 23 bp, Artificial sequence
  SiRNA target sequence
tggtggggagattattaaagctg

SEQ ID NO: 15471 - DNA, 23 bp, Artificial sequence
  SiRNA target sequence
ggtggggagattattaaagctga

SEQ ID NO: 15472 - DNA, 23 bp, Artificial sequence
  SiRNA target sequence
gtggggagattattaaagctgat

SEQ ID NO: 15473 - DNA, 23 bp, Artificial sequence
  SiRNA target sequence
tggggagattattaaagctgatg

SEQ ID NO: 15474 - DNA, 23 bp, Artificial sequence
  SiRNA target sequence
ggggagattattaaagctgatga

SEQ ID NO: 15475 - DNA, 23 bp, Artificial sequence
  SiRNA target sequence
gggagattattaaagctgatgaa

SEQ ID NO: 15476 - DNA, 23 bp, Artificial sequence
  SiRNA target sequence
ggagattattaaagctgatgaat

SEQ ID NO: 15477 - DNA, 23 bp, Artificial sequence
  SiRNA target sequence
gagattattaaagctgatgaata

SEQ ID NO: 15478 - DNA, 23 bp, Artificial sequence
  SiRNA target sequence
agattattaaagctgatgaatac

SEQ ID NO: 15479 - DNA, 23 bp, Artificial sequence
  SiRNA target sequence
gattattaaagctgatgaataca

SEQ ID NO: 15480 - DNA, 23 bp, Artificial sequence
  SiRNA target sequence
attattaaagctgatgaatacat

SEQ ID NO: 15481 - DNA, 23 bp, Artificial sequence
  SiRNA target sequence
ttattaaagctgatgaatacatt

SEQ ID NO: 15482 - DNA, 23 bp, Artificial sequence
  SiRNA target sequence
tattaaagctgatgaatacattg

SEQ ID NO: 15483 - DNA, 23 bp, Artificial sequence
  SiRNA target sequence
attaaagctgatgaatacattgg

SEQ ID NO: 15484 - DNA, 23 bp, Artificial sequence
  SiRNA target sequence
ttaaagctgatgaatacattgga

SEQ ID NO: 15485 - DNA, 23 bp, Artificial sequence
  SiRNA target sequence
taaagctgatgaatacattggac

SEQ ID NO: 15486 - DNA, 23 bp, Artificial sequence
  SiRNA target sequence
aaagctgatgaatacattggact

SEQ ID NO: 15487 - DNA, 23 bp, Artificial sequence
  SiRNA target sequence
aagctgatgaatacattggacta

SEQ ID NO: 15488 - DNA, 23 bp, Artificial sequence
  SiRNA target sequence
agctgatgaatacattggactat

SEQ ID NO: 15489 - DNA, 23 bp, Artificial sequence
  SiRNA target sequence
gctgatgaatacattggactatc

SEQ ID NO: 15490 - DNA, 23 bp, Artificial sequence
  SiRNA target sequence
ctgatgaatacattggactatct

SEQ ID NO: 15491 - DNA, 23 bp, Artificial sequence
  SiRNA target sequence
tgatgaatacattggactatctt

SEQ ID NO: 15492 - DNA, 23 bp, Artificial sequence
  SiRNA target sequence
gatgaatacattggactatcttt

SEQ ID NO: 15493 - DNA, 23 bp, Artificial sequence
  SiRNA target sequence
atgaatacattggactatctttt

SEQ ID NO: 15494 - DNA, 23 bp, Artificial sequence
  SiRNA target sequence
tgaatacattggactatcttttg

SEQ ID NO: 15495 - DNA, 23 bp, Artificial sequence
  SiRNA target sequence
gaatacattggactatcttttgt

SEQ ID NO: 15496 - DNA, 23 bp, Artificial sequence
  SiRNA target sequence
aatacattggactatcttttgta

SEQ ID NO: 15497 - DNA, 23 bp, Artificial sequence
  SiRNA target sequence
atacattggactatcttttgtag

SEQ ID NO: 15498 - DNA, 23 bp, Artificial sequence
  SiRNA target sequence
tacattggactatcttttgtagg

SEQ ID NO: 15499 - DNA, 23 bp, Artificial sequence
  SiRNA target sequence
acattggactatcttttgtaggg

SEQ ID NO: 15500 - DNA, 23 bp, Artificial sequence
  SiRNA target sequence
cattggactatcttttgtaggga

SEQ ID NO: 15501 - DNA, 23 bp, Artificial sequence
  SiRNA target sequence
attggactatcttttgtagggag

SEQ ID NO: 15502 - DNA, 23 bp, Artificial sequence
  SiRNA target sequence
ttggactatcttttgtagggaga

SEQ ID NO: 15503 - DNA, 23 bp, Artificial sequence
  SiRNA target sequence
tggactatcttttgtagggagat

SEQ ID NO: 15504 - DNA, 23 bp, Artificial sequence
  SiRNA target sequence
ggactatcttttgtagggagata

SEQ ID NO: 15505 - DNA, 23 bp, Artificial sequence
  SiRNA target sequence
gactatcttttgtagggagatat

SEQ ID NO: 15506 - DNA, 23 bp, Artificial sequence
  SiRNA target sequence
actatcttttgtagggagatatg

SEQ ID NO: 15507 - DNA, 23 bp, Artificial sequence
  SiRNA target sequence
ctatcttttgtagggagatatga

SEQ ID NO: 15508 - DNA, 23 bp, Artificial sequence
  SiRNA target sequence
tatcttttgtagggagatatgaa

SEQ ID NO: 15509 - DNA, 23 bp, Artificial sequence
  SiRNA target sequence
atcttttgtagggagatatgaag

SEQ ID NO: 15510 - DNA, 23 bp, Artificial sequence
  SiRNA target sequence
tcttttgtagggagatatgaagg

SEQ ID NO: 15511 - DNA, 23 bp, Artificial sequence
  SiRNA target sequence
cttttgtagggagatatgaaggg

SEQ ID NO: 15512 - DNA, 23 bp, Artificial sequence
  SiRNA target sequence
ttttgtagggagatatgaaggga

SEQ ID NO: 15513 - DNA, 23 bp, Artificial sequence
  SiRNA target sequence
tttgtagggagatatgaagggat

SEQ ID NO: 15514 - DNA, 23 bp, Artificial sequence
  SiRNA target sequence
ttgtagggagatatgaagggatt

SEQ ID NO: 15515 - DNA, 23 bp, Artificial sequence
  SiRNA target sequence
tgtagggagatatgaagggattg

SEQ ID NO: 15516 - DNA, 23 bp, Artificial sequence
  SiRNA target sequence
gtagggagatatgaagggattgg

SEQ ID NO: 15517 - DNA, 23 bp, Artificial sequence
  SiRNA target sequence
tagggagatatgaagggattggt

SEQ ID NO: 15518 - DNA, 23 bp, Artificial sequence
  SiRNA target sequence
agggagatatgaagggattggtt

SEQ ID NO: 15519 - DNA, 23 bp, Artificial sequence
  SiRNA target sequence
gggagatatgaagggattggttc

SEQ ID NO: 15520 - DNA, 23 bp, Artificial sequence
  SiRNA target sequence
ggagatatgaagggattggttct

SEQ ID NO: 15521 - DNA, 23 bp, Artificial sequence
  SiRNA target sequence
gagatatgaagggattggttcta

SEQ ID NO: 15522 - DNA, 23 bp, Artificial sequence
  SiRNA target sequence
agatatgaagggattggttctat

SEQ ID NO: 15523 - DNA, 23 bp, Artificial sequence
  SiRNA target sequence
gatatgaagggattggttctatt

SEQ ID NO: 15524 - DNA, 23 bp, Artificial sequence
  SiRNA target sequence
atatgaagggattggttctattt

SEQ ID NO: 15525 - DNA, 23 bp, Artificial sequence
  SiRNA target sequence
tatgaagggattggttctatttc

SEQ ID NO: 15526 - DNA, 23 bp, Artificial sequence
  SiRNA target sequence
atgaagggattggttctatttct

SEQ ID NO: 15527 - DNA, 23 bp, Artificial sequence
  SiRNA target sequence
tgaagggattggttctatttcta

SEQ ID NO: 15528 - DNA, 23 bp, Artificial sequence
  SiRNA target sequence
gaagggattggttctatttctac

SEQ ID NO: 15529 - DNA, 23 bp, Artificial sequence
  SiRNA target sequence
aagggattggttctatttctact

SEQ ID NO: 15530 - DNA, 23 bp, Artificial sequence
  SiRNA target sequence
agggattggttctatttctacta

SEQ ID NO: 15531 - DNA, 23 bp, Artificial sequence
  SiRNA target sequence
gggattggttctatttctactat

SEQ ID NO: 15532 - DNA, 23 bp, Artificial sequence
  SiRNA target sequence
ggattggttctatttctactata

SEQ ID NO: 15533 - DNA, 23 bp, Artificial sequence
  SiRNA target sequence
gattggttctatttctactatat

SEQ ID NO: 15534 - DNA, 23 bp, Artificial sequence
  SiRNA target sequence
attggttctatttctactatatc

SEQ ID NO: 15535 - DNA, 23 bp, Artificial sequence
  SiRNA target sequence
ttggttctatttctactatatca

SEQ ID NO: 15536 - DNA, 23 bp, Artificial sequence
  SiRNA target sequence
tggttctatttctactatatcac

SEQ ID NO: 15537 - DNA, 23 bp, Artificial sequence
  SiRNA target sequence
ggttctatttctactatatcact

SEQ ID NO: 15538 - DNA, 23 bp, Artificial sequence
  SiRNA target sequence
gttctatttctactatatcactt

SEQ ID NO: 15539 - DNA, 23 bp, Artificial sequence
  SiRNA target sequence
ttctatttctactatatcacttc

SEQ ID NO: 15540 - DNA, 23 bp, Artificial sequence
  SiRNA target sequence
tctatttctactatatcacttca

SEQ ID NO: 15541 - DNA, 23 bp, Artificial sequence
  SiRNA target sequence
ctatttctactatatcacttcag

SEQ ID NO: 15542 - DNA, 23 bp, Artificial sequence
  SiRNA target sequence
tatttctactatatcacttcagc

SEQ ID NO: 15543 - DNA, 23 bp, Artificial sequence
  SiRNA target sequence
atttctactatatcacttcagca

SEQ ID NO: 15544 - DNA, 23 bp, Artificial sequence
  SiRNA target sequence
tttctactatatcacttcagcag

SEQ ID NO: 15545 - DNA, 23 bp, Artificial sequence
  SiRNA target sequence
ttctactatatcacttcagcagt

SEQ ID NO: 15546 - DNA, 23 bp, Artificial sequence
  SiRNA target sequence
tctactatatcacttcagcagtt

SEQ ID NO: 15547 - DNA, 23 bp, Artificial sequence
  SiRNA target sequence
ctactatatcacttcagcagttt

SEQ ID NO: 15548 - DNA, 23 bp, Artificial sequence
  SiRNA target sequence
tactatatcacttcagcagttta

SEQ ID NO: 15549 - DNA, 23 bp, Artificial sequence
  SiRNA target sequence
actatatcacttcagcagtttaa

SEQ ID NO: 15550 - DNA, 23 bp, Artificial sequence
  SiRNA target sequence
ctatatcacttcagcagtttaat

SEQ ID NO: 15551 - DNA, 23 bp, Artificial sequence
  SiRNA target sequence
tatatcacttcagcagtttaata

SEQ ID NO: 15552 - DNA, 23 bp, Artificial sequence
  SiRNA target sequence
atatcacttcagcagtttaatac

SEQ ID NO: 15553 - DNA, 23 bp, Artificial sequence
  SiRNA target sequence
tatcacttcagcagtttaataca

SEQ ID NO: 15554 - DNA, 23 bp, Artificial sequence
  SiRNA target sequence
atcacttcagcagtttaatacac

SEQ ID NO: 15555 - DNA, 23 bp, Artificial sequence
  SiRNA target sequence
tcacttcagcagtttaatacact

SEQ ID NO: 15556 - DNA, 23 bp, Artificial sequence
  SiRNA target sequence
cacttcagcagtttaatacactg

SEQ ID NO: 15557 - DNA, 23 bp, Artificial sequence
  SiRNA target sequence
acttcagcagtttaatacactgt

SEQ ID NO: 15558 - DNA, 23 bp, Artificial sequence
  SiRNA target sequence
cttcagcagtttaatacactgtc

SEQ ID NO: 15559 - DNA, 23 bp, Artificial sequence
  SiRNA target sequence
ttcagcagtttaatacactgtct

SEQ ID NO: 15560 - DNA, 23 bp, Artificial sequence
  SiRNA target sequence
tcagcagtttaatacactgtcta

SEQ ID NO: 15561 - DNA, 23 bp, Artificial sequence
  SiRNA target sequence
cagcagtttaatacactgtctat

SEQ ID NO: 15562 - DNA, 23 bp, Artificial sequence
  SiRNA target sequence
agcagtttaatacactgtctata

SEQ ID NO: 15563 - DNA, 23 bp, Artificial sequence
  SiRNA target sequence
gcagtttaatacactgtctatag

SEQ ID NO: 15564 - DNA, 23 bp, Artificial sequence
  SiRNA target sequence
cagtttaatacactgtctataga

SEQ ID NO: 15565 - DNA, 23 bp, Artificial sequence
  SiRNA target sequence
agtttaatacactgtctatagat

SEQ ID NO: 15566 - DNA, 23 bp, Artificial sequence
  SiRNA target sequence
gtttaatacactgtctatagatt

SEQ ID NO: 15567 - DNA, 23 bp, Artificial sequence
  SiRNA target sequence
tttaatacactgtctatagatta

SEQ ID NO: 15568 - DNA, 23 bp, Artificial sequence
  SiRNA target sequence
ttaatacactgtctatagattat

SEQ ID NO: 15569 - DNA, 23 bp, Artificial sequence
  SiRNA target sequence
taatacactgtctatagattatt

SEQ ID NO: 15570 - DNA, 23 bp, Artificial sequence
  SiRNA target sequence
aatacactgtctatagattatta

SEQ ID NO: 15571 - DNA, 23 bp, Artificial sequence
  SiRNA target sequence
atacactgtctatagattattac

SEQ ID NO: 15572 - DNA, 23 bp, Artificial sequence
  SiRNA target sequence
tacactgtctatagattattaca

SEQ ID NO: 15573 - DNA, 23 bp, Artificial sequence
  SiRNA target sequence
acactgtctatagattattacaa

SEQ ID NO: 15574 - DNA, 23 bp, Artificial sequence
  SiRNA target sequence
cactgtctatagattattacaag

SEQ ID NO: 15575 - DNA, 23 bp, Artificial sequence
  SiRNA target sequence
actgtctatagattattacaaga

SEQ ID NO: 15576 - DNA, 23 bp, Artificial sequence
  SiRNA target sequence
ctgtctatagattattacaagac

SEQ ID NO: 15577 - DNA, 23 bp, Artificial sequence
  SiRNA target sequence
tgtctatagattattacaagaca

SEQ ID NO: 15578 - DNA, 23 bp, Artificial sequence
  SiRNA target sequence
gtctatagattattacaagacat

SEQ ID NO: 15579 - DNA, 23 bp, Artificial sequence
  SiRNA target sequence
tctatagattattacaagacatt

SEQ ID NO: 15580 - DNA, 23 bp, Artificial sequence
  SiRNA target sequence
ctatagattattacaagacattg

SEQ ID NO: 15581 - DNA, 23 bp, Artificial sequence
  SiRNA target sequence
tatagattattacaagacattgt

SEQ ID NO: 15582 - DNA, 23 bp, Artificial sequence
  SiRNA target sequence
atagattattacaagacattgtc

SEQ ID NO: 15583 - DNA, 23 bp, Artificial sequence
  SiRNA target sequence
tagattattacaagacattgtct

SEQ ID NO: 15584 - DNA, 23 bp, Artificial sequence
  SiRNA target sequence
agattattacaagacattgtctt

SEQ ID NO: 15585 - DNA, 23 bp, Artificial sequence
  SiRNA target sequence
gattattacaagacattgtcttc

SEQ ID NO: 15586 - DNA, 23 bp, Artificial sequence
  SiRNA target sequence
attattacaagacattgtcttct

SEQ ID NO: 15587 - DNA, 23 bp, Artificial sequence
  SiRNA target sequence
ttattacaagacattgtcttcta

SEQ ID NO: 15588 - DNA, 23 bp, Artificial sequence
  SiRNA target sequence
tattacaagacattgtcttctat

SEQ ID NO: 15589 - DNA, 23 bp, Artificial sequence
  SiRNA target sequence
attacaagacattgtcttctatt

SEQ ID NO: 15590 - DNA, 23 bp, Artificial sequence
  SiRNA target sequence
ttacaagacattgtcttctattt

SEQ ID NO: 15591 - DNA, 23 bp, Artificial sequence
  SiRNA target sequence
tacaagacattgtcttctatttg

SEQ ID NO: 15592 - DNA, 23 bp, Artificial sequence
  SiRNA target sequence
acaagacattgtcttctatttgt

SEQ ID NO: 15593 - DNA, 23 bp, Artificial sequence
  SiRNA target sequence
caagacattgtcttctatttgtg

SEQ ID NO: 15594 - DNA, 23 bp, Artificial sequence
  SiRNA target sequence
aagacattgtcttctatttgtga

SEQ ID NO: 15595 - DNA, 23 bp, Artificial sequence
  SiRNA target sequence
agacattgtcttctatttgtgac

SEQ ID NO: 15596 - DNA, 23 bp, Artificial sequence
  SiRNA target sequence
gacattgtcttctatttgtgacg

SEQ ID NO: 15597 - DNA, 23 bp, Artificial sequence
  SiRNA target sequence
acattgtcttctatttgtgacgt

SEQ ID NO: 15598 - DNA, 23 bp, Artificial sequence
  SiRNA target sequence
cattgtcttctatttgtgacgta

SEQ ID NO: 15599 - DNA, 23 bp, Artificial sequence
  SiRNA target sequence
attgtcttctatttgtgacgtag

SEQ ID NO: 15600 - DNA, 23 bp, Artificial sequence
  SiRNA target sequence
ttgtcttctatttgtgacgtagg

SEQ ID NO: 15601 - DNA, 23 bp, Artificial sequence
  SiRNA target sequence
tgtcttctatttgtgacgtaggt

SEQ ID NO: 15602 - DNA, 23 bp, Artificial sequence
  SiRNA target sequence
gtcttctatttgtgacgtaggta

SEQ ID NO: 15603 - DNA, 23 bp, Artificial sequence
  SiRNA target sequence
tcttctatttgtgacgtaggtat

SEQ ID NO: 15604 - DNA, 23 bp, Artificial sequence
  SiRNA target sequence
cttctatttgtgacgtaggtatt

SEQ ID NO: 15605 - DNA, 23 bp, Artificial sequence
  SiRNA target sequence
ttctatttgtgacgtaggtatta

SEQ ID NO: 15606 - DNA, 23 bp, Artificial sequence
  SiRNA target sequence
tctatttgtgacgtaggtattaa

SEQ ID NO: 15607 - DNA, 23 bp, Artificial sequence
  SiRNA target sequence
ctatttgtgacgtaggtattaaa

SEQ ID NO: 15608 - DNA, 23 bp, Artificial sequence
  SiRNA target sequence
tatttgtgacgtaggtattaaaa

SEQ ID NO: 15609 - DNA, 23 bp, Artificial sequence
  SiRNA target sequence
atttgtgacgtaggtattaaaat

SEQ ID NO: 15610 - DNA, 23 bp, Artificial sequence
  SiRNA target sequence
tttgtgacgtaggtattaaaata

SEQ ID NO: 15611 - DNA, 23 bp, Artificial sequence
  SiRNA target sequence
ttgtgacgtaggtattaaaatat

SEQ ID NO: 15612 - DNA, 23 bp, Artificial sequence
  SiRNA target sequence
tgtgacgtaggtattaaaatatc

SEQ ID NO: 15613 - DNA, 23 bp, Artificial sequence
  SiRNA target sequence
gtgacgtaggtattaaaatatca

SEQ ID NO: 15614 - DNA, 23 bp, Artificial sequence
  SiRNA target sequence
tgacgtaggtattaaaatatcaa

SEQ ID NO: 15615 - DNA, 23 bp, Artificial sequence
  SiRNA target sequence
gacgtaggtattaaaatatcaac

SEQ ID NO: 15616 - DNA, 23 bp, Artificial sequence
  SiRNA target sequence
acgtaggtattaaaatatcaact

SEQ ID NO: 15617 - DNA, 23 bp, Artificial sequence
  SiRNA target sequence
cgtaggtattaaaatatcaactg

SEQ ID NO: 15618 - DNA, 23 bp, Artificial sequence
  SiRNA target sequence
gtaggtattaaaatatcaactga

SEQ ID NO: 15619 - DNA, 23 bp, Artificial sequence
  SiRNA target sequence
taggtattaaaatatcaactgat

SEQ ID NO: 15620 - DNA, 23 bp, Artificial sequence
  SiRNA target sequence
aggtattaaaatatcaactgata

SEQ ID NO: 15621 - DNA, 23 bp, Artificial sequence
  SiRNA target sequence
ggtattaaaatatcaactgatag

SEQ ID NO: 15622 - DNA, 23 bp, Artificial sequence
  SiRNA target sequence
gtattaaaatatcaactgatagg

SEQ ID NO: 15623 - DNA, 23 bp, Artificial sequence
  SiRNA target sequence
tattaaaatatcaactgataggg

SEQ ID NO: 15624 - DNA, 23 bp, Artificial sequence
  SiRNA target sequence
attaaaatatcaactgataggga

SEQ ID NO: 15625 - DNA, 23 bp, Artificial sequence
  SiRNA target sequence
ttaaaatatcaactgatagggaa

SEQ ID NO: 15626 - DNA, 23 bp, Artificial sequence
  SiRNA target sequence
taaaatatcaactgatagggaaa

SEQ ID NO: 15627 - DNA, 23 bp, Artificial sequence
  SiRNA target sequence
aaaatatcaactgatagggaaaa

SEQ ID NO: 15628 - DNA, 23 bp, Artificial sequence
  SiRNA target sequence
aaatatcaactgatagggaaaaa

SEQ ID NO: 15629 - DNA, 23 bp, Artificial sequence
  SiRNA target sequence
aatatcaactgatagggaaaaat

SEQ ID NO: 15630 - DNA, 23 bp, Artificial sequence
  SiRNA target sequence
atatcaactgatagggaaaaatc

SEQ ID NO: 15631 - DNA, 23 bp, Artificial sequence
  SiRNA target sequence
tatcaactgatagggaaaaatca

SEQ ID NO: 15632 - DNA, 23 bp, Artificial sequence
  SiRNA target sequence
atcaactgatagggaaaaatcag

SEQ ID NO: 15633 - DNA, 23 bp, Artificial sequence
  SiRNA target sequence
tcaactgatagggaaaaatcagt

SEQ ID NO: 15634 - DNA, 23 bp, Artificial sequence
  SiRNA target sequence
caactgatagggaaaaatcagtt

SEQ ID NO: 15635 - DNA, 23 bp, Artificial sequence
  SiRNA target sequence
aactgatagggaaaaatcagtta

SEQ ID NO: 15636 - DNA, 23 bp, Artificial sequence
  SiRNA target sequence
actgatagggaaaaatcagttaa

SEQ ID NO: 15637 - DNA, 23 bp, Artificial sequence
  SiRNA target sequence
ctgatagggaaaaatcagttaat

SEQ ID NO: 15638 - DNA, 23 bp, Artificial sequence
  SiRNA target sequence
tgatagggaaaaatcagttaatt

SEQ ID NO: 15639 - DNA, 23 bp, Artificial sequence
  SiRNA target sequence
gatagggaaaaatcagttaatta

SEQ ID NO: 15640 - DNA, 23 bp, Artificial sequence
  SiRNA target sequence
atagggaaaaatcagttaattat

SEQ ID NO: 15641 - DNA, 23 bp, Artificial sequence
  SiRNA target sequence
tagggaaaaatcagttaattatg

SEQ ID NO: 15642 - DNA, 23 bp, Artificial sequence
  SiRNA target sequence
agggaaaaatcagttaattatgg

SEQ ID NO: 15643 - DNA, 23 bp, Artificial sequence
  SiRNA target sequence
gggaaaaatcagttaattatgga

SEQ ID NO: 15644 - DNA, 23 bp, Artificial sequence
  SiRNA target sequence
ggaaaaatcagttaattatggat

SEQ ID NO: 15645 - DNA, 23 bp, Artificial sequence
  SiRNA target sequence
gaaaaatcagttaattatggatt

SEQ ID NO: 15646 - DNA, 23 bp, Artificial sequence
  SiRNA target sequence
aaaaatcagttaattatggatta

SEQ ID NO: 15647 - DNA, 23 bp, Artificial sequence
  SiRNA target sequence
aaaatcagttaattatggattag

SEQ ID NO: 15648 - DNA, 23 bp, Artificial sequence
  SiRNA target sequence
aaatcagttaattatggattagg

SEQ ID NO: 15649 - DNA, 23 bp, Artificial sequence
  SiRNA target sequence
aatcagttaattatggattagga

SEQ ID NO: 15650 - DNA, 23 bp, Artificial sequence
  SiRNA target sequence
atcagttaattatggattaggag

SEQ ID NO: 15651 - DNA, 23 bp, Artificial sequence
  SiRNA target sequence
tcagttaattatggattaggagt

SEQ ID NO: 15652 - DNA, 23 bp, Artificial sequence
  SiRNA target sequence
cagttaattatggattaggagtt

SEQ ID NO: 15653 - DNA, 23 bp, Artificial sequence
  SiRNA target sequence
agttaattatggattaggagtta

SEQ ID NO: 15654 - DNA, 23 bp, Artificial sequence
  SiRNA target sequence
gttaattatggattaggagttaa

SEQ ID NO: 15655 - DNA, 23 bp, Artificial sequence
  SiRNA target sequence
ttaattatggattaggagttaaa

SEQ ID NO: 15656 - DNA, 23 bp, Artificial sequence
  SiRNA target sequence
taattatggattaggagttaaac

SEQ ID NO: 15657 - DNA, 23 bp, Artificial sequence
  SiRNA target sequence
aattatggattaggagttaaact

SEQ ID NO: 15658 - DNA, 23 bp, Artificial sequence
  SiRNA target sequence
attatggattaggagttaaacta

SEQ ID NO: 15659 - DNA, 23 bp, Artificial sequence
  SiRNA target sequence
ttatggattaggagttaaactac

SEQ ID NO: 15660 - DNA, 23 bp, Artificial sequence
  SiRNA target sequence
tatggattaggagttaaactaca

SEQ ID NO: 15661 - DNA, 23 bp, Artificial sequence
  SiRNA target sequence
atggattaggagttaaactacac

SEQ ID NO: 15662 - DNA, 23 bp, Artificial sequence
  SiRNA target sequence
tggattaggagttaaactacaca

SEQ ID NO: 15663 - DNA, 23 bp, Artificial sequence
  SiRNA target sequence
ggattaggagttaaactacacag

SEQ ID NO: 15664 - DNA, 23 bp, Artificial sequence
  SiRNA target sequence
gattaggagttaaactacacagt

SEQ ID NO: 15665 - DNA, 23 bp, Artificial sequence
  SiRNA target sequence
attaggagttaaactacacagta

SEQ ID NO: 15666 - DNA, 23 bp, Artificial sequence
  SiRNA target sequence
ttaggagttaaactacacagtaa

SEQ ID NO: 15667 - DNA, 23 bp, Artificial sequence
  SiRNA target sequence
taggagttaaactacacagtaaa

SEQ ID NO: 15668 - DNA, 23 bp, Artificial sequence
  SiRNA target sequence
aggagttaaactacacagtaaaa

SEQ ID NO: 15669 - DNA, 23 bp, Artificial sequence
  SiRNA target sequence
ggagttaaactacacagtaaaaa

SEQ ID NO: 15670 - DNA, 23 bp, Artificial sequence
  SiRNA target sequence
gagttaaactacacagtaaaaaa

SEQ ID NO: 15671 - DNA, 23 bp, Artificial sequence
  SiRNA target sequence
agttaaactacacagtaaaaaag

SEQ ID NO: 15672 - DNA, 23 bp, Artificial sequence
  SiRNA target sequence
gttaaactacacagtaaaaaagg

SEQ ID NO: 15673 - DNA, 23 bp, Artificial sequence
  SiRNA target sequence
ttaaactacacagtaaaaaagga

SEQ ID NO: 15674 - DNA, 23 bp, Artificial sequence
  SiRNA target sequence
taaactacacagtaaaaaaggag

SEQ ID NO: 15675 - DNA, 23 bp, Artificial sequence
  SiRNA target sequence
aaactacacagtaaaaaaggaga

SEQ ID NO: 15676 - DNA, 23 bp, Artificial sequence
  SiRNA target sequence
aactacacagtaaaaaaggagaa

SEQ ID NO: 15677 - DNA, 23 bp, Artificial sequence
  SiRNA target sequence
actacacagtaaaaaaggagaaa

SEQ ID NO: 15678 - DNA, 23 bp, Artificial sequence
  SiRNA target sequence
ctacacagtaaaaaaggagaaat

SEQ ID NO: 15679 - DNA, 23 bp, Artificial sequence
  SiRNA target sequence
tacacagtaaaaaaggagaaatt

SEQ ID NO: 15680 - DNA, 23 bp, Artificial sequence
  SiRNA target sequence
acacagtaaaaaaggagaaatta

SEQ ID NO: 15681 - DNA, 23 bp, Artificial sequence
  SiRNA target sequence
cacagtaaaaaaggagaaattat

SEQ ID NO: 15682 - DNA, 23 bp, Artificial sequence
  SiRNA target sequence
acagtaaaaaaggagaaattatc

SEQ ID NO: 15683 - DNA, 23 bp, Artificial sequence
  SiRNA target sequence
cagtaaaaaaggagaaattatcg

SEQ ID NO: 15684 - DNA, 23 bp, Artificial sequence
  SiRNA target sequence
agtaaaaaaggagaaattatcgg

SEQ ID NO: 15685 - DNA, 23 bp, Artificial sequence
  SiRNA target sequence
gtaaaaaaggagaaattatcgga

SEQ ID NO: 15686 - DNA, 23 bp, Artificial sequence
  SiRNA target sequence
taaaaaaggagaaattatcggat

SEQ ID NO: 15687 - DNA, 23 bp, Artificial sequence
  SiRNA target sequence
aaaaaaggagaaattatcggatg

SEQ ID NO: 15688 - DNA, 23 bp, Artificial sequence
  SiRNA target sequence
aaaaaggagaaattatcggatgt

SEQ ID NO: 15689 - DNA, 23 bp, Artificial sequence
  SiRNA target sequence
aaaaggagaaattatcggatgtg

SEQ ID NO: 15690 - DNA, 23 bp, Artificial sequence
  SiRNA target sequence
aaaggagaaattatcggatgtgt

SEQ ID NO: 15691 - DNA, 23 bp, Artificial sequence
  SiRNA target sequence
aaggagaaattatcggatgtgta

SEQ ID NO: 15692 - DNA, 23 bp, Artificial sequence
  SiRNA target sequence
aggagaaattatcggatgtgtag

SEQ ID NO: 15693 - DNA, 23 bp, Artificial sequence
  SiRNA target sequence
ggagaaattatcggatgtgtaga

SEQ ID NO: 15694 - DNA, 23 bp, Artificial sequence
  SiRNA target sequence
gagaaattatcggatgtgtagat

SEQ ID NO: 15695 - DNA, 23 bp, Artificial sequence
  SiRNA target sequence
agaaattatcggatgtgtagata

SEQ ID NO: 15696 - DNA, 23 bp, Artificial sequence
  SiRNA target sequence
gaaattatcggatgtgtagataa

SEQ ID NO: 15697 - DNA, 23 bp, Artificial sequence
  SiRNA target sequence
aaattatcggatgtgtagataac

SEQ ID NO: 15698 - DNA, 23 bp, Artificial sequence
  SiRNA target sequence
aattatcggatgtgtagataaca

SEQ ID NO: 15699 - DNA, 23 bp, Artificial sequence
  SiRNA target sequence
attatcggatgtgtagataacaa

SEQ ID NO: 15700 - DNA, 23 bp, Artificial sequence
  SiRNA target sequence
ttatcggatgtgtagataacaat

SEQ ID NO: 15701 - DNA, 23 bp, Artificial sequence
  SiRNA target sequence
tatcggatgtgtagataacaatc

SEQ ID NO: 15702 - DNA, 23 bp, Artificial sequence
  SiRNA target sequence
atcggatgtgtagataacaatca

SEQ ID NO: 15703 - DNA, 23 bp, Artificial sequence
  SiRNA target sequence
tcggatgtgtagataacaatcat

SEQ ID NO: 15704 - DNA, 23 bp, Artificial sequence
  SiRNA target sequence
cggatgtgtagataacaatcata

SEQ ID NO: 15705 - DNA, 23 bp, Artificial sequence
  SiRNA target sequence
ggatgtgtagataacaatcatat

SEQ ID NO: 15706 - DNA, 23 bp, Artificial sequence
  SiRNA target sequence
gatgtgtagataacaatcatatt

SEQ ID NO: 15707 - DNA, 23 bp, Artificial sequence
  SiRNA target sequence
atgtgtagataacaatcatattt

SEQ ID NO: 15708 - DNA, 23 bp, Artificial sequence
  SiRNA target sequence
tgtgtagataacaatcatatttt

SEQ ID NO: 15709 - DNA, 23 bp, Artificial sequence
  SiRNA target sequence
gtgtagataacaatcatatttta

SEQ ID NO: 15710 - DNA, 23 bp, Artificial sequence
  SiRNA target sequence
tgtagataacaatcatattttaa

SEQ ID NO: 15711 - DNA, 23 bp, Artificial sequence
  SiRNA target sequence
gtagataacaatcatattttaag

SEQ ID NO: 15712 - DNA, 23 bp, Artificial sequence
  SiRNA target sequence
tagataacaatcatattttaagc

SEQ ID NO: 15713 - DNA, 23 bp, Artificial sequence
  SiRNA target sequence
agataacaatcatattttaagca

SEQ ID NO: 15714 - DNA, 23 bp, Artificial sequence
  SiRNA target sequence
gataacaatcatattttaagcat

SEQ ID NO: 15715 - DNA, 23 bp, Artificial sequence
  SiRNA target sequence
ataacaatcatattttaagcata

SEQ ID NO: 15716 - DNA, 23 bp, Artificial sequence
  SiRNA target sequence
taacaatcatattttaagcataa

SEQ ID NO: 15717 - DNA, 23 bp, Artificial sequence
  SiRNA target sequence
aacaatcatattttaagcataat

SEQ ID NO: 15718 - DNA, 23 bp, Artificial sequence
  SiRNA target sequence
acaatcatattttaagcataatt

SEQ ID NO: 15719 - DNA, 23 bp, Artificial sequence
  SiRNA target sequence
caatcatattttaagcataattt

SEQ ID NO: 15720 - DNA, 23 bp, Artificial sequence
  SiRNA target sequence
aatcatattttaagcataattta

SEQ ID NO: 15721 - DNA, 23 bp, Artificial sequence
  SiRNA target sequence
atcatattttaagcataatttat

SEQ ID NO: 15722 - DNA, 23 bp, Artificial sequence
  SiRNA target sequence
tcatattttaagcataatttata

SEQ ID NO: 15723 - DNA, 23 bp, Artificial sequence
  SiRNA target sequence
catattttaagcataatttataa

SEQ ID NO: 15724 - DNA, 23 bp, Artificial sequence
  SiRNA target sequence
atattttaagcataatttataat

SEQ ID NO: 15725 - DNA, 23 bp, Artificial sequence
  SiRNA target sequence
tattttaagcataatttataatg

SEQ ID NO: 15726 - DNA, 23 bp, Artificial sequence
  SiRNA target sequence
attttaagcataatttataatga

SEQ ID NO: 15727 - DNA, 23 bp, Artificial sequence
  SiRNA target sequence
ttttaagcataatttataatgat

SEQ ID NO: 15728 - DNA, 23 bp, Artificial sequence
  SiRNA target sequence
tttaagcataatttataatgata

SEQ ID NO: 15729 - DNA, 23 bp, Artificial sequence
  SiRNA target sequence
ttaagcataatttataatgataa

SEQ ID NO: 15730 - DNA, 23 bp, Artificial sequence
  SiRNA target sequence
taagcataatttataatgataaa

SEQ ID NO: 15731 - DNA, 23 bp, Artificial sequence
  SiRNA target sequence
aagcataatttataatgataaat

SEQ ID NO: 15732 - DNA, 23 bp, Artificial sequence
  SiRNA target sequence
agcataatttataatgataaatt

SEQ ID NO: 15733 - DNA, 23 bp, Artificial sequence
  SiRNA target sequence
gcataatttataatgataaatta

SEQ ID NO: 15734 - DNA, 23 bp, Artificial sequence
  SiRNA target sequence
cataatttataatgataaattat

SEQ ID NO: 15735 - DNA, 23 bp, Artificial sequence
  SiRNA target sequence
ataatttataatgataaattatc

SEQ ID NO: 15736 - DNA, 23 bp, Artificial sequence
  SiRNA target sequence
taatttataatgataaattatct

SEQ ID NO: 15737 - DNA, 23 bp, Artificial sequence
  SiRNA target sequence
aatttataatgataaattatctg

SEQ ID NO: 15738 - DNA, 23 bp, Artificial sequence
  SiRNA target sequence
atttataatgataaattatctga

SEQ ID NO: 15739 - DNA, 23 bp, Artificial sequence
  SiRNA target sequence
tttataatgataaattatctgaa

SEQ ID NO: 15740 - DNA, 23 bp, Artificial sequence
  SiRNA target sequence
ttataatgataaattatctgaag

SEQ ID NO: 15741 - DNA, 23 bp, Artificial sequence
  SiRNA target sequence
tataatgataaattatctgaagg

SEQ ID NO: 15742 - DNA, 23 bp, Artificial sequence
  SiRNA target sequence
ataatgataaattatctgaaggg

SEQ ID NO: 15743 - DNA, 23 bp, Artificial sequence
  SiRNA target sequence
taatgataaattatctgaagggt

SEQ ID NO: 15744 - DNA, 23 bp, Artificial sequence
  SiRNA target sequence
aatgataaattatctgaagggtt

SEQ ID NO: 15745 - DNA, 23 bp, Artificial sequence
  SiRNA target sequence
atgataaattatctgaagggtta

SEQ ID NO: 15746 - DNA, 23 bp, Artificial sequence
  SiRNA target sequence
tgataaattatctgaagggttaa

SEQ ID NO: 15747 - DNA, 23 bp, Artificial sequence
  SiRNA target sequence
gataaattatctgaagggttaac

SEQ ID NO: 15748 - DNA, 23 bp, Artificial sequence
  SiRNA target sequence
ataaattatctgaagggttaaca

SEQ ID NO: 15749 - DNA, 23 bp, Artificial sequence
  SiRNA target sequence
taaattatctgaagggttaacac

SEQ ID NO: 15750 - DNA, 23 bp, Artificial sequence
  SiRNA target sequence
aaattatctgaagggttaacact

SEQ ID NO: 15751 - DNA, 23 bp, Artificial sequence
  SiRNA target sequence
aattatctgaagggttaacactt

SEQ ID NO: 15752 - DNA, 23 bp, Artificial sequence
  SiRNA target sequence
attatctgaagggttaacactta

SEQ ID NO: 15753 - DNA, 23 bp, Artificial sequence
  SiRNA target sequence
ttatctgaagggttaacacttaa

SEQ ID NO: 15754 - DNA, 23 bp, Artificial sequence
  SiRNA target sequence
tatctgaagggttaacacttaat

SEQ ID NO: 15755 - DNA, 23 bp, Artificial sequence
  SiRNA target sequence
atctgaagggttaacacttaatt

SEQ ID NO: 15756 - DNA, 23 bp, Artificial sequence
  SiRNA target sequence
tctgaagggttaacacttaattt

SEQ ID NO: 15757 - DNA, 23 bp, Artificial sequence
  SiRNA target sequence
ctgaagggttaacacttaatttg

SEQ ID NO: 15758 - DNA, 23 bp, Artificial sequence
  SiRNA target sequence
tgaagggttaacacttaatttga

SEQ ID NO: 15759 - DNA, 23 bp, Artificial sequence
  SiRNA target sequence
gaagggttaacacttaatttgag

SEQ ID NO: 15760 - DNA, 23 bp, Artificial sequence
  SiRNA target sequence
aagggttaacacttaatttgagt

SEQ ID NO: 15761 - DNA, 23 bp, Artificial sequence
  SiRNA target sequence
agggttaacacttaatttgagtt

SEQ ID NO: 15762 - DNA, 23 bp, Artificial sequence
  SiRNA target sequence
gggttaacacttaatttgagttg

SEQ ID NO: 15763 - DNA, 23 bp, Artificial sequence
  SiRNA target sequence
ggttaacacttaatttgagttgt

SEQ ID NO: 15764 - DNA, 23 bp, Artificial sequence
  SiRNA target sequence
gttaacacttaatttgagttgta

SEQ ID NO: 15765 - DNA, 23 bp, Artificial sequence
  SiRNA target sequence
ttaacacttaatttgagttgtag

SEQ ID NO: 15766 - DNA, 23 bp, Artificial sequence
  SiRNA target sequence
taacacttaatttgagttgtaga

SEQ ID NO: 15767 - DNA, 23 bp, Artificial sequence
  SiRNA target sequence
aacacttaatttgagttgtagat

SEQ ID NO: 15768 - DNA, 23 bp, Artificial sequence
  SiRNA target sequence
acacttaatttgagttgtagatt

SEQ ID NO: 15769 - DNA, 23 bp, Artificial sequence
  SiRNA target sequence
cacttaatttgagttgtagattt

SEQ ID NO: 15770 - DNA, 23 bp, Artificial sequence
  SiRNA target sequence
acttaatttgagttgtagatttg

SEQ ID NO: 15771 - DNA, 23 bp, Artificial sequence
  SiRNA target sequence
cttaatttgagttgtagatttgg

SEQ ID NO: 15772 - DNA, 23 bp, Artificial sequence
  SiRNA target sequence
ttaatttgagttgtagatttggt

SEQ ID NO: 15773 - DNA, 23 bp, Artificial sequence
  SiRNA target sequence
taatttgagttgtagatttggta

SEQ ID NO: 15774 - DNA, 23 bp, Artificial sequence
  SiRNA target sequence
aatttgagttgtagatttggtaa

SEQ ID NO: 15775 - DNA, 23 bp, Artificial sequence
  SiRNA target sequence
atttgagttgtagatttggtaag

SEQ ID NO: 15776 - DNA, 23 bp, Artificial sequence
  SiRNA target sequence
tttgagttgtagatttggtaaga

SEQ ID NO: 15777 - DNA, 23 bp, Artificial sequence
  SiRNA target sequence
ttgagttgtagatttggtaagaa

SEQ ID NO: 15778 - DNA, 23 bp, Artificial sequence
  SiRNA target sequence
tgagttgtagatttggtaagaaa

SEQ ID NO: 15779 - DNA, 23 bp, Artificial sequence
  SiRNA target sequence
gagttgtagatttggtaagaaag

SEQ ID NO: 15780 - DNA, 23 bp, Artificial sequence
  SiRNA target sequence
agttgtagatttggtaagaaagt

SEQ ID NO: 15781 - DNA, 23 bp, Artificial sequence
  SiRNA target sequence
gttgtagatttggtaagaaagta

SEQ ID NO: 15782 - DNA, 23 bp, Artificial sequence
  SiRNA target sequence
ttgtagatttggtaagaaagtat

SEQ ID NO: 15783 - DNA, 23 bp, Artificial sequence
  SiRNA target sequence
tgtagatttggtaagaaagtatt

SEQ ID NO: 15784 - DNA, 23 bp, Artificial sequence
  SiRNA target sequence
gtagatttggtaagaaagtattt

SEQ ID NO: 15785 - DNA, 23 bp, Artificial sequence
  SiRNA target sequence
tagatttggtaagaaagtatttg

SEQ ID NO: 15786 - DNA, 23 bp, Artificial sequence
  SiRNA target sequence
agatttggtaagaaagtatttga

SEQ ID NO: 15787 - DNA, 23 bp, Artificial sequence
  SiRNA target sequence
gatttggtaagaaagtatttgat

SEQ ID NO: 15788 - DNA, 23 bp, Artificial sequence
  SiRNA target sequence
atttggtaagaaagtatttgatt

SEQ ID NO: 15789 - DNA, 23 bp, Artificial sequence
  SiRNA target sequence
tttggtaagaaagtatttgatta

SEQ ID NO: 15790 - DNA, 23 bp, Artificial sequence
  SiRNA target sequence
ttggtaagaaagtatttgattat

SEQ ID NO: 15791 - DNA, 23 bp, Artificial sequence
  SiRNA target sequence
tggtaagaaagtatttgattatg

SEQ ID NO: 15792 - DNA, 23 bp, Artificial sequence
  SiRNA target sequence
ggtaagaaagtatttgattatgg

SEQ ID NO: 15793 - DNA, 23 bp, Artificial sequence
  SiRNA target sequence
gtaagaaagtatttgattatggc

SEQ ID NO: 15794 - DNA, 23 bp, Artificial sequence
  SiRNA target sequence
taagaaagtatttgattatggct

SEQ ID NO: 15795 - DNA, 23 bp, Artificial sequence
  SiRNA target sequence
aagaaagtatttgattatggcta

SEQ ID NO: 15796 - DNA, 23 bp, Artificial sequence
  SiRNA target sequence
agaaagtatttgattatggctat

SEQ ID NO: 15797 - DNA, 23 bp, Artificial sequence
  SiRNA target sequence
gaaagtatttgattatggctatg

SEQ ID NO: 15798 - DNA, 23 bp, Artificial sequence
  SiRNA target sequence
aaagtatttgattatggctatgg

SEQ ID NO: 15799 - DNA, 23 bp, Artificial sequence
  SiRNA target sequence
aagtatttgattatggctatggg

SEQ ID NO: 15800 - DNA, 23 bp, Artificial sequence
  SiRNA target sequence
agtatttgattatggctatgggt

SEQ ID NO: 15801 - DNA, 23 bp, Artificial sequence
  SiRNA target sequence
gtatttgattatggctatgggtt

SEQ ID NO: 15802 - DNA, 23 bp, Artificial sequence
  SiRNA target sequence
tatttgattatggctatgggttt

SEQ ID NO: 15803 - DNA, 23 bp, Artificial sequence
  SiRNA target sequence
atttgattatggctatgggttta

SEQ ID NO: 15804 - DNA, 23 bp, Artificial sequence
  SiRNA target sequence
tttgattatggctatgggtttat

SEQ ID NO: 15805 - DNA, 23 bp, Artificial sequence
  SiRNA target sequence
ttgattatggctatgggtttatt

SEQ ID NO: 15806 - DNA, 23 bp, Artificial sequence
  SiRNA target sequence
tgattatggctatgggtttattt

SEQ ID NO: 15807 - DNA, 23 bp, Artificial sequence
  SiRNA target sequence
gattatggctatgggtttattta

SEQ ID NO: 15808 - DNA, 23 bp, Artificial sequence
  SiRNA target sequence
attatggctatgggtttatttat

SEQ ID NO: 15809 - DNA, 23 bp, Artificial sequence
  SiRNA target sequence
ttatggctatgggtttatttatg

SEQ ID NO: 15810 - DNA, 23 bp, Artificial sequence
  SiRNA target sequence
tatggctatgggtttatttatga

SEQ ID NO: 15811 - DNA, 23 bp, Artificial sequence
  SiRNA target sequence
atggctatgggtttatttatgaa

SEQ ID NO: 15812 - DNA, 23 bp, Artificial sequence
  SiRNA target sequence
tggctatgggtttatttatgaat

SEQ ID NO: 15813 - DNA, 23 bp, Artificial sequence
  SiRNA target sequence
ggctatgggtttatttatgaatt

SEQ ID NO: 15814 - DNA, 23 bp, Artificial sequence
  SiRNA target sequence
gctatgggtttatttatgaattt

SEQ ID NO: 15815 - DNA, 23 bp, Artificial sequence
  SiRNA target sequence
ctatgggtttatttatgaatttt

SEQ ID NO: 15816 - DNA, 23 bp, Artificial sequence
  SiRNA target sequence
tatgggtttatttatgaatttta

SEQ ID NO: 15817 - DNA, 23 bp, Artificial sequence
  SiRNA target sequence
atgggtttatttatgaattttaa

SEQ ID NO: 15818 - DNA, 24 bp, Artificial sequence
  SiRNA target sequence
atgaaatctttctacaaaaaaata

SEQ ID NO: 15819 - DNA, 24 bp, Artificial sequence
  SiRNA target sequence
tgaaatctttctacaaaaaaataa

SEQ ID NO: 15820 - DNA, 24 bp, Artificial sequence
  SiRNA target sequence
gaaatctttctacaaaaaaataaa

SEQ ID NO: 15821 - DNA, 24 bp, Artificial sequence
  SiRNA target sequence
aaatctttctacaaaaaaataaaa

SEQ ID NO: 15822 - DNA, 24 bp, Artificial sequence
  SiRNA target sequence
aatctttctacaaaaaaataaaaa

SEQ ID NO: 15823 - DNA, 24 bp, Artificial sequence
  SiRNA target sequence
atctttctacaaaaaaataaaaag

SEQ ID NO: 15824 - DNA, 24 bp, Artificial sequence
  SiRNA target sequence
tctttctacaaaaaaataaaaagt

SEQ ID NO: 15825 - DNA, 24 bp, Artificial sequence
  SiRNA target sequence
ctttctacaaaaaaataaaaagtt

SEQ ID NO: 15826 - DNA, 24 bp, Artificial sequence
  SiRNA target sequence
tttctacaaaaaaataaaaagtta

SEQ ID NO: 15827 - DNA, 24 bp, Artificial sequence
  SiRNA target sequence
ttctacaaaaaaataaaaagttat

SEQ ID NO: 15828 - DNA, 24 bp, Artificial sequence
  SiRNA target sequence
tctacaaaaaaataaaaagttatt

SEQ ID NO: 15829 - DNA, 24 bp, Artificial sequence
  SiRNA target sequence
ctacaaaaaaataaaaagttattt

SEQ ID NO: 15830 - DNA, 24 bp, Artificial sequence
  SiRNA target sequence
tacaaaaaaataaaaagttattta

SEQ ID NO: 15831 - DNA, 24 bp, Artificial sequence
  SiRNA target sequence
acaaaaaaataaaaagttatttat

SEQ ID NO: 15832 - DNA, 24 bp, Artificial sequence
  SiRNA target sequence
caaaaaaataaaaagttatttatt

SEQ ID NO: 15833 - DNA, 24 bp, Artificial sequence
  SiRNA target sequence
aaaaaaataaaaagttatttattc

SEQ ID NO: 15834 - DNA, 24 bp, Artificial sequence
  SiRNA target sequence
aaaaaataaaaagttatttattca

SEQ ID NO: 15835 - DNA, 24 bp, Artificial sequence
  SiRNA target sequence
aaaaataaaaagttatttattcaa

SEQ ID NO: 15836 - DNA, 24 bp, Artificial sequence
  SiRNA target sequence
aaaataaaaagttatttattcaaa

SEQ ID NO: 15837 - DNA, 24 bp, Artificial sequence
  SiRNA target sequence
aaataaaaagttatttattcaaat

SEQ ID NO: 15838 - DNA, 24 bp, Artificial sequence
  SiRNA target sequence
aataaaaagttatttattcaaatc

SEQ ID NO: 15839 - DNA, 24 bp, Artificial sequence
  SiRNA target sequence
ataaaaagttatttattcaaatct

SEQ ID NO: 15840 - DNA, 24 bp, Artificial sequence
  SiRNA target sequence
taaaaagttatttattcaaatctg

SEQ ID NO: 15841 - DNA, 24 bp, Artificial sequence
  SiRNA target sequence
aaaaagttatttattcaaatctgc

SEQ ID NO: 15842 - DNA, 24 bp, Artificial sequence
  SiRNA target sequence
aaaagttatttattcaaatctgcc

SEQ ID NO: 15843 - DNA, 24 bp, Artificial sequence
  SiRNA target sequence
aaagttatttattcaaatctgcca

SEQ ID NO: 15844 - DNA, 24 bp, Artificial sequence
  SiRNA target sequence
aagttatttattcaaatctgccat

SEQ ID NO: 15845 - DNA, 24 bp, Artificial sequence
  SiRNA target sequence
agttatttattcaaatctgccatt

SEQ ID NO: 15846 - DNA, 24 bp, Artificial sequence
  SiRNA target sequence
gttatttattcaaatctgccatta

SEQ ID NO: 15847 - DNA, 24 bp, Artificial sequence
  SiRNA target sequence
ttatttattcaaatctgccattaa

SEQ ID NO: 15848 - DNA, 24 bp, Artificial sequence
  SiRNA target sequence
tatttattcaaatctgccattaat

SEQ ID NO: 15849 - DNA, 24 bp, Artificial sequence
  SiRNA target sequence
atttattcaaatctgccattaata

SEQ ID NO: 15850 - DNA, 24 bp, Artificial sequence
  SiRNA target sequence
tttattcaaatctgccattaatac

SEQ ID NO: 15851 - DNA, 24 bp, Artificial sequence
  SiRNA target sequence
ttattcaaatctgccattaataca

SEQ ID NO: 15852 - DNA, 24 bp, Artificial sequence
  SiRNA target sequence
tattcaaatctgccattaatacat

SEQ ID NO: 15853 - DNA, 24 bp, Artificial sequence
  SiRNA target sequence
attcaaatctgccattaatacatc

SEQ ID NO: 15854 - DNA, 24 bp, Artificial sequence
  SiRNA target sequence
ttcaaatctgccattaatacatct

SEQ ID NO: 15855 - DNA, 24 bp, Artificial sequence
  SiRNA target sequence
tcaaatctgccattaatacatctt

SEQ ID NO: 15856 - DNA, 24 bp, Artificial sequence
  SiRNA target sequence
caaatctgccattaatacatcttt

SEQ ID NO: 15857 - DNA, 24 bp, Artificial sequence
  SiRNA target sequence
aaatctgccattaatacatctttt

SEQ ID NO: 15858 - DNA, 24 bp, Artificial sequence
  SiRNA target sequence
aatctgccattaatacatcttttg

SEQ ID NO: 15859 - DNA, 24 bp, Artificial sequence
  SiRNA target sequence
atctgccattaatacatcttttga

SEQ ID NO: 15860 - DNA, 24 bp, Artificial sequence
  SiRNA target sequence
tctgccattaatacatcttttgat

SEQ ID NO: 15861 - DNA, 24 bp, Artificial sequence
  SiRNA target sequence
ctgccattaatacatcttttgata

SEQ ID NO: 15862 - DNA, 24 bp, Artificial sequence
  SiRNA target sequence
tgccattaatacatcttttgatac

SEQ ID NO: 15863 - DNA, 24 bp, Artificial sequence
  SiRNA target sequence
gccattaatacatcttttgatact

SEQ ID NO: 15864 - DNA, 24 bp, Artificial sequence
  SiRNA target sequence
ccattaatacatcttttgatactt

SEQ ID NO: 15865 - DNA, 24 bp, Artificial sequence
  SiRNA target sequence
cattaatacatcttttgatacttt

SEQ ID NO: 15866 - DNA, 24 bp, Artificial sequence
  SiRNA target sequence
attaatacatcttttgatactttt

SEQ ID NO: 15867 - DNA, 24 bp, Artificial sequence
  SiRNA target sequence
ttaatacatcttttgatactttta

SEQ ID NO: 15868 - DNA, 24 bp, Artificial sequence
  SiRNA target sequence
taatacatcttttgatacttttaa

SEQ ID NO: 15869 - DNA, 24 bp, Artificial sequence
  SiRNA target sequence
aatacatcttttgatacttttaat

SEQ ID NO: 15870 - DNA, 24 bp, Artificial sequence
  SiRNA target sequence
atacatcttttgatacttttaatt

SEQ ID NO: 15871 - DNA, 24 bp, Artificial sequence
  SiRNA target sequence
tacatcttttgatacttttaattt

SEQ ID NO: 15872 - DNA, 24 bp, Artificial sequence
  SiRNA target sequence
acatcttttgatacttttaattta

SEQ ID NO: 15873 - DNA, 24 bp, Artificial sequence
  SiRNA target sequence
catcttttgatacttttaatttag

SEQ ID NO: 15874 - DNA, 24 bp, Artificial sequence
  SiRNA target sequence
atcttttgatacttttaatttaga

SEQ ID NO: 15875 - DNA, 24 bp, Artificial sequence
  SiRNA target sequence
tcttttgatacttttaatttagaa

SEQ ID NO: 15876 - DNA, 24 bp, Artificial sequence
  SiRNA target sequence
cttttgatacttttaatttagaaa

SEQ ID NO: 15877 - DNA, 24 bp, Artificial sequence
  SiRNA target sequence
ttttgatacttttaatttagaaaa

SEQ ID NO: 15878 - DNA, 24 bp, Artificial sequence
  SiRNA target sequence
tttgatacttttaatttagaaaat

SEQ ID NO: 15879 - DNA, 24 bp, Artificial sequence
  SiRNA target sequence
ttgatacttttaatttagaaaatg

SEQ ID NO: 15880 - DNA, 24 bp, Artificial sequence
  SiRNA target sequence
tgatacttttaatttagaaaatgt

SEQ ID NO: 15881 - DNA, 24 bp, Artificial sequence
  SiRNA target sequence
gatacttttaatttagaaaatgta

SEQ ID NO: 15882 - DNA, 24 bp, Artificial sequence
  SiRNA target sequence
atacttttaatttagaaaatgtaa

SEQ ID NO: 15883 - DNA, 24 bp, Artificial sequence
  SiRNA target sequence
tacttttaatttagaaaatgtaag

SEQ ID NO: 15884 - DNA, 24 bp, Artificial sequence
  SiRNA target sequence
acttttaatttagaaaatgtaagc

SEQ ID NO: 15885 - DNA, 24 bp, Artificial sequence
  SiRNA target sequence
cttttaatttagaaaatgtaagca

SEQ ID NO: 15886 - DNA, 24 bp, Artificial sequence
  SiRNA target sequence
ttttaatttagaaaatgtaagcat

SEQ ID NO: 15887 - DNA, 24 bp, Artificial sequence
  SiRNA target sequence
tttaatttagaaaatgtaagcatt

SEQ ID NO: 15888 - DNA, 24 bp, Artificial sequence
  SiRNA target sequence
ttaatttagaaaatgtaagcatta

SEQ ID NO: 15889 - DNA, 24 bp, Artificial sequence
  SiRNA target sequence
taatttagaaaatgtaagcattac

SEQ ID NO: 15890 - DNA, 24 bp, Artificial sequence
  SiRNA target sequence
aatttagaaaatgtaagcattact

SEQ ID NO: 15891 - DNA, 24 bp, Artificial sequence
  SiRNA target sequence
atttagaaaatgtaagcattacta

SEQ ID NO: 15892 - DNA, 24 bp, Artificial sequence
  SiRNA target sequence
tttagaaaatgtaagcattactag

SEQ ID NO: 15893 - DNA, 24 bp, Artificial sequence
  SiRNA target sequence
ttagaaaatgtaagcattactagc

SEQ ID NO: 15894 - DNA, 24 bp, Artificial sequence
  SiRNA target sequence
tagaaaatgtaagcattactagct

SEQ ID NO: 15895 - DNA, 24 bp, Artificial sequence
  SiRNA target sequence
agaaaatgtaagcattactagctt

SEQ ID NO: 15896 - DNA, 24 bp, Artificial sequence
  SiRNA target sequence
gaaaatgtaagcattactagctta

SEQ ID NO: 15897 - DNA, 24 bp, Artificial sequence
  SiRNA target sequence
aaaatgtaagcattactagcttaa

SEQ ID NO: 15898 - DNA, 24 bp, Artificial sequence
  SiRNA target sequence
aaatgtaagcattactagcttaaa

SEQ ID NO: 15899 - DNA, 24 bp, Artificial sequence
  SiRNA target sequence
aatgtaagcattactagcttaaat

SEQ ID NO: 15900 - DNA, 24 bp, Artificial sequence
  SiRNA target sequence
atgtaagcattactagcttaaata

SEQ ID NO: 15901 - DNA, 24 bp, Artificial sequence
  SiRNA target sequence
tgtaagcattactagcttaaatac

SEQ ID NO: 15902 - DNA, 24 bp, Artificial sequence
  SiRNA target sequence
gtaagcattactagcttaaatacg

SEQ ID NO: 15903 - DNA, 24 bp, Artificial sequence
  SiRNA target sequence
taagcattactagcttaaatacgt

SEQ ID NO: 15904 - DNA, 24 bp, Artificial sequence
  SiRNA target sequence
aagcattactagcttaaatacgta

SEQ ID NO: 15905 - DNA, 24 bp, Artificial sequence
  SiRNA target sequence
agcattactagcttaaatacgtac

SEQ ID NO: 15906 - DNA, 24 bp, Artificial sequence
  SiRNA target sequence
gcattactagcttaaatacgtaca

SEQ ID NO: 15907 - DNA, 24 bp, Artificial sequence
  SiRNA target sequence
cattactagcttaaatacgtacac

SEQ ID NO: 15908 - DNA, 24 bp, Artificial sequence
  SiRNA target sequence
attactagcttaaatacgtacacc

SEQ ID NO: 15909 - DNA, 24 bp, Artificial sequence
  SiRNA target sequence
ttactagcttaaatacgtacaccg

SEQ ID NO: 15910 - DNA, 24 bp, Artificial sequence
  SiRNA target sequence
tactagcttaaatacgtacaccgg

SEQ ID NO: 15911 - DNA, 24 bp, Artificial sequence
  SiRNA target sequence
actagcttaaatacgtacaccggt

SEQ ID NO: 15912 - DNA, 24 bp, Artificial sequence
  SiRNA target sequence
ctagcttaaatacgtacaccggtg

SEQ ID NO: 15913 - DNA, 24 bp, Artificial sequence
  SiRNA target sequence
tagcttaaatacgtacaccggtgt

SEQ ID NO: 15914 - DNA, 24 bp, Artificial sequence
  SiRNA target sequence
agcttaaatacgtacaccggtgtt

SEQ ID NO: 15915 - DNA, 24 bp, Artificial sequence
  SiRNA target sequence
gcttaaatacgtacaccggtgtta

SEQ ID NO: 15916 - DNA, 24 bp, Artificial sequence
  SiRNA target sequence
cttaaatacgtacaccggtgttaa

SEQ ID NO: 15917 - DNA, 24 bp, Artificial sequence
  SiRNA target sequence
ttaaatacgtacaccggtgttaaa

SEQ ID NO: 15918 - DNA, 24 bp, Artificial sequence
  SiRNA target sequence
taaatacgtacaccggtgttaaaa

SEQ ID NO: 15919 - DNA, 24 bp, Artificial sequence
  SiRNA target sequence
aaatacgtacaccggtgttaaaac

SEQ ID NO: 15920 - DNA, 24 bp, Artificial sequence
  SiRNA target sequence
aatacgtacaccggtgttaaaacc

SEQ ID NO: 15921 - DNA, 24 bp, Artificial sequence
  SiRNA target sequence
atacgtacaccggtgttaaaaccg

SEQ ID NO: 15922 - DNA, 24 bp, Artificial sequence
  SiRNA target sequence
tacgtacaccggtgttaaaaccga

SEQ ID NO: 15923 - DNA, 24 bp, Artificial sequence
  SiRNA target sequence
acgtacaccggtgttaaaaccgaa

SEQ ID NO: 15924 - DNA, 24 bp, Artificial sequence
  SiRNA target sequence
cgtacaccggtgttaaaaccgaaa

SEQ ID NO: 15925 - DNA, 24 bp, Artificial sequence
  SiRNA target sequence
gtacaccggtgttaaaaccgaaat

SEQ ID NO: 15926 - DNA, 24 bp, Artificial sequence
  SiRNA target sequence
tacaccggtgttaaaaccgaaata

SEQ ID NO: 15927 - DNA, 24 bp, Artificial sequence
  SiRNA target sequence
acaccggtgttaaaaccgaaatat

SEQ ID NO: 15928 - DNA, 24 bp, Artificial sequence
  SiRNA target sequence
caccggtgttaaaaccgaaatatc

SEQ ID NO: 15929 - DNA, 24 bp, Artificial sequence
  SiRNA target sequence
accggtgttaaaaccgaaatatca

SEQ ID NO: 15930 - DNA, 24 bp, Artificial sequence
  SiRNA target sequence
ccggtgttaaaaccgaaatatcaa

SEQ ID NO: 15931 - DNA, 24 bp, Artificial sequence
  SiRNA target sequence
cggtgttaaaaccgaaatatcaaa

SEQ ID NO: 15932 - DNA, 24 bp, Artificial sequence
  SiRNA target sequence
ggtgttaaaaccgaaatatcaaaa

SEQ ID NO: 15933 - DNA, 24 bp, Artificial sequence
  SiRNA target sequence
gtgttaaaaccgaaatatcaaaaa

SEQ ID NO: 15934 - DNA, 24 bp, Artificial sequence
  SiRNA target sequence
tgttaaaaccgaaatatcaaaaac

SEQ ID NO: 15935 - DNA, 24 bp, Artificial sequence
  SiRNA target sequence
gttaaaaccgaaatatcaaaaacc

SEQ ID NO: 15936 - DNA, 24 bp, Artificial sequence
  SiRNA target sequence
ttaaaaccgaaatatcaaaaaccg

SEQ ID NO: 15937 - DNA, 24 bp, Artificial sequence
  SiRNA target sequence
taaaaccgaaatatcaaaaaccgt

SEQ ID NO: 15938 - DNA, 24 bp, Artificial sequence
  SiRNA target sequence
aaaaccgaaatatcaaaaaccgta

SEQ ID NO: 15939 - DNA, 24 bp, Artificial sequence
  SiRNA target sequence
aaaccgaaatatcaaaaaccgtat

SEQ ID NO: 15940 - DNA, 24 bp, Artificial sequence
  SiRNA target sequence
aaccgaaatatcaaaaaccgtatc

SEQ ID NO: 15941 - DNA, 24 bp, Artificial sequence
  SiRNA target sequence
accgaaatatcaaaaaccgtatca

SEQ ID NO: 15942 - DNA, 24 bp, Artificial sequence
  SiRNA target sequence
ccgaaatatcaaaaaccgtatcac

SEQ ID NO: 15943 - DNA, 24 bp, Artificial sequence
  SiRNA target sequence
cgaaatatcaaaaaccgtatcacc

SEQ ID NO: 15944 - DNA, 24 bp, Artificial sequence
  SiRNA target sequence
gaaatatcaaaaaccgtatcacca

SEQ ID NO: 15945 - DNA, 24 bp, Artificial sequence
  SiRNA target sequence
aaatatcaaaaaccgtatcaccac

SEQ ID NO: 15946 - DNA, 24 bp, Artificial sequence
  SiRNA target sequence
aatatcaaaaaccgtatcaccaca

SEQ ID NO: 15947 - DNA, 24 bp, Artificial sequence
  SiRNA target sequence
atatcaaaaaccgtatcaccacac

SEQ ID NO: 15948 - DNA, 24 bp, Artificial sequence
  SiRNA target sequence
tatcaaaaaccgtatcaccacact

SEQ ID NO: 15949 - DNA, 24 bp, Artificial sequence
  SiRNA target sequence
atcaaaaaccgtatcaccacactt

SEQ ID NO: 15950 - DNA, 24 bp, Artificial sequence
  SiRNA target sequence
tcaaaaaccgtatcaccacacttc

SEQ ID NO: 15951 - DNA, 24 bp, Artificial sequence
  SiRNA target sequence
caaaaaccgtatcaccacacttcc

SEQ ID NO: 15952 - DNA, 24 bp, Artificial sequence
  SiRNA target sequence
aaaaaccgtatcaccacacttcca

SEQ ID NO: 15953 - DNA, 24 bp, Artificial sequence
  SiRNA target sequence
aaaaccgtatcaccacacttccag

SEQ ID NO: 15954 - DNA, 24 bp, Artificial sequence
  SiRNA target sequence
aaaccgtatcaccacacttccaga

SEQ ID NO: 15955 - DNA, 24 bp, Artificial sequence
  SiRNA target sequence
aaccgtatcaccacacttccagat

SEQ ID NO: 15956 - DNA, 24 bp, Artificial sequence
  SiRNA target sequence
accgtatcaccacacttccagatt

SEQ ID NO: 15957 - DNA, 24 bp, Artificial sequence
  SiRNA target sequence
ccgtatcaccacacttccagattt

SEQ ID NO: 15958 - DNA, 24 bp, Artificial sequence
  SiRNA target sequence
cgtatcaccacacttccagatttc

SEQ ID NO: 15959 - DNA, 24 bp, Artificial sequence
  SiRNA target sequence
gtatcaccacacttccagatttct

SEQ ID NO: 15960 - DNA, 24 bp, Artificial sequence
  SiRNA target sequence
tatcaccacacttccagatttctc

SEQ ID NO: 15961 - DNA, 24 bp, Artificial sequence
  SiRNA target sequence
atcaccacacttccagatttctca

SEQ ID NO: 15962 - DNA, 24 bp, Artificial sequence
  SiRNA target sequence
tcaccacacttccagatttctcat

SEQ ID NO: 15963 - DNA, 24 bp, Artificial sequence
  SiRNA target sequence
caccacacttccagatttctcatg

SEQ ID NO: 15964 - DNA, 24 bp, Artificial sequence
  SiRNA target sequence
accacacttccagatttctcatgt

SEQ ID NO: 15965 - DNA, 24 bp, Artificial sequence
  SiRNA target sequence
ccacacttccagatttctcatgtc

SEQ ID NO: 15966 - DNA, 24 bp, Artificial sequence
  SiRNA target sequence
cacacttccagatttctcatgtct

SEQ ID NO: 15967 - DNA, 24 bp, Artificial sequence
  SiRNA target sequence
acacttccagatttctcatgtctc

SEQ ID NO: 15968 - DNA, 24 bp, Artificial sequence
  SiRNA target sequence
cacttccagatttctcatgtctct

SEQ ID NO: 15969 - DNA, 24 bp, Artificial sequence
  SiRNA target sequence
acttccagatttctcatgtctctt

SEQ ID NO: 15970 - DNA, 24 bp, Artificial sequence
  SiRNA target sequence
cttccagatttctcatgtctcttc

SEQ ID NO: 15971 - DNA, 24 bp, Artificial sequence
  SiRNA target sequence
ttccagatttctcatgtctcttct

SEQ ID NO: 15972 - DNA, 24 bp, Artificial sequence
  SiRNA target sequence
tccagatttctcatgtctcttcta

SEQ ID NO: 15973 - DNA, 24 bp, Artificial sequence
  SiRNA target sequence
ccagatttctcatgtctcttctat

SEQ ID NO: 15974 - DNA, 24 bp, Artificial sequence
  SiRNA target sequence
cagatttctcatgtctcttctatg

SEQ ID NO: 15975 - DNA, 24 bp, Artificial sequence
  SiRNA target sequence
agatttctcatgtctcttctatgg

SEQ ID NO: 15976 - DNA, 24 bp, Artificial sequence
  SiRNA target sequence
gatttctcatgtctcttctatggg

SEQ ID NO: 15977 - DNA, 24 bp, Artificial sequence
  SiRNA target sequence
atttctcatgtctcttctatgggc

SEQ ID NO: 15978 - DNA, 24 bp, Artificial sequence
  SiRNA target sequence
tttctcatgtctcttctatgggcg

SEQ ID NO: 15979 - DNA, 24 bp, Artificial sequence
  SiRNA target sequence
ttctcatgtctcttctatgggcgc

SEQ ID NO: 15980 - DNA, 24 bp, Artificial sequence
  SiRNA target sequence
tctcatgtctcttctatgggcgca

SEQ ID NO: 15981 - DNA, 24 bp, Artificial sequence
  SiRNA target sequence
ctcatgtctcttctatgggcgcag

SEQ ID NO: 15982 - DNA, 24 bp, Artificial sequence
  SiRNA target sequence
tcatgtctcttctatgggcgcaga

SEQ ID NO: 15983 - DNA, 24 bp, Artificial sequence
  SiRNA target sequence
catgtctcttctatgggcgcagat

SEQ ID NO: 15984 - DNA, 24 bp, Artificial sequence
  SiRNA target sequence
atgtctcttctatgggcgcagatt

SEQ ID NO: 15985 - DNA, 24 bp, Artificial sequence
  SiRNA target sequence
tgtctcttctatgggcgcagattt

SEQ ID NO: 15986 - DNA, 24 bp, Artificial sequence
  SiRNA target sequence
gtctcttctatgggcgcagatttc

SEQ ID NO: 15987 - DNA, 24 bp, Artificial sequence
  SiRNA target sequence
tctcttctatgggcgcagatttcg

SEQ ID NO: 15988 - DNA, 24 bp, Artificial sequence
  SiRNA target sequence
ctcttctatgggcgcagatttcga

SEQ ID NO: 15989 - DNA, 24 bp, Artificial sequence
  SiRNA target sequence
tcttctatgggcgcagatttcgac

SEQ ID NO: 15990 - DNA, 24 bp, Artificial sequence
  SiRNA target sequence
cttctatgggcgcagatttcgaca

SEQ ID NO: 15991 - DNA, 24 bp, Artificial sequence
  SiRNA target sequence
ttctatgggcgcagatttcgacat

SEQ ID NO: 15992 - DNA, 24 bp, Artificial sequence
  SiRNA target sequence
tctatgggcgcagatttcgacata

SEQ ID NO: 15993 - DNA, 24 bp, Artificial sequence
  SiRNA target sequence
ctatgggcgcagatttcgacataa

SEQ ID NO: 15994 - DNA, 24 bp, Artificial sequence
  SiRNA target sequence
tatgggcgcagatttcgacataaa

SEQ ID NO: 15995 - DNA, 24 bp, Artificial sequence
  SiRNA target sequence
atgggcgcagatttcgacataaaa

SEQ ID NO: 15996 - DNA, 24 bp, Artificial sequence
  SiRNA target sequence
tgggcgcagatttcgacataaaac

SEQ ID NO: 15997 - DNA, 24 bp, Artificial sequence
  SiRNA target sequence
gggcgcagatttcgacataaaaca

SEQ ID NO: 15998 - DNA, 24 bp, Artificial sequence
  SiRNA target sequence
ggcgcagatttcgacataaaacag

SEQ ID NO: 15999 - DNA, 24 bp, Artificial sequence
  SiRNA target sequence
gcgcagatttcgacataaaacaga

SEQ ID NO: 16000 - DNA, 24 bp, Artificial sequence
  SiRNA target sequence
cgcagatttcgacataaaacagac

SEQ ID NO: 16001 - DNA, 24 bp, Artificial sequence
  SiRNA target sequence
gcagatttcgacataaaacagaca

SEQ ID NO: 16002 - DNA, 24 bp, Artificial sequence
  SiRNA target sequence
cagatttcgacataaaacagacat

SEQ ID NO: 16003 - DNA, 24 bp, Artificial sequence
  SiRNA target sequence
agatttcgacataaaacagacata

SEQ ID NO: 16004 - DNA, 24 bp, Artificial sequence
  SiRNA target sequence
gatttcgacataaaacagacatac

SEQ ID NO: 16005 - DNA, 24 bp, Artificial sequence
  SiRNA target sequence
atttcgacataaaacagacatacg

SEQ ID NO: 16006 - DNA, 24 bp, Artificial sequence
  SiRNA target sequence
tttcgacataaaacagacatacgc

SEQ ID NO: 16007 - DNA, 24 bp, Artificial sequence
  SiRNA target sequence
ttcgacataaaacagacatacgcc

SEQ ID NO: 16008 - DNA, 24 bp, Artificial sequence
  SiRNA target sequence
tcgacataaaacagacatacgcca

SEQ ID NO: 16009 - DNA, 24 bp, Artificial sequence
  SiRNA target sequence
cgacataaaacagacatacgccac

SEQ ID NO: 16010 - DNA, 24 bp, Artificial sequence
  SiRNA target sequence
gacataaaacagacatacgccacg

SEQ ID NO: 16011 - DNA, 24 bp, Artificial sequence
  SiRNA target sequence
acataaaacagacatacgccacgt

SEQ ID NO: 16012 - DNA, 24 bp, Artificial sequence
  SiRNA target sequence
cataaaacagacatacgccacgtt

SEQ ID NO: 16013 - DNA, 24 bp, Artificial sequence
  SiRNA target sequence
ataaaacagacatacgccacgttc

SEQ ID NO: 16014 - DNA, 24 bp, Artificial sequence
  SiRNA target sequence
taaaacagacatacgccacgttct

SEQ ID NO: 16015 - DNA, 24 bp, Artificial sequence
  SiRNA target sequence
aaaacagacatacgccacgttctg

SEQ ID NO: 16016 - DNA, 24 bp, Artificial sequence
  SiRNA target sequence
aaacagacatacgccacgttctgc

SEQ ID NO: 16017 - DNA, 24 bp, Artificial sequence
  SiRNA target sequence
aacagacatacgccacgttctgct

SEQ ID NO: 16018 - DNA, 24 bp, Artificial sequence
  SiRNA target sequence
acagacatacgccacgttctgctt

SEQ ID NO: 16019 - DNA, 24 bp, Artificial sequence
  SiRNA target sequence
cagacatacgccacgttctgcttt

SEQ ID NO: 16020 - DNA, 24 bp, Artificial sequence
  SiRNA target sequence
agacatacgccacgttctgcttta

SEQ ID NO: 16021 - DNA, 24 bp, Artificial sequence
  SiRNA target sequence
gacatacgccacgttctgctttaa

SEQ ID NO: 16022 - DNA, 24 bp, Artificial sequence
  SiRNA target sequence
acatacgccacgttctgctttaac

SEQ ID NO: 16023 - DNA, 24 bp, Artificial sequence
  SiRNA target sequence
catacgccacgttctgctttaaca

SEQ ID NO: 16024 - DNA, 24 bp, Artificial sequence
  SiRNA target sequence
atacgccacgttctgctttaacaa

SEQ ID NO: 16025 - DNA, 24 bp, Artificial sequence
  SiRNA target sequence
tacgccacgttctgctttaacaat

SEQ ID NO: 16026 - DNA, 24 bp, Artificial sequence
  SiRNA target sequence
acgccacgttctgctttaacaatc

SEQ ID NO: 16027 - DNA, 24 bp, Artificial sequence
  SiRNA target sequence
cgccacgttctgctttaacaatct

SEQ ID NO: 16028 - DNA, 24 bp, Artificial sequence
  SiRNA target sequence
gccacgttctgctttaacaatctt

SEQ ID NO: 16029 - DNA, 24 bp, Artificial sequence
  SiRNA target sequence
ccacgttctgctttaacaatcttt

SEQ ID NO: 16030 - DNA, 24 bp, Artificial sequence
  SiRNA target sequence
cacgttctgctttaacaatctttt

SEQ ID NO: 16031 - DNA, 24 bp, Artificial sequence
  SiRNA target sequence
acgttctgctttaacaatcttttg

SEQ ID NO: 16032 - DNA, 24 bp, Artificial sequence
  SiRNA target sequence
cgttctgctttaacaatcttttgc

SEQ ID NO: 16033 - DNA, 24 bp, Artificial sequence
  SiRNA target sequence
gttctgctttaacaatcttttgct

SEQ ID NO: 16034 - DNA, 24 bp, Artificial sequence
  SiRNA target sequence
ttctgctttaacaatcttttgcta

SEQ ID NO: 16035 - DNA, 24 bp, Artificial sequence
  SiRNA target sequence
tctgctttaacaatcttttgctac

SEQ ID NO: 16036 - DNA, 24 bp, Artificial sequence
  SiRNA target sequence
ctgctttaacaatcttttgctaca

SEQ ID NO: 16037 - DNA, 24 bp, Artificial sequence
  SiRNA target sequence
tgctttaacaatcttttgctacaa

SEQ ID NO: 16038 - DNA, 24 bp, Artificial sequence
  SiRNA target sequence
gctttaacaatcttttgctacaaa

SEQ ID NO: 16039 - DNA, 24 bp, Artificial sequence
  SiRNA target sequence
ctttaacaatcttttgctacaaac

SEQ ID NO: 16040 - DNA, 24 bp, Artificial sequence
  SiRNA target sequence
tttaacaatcttttgctacaaacg

SEQ ID NO: 16041 - DNA, 24 bp, Artificial sequence
  SiRNA target sequence
ttaacaatcttttgctacaaacga

SEQ ID NO: 16042 - DNA, 24 bp, Artificial sequence
  SiRNA target sequence
taacaatcttttgctacaaacgag

SEQ ID NO: 16043 - DNA, 24 bp, Artificial sequence
  SiRNA target sequence
aacaatcttttgctacaaacgagc

SEQ ID NO: 16044 - DNA, 24 bp, Artificial sequence
  SiRNA target sequence
acaatcttttgctacaaacgagca

SEQ ID NO: 16045 - DNA, 24 bp, Artificial sequence
  SiRNA target sequence
caatcttttgctacaaacgagcat

SEQ ID NO: 16046 - DNA, 24 bp, Artificial sequence
  SiRNA target sequence
aatcttttgctacaaacgagcata

SEQ ID NO: 16047 - DNA, 24 bp, Artificial sequence
  SiRNA target sequence
atcttttgctacaaacgagcatag

SEQ ID NO: 16048 - DNA, 24 bp, Artificial sequence
  SiRNA target sequence
tcttttgctacaaacgagcataga

SEQ ID NO: 16049 - DNA, 24 bp, Artificial sequence
  SiRNA target sequence
cttttgctacaaacgagcatagac

SEQ ID NO: 16050 - DNA, 24 bp, Artificial sequence
  SiRNA target sequence
ttttgctacaaacgagcatagacc

SEQ ID NO: 16051 - DNA, 24 bp, Artificial sequence
  SiRNA target sequence
tttgctacaaacgagcatagacca

SEQ ID NO: 16052 - DNA, 24 bp, Artificial sequence
  SiRNA target sequence
ttgctacaaacgagcatagaccaa

SEQ ID NO: 16053 - DNA, 24 bp, Artificial sequence
  SiRNA target sequence
tgctacaaacgagcatagaccaag

SEQ ID NO: 16054 - DNA, 24 bp, Artificial sequence
  SiRNA target sequence
gctacaaacgagcatagaccaaga

SEQ ID NO: 16055 - DNA, 24 bp, Artificial sequence
  SiRNA target sequence
ctacaaacgagcatagaccaagac

SEQ ID NO: 16056 - DNA, 24 bp, Artificial sequence
  SiRNA target sequence
tacaaacgagcatagaccaagaca

SEQ ID NO: 16057 - DNA, 24 bp, Artificial sequence
  SiRNA target sequence
acaaacgagcatagaccaagacaa

SEQ ID NO: 16058 - DNA, 24 bp, Artificial sequence
  SiRNA target sequence
caaacgagcatagaccaagacaaa

SEQ ID NO: 16059 - DNA, 24 bp, Artificial sequence
  SiRNA target sequence
aaacgagcatagaccaagacaaaa

SEQ ID NO: 16060 - DNA, 24 bp, Artificial sequence
  SiRNA target sequence
aacgagcatagaccaagacaaaat

SEQ ID NO: 16061 - DNA, 24 bp, Artificial sequence
  SiRNA target sequence
acgagcatagaccaagacaaaata

SEQ ID NO: 16062 - DNA, 24 bp, Artificial sequence
  SiRNA target sequence
cgagcatagaccaagacaaaatat

SEQ ID NO: 16063 - DNA, 24 bp, Artificial sequence
  SiRNA target sequence
gagcatagaccaagacaaaatatt

SEQ ID NO: 16064 - DNA, 24 bp, Artificial sequence
  SiRNA target sequence
agcatagaccaagacaaaatattt

SEQ ID NO: 16065 - DNA, 24 bp, Artificial sequence
  SiRNA target sequence
gcatagaccaagacaaaatattta

SEQ ID NO: 16066 - DNA, 24 bp, Artificial sequence
  SiRNA target sequence
catagaccaagacaaaatatttag

SEQ ID NO: 16067 - DNA, 24 bp, Artificial sequence
  SiRNA target sequence
atagaccaagacaaaatatttaga

SEQ ID NO: 16068 - DNA, 24 bp, Artificial sequence
  SiRNA target sequence
tagaccaagacaaaatatttagaa

SEQ ID NO: 16069 - DNA, 24 bp, Artificial sequence
  SiRNA target sequence
agaccaagacaaaatatttagaat

SEQ ID NO: 16070 - DNA, 24 bp, Artificial sequence
  SiRNA target sequence
gaccaagacaaaatatttagaata

SEQ ID NO: 16071 - DNA, 24 bp, Artificial sequence
  SiRNA target sequence
accaagacaaaatatttagaataa

SEQ ID NO: 16072 - DNA, 24 bp, Artificial sequence
  SiRNA target sequence
ccaagacaaaatatttagaataag

SEQ ID NO: 16073 - DNA, 24 bp, Artificial sequence
  SiRNA target sequence
caagacaaaatatttagaataaga

SEQ ID NO: 16074 - DNA, 24 bp, Artificial sequence
  SiRNA target sequence
aagacaaaatatttagaataagag

SEQ ID NO: 16075 - DNA, 24 bp, Artificial sequence
  SiRNA target sequence
agacaaaatatttagaataagagg

SEQ ID NO: 16076 - DNA, 24 bp, Artificial sequence
  SiRNA target sequence
gacaaaatatttagaataagaggt

SEQ ID NO: 16077 - DNA, 24 bp, Artificial sequence
  SiRNA target sequence
acaaaatatttagaataagaggta

SEQ ID NO: 16078 - DNA, 24 bp, Artificial sequence
  SiRNA target sequence
caaaatatttagaataagaggtac

SEQ ID NO: 16079 - DNA, 24 bp, Artificial sequence
  SiRNA target sequence
aaaatatttagaataagaggtacc

SEQ ID NO: 16080 - DNA, 24 bp, Artificial sequence
  SiRNA target sequence
aaatatttagaataagaggtaccc

SEQ ID NO: 16081 - DNA, 24 bp, Artificial sequence
  SiRNA target sequence
aatatttagaataagaggtaccca

SEQ ID NO: 16082 - DNA, 24 bp, Artificial sequence
  SiRNA target sequence
atatttagaataagaggtacccac

SEQ ID NO: 16083 - DNA, 24 bp, Artificial sequence
  SiRNA target sequence
tatttagaataagaggtacccaca

SEQ ID NO: 16084 - DNA, 24 bp, Artificial sequence
  SiRNA target sequence
atttagaataagaggtacccacat

SEQ ID NO: 16085 - DNA, 24 bp, Artificial sequence
  SiRNA target sequence
tttagaataagaggtacccacatg

SEQ ID NO: 16086 - DNA, 24 bp, Artificial sequence
  SiRNA target sequence
ttagaataagaggtacccacatgt

SEQ ID NO: 16087 - DNA, 24 bp, Artificial sequence
  SiRNA target sequence
tagaataagaggtacccacatgtt

SEQ ID NO: 16088 - DNA, 24 bp, Artificial sequence
  SiRNA target sequence
agaataagaggtacccacatgttt

SEQ ID NO: 16089 - DNA, 24 bp, Artificial sequence
  SiRNA target sequence
gaataagaggtacccacatgttta

SEQ ID NO: 16090 - DNA, 24 bp, Artificial sequence
  SiRNA target sequence
aataagaggtacccacatgtttaa

SEQ ID NO: 16091 - DNA, 24 bp, Artificial sequence
  SiRNA target sequence
ataagaggtacccacatgtttaaa

SEQ ID NO: 16092 - DNA, 24 bp, Artificial sequence
  SiRNA target sequence
taagaggtacccacatgtttaaaa

SEQ ID NO: 16093 - DNA, 24 bp, Artificial sequence
  SiRNA target sequence
aagaggtacccacatgtttaaaaa

SEQ ID NO: 16094 - DNA, 24 bp, Artificial sequence
  SiRNA target sequence
agaggtacccacatgtttaaaaat

SEQ ID NO: 16095 - DNA, 24 bp, Artificial sequence
  SiRNA target sequence
gaggtacccacatgtttaaaaatc

SEQ ID NO: 16096 - DNA, 24 bp, Artificial sequence
  SiRNA target sequence
aggtacccacatgtttaaaaatct

SEQ ID NO: 16097 - DNA, 24 bp, Artificial sequence
  SiRNA target sequence
ggtacccacatgtttaaaaatcta

SEQ ID NO: 16098 - DNA, 24 bp, Artificial sequence
  SiRNA target sequence
gtacccacatgtttaaaaatctac

SEQ ID NO: 16099 - DNA, 24 bp, Artificial sequence
  SiRNA target sequence
tacccacatgtttaaaaatctact

SEQ ID NO: 16100 - DNA, 24 bp, Artificial sequence
  SiRNA target sequence
acccacatgtttaaaaatctactt

SEQ ID NO: 16101 - DNA, 24 bp, Artificial sequence
  SiRNA target sequence
cccacatgtttaaaaatctactta

SEQ ID NO: 16102 - DNA, 24 bp, Artificial sequence
  SiRNA target sequence
ccacatgtttaaaaatctacttac

SEQ ID NO: 16103 - DNA, 24 bp, Artificial sequence
  SiRNA target sequence
cacatgtttaaaaatctacttact

SEQ ID NO: 16104 - DNA, 24 bp, Artificial sequence
  SiRNA target sequence
acatgtttaaaaatctacttacta

SEQ ID NO: 16105 - DNA, 24 bp, Artificial sequence
  SiRNA target sequence
catgtttaaaaatctacttactaa

SEQ ID NO: 16106 - DNA, 24 bp, Artificial sequence
  SiRNA target sequence
atgtttaaaaatctacttactaaa

SEQ ID NO: 16107 - DNA, 24 bp, Artificial sequence
  SiRNA target sequence
tgtttaaaaatctacttactaaat

SEQ ID NO: 16108 - DNA, 24 bp, Artificial sequence
  SiRNA target sequence
gtttaaaaatctacttactaaatt

SEQ ID NO: 16109 - DNA, 24 bp, Artificial sequence
  SiRNA target sequence
tttaaaaatctacttactaaattc

SEQ ID NO: 16110 - DNA, 24 bp, Artificial sequence
  SiRNA target sequence
ttaaaaatctacttactaaattcc

SEQ ID NO: 16111 - DNA, 24 bp, Artificial sequence
  SiRNA target sequence
taaaaatctacttactaaattcca

SEQ ID NO: 16112 - DNA, 24 bp, Artificial sequence
  SiRNA target sequence
aaaaatctacttactaaattccat

SEQ ID NO: 16113 - DNA, 24 bp, Artificial sequence
  SiRNA target sequence
aaaatctacttactaaattccata

SEQ ID NO: 16114 - DNA, 24 bp, Artificial sequence
  SiRNA target sequence
aaatctacttactaaattccatac

SEQ ID NO: 16115 - DNA, 24 bp, Artificial sequence
  SiRNA target sequence
aatctacttactaaattccataca

SEQ ID NO: 16116 - DNA, 24 bp, Artificial sequence
  SiRNA target sequence
atctacttactaaattccatacag

SEQ ID NO: 16117 - DNA, 24 bp, Artificial sequence
  SiRNA target sequence
tctacttactaaattccatacagt

SEQ ID NO: 16118 - DNA, 24 bp, Artificial sequence
  SiRNA target sequence
ctacttactaaattccatacagta

SEQ ID NO: 16119 - DNA, 24 bp, Artificial sequence
  SiRNA target sequence
tacttactaaattccatacagtaa

SEQ ID NO: 16120 - DNA, 24 bp, Artificial sequence
  SiRNA target sequence
acttactaaattccatacagtaat

SEQ ID NO: 16121 - DNA, 24 bp, Artificial sequence
  SiRNA target sequence
cttactaaattccatacagtaatt

SEQ ID NO: 16122 - DNA, 24 bp, Artificial sequence
  SiRNA target sequence
ttactaaattccatacagtaattg

SEQ ID NO: 16123 - DNA, 24 bp, Artificial sequence
  SiRNA target sequence
tactaaattccatacagtaattgg

SEQ ID NO: 16124 - DNA, 24 bp, Artificial sequence
  SiRNA target sequence
actaaattccatacagtaattggt

SEQ ID NO: 16125 - DNA, 24 bp, Artificial sequence
  SiRNA target sequence
ctaaattccatacagtaattggta

SEQ ID NO: 16126 - DNA, 24 bp, Artificial sequence
  SiRNA target sequence
taaattccatacagtaattggtag

SEQ ID NO: 16127 - DNA, 24 bp, Artificial sequence
  SiRNA target sequence
aaattccatacagtaattggtaga

SEQ ID NO: 16128 - DNA, 24 bp, Artificial sequence
  SiRNA target sequence
aattccatacagtaattggtagaa

SEQ ID NO: 16129 - DNA, 24 bp, Artificial sequence
  SiRNA target sequence
attccatacagtaattggtagaag

SEQ ID NO: 16130 - DNA, 24 bp, Artificial sequence
  SiRNA target sequence
ttccatacagtaattggtagaagt

SEQ ID NO: 16131 - DNA, 24 bp, Artificial sequence
  SiRNA target sequence
tccatacagtaattggtagaagta

SEQ ID NO: 16132 - DNA, 24 bp, Artificial sequence
  SiRNA target sequence
ccatacagtaattggtagaagtaa

SEQ ID NO: 16133 - DNA, 24 bp, Artificial sequence
  SiRNA target sequence
catacagtaattggtagaagtaaa

SEQ ID NO: 16134 - DNA, 24 bp, Artificial sequence
  SiRNA target sequence
atacagtaattggtagaagtaaag

SEQ ID NO: 16135 - DNA, 24 bp, Artificial sequence
  SiRNA target sequence
tacagtaattggtagaagtaaaga

SEQ ID NO: 16136 - DNA, 24 bp, Artificial sequence
  SiRNA target sequence
acagtaattggtagaagtaaagat

SEQ ID NO: 16137 - DNA, 24 bp, Artificial sequence
  SiRNA target sequence
cagtaattggtagaagtaaagata

SEQ ID NO: 16138 - DNA, 24 bp, Artificial sequence
  SiRNA target sequence
agtaattggtagaagtaaagatat

SEQ ID NO: 16139 - DNA, 24 bp, Artificial sequence
  SiRNA target sequence
gtaattggtagaagtaaagatatc

SEQ ID NO: 16140 - DNA, 24 bp, Artificial sequence
  SiRNA target sequence
taattggtagaagtaaagatatct

SEQ ID NO: 16141 - DNA, 24 bp, Artificial sequence
  SiRNA target sequence
aattggtagaagtaaagatatctt

SEQ ID NO: 16142 - DNA, 24 bp, Artificial sequence
  SiRNA target sequence
attggtagaagtaaagatatcttt

SEQ ID NO: 16143 - DNA, 24 bp, Artificial sequence
  SiRNA target sequence
ttggtagaagtaaagatatcttta

SEQ ID NO: 16144 - DNA, 24 bp, Artificial sequence
  SiRNA target sequence
tggtagaagtaaagatatctttac

SEQ ID NO: 16145 - DNA, 24 bp, Artificial sequence
  SiRNA target sequence
ggtagaagtaaagatatctttaca

SEQ ID NO: 16146 - DNA, 24 bp, Artificial sequence
  SiRNA target sequence
gtagaagtaaagatatctttacac

SEQ ID NO: 16147 - DNA, 24 bp, Artificial sequence
  SiRNA target sequence
tagaagtaaagatatctttacaca

SEQ ID NO: 16148 - DNA, 24 bp, Artificial sequence
  SiRNA target sequence
agaagtaaagatatctttacacaa

SEQ ID NO: 16149 - DNA, 24 bp, Artificial sequence
  SiRNA target sequence
gaagtaaagatatctttacacaaa

SEQ ID NO: 16150 - DNA, 24 bp, Artificial sequence
  SiRNA target sequence
aagtaaagatatctttacacaaat

SEQ ID NO: 16151 - DNA, 24 bp, Artificial sequence
  SiRNA target sequence
agtaaagatatctttacacaaata

SEQ ID NO: 16152 - DNA, 24 bp, Artificial sequence
  SiRNA target sequence
gtaaagatatctttacacaaatag

SEQ ID NO: 16153 - DNA, 24 bp, Artificial sequence
  SiRNA target sequence
taaagatatctttacacaaataga

SEQ ID NO: 16154 - DNA, 24 bp, Artificial sequence
  SiRNA target sequence
aaagatatctttacacaaatagag

SEQ ID NO: 16155 - DNA, 24 bp, Artificial sequence
  SiRNA target sequence
aagatatctttacacaaatagagg

SEQ ID NO: 16156 - DNA, 24 bp, Artificial sequence
  SiRNA target sequence
agatatctttacacaaatagaggt

SEQ ID NO: 16157 - DNA, 24 bp, Artificial sequence
  SiRNA target sequence
gatatctttacacaaatagaggta

SEQ ID NO: 16158 - DNA, 24 bp, Artificial sequence
  SiRNA target sequence
atatctttacacaaatagaggtag

SEQ ID NO: 16159 - DNA, 24 bp, Artificial sequence
  SiRNA target sequence
tatctttacacaaatagaggtaga

SEQ ID NO: 16160 - DNA, 24 bp, Artificial sequence
  SiRNA target sequence
atctttacacaaatagaggtagac

SEQ ID NO: 16161 - DNA, 24 bp, Artificial sequence
  SiRNA target sequence
tctttacacaaatagaggtagaca

SEQ ID NO: 16162 - DNA, 24 bp, Artificial sequence
  SiRNA target sequence
ctttacacaaatagaggtagacat

SEQ ID NO: 16163 - DNA, 24 bp, Artificial sequence
  SiRNA target sequence
tttacacaaatagaggtagacata

SEQ ID NO: 16164 - DNA, 24 bp, Artificial sequence
  SiRNA target sequence
ttacacaaatagaggtagacataa

SEQ ID NO: 16165 - DNA, 24 bp, Artificial sequence
  SiRNA target sequence
tacacaaatagaggtagacataaa

SEQ ID NO: 16166 - DNA, 24 bp, Artificial sequence
  SiRNA target sequence
acacaaatagaggtagacataaaa

SEQ ID NO: 16167 - DNA, 24 bp, Artificial sequence
  SiRNA target sequence
cacaaatagaggtagacataaaaa

SEQ ID NO: 16168 - DNA, 24 bp, Artificial sequence
  SiRNA target sequence
acaaatagaggtagacataaaaaa

SEQ ID NO: 16169 - DNA, 24 bp, Artificial sequence
  SiRNA target sequence
caaatagaggtagacataaaaaat

SEQ ID NO: 16170 - DNA, 24 bp, Artificial sequence
  SiRNA target sequence
aaatagaggtagacataaaaaata

SEQ ID NO: 16171 - DNA, 24 bp, Artificial sequence
  SiRNA target sequence
aatagaggtagacataaaaaataa

SEQ ID NO: 16172 - DNA, 24 bp, Artificial sequence
  SiRNA target sequence
atagaggtagacataaaaaataaa

SEQ ID NO: 16173 - DNA, 24 bp, Artificial sequence
  SiRNA target sequence
tagaggtagacataaaaaataaat

SEQ ID NO: 16174 - DNA, 24 bp, Artificial sequence
  SiRNA target sequence
agaggtagacataaaaaataaata

SEQ ID NO: 16175 - DNA, 24 bp, Artificial sequence
  SiRNA target sequence
gaggtagacataaaaaataaatac

SEQ ID NO: 16176 - DNA, 24 bp, Artificial sequence
  SiRNA target sequence
aggtagacataaaaaataaataca

SEQ ID NO: 16177 - DNA, 24 bp, Artificial sequence
  SiRNA target sequence
ggtagacataaaaaataaatacaa

SEQ ID NO: 16178 - DNA, 24 bp, Artificial sequence
  SiRNA target sequence
gtagacataaaaaataaatacaat

SEQ ID NO: 16179 - DNA, 24 bp, Artificial sequence
  SiRNA target sequence
tagacataaaaaataaatacaata

SEQ ID NO: 16180 - DNA, 24 bp, Artificial sequence
  SiRNA target sequence
agacataaaaaataaatacaataa

SEQ ID NO: 16181 - DNA, 24 bp, Artificial sequence
  SiRNA target sequence
gacataaaaaataaatacaataat

SEQ ID NO: 16182 - DNA, 24 bp, Artificial sequence
  SiRNA target sequence
acataaaaaataaatacaataata

SEQ ID NO: 16183 - DNA, 24 bp, Artificial sequence
  SiRNA target sequence
cataaaaaataaatacaataatat

SEQ ID NO: 16184 - DNA, 24 bp, Artificial sequence
  SiRNA target sequence
ataaaaaataaatacaataatatg

SEQ ID NO: 16185 - DNA, 24 bp, Artificial sequence
  SiRNA target sequence
taaaaaataaatacaataatatgt

SEQ ID NO: 16186 - DNA, 24 bp, Artificial sequence
  SiRNA target sequence
aaaaaataaatacaataatatgtg

SEQ ID NO: 16187 - DNA, 24 bp, Artificial sequence
  SiRNA target sequence
aaaaataaatacaataatatgtgt

SEQ ID NO: 16188 - DNA, 24 bp, Artificial sequence
  SiRNA target sequence
aaaataaatacaataatatgtgta

SEQ ID NO: 16189 - DNA, 24 bp, Artificial sequence
  SiRNA target sequence
aaataaatacaataatatgtgtat

SEQ ID NO: 16190 - DNA, 24 bp, Artificial sequence
  SiRNA target sequence
aataaatacaataatatgtgtata

SEQ ID NO: 16191 - DNA, 24 bp, Artificial sequence
  SiRNA target sequence
ataaatacaataatatgtgtataa

SEQ ID NO: 16192 - DNA, 24 bp, Artificial sequence
  SiRNA target sequence
taaatacaataatatgtgtataaa

SEQ ID NO: 16193 - DNA, 24 bp, Artificial sequence
  SiRNA target sequence
aaatacaataatatgtgtataaaa

SEQ ID NO: 16194 - DNA, 24 bp, Artificial sequence
  SiRNA target sequence
aatacaataatatgtgtataaaaa

SEQ ID NO: 16195 - DNA, 24 bp, Artificial sequence
  SiRNA target sequence
atacaataatatgtgtataaaaat

SEQ ID NO: 16196 - DNA, 24 bp, Artificial sequence
  SiRNA target sequence
tacaataatatgtgtataaaaatg

SEQ ID NO: 16197 - DNA, 24 bp, Artificial sequence
  SiRNA target sequence
acaataatatgtgtataaaaatga

SEQ ID NO: 16198 - DNA, 24 bp, Artificial sequence
  SiRNA target sequence
caataatatgtgtataaaaatgat

SEQ ID NO: 16199 - DNA, 24 bp, Artificial sequence
  SiRNA target sequence
aataatatgtgtataaaaatgata

SEQ ID NO: 16200 - DNA, 24 bp, Artificial sequence
  SiRNA target sequence
ataatatgtgtataaaaatgatac

SEQ ID NO: 16201 - DNA, 24 bp, Artificial sequence
  SiRNA target sequence
taatatgtgtataaaaatgataca

SEQ ID NO: 16202 - DNA, 24 bp, Artificial sequence
  SiRNA target sequence
aatatgtgtataaaaatgatacag

SEQ ID NO: 16203 - DNA, 24 bp, Artificial sequence
  SiRNA target sequence
atatgtgtataaaaatgatacagc

SEQ ID NO: 16204 - DNA, 24 bp, Artificial sequence
  SiRNA target sequence
tatgtgtataaaaatgatacagcc

SEQ ID NO: 16205 - DNA, 24 bp, Artificial sequence
  SiRNA target sequence
atgtgtataaaaatgatacagcca

SEQ ID NO: 16206 - DNA, 24 bp, Artificial sequence
  SiRNA target sequence
tgtgtataaaaatgatacagccag

SEQ ID NO: 16207 - DNA, 24 bp, Artificial sequence
  SiRNA target sequence
gtgtataaaaatgatacagccagc

SEQ ID NO: 16208 - DNA, 24 bp, Artificial sequence
  SiRNA target sequence
tgtataaaaatgatacagccagct

SEQ ID NO: 16209 - DNA, 24 bp, Artificial sequence
  SiRNA target sequence
gtataaaaatgatacagccagcta

SEQ ID NO: 16210 - DNA, 24 bp, Artificial sequence
  SiRNA target sequence
tataaaaatgatacagccagctat

SEQ ID NO: 16211 - DNA, 24 bp, Artificial sequence
  SiRNA target sequence
ataaaaatgatacagccagctatt

SEQ ID NO: 16212 - DNA, 24 bp, Artificial sequence
  SiRNA target sequence
taaaaatgatacagccagctatta

SEQ ID NO: 16213 - DNA, 24 bp, Artificial sequence
  SiRNA target sequence
aaaaatgatacagccagctattaa

SEQ ID NO: 16214 - DNA, 24 bp, Artificial sequence
  SiRNA target sequence
aaaatgatacagccagctattaaa

SEQ ID NO: 16215 - DNA, 24 bp, Artificial sequence
  SiRNA target sequence
aaatgatacagccagctattaaag

SEQ ID NO: 16216 - DNA, 24 bp, Artificial sequence
  SiRNA target sequence
aatgatacagccagctattaaagg

SEQ ID NO: 16217 - DNA, 24 bp, Artificial sequence
  SiRNA target sequence
atgatacagccagctattaaaggt

SEQ ID NO: 16218 - DNA, 24 bp, Artificial sequence
  SiRNA target sequence
tgatacagccagctattaaaggtg

SEQ ID NO: 16219 - DNA, 24 bp, Artificial sequence
  SiRNA target sequence
gatacagccagctattaaaggtgc

SEQ ID NO: 16220 - DNA, 24 bp, Artificial sequence
  SiRNA target sequence
atacagccagctattaaaggtgct

SEQ ID NO: 16221 - DNA, 24 bp, Artificial sequence
  SiRNA target sequence
tacagccagctattaaaggtgctt

SEQ ID NO: 16222 - DNA, 24 bp, Artificial sequence
  SiRNA target sequence
acagccagctattaaaggtgcttc

SEQ ID NO: 16223 - DNA, 24 bp, Artificial sequence
  SiRNA target sequence
cagccagctattaaaggtgcttca

SEQ ID NO: 16224 - DNA, 24 bp, Artificial sequence
  SiRNA target sequence
agccagctattaaaggtgcttcat

SEQ ID NO: 16225 - DNA, 24 bp, Artificial sequence
  SiRNA target sequence
gccagctattaaaggtgcttcatg

SEQ ID NO: 16226 - DNA, 24 bp, Artificial sequence
  SiRNA target sequence
ccagctattaaaggtgcttcatgt

SEQ ID NO: 16227 - DNA, 24 bp, Artificial sequence
  SiRNA target sequence
cagctattaaaggtgcttcatgta

SEQ ID NO: 16228 - DNA, 24 bp, Artificial sequence
  SiRNA target sequence
agctattaaaggtgcttcatgtat

SEQ ID NO: 16229 - DNA, 24 bp, Artificial sequence
  SiRNA target sequence
gctattaaaggtgcttcatgtata

SEQ ID NO: 16230 - DNA, 24 bp, Artificial sequence
  SiRNA target sequence
ctattaaaggtgcttcatgtatat

SEQ ID NO: 16231 - DNA, 24 bp, Artificial sequence
  SiRNA target sequence
tattaaaggtgcttcatgtatata

SEQ ID NO: 16232 - DNA, 24 bp, Artificial sequence
  SiRNA target sequence
attaaaggtgcttcatgtatatac

SEQ ID NO: 16233 - DNA, 24 bp, Artificial sequence
  SiRNA target sequence
ttaaaggtgcttcatgtatatacg

SEQ ID NO: 16234 - DNA, 24 bp, Artificial sequence
  SiRNA target sequence
taaaggtgcttcatgtatatacgt

SEQ ID NO: 16235 - DNA, 24 bp, Artificial sequence
  SiRNA target sequence
aaaggtgcttcatgtatatacgtg

SEQ ID NO: 16236 - DNA, 24 bp, Artificial sequence
  SiRNA target sequence
aaggtgcttcatgtatatacgtgg

SEQ ID NO: 16237 - DNA, 24 bp, Artificial sequence
  SiRNA target sequence
aggtgcttcatgtatatacgtggg

SEQ ID NO: 16238 - DNA, 24 bp, Artificial sequence
  SiRNA target sequence
ggtgcttcatgtatatacgtgggt

SEQ ID NO: 16239 - DNA, 24 bp, Artificial sequence
  SiRNA target sequence
gtgcttcatgtatatacgtgggta

SEQ ID NO: 16240 - DNA, 24 bp, Artificial sequence
  SiRNA target sequence
tgcttcatgtatatacgtgggtaa

SEQ ID NO: 16241 - DNA, 24 bp, Artificial sequence
  SiRNA target sequence
gcttcatgtatatacgtgggtaat

SEQ ID NO: 16242 - DNA, 24 bp, Artificial sequence
  SiRNA target sequence
cttcatgtatatacgtgggtaatt

SEQ ID NO: 16243 - DNA, 24 bp, Artificial sequence
  SiRNA target sequence
ttcatgtatatacgtgggtaatta

SEQ ID NO: 16244 - DNA, 24 bp, Artificial sequence
  SiRNA target sequence
tcatgtatatacgtgggtaattat

SEQ ID NO: 16245 - DNA, 24 bp, Artificial sequence
  SiRNA target sequence
catgtatatacgtgggtaattata

SEQ ID NO: 16246 - DNA, 24 bp, Artificial sequence
  SiRNA target sequence
atgtatatacgtgggtaattatat

SEQ ID NO: 16247 - DNA, 24 bp, Artificial sequence
  SiRNA target sequence
tgtatatacgtgggtaattatatg

SEQ ID NO: 16248 - DNA, 24 bp, Artificial sequence
  SiRNA target sequence
gtatatacgtgggtaattatatgc

SEQ ID NO: 16249 - DNA, 24 bp, Artificial sequence
  SiRNA target sequence
tatatacgtgggtaattatatgca

SEQ ID NO: 16250 - DNA, 24 bp, Artificial sequence
  SiRNA target sequence
atatacgtgggtaattatatgcag

SEQ ID NO: 16251 - DNA, 24 bp, Artificial sequence
  SiRNA target sequence
tatacgtgggtaattatatgcagc

SEQ ID NO: 16252 - DNA, 24 bp, Artificial sequence
  SiRNA target sequence
atacgtgggtaattatatgcagca

SEQ ID NO: 16253 - DNA, 24 bp, Artificial sequence
  SiRNA target sequence
tacgtgggtaattatatgcagcag

SEQ ID NO: 16254 - DNA, 24 bp, Artificial sequence
  SiRNA target sequence
acgtgggtaattatatgcagcagc

SEQ ID NO: 16255 - DNA, 24 bp, Artificial sequence
  SiRNA target sequence
cgtgggtaattatatgcagcagct

SEQ ID NO: 16256 - DNA, 24 bp, Artificial sequence
  SiRNA target sequence
gtgggtaattatatgcagcagcta

SEQ ID NO: 16257 - DNA, 24 bp, Artificial sequence
  SiRNA target sequence
tgggtaattatatgcagcagctag

SEQ ID NO: 16258 - DNA, 24 bp, Artificial sequence
  SiRNA target sequence
gggtaattatatgcagcagctagg

SEQ ID NO: 16259 - DNA, 24 bp, Artificial sequence
  SiRNA target sequence
ggtaattatatgcagcagctagga

SEQ ID NO: 16260 - DNA, 24 bp, Artificial sequence
  SiRNA target sequence
gtaattatatgcagcagctaggag

SEQ ID NO: 16261 - DNA, 24 bp, Artificial sequence
  SiRNA target sequence
taattatatgcagcagctaggagt

SEQ ID NO: 16262 - DNA, 24 bp, Artificial sequence
  SiRNA target sequence
aattatatgcagcagctaggagta

SEQ ID NO: 16263 - DNA, 24 bp, Artificial sequence
  SiRNA target sequence
attatatgcagcagctaggagtaa

SEQ ID NO: 16264 - DNA, 24 bp, Artificial sequence
  SiRNA target sequence
ttatatgcagcagctaggagtaat

SEQ ID NO: 16265 - DNA, 24 bp, Artificial sequence
  SiRNA target sequence
tatatgcagcagctaggagtaatt

SEQ ID NO: 16266 - DNA, 24 bp, Artificial sequence
  SiRNA target sequence
atatgcagcagctaggagtaatta

SEQ ID NO: 16267 - DNA, 24 bp, Artificial sequence
  SiRNA target sequence
tatgcagcagctaggagtaattag

SEQ ID NO: 16268 - DNA, 24 bp, Artificial sequence
  SiRNA target sequence
atgcagcagctaggagtaattagt

SEQ ID NO: 16269 - DNA, 24 bp, Artificial sequence
  SiRNA target sequence
tgcagcagctaggagtaattagtc

SEQ ID NO: 16270 - DNA, 24 bp, Artificial sequence
  SiRNA target sequence
gcagcagctaggagtaattagtct

SEQ ID NO: 16271 - DNA, 24 bp, Artificial sequence
  SiRNA target sequence
cagcagctaggagtaattagtctt

SEQ ID NO: 16272 - DNA, 24 bp, Artificial sequence
  SiRNA target sequence
agcagctaggagtaattagtcttg

SEQ ID NO: 16273 - DNA, 24 bp, Artificial sequence
  SiRNA target sequence
gcagctaggagtaattagtcttgg

SEQ ID NO: 16274 - DNA, 24 bp, Artificial sequence
  SiRNA target sequence
cagctaggagtaattagtcttggt

SEQ ID NO: 16275 - DNA, 24 bp, Artificial sequence
  SiRNA target sequence
agctaggagtaattagtcttggtg

SEQ ID NO: 16276 - DNA, 24 bp, Artificial sequence
  SiRNA target sequence
gctaggagtaattagtcttggtgg

SEQ ID NO: 16277 - DNA, 24 bp, Artificial sequence
  SiRNA target sequence
ctaggagtaattagtcttggtggg

SEQ ID NO: 16278 - DNA, 24 bp, Artificial sequence
  SiRNA target sequence
taggagtaattagtcttggtgggg

SEQ ID NO: 16279 - DNA, 24 bp, Artificial sequence
  SiRNA target sequence
aggagtaattagtcttggtgggga

SEQ ID NO: 16280 - DNA, 24 bp, Artificial sequence
  SiRNA target sequence
ggagtaattagtcttggtggggag

SEQ ID NO: 16281 - DNA, 24 bp, Artificial sequence
  SiRNA target sequence
gagtaattagtcttggtggggaga

SEQ ID NO: 16282 - DNA, 24 bp, Artificial sequence
  SiRNA target sequence
agtaattagtcttggtggggagat

SEQ ID NO: 16283 - DNA, 24 bp, Artificial sequence
  SiRNA target sequence
gtaattagtcttggtggggagatt

SEQ ID NO: 16284 - DNA, 24 bp, Artificial sequence
  SiRNA target sequence
taattagtcttggtggggagatta

SEQ ID NO: 16285 - DNA, 24 bp, Artificial sequence
  SiRNA target sequence
aattagtcttggtggggagattat

SEQ ID NO: 16286 - DNA, 24 bp, Artificial sequence
  SiRNA target sequence
attagtcttggtggggagattatt

SEQ ID NO: 16287 - DNA, 24 bp, Artificial sequence
  SiRNA target sequence
ttagtcttggtggggagattatta

SEQ ID NO: 16288 - DNA, 24 bp, Artificial sequence
  SiRNA target sequence
tagtcttggtggggagattattaa

SEQ ID NO: 16289 - DNA, 24 bp, Artificial sequence
  SiRNA target sequence
agtcttggtggggagattattaaa

SEQ ID NO: 16290 - DNA, 24 bp, Artificial sequence
  SiRNA target sequence
gtcttggtggggagattattaaag

SEQ ID NO: 16291 - DNA, 24 bp, Artificial sequence
  SiRNA target sequence
tcttggtggggagattattaaagc

SEQ ID NO: 16292 - DNA, 24 bp, Artificial sequence
  SiRNA target sequence
cttggtggggagattattaaagct

SEQ ID NO: 16293 - DNA, 24 bp, Artificial sequence
  SiRNA target sequence
ttggtggggagattattaaagctg

SEQ ID NO: 16294 - DNA, 24 bp, Artificial sequence
  SiRNA target sequence
tggtggggagattattaaagctga

SEQ ID NO: 16295 - DNA, 24 bp, Artificial sequence
  SiRNA target sequence
ggtggggagattattaaagctgat

SEQ ID NO: 16296 - DNA, 24 bp, Artificial sequence
  SiRNA target sequence
gtggggagattattaaagctgatg

SEQ ID NO: 16297 - DNA, 24 bp, Artificial sequence
  SiRNA target sequence
tggggagattattaaagctgatga

SEQ ID NO: 16298 - DNA, 24 bp, Artificial sequence
  SiRNA target sequence
ggggagattattaaagctgatgaa

SEQ ID NO: 16299 - DNA, 24 bp, Artificial sequence
  SiRNA target sequence
gggagattattaaagctgatgaat

SEQ ID NO: 16300 - DNA, 24 bp, Artificial sequence
  SiRNA target sequence
ggagattattaaagctgatgaata

SEQ ID NO: 16301 - DNA, 24 bp, Artificial sequence
  SiRNA target sequence
gagattattaaagctgatgaatac

SEQ ID NO: 16302 - DNA, 24 bp, Artificial sequence
  SiRNA target sequence
agattattaaagctgatgaataca

SEQ ID NO: 16303 - DNA, 24 bp, Artificial sequence
  SiRNA target sequence
gattattaaagctgatgaatacat

SEQ ID NO: 16304 - DNA, 24 bp, Artificial sequence
  SiRNA target sequence
attattaaagctgatgaatacatt

SEQ ID NO: 16305 - DNA, 24 bp, Artificial sequence
  SiRNA target sequence
ttattaaagctgatgaatacattg

SEQ ID NO: 16306 - DNA, 24 bp, Artificial sequence
  SiRNA target sequence
tattaaagctgatgaatacattgg

SEQ ID NO: 16307 - DNA, 24 bp, Artificial sequence
  SiRNA target sequence
attaaagctgatgaatacattgga

SEQ ID NO: 16308 - DNA, 24 bp, Artificial sequence
  SiRNA target sequence
ttaaagctgatgaatacattggac

SEQ ID NO: 16309 - DNA, 24 bp, Artificial sequence
  SiRNA target sequence
taaagctgatgaatacattggact

SEQ ID NO: 16310 - DNA, 24 bp, Artificial sequence
  SiRNA target sequence
aaagctgatgaatacattggacta

SEQ ID NO: 16311 - DNA, 24 bp, Artificial sequence
  SiRNA target sequence
aagctgatgaatacattggactat

SEQ ID NO: 16312 - DNA, 24 bp, Artificial sequence
  SiRNA target sequence
agctgatgaatacattggactatc

SEQ ID NO: 16313 - DNA, 24 bp, Artificial sequence
  SiRNA target sequence
gctgatgaatacattggactatct

SEQ ID NO: 16314 - DNA, 24 bp, Artificial sequence
  SiRNA target sequence
ctgatgaatacattggactatctt

SEQ ID NO: 16315 - DNA, 24 bp, Artificial sequence
  SiRNA target sequence
tgatgaatacattggactatcttt

SEQ ID NO: 16316 - DNA, 24 bp, Artificial sequence
  SiRNA target sequence
gatgaatacattggactatctttt

SEQ ID NO: 16317 - DNA, 24 bp, Artificial sequence
  SiRNA target sequence
atgaatacattggactatcttttg

SEQ ID NO: 16318 - DNA, 24 bp, Artificial sequence
  SiRNA target sequence
tgaatacattggactatcttttgt

SEQ ID NO: 16319 - DNA, 24 bp, Artificial sequence
  SiRNA target sequence
gaatacattggactatcttttgta

SEQ ID NO: 16320 - DNA, 24 bp, Artificial sequence
  SiRNA target sequence
aatacattggactatcttttgtag

SEQ ID NO: 16321 - DNA, 24 bp, Artificial sequence
  SiRNA target sequence
atacattggactatcttttgtagg

SEQ ID NO: 16322 - DNA, 24 bp, Artificial sequence
  SiRNA target sequence
tacattggactatcttttgtaggg

SEQ ID NO: 16323 - DNA, 24 bp, Artificial sequence
  SiRNA target sequence
acattggactatcttttgtaggga

SEQ ID NO: 16324 - DNA, 24 bp, Artificial sequence
  SiRNA target sequence
cattggactatcttttgtagggag

SEQ ID NO: 16325 - DNA, 24 bp, Artificial sequence
  SiRNA target sequence
attggactatcttttgtagggaga

SEQ ID NO: 16326 - DNA, 24 bp, Artificial sequence
  SiRNA target sequence
ttggactatcttttgtagggagat

SEQ ID NO: 16327 - DNA, 24 bp, Artificial sequence
  SiRNA target sequence
tggactatcttttgtagggagata

SEQ ID NO: 16328 - DNA, 24 bp, Artificial sequence
  SiRNA target sequence
ggactatcttttgtagggagatat

SEQ ID NO: 16329 - DNA, 24 bp, Artificial sequence
  SiRNA target sequence
gactatcttttgtagggagatatg

SEQ ID NO: 16330 - DNA, 24 bp, Artificial sequence
  SiRNA target sequence
actatcttttgtagggagatatga

SEQ ID NO: 16331 - DNA, 24 bp, Artificial sequence
  SiRNA target sequence
ctatcttttgtagggagatatgaa

SEQ ID NO: 16332 - DNA, 24 bp, Artificial sequence
  SiRNA target sequence
tatcttttgtagggagatatgaag

SEQ ID NO: 16333 - DNA, 24 bp, Artificial sequence
  SiRNA target sequence
atcttttgtagggagatatgaagg

SEQ ID NO: 16334 - DNA, 24 bp, Artificial sequence
  SiRNA target sequence
tcttttgtagggagatatgaaggg

SEQ ID NO: 16335 - DNA, 24 bp, Artificial sequence
  SiRNA target sequence
cttttgtagggagatatgaaggga

SEQ ID NO: 16336 - DNA, 24 bp, Artificial sequence
  SiRNA target sequence
ttttgtagggagatatgaagggat

SEQ ID NO: 16337 - DNA, 24 bp, Artificial sequence
  SiRNA target sequence
tttgtagggagatatgaagggatt

SEQ ID NO: 16338 - DNA, 24 bp, Artificial sequence
  SiRNA target sequence
ttgtagggagatatgaagggattg

SEQ ID NO: 16339 - DNA, 24 bp, Artificial sequence
  SiRNA target sequence
tgtagggagatatgaagggattgg

SEQ ID NO: 16340 - DNA, 24 bp, Artificial sequence
  SiRNA target sequence
gtagggagatatgaagggattggt

SEQ ID NO: 16341 - DNA, 24 bp, Artificial sequence
  SiRNA target sequence
tagggagatatgaagggattggtt

SEQ ID NO: 16342 - DNA, 24 bp, Artificial sequence
  SiRNA target sequence
agggagatatgaagggattggttc

SEQ ID NO: 16343 - DNA, 24 bp, Artificial sequence
  SiRNA target sequence
gggagatatgaagggattggttct

SEQ ID NO: 16344 - DNA, 24 bp, Artificial sequence
  SiRNA target sequence
ggagatatgaagggattggttcta

SEQ ID NO: 16345 - DNA, 24 bp, Artificial sequence
  SiRNA target sequence
gagatatgaagggattggttctat

SEQ ID NO: 16346 - DNA, 24 bp, Artificial sequence
  SiRNA target sequence
agatatgaagggattggttctatt

SEQ ID NO: 16347 - DNA, 24 bp, Artificial sequence
  SiRNA target sequence
gatatgaagggattggttctattt

SEQ ID NO: 16348 - DNA, 24 bp, Artificial sequence
  SiRNA target sequence
atatgaagggattggttctatttc

SEQ ID NO: 16349 - DNA, 24 bp, Artificial sequence
  SiRNA target sequence
tatgaagggattggttctatttct

SEQ ID NO: 16350 - DNA, 24 bp, Artificial sequence
  SiRNA target sequence
atgaagggattggttctatttcta

SEQ ID NO: 16351 - DNA, 24 bp, Artificial sequence
  SiRNA target sequence
tgaagggattggttctatttctac

SEQ ID NO: 16352 - DNA, 24 bp, Artificial sequence
  SiRNA target sequence
gaagggattggttctatttctact

SEQ ID NO: 16353 - DNA, 24 bp, Artificial sequence
  SiRNA target sequence
aagggattggttctatttctacta

SEQ ID NO: 16354 - DNA, 24 bp, Artificial sequence
  SiRNA target sequence
agggattggttctatttctactat

SEQ ID NO: 16355 - DNA, 24 bp, Artificial sequence
  SiRNA target sequence
gggattggttctatttctactata

SEQ ID NO: 16356 - DNA, 24 bp, Artificial sequence
  SiRNA target sequence
ggattggttctatttctactatat

SEQ ID NO: 16357 - DNA, 24 bp, Artificial sequence
  SiRNA target sequence
gattggttctatttctactatatc

SEQ ID NO: 16358 - DNA, 24 bp, Artificial sequence
  SiRNA target sequence
attggttctatttctactatatca

SEQ ID NO: 16359 - DNA, 24 bp, Artificial sequence
  SiRNA target sequence
ttggttctatttctactatatcac

SEQ ID NO: 16360 - DNA, 24 bp, Artificial sequence
  SiRNA target sequence
tggttctatttctactatatcact

SEQ ID NO: 16361 - DNA, 24 bp, Artificial sequence
  SiRNA target sequence
ggttctatttctactatatcactt

SEQ ID NO: 16362 - DNA, 24 bp, Artificial sequence
  SiRNA target sequence
gttctatttctactatatcacttc

SEQ ID NO: 16363 - DNA, 24 bp, Artificial sequence
  SiRNA target sequence
ttctatttctactatatcacttca

SEQ ID NO: 16364 - DNA, 24 bp, Artificial sequence
  SiRNA target sequence
tctatttctactatatcacttcag

SEQ ID NO: 16365 - DNA, 24 bp, Artificial sequence
  SiRNA target sequence
ctatttctactatatcacttcagc

SEQ ID NO: 16366 - DNA, 24 bp, Artificial sequence
  SiRNA target sequence
tatttctactatatcacttcagca

SEQ ID NO: 16367 - DNA, 24 bp, Artificial sequence
  SiRNA target sequence
atttctactatatcacttcagcag

SEQ ID NO: 16368 - DNA, 24 bp, Artificial sequence
  SiRNA target sequence
tttctactatatcacttcagcagt

SEQ ID NO: 16369 - DNA, 24 bp, Artificial sequence
  SiRNA target sequence
ttctactatatcacttcagcagtt

SEQ ID NO: 16370 - DNA, 24 bp, Artificial sequence
  SiRNA target sequence
tctactatatcacttcagcagttt

SEQ ID NO: 16371 - DNA, 24 bp, Artificial sequence
  SiRNA target sequence
ctactatatcacttcagcagttta

SEQ ID NO: 16372 - DNA, 24 bp, Artificial sequence
  SiRNA target sequence
tactatatcacttcagcagtttaa

SEQ ID NO: 16373 - DNA, 24 bp, Artificial sequence
  SiRNA target sequence
actatatcacttcagcagtttaat

SEQ ID NO: 16374 - DNA, 24 bp, Artificial sequence
  SiRNA target sequence
ctatatcacttcagcagtttaata

SEQ ID NO: 16375 - DNA, 24 bp, Artificial sequence
  SiRNA target sequence
tatatcacttcagcagtttaatac

SEQ ID NO: 16376 - DNA, 24 bp, Artificial sequence
  SiRNA target sequence
atatcacttcagcagtttaataca

SEQ ID NO: 16377 - DNA, 24 bp, Artificial sequence
  SiRNA target sequence
tatcacttcagcagtttaatacac

SEQ ID NO: 16378 - DNA, 24 bp, Artificial sequence
  SiRNA target sequence
atcacttcagcagtttaatacact

SEQ ID NO: 16379 - DNA, 24 bp, Artificial sequence
  SiRNA target sequence
tcacttcagcagtttaatacactg

SEQ ID NO: 16380 - DNA, 24 bp, Artificial sequence
  SiRNA target sequence
cacttcagcagtttaatacactgt

SEQ ID NO: 16381 - DNA, 24 bp, Artificial sequence
  SiRNA target sequence
acttcagcagtttaatacactgtc

SEQ ID NO: 16382 - DNA, 24 bp, Artificial sequence
  SiRNA target sequence
cttcagcagtttaatacactgtct

SEQ ID NO: 16383 - DNA, 24 bp, Artificial sequence
  SiRNA target sequence
ttcagcagtttaatacactgtcta

SEQ ID NO: 16384 - DNA, 24 bp, Artificial sequence
  SiRNA target sequence
tcagcagtttaatacactgtctat

SEQ ID NO: 16385 - DNA, 24 bp, Artificial sequence
  SiRNA target sequence
cagcagtttaatacactgtctata

SEQ ID NO: 16386 - DNA, 24 bp, Artificial sequence
  SiRNA target sequence
agcagtttaatacactgtctatag

SEQ ID NO: 16387 - DNA, 24 bp, Artificial sequence
  SiRNA target sequence
gcagtttaatacactgtctataga

SEQ ID NO: 16388 - DNA, 24 bp, Artificial sequence
  SiRNA target sequence
cagtttaatacactgtctatagat

SEQ ID NO: 16389 - DNA, 24 bp, Artificial sequence
  SiRNA target sequence
agtttaatacactgtctatagatt

SEQ ID NO: 16390 - DNA, 24 bp, Artificial sequence
  SiRNA target sequence
gtttaatacactgtctatagatta

SEQ ID NO: 16391 - DNA, 24 bp, Artificial sequence
  SiRNA target sequence
tttaatacactgtctatagattat

SEQ ID NO: 16392 - DNA, 24 bp, Artificial sequence
  SiRNA target sequence
ttaatacactgtctatagattatt

SEQ ID NO: 16393 - DNA, 24 bp, Artificial sequence
  SiRNA target sequence
taatacactgtctatagattatta

SEQ ID NO: 16394 - DNA, 24 bp, Artificial sequence
  SiRNA target sequence
aatacactgtctatagattattac

SEQ ID NO: 16395 - DNA, 24 bp, Artificial sequence
  SiRNA target sequence
atacactgtctatagattattaca

SEQ ID NO: 16396 - DNA, 24 bp, Artificial sequence
  SiRNA target sequence
tacactgtctatagattattacaa

SEQ ID NO: 16397 - DNA, 24 bp, Artificial sequence
  SiRNA target sequence
acactgtctatagattattacaag

SEQ ID NO: 16398 - DNA, 24 bp, Artificial sequence
  SiRNA target sequence
cactgtctatagattattacaaga

SEQ ID NO: 16399 - DNA, 24 bp, Artificial sequence
  SiRNA target sequence
actgtctatagattattacaagac

SEQ ID NO: 16400 - DNA, 24 bp, Artificial sequence
  SiRNA target sequence
ctgtctatagattattacaagaca

SEQ ID NO: 16401 - DNA, 24 bp, Artificial sequence
  SiRNA target sequence
tgtctatagattattacaagacat

SEQ ID NO: 16402 - DNA, 24 bp, Artificial sequence
  SiRNA target sequence
gtctatagattattacaagacatt

SEQ ID NO: 16403 - DNA, 24 bp, Artificial sequence
  SiRNA target sequence
tctatagattattacaagacattg

SEQ ID NO: 16404 - DNA, 24 bp, Artificial sequence
  SiRNA target sequence
ctatagattattacaagacattgt

SEQ ID NO: 16405 - DNA, 24 bp, Artificial sequence
  SiRNA target sequence
tatagattattacaagacattgtc

SEQ ID NO: 16406 - DNA, 24 bp, Artificial sequence
  SiRNA target sequence
atagattattacaagacattgtct

SEQ ID NO: 16407 - DNA, 24 bp, Artificial sequence
  SiRNA target sequence
tagattattacaagacattgtctt

SEQ ID NO: 16408 - DNA, 24 bp, Artificial sequence
  SiRNA target sequence
agattattacaagacattgtcttc

SEQ ID NO: 16409 - DNA, 24 bp, Artificial sequence
  SiRNA target sequence
gattattacaagacattgtcttct

SEQ ID NO: 16410 - DNA, 24 bp, Artificial sequence
  SiRNA target sequence
attattacaagacattgtcttcta

SEQ ID NO: 16411 - DNA, 24 bp, Artificial sequence
  SiRNA target sequence
ttattacaagacattgtcttctat

SEQ ID NO: 16412 - DNA, 24 bp, Artificial sequence
  SiRNA target sequence
tattacaagacattgtcttctatt

SEQ ID NO: 16413 - DNA, 24 bp, Artificial sequence
  SiRNA target sequence
attacaagacattgtcttctattt

SEQ ID NO: 16414 - DNA, 24 bp, Artificial sequence
  SiRNA target sequence
ttacaagacattgtcttctatttg

SEQ ID NO: 16415 - DNA, 24 bp, Artificial sequence
  SiRNA target sequence
tacaagacattgtcttctatttgt

SEQ ID NO: 16416 - DNA, 24 bp, Artificial sequence
  SiRNA target sequence
acaagacattgtcttctatttgtg

SEQ ID NO: 16417 - DNA, 24 bp, Artificial sequence
  SiRNA target sequence
caagacattgtcttctatttgtga

SEQ ID NO: 16418 - DNA, 24 bp, Artificial sequence
  SiRNA target sequence
aagacattgtcttctatttgtgac

SEQ ID NO: 16419 - DNA, 24 bp, Artificial sequence
  SiRNA target sequence
agacattgtcttctatttgtgacg

SEQ ID NO: 16420 - DNA, 24 bp, Artificial sequence
  SiRNA target sequence
gacattgtcttctatttgtgacgt

SEQ ID NO: 16421 - DNA, 24 bp, Artificial sequence
  SiRNA target sequence
acattgtcttctatttgtgacgta

SEQ ID NO: 16422 - DNA, 24 bp, Artificial sequence
  SiRNA target sequence
cattgtcttctatttgtgacgtag

SEQ ID NO: 16423 - DNA, 24 bp, Artificial sequence
  SiRNA target sequence
attgtcttctatttgtgacgtagg

SEQ ID NO: 16424 - DNA, 24 bp, Artificial sequence
  SiRNA target sequence
ttgtcttctatttgtgacgtaggt

SEQ ID NO: 16425 - DNA, 24 bp, Artificial sequence
  SiRNA target sequence
tgtcttctatttgtgacgtaggta

SEQ ID NO: 16426 - DNA, 24 bp, Artificial sequence
  SiRNA target sequence
gtcttctatttgtgacgtaggtat

SEQ ID NO: 16427 - DNA, 24 bp, Artificial sequence
  SiRNA target sequence
tcttctatttgtgacgtaggtatt

SEQ ID NO: 16428 - DNA, 24 bp, Artificial sequence
  SiRNA target sequence
cttctatttgtgacgtaggtatta

SEQ ID NO: 16429 - DNA, 24 bp, Artificial sequence
  SiRNA target sequence
ttctatttgtgacgtaggtattaa

SEQ ID NO: 16430 - DNA, 24 bp, Artificial sequence
  SiRNA target sequence
tctatttgtgacgtaggtattaaa

SEQ ID NO: 16431 - DNA, 24 bp, Artificial sequence
  SiRNA target sequence
ctatttgtgacgtaggtattaaaa

SEQ ID NO: 16432 - DNA, 24 bp, Artificial sequence
  SiRNA target sequence
tatttgtgacgtaggtattaaaat

SEQ ID NO: 16433 - DNA, 24 bp, Artificial sequence
  SiRNA target sequence
atttgtgacgtaggtattaaaata

SEQ ID NO: 16434 - DNA, 24 bp, Artificial sequence
  SiRNA target sequence
tttgtgacgtaggtattaaaatat

SEQ ID NO: 16435 - DNA, 24 bp, Artificial sequence
  SiRNA target sequence
ttgtgacgtaggtattaaaatatc

SEQ ID NO: 16436 - DNA, 24 bp, Artificial sequence
  SiRNA target sequence
tgtgacgtaggtattaaaatatca

SEQ ID NO: 16437 - DNA, 24 bp, Artificial sequence
  SiRNA target sequence
gtgacgtaggtattaaaatatcaa

SEQ ID NO: 16438 - DNA, 24 bp, Artificial sequence
  SiRNA target sequence
tgacgtaggtattaaaatatcaac

SEQ ID NO: 16439 - DNA, 24 bp, Artificial sequence
  SiRNA target sequence
gacgtaggtattaaaatatcaact

SEQ ID NO: 16440 - DNA, 24 bp, Artificial sequence
  SiRNA target sequence
acgtaggtattaaaatatcaactg

SEQ ID NO: 16441 - DNA, 24 bp, Artificial sequence
  SiRNA target sequence
cgtaggtattaaaatatcaactga

SEQ ID NO: 16442 - DNA, 24 bp, Artificial sequence
  SiRNA target sequence
gtaggtattaaaatatcaactgat

SEQ ID NO: 16443 - DNA, 24 bp, Artificial sequence
  SiRNA target sequence
taggtattaaaatatcaactgata

SEQ ID NO: 16444 - DNA, 24 bp, Artificial sequence
  SiRNA target sequence
aggtattaaaatatcaactgatag

SEQ ID NO: 16445 - DNA, 24 bp, Artificial sequence
  SiRNA target sequence
ggtattaaaatatcaactgatagg

SEQ ID NO: 16446 - DNA, 24 bp, Artificial sequence
  SiRNA target sequence
gtattaaaatatcaactgataggg

SEQ ID NO: 16447 - DNA, 24 bp, Artificial sequence
  SiRNA target sequence
tattaaaatatcaactgataggga

SEQ ID NO: 16448 - DNA, 24 bp, Artificial sequence
  SiRNA target sequence
attaaaatatcaactgatagggaa

SEQ ID NO: 16449 - DNA, 24 bp, Artificial sequence
  SiRNA target sequence
ttaaaatatcaactgatagggaaa

SEQ ID NO: 16450 - DNA, 24 bp, Artificial sequence
  SiRNA target sequence
taaaatatcaactgatagggaaaa

SEQ ID NO: 16451 - DNA, 24 bp, Artificial sequence
  SiRNA target sequence
aaaatatcaactgatagggaaaaa

SEQ ID NO: 16452 - DNA, 24 bp, Artificial sequence
  SiRNA target sequence
aaatatcaactgatagggaaaaat

SEQ ID NO: 16453 - DNA, 24 bp, Artificial sequence
  SiRNA target sequence
aatatcaactgatagggaaaaatc

SEQ ID NO: 16454 - DNA, 24 bp, Artificial sequence
  SiRNA target sequence
atatcaactgatagggaaaaatca

SEQ ID NO: 16455 - DNA, 24 bp, Artificial sequence
  SiRNA target sequence
tatcaactgatagggaaaaatcag

SEQ ID NO: 16456 - DNA, 24 bp, Artificial sequence
  SiRNA target sequence
atcaactgatagggaaaaatcagt

SEQ ID NO: 16457 - DNA, 24 bp, Artificial sequence
  SiRNA target sequence
tcaactgatagggaaaaatcagtt

SEQ ID NO: 16458 - DNA, 24 bp, Artificial sequence
  SiRNA target sequence
caactgatagggaaaaatcagtta

SEQ ID NO: 16459 - DNA, 24 bp, Artificial sequence
  SiRNA target sequence
aactgatagggaaaaatcagttaa

SEQ ID NO: 16460 - DNA, 24 bp, Artificial sequence
  SiRNA target sequence
actgatagggaaaaatcagttaat

SEQ ID NO: 16461 - DNA, 24 bp, Artificial sequence
  SiRNA target sequence
ctgatagggaaaaatcagttaatt

SEQ ID NO: 16462 - DNA, 24 bp, Artificial sequence
  SiRNA target sequence
tgatagggaaaaatcagttaatta

SEQ ID NO: 16463 - DNA, 24 bp, Artificial sequence
  SiRNA target sequence
gatagggaaaaatcagttaattat

SEQ ID NO: 16464 - DNA, 24 bp, Artificial sequence
  SiRNA target sequence
atagggaaaaatcagttaattatg

SEQ ID NO: 16465 - DNA, 24 bp, Artificial sequence
  SiRNA target sequence
tagggaaaaatcagttaattatgg

SEQ ID NO: 16466 - DNA, 24 bp, Artificial sequence
  SiRNA target sequence
agggaaaaatcagttaattatgga

SEQ ID NO: 16467 - DNA, 24 bp, Artificial sequence
  SiRNA target sequence
gggaaaaatcagttaattatggat

SEQ ID NO: 16468 - DNA, 24 bp, Artificial sequence
  SiRNA target sequence
ggaaaaatcagttaattatggatt

SEQ ID NO: 16469 - DNA, 24 bp, Artificial sequence
  SiRNA target sequence
gaaaaatcagttaattatggatta

SEQ ID NO: 16470 - DNA, 24 bp, Artificial sequence
  SiRNA target sequence
aaaaatcagttaattatggattag

SEQ ID NO: 16471 - DNA, 24 bp, Artificial sequence
  SiRNA target sequence
aaaatcagttaattatggattagg

SEQ ID NO: 16472 - DNA, 24 bp, Artificial sequence
  SiRNA target sequence
aaatcagttaattatggattagga

SEQ ID NO: 16473 - DNA, 24 bp, Artificial sequence
  SiRNA target sequence
aatcagttaattatggattaggag

SEQ ID NO: 16474 - DNA, 24 bp, Artificial sequence
  SiRNA target sequence
atcagttaattatggattaggagt

SEQ ID NO: 16475 - DNA, 24 bp, Artificial sequence
  SiRNA target sequence
tcagttaattatggattaggagtt

SEQ ID NO: 16476 - DNA, 24 bp, Artificial sequence
  SiRNA target sequence
cagttaattatggattaggagtta

SEQ ID NO: 16477 - DNA, 24 bp, Artificial sequence
  SiRNA target sequence
agttaattatggattaggagttaa

SEQ ID NO: 16478 - DNA, 24 bp, Artificial sequence
  SiRNA target sequence
gttaattatggattaggagttaaa

SEQ ID NO: 16479 - DNA, 24 bp, Artificial sequence
  SiRNA target sequence
ttaattatggattaggagttaaac

SEQ ID NO: 16480 - DNA, 24 bp, Artificial sequence
  SiRNA target sequence
taattatggattaggagttaaact

SEQ ID NO: 16481 - DNA, 24 bp, Artificial sequence
  SiRNA target sequence
aattatggattaggagttaaacta

SEQ ID NO: 16482 - DNA, 24 bp, Artificial sequence
  SiRNA target sequence
attatggattaggagttaaactac

SEQ ID NO: 16483 - DNA, 24 bp, Artificial sequence
  SiRNA target sequence
ttatggattaggagttaaactaca

SEQ ID NO: 16484 - DNA, 24 bp, Artificial sequence
  SiRNA target sequence
tatggattaggagttaaactacac

SEQ ID NO: 16485 - DNA, 24 bp, Artificial sequence
  SiRNA target sequence
atggattaggagttaaactacaca

SEQ ID NO: 16486 - DNA, 24 bp, Artificial sequence
  SiRNA target sequence
tggattaggagttaaactacacag

SEQ ID NO: 16487 - DNA, 24 bp, Artificial sequence
  SiRNA target sequence
ggattaggagttaaactacacagt

SEQ ID NO: 16488 - DNA, 24 bp, Artificial sequence
  SiRNA target sequence
gattaggagttaaactacacagta

SEQ ID NO: 16489 - DNA, 24 bp, Artificial sequence
  SiRNA target sequence
attaggagttaaactacacagtaa

SEQ ID NO: 16490 - DNA, 24 bp, Artificial sequence
  SiRNA target sequence
ttaggagttaaactacacagtaaa

SEQ ID NO: 16491 - DNA, 24 bp, Artificial sequence
  SiRNA target sequence
taggagttaaactacacagtaaaa

SEQ ID NO: 16492 - DNA, 24 bp, Artificial sequence
  SiRNA target sequence
aggagttaaactacacagtaaaaa

SEQ ID NO: 16493 - DNA, 24 bp, Artificial sequence
  SiRNA target sequence
ggagttaaactacacagtaaaaaa

SEQ ID NO: 16494 - DNA, 24 bp, Artificial sequence
  SiRNA target sequence
gagttaaactacacagtaaaaaag

SEQ ID NO: 16495 - DNA, 24 bp, Artificial sequence
  SiRNA target sequence
agttaaactacacagtaaaaaagg

SEQ ID NO: 16496 - DNA, 24 bp, Artificial sequence
  SiRNA target sequence
gttaaactacacagtaaaaaagga

SEQ ID NO: 16497 - DNA, 24 bp, Artificial sequence
  SiRNA target sequence
ttaaactacacagtaaaaaaggag

SEQ ID NO: 16498 - DNA, 24 bp, Artificial sequence
  SiRNA target sequence
taaactacacagtaaaaaaggaga

SEQ ID NO: 16499 - DNA, 24 bp, Artificial sequence
  SiRNA target sequence
aaactacacagtaaaaaaggagaa

SEQ ID NO: 16500 - DNA, 24 bp, Artificial sequence
  SiRNA target sequence
aactacacagtaaaaaaggagaaa

SEQ ID NO: 16501 - DNA, 24 bp, Artificial sequence
  SiRNA target sequence
actacacagtaaaaaaggagaaat

SEQ ID NO: 16502 - DNA, 24 bp, Artificial sequence
  SiRNA target sequence
ctacacagtaaaaaaggagaaatt

SEQ ID NO: 16503 - DNA, 24 bp, Artificial sequence
  SiRNA target sequence
tacacagtaaaaaaggagaaatta

SEQ ID NO: 16504 - DNA, 24 bp, Artificial sequence
  SiRNA target sequence
acacagtaaaaaaggagaaattat

SEQ ID NO: 16505 - DNA, 24 bp, Artificial sequence
  SiRNA target sequence
cacagtaaaaaaggagaaattatc

SEQ ID NO: 16506 - DNA, 24 bp, Artificial sequence
  SiRNA target sequence
acagtaaaaaaggagaaattatcg

SEQ ID NO: 16507 - DNA, 24 bp, Artificial sequence
  SiRNA target sequence
cagtaaaaaaggagaaattatcgg

SEQ ID NO: 16508 - DNA, 24 bp, Artificial sequence
  SiRNA target sequence
agtaaaaaaggagaaattatcgga

SEQ ID NO: 16509 - DNA, 24 bp, Artificial sequence
  SiRNA target sequence
gtaaaaaaggagaaattatcggat

SEQ ID NO: 16510 - DNA, 24 bp, Artificial sequence
  SiRNA target sequence
taaaaaaggagaaattatcggatg

SEQ ID NO: 16511 - DNA, 24 bp, Artificial sequence
  SiRNA target sequence
aaaaaaggagaaattatcggatgt

SEQ ID NO: 16512 - DNA, 24 bp, Artificial sequence
  SiRNA target sequence
aaaaaggagaaattatcggatgtg

SEQ ID NO: 16513 - DNA, 24 bp, Artificial sequence
  SiRNA target sequence
aaaaggagaaattatcggatgtgt

SEQ ID NO: 16514 - DNA, 24 bp, Artificial sequence
  SiRNA target sequence
aaaggagaaattatcggatgtgta

SEQ ID NO: 16515 - DNA, 24 bp, Artificial sequence
  SiRNA target sequence
aaggagaaattatcggatgtgtag

SEQ ID NO: 16516 - DNA, 24 bp, Artificial sequence
  SiRNA target sequence
aggagaaattatcggatgtgtaga

SEQ ID NO: 16517 - DNA, 24 bp, Artificial sequence
  SiRNA target sequence
ggagaaattatcggatgtgtagat

SEQ ID NO: 16518 - DNA, 24 bp, Artificial sequence
  SiRNA target sequence
gagaaattatcggatgtgtagata

SEQ ID NO: 16519 - DNA, 24 bp, Artificial sequence
  SiRNA target sequence
agaaattatcggatgtgtagataa

SEQ ID NO: 16520 - DNA, 24 bp, Artificial sequence
  SiRNA target sequence
gaaattatcggatgtgtagataac

SEQ ID NO: 16521 - DNA, 24 bp, Artificial sequence
  SiRNA target sequence
aaattatcggatgtgtagataaca

SEQ ID NO: 16522 - DNA, 24 bp, Artificial sequence
  SiRNA target sequence
aattatcggatgtgtagataacaa

SEQ ID NO: 16523 - DNA, 24 bp, Artificial sequence
  SiRNA target sequence
attatcggatgtgtagataacaat

SEQ ID NO: 16524 - DNA, 24 bp, Artificial sequence
  SiRNA target sequence
ttatcggatgtgtagataacaatc

SEQ ID NO: 16525 - DNA, 24 bp, Artificial sequence
  SiRNA target sequence
tatcggatgtgtagataacaatca

SEQ ID NO: 16526 - DNA, 24 bp, Artificial sequence
  SiRNA target sequence
atcggatgtgtagataacaatcat

SEQ ID NO: 16527 - DNA, 24 bp, Artificial sequence
  SiRNA target sequence
tcggatgtgtagataacaatcata

SEQ ID NO: 16528 - DNA, 24 bp, Artificial sequence
  SiRNA target sequence
cggatgtgtagataacaatcatat

SEQ ID NO: 16529 - DNA, 24 bp, Artificial sequence
  SiRNA target sequence
ggatgtgtagataacaatcatatt

SEQ ID NO: 16530 - DNA, 24 bp, Artificial sequence
  SiRNA target sequence
gatgtgtagataacaatcatattt

SEQ ID NO: 16531 - DNA, 24 bp, Artificial sequence
  SiRNA target sequence
atgtgtagataacaatcatatttt

SEQ ID NO: 16532 - DNA, 24 bp, Artificial sequence
  SiRNA target sequence
tgtgtagataacaatcatatttta

SEQ ID NO: 16533 - DNA, 24 bp, Artificial sequence
  SiRNA target sequence
gtgtagataacaatcatattttaa

SEQ ID NO: 16534 - DNA, 24 bp, Artificial sequence
  SiRNA target sequence
tgtagataacaatcatattttaag

SEQ ID NO: 16535 - DNA, 24 bp, Artificial sequence
  SiRNA target sequence
gtagataacaatcatattttaagc

SEQ ID NO: 16536 - DNA, 24 bp, Artificial sequence
  SiRNA target sequence
tagataacaatcatattttaagca

SEQ ID NO: 16537 - DNA, 24 bp, Artificial sequence
  SiRNA target sequence
agataacaatcatattttaagcat

SEQ ID NO: 16538 - DNA, 24 bp, Artificial sequence
  SiRNA target sequence
gataacaatcatattttaagcata

SEQ ID NO: 16539 - DNA, 24 bp, Artificial sequence
  SiRNA target sequence
ataacaatcatattttaagcataa

SEQ ID NO: 16540 - DNA, 24 bp, Artificial sequence
  SiRNA target sequence
taacaatcatattttaagcataat

SEQ ID NO: 16541 - DNA, 24 bp, Artificial sequence
  SiRNA target sequence
aacaatcatattttaagcataatt

SEQ ID NO: 16542 - DNA, 24 bp, Artificial sequence
  SiRNA target sequence
acaatcatattttaagcataattt

SEQ ID NO: 16543 - DNA, 24 bp, Artificial sequence
  SiRNA target sequence
caatcatattttaagcataattta

SEQ ID NO: 16544 - DNA, 24 bp, Artificial sequence
  SiRNA target sequence
aatcatattttaagcataatttat

SEQ ID NO: 16545 - DNA, 24 bp, Artificial sequence
  SiRNA target sequence
atcatattttaagcataatttata

SEQ ID NO: 16546 - DNA, 24 bp, Artificial sequence
  SiRNA target sequence
tcatattttaagcataatttataa

SEQ ID NO: 16547 - DNA, 24 bp, Artificial sequence
  SiRNA target sequence
catattttaagcataatttataat

SEQ ID NO: 16548 - DNA, 24 bp, Artificial sequence
  SiRNA target sequence
atattttaagcataatttataatg

SEQ ID NO: 16549 - DNA, 24 bp, Artificial sequence
  SiRNA target sequence
tattttaagcataatttataatga

SEQ ID NO: 16550 - DNA, 24 bp, Artificial sequence
  SiRNA target sequence
attttaagcataatttataatgat

SEQ ID NO: 16551 - DNA, 24 bp, Artificial sequence
  SiRNA target sequence
ttttaagcataatttataatgata

SEQ ID NO: 16552 - DNA, 24 bp, Artificial sequence
  SiRNA target sequence
tttaagcataatttataatgataa

SEQ ID NO: 16553 - DNA, 24 bp, Artificial sequence
  SiRNA target sequence
ttaagcataatttataatgataaa

SEQ ID NO: 16554 - DNA, 24 bp, Artificial sequence
  SiRNA target sequence
taagcataatttataatgataaat

SEQ ID NO: 16555 - DNA, 24 bp, Artificial sequence
  SiRNA target sequence
aagcataatttataatgataaatt

SEQ ID NO: 16556 - DNA, 24 bp, Artificial sequence
  SiRNA target sequence
agcataatttataatgataaatta

SEQ ID NO: 16557 - DNA, 24 bp, Artificial sequence
  SiRNA target sequence
gcataatttataatgataaattat

SEQ ID NO: 16558 - DNA, 24 bp, Artificial sequence
  SiRNA target sequence
cataatttataatgataaattatc

SEQ ID NO: 16559 - DNA, 24 bp, Artificial sequence
  SiRNA target sequence
ataatttataatgataaattatct

SEQ ID NO: 16560 - DNA, 24 bp, Artificial sequence
  SiRNA target sequence
taatttataatgataaattatctg

SEQ ID NO: 16561 - DNA, 24 bp, Artificial sequence
  SiRNA target sequence
aatttataatgataaattatctga

SEQ ID NO: 16562 - DNA, 24 bp, Artificial sequence
  SiRNA target sequence
atttataatgataaattatctgaa

SEQ ID NO: 16563 - DNA, 24 bp, Artificial sequence
  SiRNA target sequence
tttataatgataaattatctgaag

SEQ ID NO: 16564 - DNA, 24 bp, Artificial sequence
  SiRNA target sequence
ttataatgataaattatctgaagg

SEQ ID NO: 16565 - DNA, 24 bp, Artificial sequence
  SiRNA target sequence
tataatgataaattatctgaaggg

SEQ ID NO: 16566 - DNA, 24 bp, Artificial sequence
  SiRNA target sequence
ataatgataaattatctgaagggt

SEQ ID NO: 16567 - DNA, 24 bp, Artificial sequence
  SiRNA target sequence
taatgataaattatctgaagggtt

SEQ ID NO: 16568 - DNA, 24 bp, Artificial sequence
  SiRNA target sequence
aatgataaattatctgaagggtta

SEQ ID NO: 16569 - DNA, 24 bp, Artificial sequence
  SiRNA target sequence
atgataaattatctgaagggttaa

SEQ ID NO: 16570 - DNA, 24 bp, Artificial sequence
  SiRNA target sequence
tgataaattatctgaagggttaac

SEQ ID NO: 16571 - DNA, 24 bp, Artificial sequence
  SiRNA target sequence
gataaattatctgaagggttaaca

SEQ ID NO: 16572 - DNA, 24 bp, Artificial sequence
  SiRNA target sequence
ataaattatctgaagggttaacac

SEQ ID NO: 16573 - DNA, 24 bp, Artificial sequence
  SiRNA target sequence
taaattatctgaagggttaacact

SEQ ID NO: 16574 - DNA, 24 bp, Artificial sequence
  SiRNA target sequence
aaattatctgaagggttaacactt

SEQ ID NO: 16575 - DNA, 24 bp, Artificial sequence
  SiRNA target sequence
aattatctgaagggttaacactta

SEQ ID NO: 16576 - DNA, 24 bp, Artificial sequence
  SiRNA target sequence
attatctgaagggttaacacttaa

SEQ ID NO: 16577 - DNA, 24 bp, Artificial sequence
  SiRNA target sequence
ttatctgaagggttaacacttaat

SEQ ID NO: 16578 - DNA, 24 bp, Artificial sequence
  SiRNA target sequence
tatctgaagggttaacacttaatt

SEQ ID NO: 16579 - DNA, 24 bp, Artificial sequence
  SiRNA target sequence
atctgaagggttaacacttaattt

SEQ ID NO: 16580 - DNA, 24 bp, Artificial sequence
  SiRNA target sequence
tctgaagggttaacacttaatttg

SEQ ID NO: 16581 - DNA, 24 bp, Artificial sequence
  SiRNA target sequence
ctgaagggttaacacttaatttga

SEQ ID NO: 16582 - DNA, 24 bp, Artificial sequence
  SiRNA target sequence
tgaagggttaacacttaatttgag

SEQ ID NO: 16583 - DNA, 24 bp, Artificial sequence
  SiRNA target sequence
gaagggttaacacttaatttgagt

SEQ ID NO: 16584 - DNA, 24 bp, Artificial sequence
  SiRNA target sequence
aagggttaacacttaatttgagtt

SEQ ID NO: 16585 - DNA, 24 bp, Artificial sequence
  SiRNA target sequence
agggttaacacttaatttgagttg

SEQ ID NO: 16586 - DNA, 24 bp, Artificial sequence
  SiRNA target sequence
gggttaacacttaatttgagttgt

SEQ ID NO: 16587 - DNA, 24 bp, Artificial sequence
  SiRNA target sequence
ggttaacacttaatttgagttgta

SEQ ID NO: 16588 - DNA, 24 bp, Artificial sequence
  SiRNA target sequence
gttaacacttaatttgagttgtag

SEQ ID NO: 16589 - DNA, 24 bp, Artificial sequence
  SiRNA target sequence
ttaacacttaatttgagttgtaga

SEQ ID NO: 16590 - DNA, 24 bp, Artificial sequence
  SiRNA target sequence
taacacttaatttgagttgtagat

SEQ ID NO: 16591 - DNA, 24 bp, Artificial sequence
  SiRNA target sequence
aacacttaatttgagttgtagatt

SEQ ID NO: 16592 - DNA, 24 bp, Artificial sequence
  SiRNA target sequence
acacttaatttgagttgtagattt

SEQ ID NO: 16593 - DNA, 24 bp, Artificial sequence
  SiRNA target sequence
cacttaatttgagttgtagatttg

SEQ ID NO: 16594 - DNA, 24 bp, Artificial sequence
  SiRNA target sequence
acttaatttgagttgtagatttgg

SEQ ID NO: 16595 - DNA, 24 bp, Artificial sequence
  SiRNA target sequence
cttaatttgagttgtagatttggt

SEQ ID NO: 16596 - DNA, 24 bp, Artificial sequence
  SiRNA target sequence
ttaatttgagttgtagatttggta

SEQ ID NO: 16597 - DNA, 24 bp, Artificial sequence
  SiRNA target sequence
taatttgagttgtagatttggtaa

SEQ ID NO: 16598 - DNA, 24 bp, Artificial sequence
  SiRNA target sequence
aatttgagttgtagatttggtaag

SEQ ID NO: 16599 - DNA, 24 bp, Artificial sequence
  SiRNA target sequence
atttgagttgtagatttggtaaga

SEQ ID NO: 16600 - DNA, 24 bp, Artificial sequence
  SiRNA target sequence
tttgagttgtagatttggtaagaa

SEQ ID NO: 16601 - DNA, 24 bp, Artificial sequence
  SiRNA target sequence
ttgagttgtagatttggtaagaaa

SEQ ID NO: 16602 - DNA, 24 bp, Artificial sequence
  SiRNA target sequence
tgagttgtagatttggtaagaaag

SEQ ID NO: 16603 - DNA, 24 bp, Artificial sequence
  SiRNA target sequence
gagttgtagatttggtaagaaagt

SEQ ID NO: 16604 - DNA, 24 bp, Artificial sequence
  SiRNA target sequence
agttgtagatttggtaagaaagta

SEQ ID NO: 16605 - DNA, 24 bp, Artificial sequence
  SiRNA target sequence
gttgtagatttggtaagaaagtat

SEQ ID NO: 16606 - DNA, 24 bp, Artificial sequence
  SiRNA target sequence
ttgtagatttggtaagaaagtatt

SEQ ID NO: 16607 - DNA, 24 bp, Artificial sequence
  SiRNA target sequence
tgtagatttggtaagaaagtattt

SEQ ID NO: 16608 - DNA, 24 bp, Artificial sequence
  SiRNA target sequence
gtagatttggtaagaaagtatttg

SEQ ID NO: 16609 - DNA, 24 bp, Artificial sequence
  SiRNA target sequence
tagatttggtaagaaagtatttga

SEQ ID NO: 16610 - DNA, 24 bp, Artificial sequence
  SiRNA target sequence
agatttggtaagaaagtatttgat

SEQ ID NO: 16611 - DNA, 24 bp, Artificial sequence
  SiRNA target sequence
gatttggtaagaaagtatttgatt

SEQ ID NO: 16612 - DNA, 24 bp, Artificial sequence
  SiRNA target sequence
atttggtaagaaagtatttgatta

SEQ ID NO: 16613 - DNA, 24 bp, Artificial sequence
  SiRNA target sequence
tttggtaagaaagtatttgattat

SEQ ID NO: 16614 - DNA, 24 bp, Artificial sequence
  SiRNA target sequence
ttggtaagaaagtatttgattatg

SEQ ID NO: 16615 - DNA, 24 bp, Artificial sequence
  SiRNA target sequence
tggtaagaaagtatttgattatgg

SEQ ID NO: 16616 - DNA, 24 bp, Artificial sequence
  SiRNA target sequence
ggtaagaaagtatttgattatggc

SEQ ID NO: 16617 - DNA, 24 bp, Artificial sequence
  SiRNA target sequence
gtaagaaagtatttgattatggct

SEQ ID NO: 16618 - DNA, 24 bp, Artificial sequence
  SiRNA target sequence
taagaaagtatttgattatggcta

SEQ ID NO: 16619 - DNA, 24 bp, Artificial sequence
  SiRNA target sequence
aagaaagtatttgattatggctat

SEQ ID NO: 16620 - DNA, 24 bp, Artificial sequence
  SiRNA target sequence
agaaagtatttgattatggctatg

SEQ ID NO: 16621 - DNA, 24 bp, Artificial sequence
  SiRNA target sequence
gaaagtatttgattatggctatgg

SEQ ID NO: 16622 - DNA, 24 bp, Artificial sequence
  SiRNA target sequence
aaagtatttgattatggctatggg

SEQ ID NO: 16623 - DNA, 24 bp, Artificial sequence
  SiRNA target sequence
aagtatttgattatggctatgggt

SEQ ID NO: 16624 - DNA, 24 bp, Artificial sequence
  SiRNA target sequence
agtatttgattatggctatgggtt

SEQ ID NO: 16625 - DNA, 24 bp, Artificial sequence
  SiRNA target sequence
gtatttgattatggctatgggttt

SEQ ID NO: 16626 - DNA, 24 bp, Artificial sequence
  SiRNA target sequence
tatttgattatggctatgggttta

SEQ ID NO: 16627 - DNA, 24 bp, Artificial sequence
  SiRNA target sequence
atttgattatggctatgggtttat

SEQ ID NO: 16628 - DNA, 24 bp, Artificial sequence
  SiRNA target sequence
tttgattatggctatgggtttatt

SEQ ID NO: 16629 - DNA, 24 bp, Artificial sequence
  SiRNA target sequence
ttgattatggctatgggtttattt

SEQ ID NO: 16630 - DNA, 24 bp, Artificial sequence
  SiRNA target sequence
tgattatggctatgggtttattta

SEQ ID NO: 16631 - DNA, 24 bp, Artificial sequence
  SiRNA target sequence
gattatggctatgggtttatttat

SEQ ID NO: 16632 - DNA, 24 bp, Artificial sequence
  SiRNA target sequence
attatggctatgggtttatttatg

SEQ ID NO: 16633 - DNA, 24 bp, Artificial sequence
  SiRNA target sequence
ttatggctatgggtttatttatga

SEQ ID NO: 16634 - DNA, 24 bp, Artificial sequence
  SiRNA target sequence
tatggctatgggtttatttatgaa

SEQ ID NO: 16635 - DNA, 24 bp, Artificial sequence
  SiRNA target sequence
atggctatgggtttatttatgaat

SEQ ID NO: 16636 - DNA, 24 bp, Artificial sequence
  SiRNA target sequence
tggctatgggtttatttatgaatt

SEQ ID NO: 16637 - DNA, 24 bp, Artificial sequence
  SiRNA target sequence
ggctatgggtttatttatgaattt

SEQ ID NO: 16638 - DNA, 24 bp, Artificial sequence
  SiRNA target sequence
gctatgggtttatttatgaatttt

SEQ ID NO: 16639 - DNA, 24 bp, Artificial sequence
  SiRNA target sequence
ctatgggtttatttatgaatttta

SEQ ID NO: 16640 - DNA, 24 bp, Artificial sequence
  SiRNA target sequence
tatgggtttatttatgaattttaa

SEQ ID NO: 16641 - DNA, 25 bp, Artificial sequence
  SiRNA target sequence
atgaaatctttctacaaaaaaataa

SEQ ID NO: 16642 - DNA, 25 bp, Artificial sequence
  SiRNA target sequence
tgaaatctttctacaaaaaaataaa

SEQ ID NO: 16643 - DNA, 25 bp, Artificial sequence
  SiRNA target sequence
gaaatctttctacaaaaaaataaaa

SEQ ID NO: 16644 - DNA, 25 bp, Artificial sequence
  SiRNA target sequence
aaatctttctacaaaaaaataaaaa

SEQ ID NO: 16645 - DNA, 25 bp, Artificial sequence
  SiRNA target sequence
aatctttctacaaaaaaataaaaag

SEQ ID NO: 16646 - DNA, 25 bp, Artificial sequence
  SiRNA target sequence
atctttctacaaaaaaataaaaagt

SEQ ID NO: 16647 - DNA, 25 bp, Artificial sequence
  SiRNA target sequence
tctttctacaaaaaaataaaaagtt

SEQ ID NO: 16648 - DNA, 25 bp, Artificial sequence
  SiRNA target sequence
ctttctacaaaaaaataaaaagtta

SEQ ID NO: 16649 - DNA, 25 bp, Artificial sequence
  SiRNA target sequence
tttctacaaaaaaataaaaagttat

SEQ ID NO: 16650 - DNA, 25 bp, Artificial sequence
  SiRNA target sequence
ttctacaaaaaaataaaaagttatt

SEQ ID NO: 16651 - DNA, 25 bp, Artificial sequence
  SiRNA target sequence
tctacaaaaaaataaaaagttattt

SEQ ID NO: 16652 - DNA, 25 bp, Artificial sequence
  SiRNA target sequence
ctacaaaaaaataaaaagttattta

SEQ ID NO: 16653 - DNA, 25 bp, Artificial sequence
  SiRNA target sequence
tacaaaaaaataaaaagttatttat

SEQ ID NO: 16654 - DNA, 25 bp, Artificial sequence
  SiRNA target sequence
acaaaaaaataaaaagttatttatt

SEQ ID NO: 16655 - DNA, 25 bp, Artificial sequence
  SiRNA target sequence
caaaaaaataaaaagttatttattc

SEQ ID NO: 16656 - DNA, 25 bp, Artificial sequence
  SiRNA target sequence
aaaaaaataaaaagttatttattca

SEQ ID NO: 16657 - DNA, 25 bp, Artificial sequence
  SiRNA target sequence
aaaaaataaaaagttatttattcaa

SEQ ID NO: 16658 - DNA, 25 bp, Artificial sequence
  SiRNA target sequence
aaaaataaaaagttatttattcaaa

SEQ ID NO: 16659 - DNA, 25 bp, Artificial sequence
  SiRNA target sequence
aaaataaaaagttatttattcaaat

SEQ ID NO: 16660 - DNA, 25 bp, Artificial sequence
  SiRNA target sequence
aaataaaaagttatttattcaaatc

SEQ ID NO: 16661 - DNA, 25 bp, Artificial sequence
  SiRNA target sequence
aataaaaagttatttattcaaatct

SEQ ID NO: 16662 - DNA, 25 bp, Artificial sequence
  SiRNA target sequence
ataaaaagttatttattcaaatctg

SEQ ID NO: 16663 - DNA, 25 bp, Artificial sequence
  SiRNA target sequence
taaaaagttatttattcaaatctgc

SEQ ID NO: 16664 - DNA, 25 bp, Artificial sequence
  SiRNA target sequence
aaaaagttatttattcaaatctgcc

SEQ ID NO: 16665 - DNA, 25 bp, Artificial sequence
  SiRNA target sequence
aaaagttatttattcaaatctgcca

SEQ ID NO: 16666 - DNA, 25 bp, Artificial sequence
  SiRNA target sequence
aaagttatttattcaaatctgccat

SEQ ID NO: 16667 - DNA, 25 bp, Artificial sequence
  SiRNA target sequence
aagttatttattcaaatctgccatt

SEQ ID NO: 16668 - DNA, 25 bp, Artificial sequence
  SiRNA target sequence
agttatttattcaaatctgccatta

SEQ ID NO: 16669 - DNA, 25 bp, Artificial sequence
  SiRNA target sequence
gttatttattcaaatctgccattaa

SEQ ID NO: 16670 - DNA, 25 bp, Artificial sequence
  SiRNA target sequence
ttatttattcaaatctgccattaat

SEQ ID NO: 16671 - DNA, 25 bp, Artificial sequence
  SiRNA target sequence
tatttattcaaatctgccattaata

SEQ ID NO: 16672 - DNA, 25 bp, Artificial sequence
  SiRNA target sequence
atttattcaaatctgccattaatac

SEQ ID NO: 16673 - DNA, 25 bp, Artificial sequence
  SiRNA target sequence
tttattcaaatctgccattaataca

SEQ ID NO: 16674 - DNA, 25 bp, Artificial sequence
  SiRNA target sequence
ttattcaaatctgccattaatacat

SEQ ID NO: 16675 - DNA, 25 bp, Artificial sequence
  SiRNA target sequence
tattcaaatctgccattaatacatc

SEQ ID NO: 16676 - DNA, 25 bp, Artificial sequence
  SiRNA target sequence
attcaaatctgccattaatacatct

SEQ ID NO: 16677 - DNA, 25 bp, Artificial sequence
  SiRNA target sequence
ttcaaatctgccattaatacatctt

SEQ ID NO: 16678 - DNA, 25 bp, Artificial sequence
  SiRNA target sequence
tcaaatctgccattaatacatcttt

SEQ ID NO: 16679 - DNA, 25 bp, Artificial sequence
  SiRNA target sequence
caaatctgccattaatacatctttt

SEQ ID NO: 16680 - DNA, 25 bp, Artificial sequence
  SiRNA target sequence
aaatctgccattaatacatcttttg

SEQ ID NO: 16681 - DNA, 25 bp, Artificial sequence
  SiRNA target sequence
aatctgccattaatacatcttttga

SEQ ID NO: 16682 - DNA, 25 bp, Artificial sequence
  SiRNA target sequence
atctgccattaatacatcttttgat

SEQ ID NO: 16683 - DNA, 25 bp, Artificial sequence
  SiRNA target sequence
tctgccattaatacatcttttgata

SEQ ID NO: 16684 - DNA, 25 bp, Artificial sequence
  SiRNA target sequence
ctgccattaatacatcttttgatac

SEQ ID NO: 16685 - DNA, 25 bp, Artificial sequence
  SiRNA target sequence
tgccattaatacatcttttgatact

SEQ ID NO: 16686 - DNA, 25 bp, Artificial sequence
  SiRNA target sequence
gccattaatacatcttttgatactt

SEQ ID NO: 16687 - DNA, 25 bp, Artificial sequence
  SiRNA target sequence
ccattaatacatcttttgatacttt

SEQ ID NO: 16688 - DNA, 25 bp, Artificial sequence
  SiRNA target sequence
cattaatacatcttttgatactttt

SEQ ID NO: 16689 - DNA, 25 bp, Artificial sequence
  SiRNA target sequence
attaatacatcttttgatactttta

SEQ ID NO: 16690 - DNA, 25 bp, Artificial sequence
  SiRNA target sequence
ttaatacatcttttgatacttttaa

SEQ ID NO: 16691 - DNA, 25 bp, Artificial sequence
  SiRNA target sequence
taatacatcttttgatacttttaat

SEQ ID NO: 16692 - DNA, 25 bp, Artificial sequence
  SiRNA target sequence
aatacatcttttgatacttttaatt

SEQ ID NO: 16693 - DNA, 25 bp, Artificial sequence
  SiRNA target sequence
atacatcttttgatacttttaattt

SEQ ID NO: 16694 - DNA, 25 bp, Artificial sequence
  SiRNA target sequence
tacatcttttgatacttttaattta

SEQ ID NO: 16695 - DNA, 25 bp, Artificial sequence
  SiRNA target sequence
acatcttttgatacttttaatttag

SEQ ID NO: 16696 - DNA, 25 bp, Artificial sequence
  SiRNA target sequence
catcttttgatacttttaatttaga

SEQ ID NO: 16697 - DNA, 25 bp, Artificial sequence
  SiRNA target sequence
atcttttgatacttttaatttagaa

SEQ ID NO: 16698 - DNA, 25 bp, Artificial sequence
  SiRNA target sequence
tcttttgatacttttaatttagaaa

SEQ ID NO: 16699 - DNA, 25 bp, Artificial sequence
  SiRNA target sequence
cttttgatacttttaatttagaaaa

SEQ ID NO: 16700 - DNA, 25 bp, Artificial sequence
  SiRNA target sequence
ttttgatacttttaatttagaaaat

SEQ ID NO: 16701 - DNA, 25 bp, Artificial sequence
  SiRNA target sequence
tttgatacttttaatttagaaaatg

SEQ ID NO: 16702 - DNA, 25 bp, Artificial sequence
  SiRNA target sequence
ttgatacttttaatttagaaaatgt

SEQ ID NO: 16703 - DNA, 25 bp, Artificial sequence
  SiRNA target sequence
tgatacttttaatttagaaaatgta

SEQ ID NO: 16704 - DNA, 25 bp, Artificial sequence
  SiRNA target sequence
gatacttttaatttagaaaatgtaa

SEQ ID NO: 16705 - DNA, 25 bp, Artificial sequence
  SiRNA target sequence
atacttttaatttagaaaatgtaag

SEQ ID NO: 16706 - DNA, 25 bp, Artificial sequence
  SiRNA target sequence
tacttttaatttagaaaatgtaagc

SEQ ID NO: 16707 - DNA, 25 bp, Artificial sequence
  SiRNA target sequence
acttttaatttagaaaatgtaagca

SEQ ID NO: 16708 - DNA, 25 bp, Artificial sequence
  SiRNA target sequence
cttttaatttagaaaatgtaagcat

SEQ ID NO: 16709 - DNA, 25 bp, Artificial sequence
  SiRNA target sequence
ttttaatttagaaaatgtaagcatt

SEQ ID NO: 16710 - DNA, 25 bp, Artificial sequence
  SiRNA target sequence
tttaatttagaaaatgtaagcatta

SEQ ID NO: 16711 - DNA, 25 bp, Artificial sequence
  SiRNA target sequence
ttaatttagaaaatgtaagcattac

SEQ ID NO: 16712 - DNA, 25 bp, Artificial sequence
  SiRNA target sequence
taatttagaaaatgtaagcattact

SEQ ID NO: 16713 - DNA, 25 bp, Artificial sequence
  SiRNA target sequence
aatttagaaaatgtaagcattacta

SEQ ID NO: 16714 - DNA, 25 bp, Artificial sequence
  SiRNA target sequence
atttagaaaatgtaagcattactag

SEQ ID NO: 16715 - DNA, 25 bp, Artificial sequence
  SiRNA target sequence
tttagaaaatgtaagcattactagc

SEQ ID NO: 16716 - DNA, 25 bp, Artificial sequence
  SiRNA target sequence
ttagaaaatgtaagcattactagct

SEQ ID NO: 16717 - DNA, 25 bp, Artificial sequence
  SiRNA target sequence
tagaaaatgtaagcattactagctt

SEQ ID NO: 16718 - DNA, 25 bp, Artificial sequence
  SiRNA target sequence
agaaaatgtaagcattactagctta

SEQ ID NO: 16719 - DNA, 25 bp, Artificial sequence
  SiRNA target sequence
gaaaatgtaagcattactagcttaa

SEQ ID NO: 16720 - DNA, 25 bp, Artificial sequence
  SiRNA target sequence
aaaatgtaagcattactagcttaaa

SEQ ID NO: 16721 - DNA, 25 bp, Artificial sequence
  SiRNA target sequence
aaatgtaagcattactagcttaaat

SEQ ID NO: 16722 - DNA, 25 bp, Artificial sequence
  SiRNA target sequence
aatgtaagcattactagcttaaata

SEQ ID NO: 16723 - DNA, 25 bp, Artificial sequence
  SiRNA target sequence
atgtaagcattactagcttaaatac

SEQ ID NO: 16724 - DNA, 25 bp, Artificial sequence
  SiRNA target sequence
tgtaagcattactagcttaaatacg

SEQ ID NO: 16725 - DNA, 25 bp, Artificial sequence
  SiRNA target sequence
gtaagcattactagcttaaatacgt

SEQ ID NO: 16726 - DNA, 25 bp, Artificial sequence
  SiRNA target sequence
taagcattactagcttaaatacgta

SEQ ID NO: 16727 - DNA, 25 bp, Artificial sequence
  SiRNA target sequence
aagcattactagcttaaatacgtac

SEQ ID NO: 16728 - DNA, 25 bp, Artificial sequence
  SiRNA target sequence
agcattactagcttaaatacgtaca

SEQ ID NO: 16729 - DNA, 25 bp, Artificial sequence
  SiRNA target sequence
gcattactagcttaaatacgtacac

SEQ ID NO: 16730 - DNA, 25 bp, Artificial sequence
  SiRNA target sequence
cattactagcttaaatacgtacacc

SEQ ID NO: 16731 - DNA, 25 bp, Artificial sequence
  SiRNA target sequence
attactagcttaaatacgtacaccg

SEQ ID NO: 16732 - DNA, 25 bp, Artificial sequence
  SiRNA target sequence
ttactagcttaaatacgtacaccgg

SEQ ID NO: 16733 - DNA, 25 bp, Artificial sequence
  SiRNA target sequence
tactagcttaaatacgtacaccggt

SEQ ID NO: 16734 - DNA, 25 bp, Artificial sequence
  SiRNA target sequence
actagcttaaatacgtacaccggtg

SEQ ID NO: 16735 - DNA, 25 bp, Artificial sequence
  SiRNA target sequence
ctagcttaaatacgtacaccggtgt

SEQ ID NO: 16736 - DNA, 25 bp, Artificial sequence
  SiRNA target sequence
tagcttaaatacgtacaccggtgtt

SEQ ID NO: 16737 - DNA, 25 bp, Artificial sequence
  SiRNA target sequence
agcttaaatacgtacaccggtgtta

SEQ ID NO: 16738 - DNA, 25 bp, Artificial sequence
  SiRNA target sequence
gcttaaatacgtacaccggtgttaa

SEQ ID NO: 16739 - DNA, 25 bp, Artificial sequence
  SiRNA target sequence
cttaaatacgtacaccggtgttaaa

SEQ ID NO: 16740 - DNA, 25 bp, Artificial sequence
  SiRNA target sequence
ttaaatacgtacaccggtgttaaaa

SEQ ID NO: 16741 - DNA, 25 bp, Artificial sequence
  SiRNA target sequence
taaatacgtacaccggtgttaaaac

SEQ ID NO: 16742 - DNA, 25 bp, Artificial sequence
  SiRNA target sequence
aaatacgtacaccggtgttaaaacc

SEQ ID NO: 16743 - DNA, 25 bp, Artificial sequence
  SiRNA target sequence
aatacgtacaccggtgttaaaaccg

SEQ ID NO: 16744 - DNA, 25 bp, Artificial sequence
  SiRNA target sequence
atacgtacaccggtgttaaaaccga

SEQ ID NO: 16745 - DNA, 25 bp, Artificial sequence
  SiRNA target sequence
tacgtacaccggtgttaaaaccgaa

SEQ ID NO: 16746 - DNA, 25 bp, Artificial sequence
  SiRNA target sequence
acgtacaccggtgttaaaaccgaaa

SEQ ID NO: 16747 - DNA, 25 bp, Artificial sequence
  SiRNA target sequence
cgtacaccggtgttaaaaccgaaat

SEQ ID NO: 16748 - DNA, 25 bp, Artificial sequence
  SiRNA target sequence
gtacaccggtgttaaaaccgaaata

SEQ ID NO: 16749 - DNA, 25 bp, Artificial sequence
  SiRNA target sequence
tacaccggtgttaaaaccgaaatat

SEQ ID NO: 16750 - DNA, 25 bp, Artificial sequence
  SiRNA target sequence
acaccggtgttaaaaccgaaatatc

SEQ ID NO: 16751 - DNA, 25 bp, Artificial sequence
  SiRNA target sequence
caccggtgttaaaaccgaaatatca

SEQ ID NO: 16752 - DNA, 25 bp, Artificial sequence
  SiRNA target sequence
accggtgttaaaaccgaaatatcaa

SEQ ID NO: 16753 - DNA, 25 bp, Artificial sequence
  SiRNA target sequence
ccggtgttaaaaccgaaatatcaaa

SEQ ID NO: 16754 - DNA, 25 bp, Artificial sequence
  SiRNA target sequence
cggtgttaaaaccgaaatatcaaaa

SEQ ID NO: 16755 - DNA, 25 bp, Artificial sequence
  SiRNA target sequence
ggtgttaaaaccgaaatatcaaaaa

SEQ ID NO: 16756 - DNA, 25 bp, Artificial sequence
  SiRNA target sequence
gtgttaaaaccgaaatatcaaaaac

SEQ ID NO: 16757 - DNA, 25 bp, Artificial sequence
  SiRNA target sequence
tgttaaaaccgaaatatcaaaaacc

SEQ ID NO: 16758 - DNA, 25 bp, Artificial sequence
  SiRNA target sequence
gttaaaaccgaaatatcaaaaaccg

SEQ ID NO: 16759 - DNA, 25 bp, Artificial sequence
  SiRNA target sequence
ttaaaaccgaaatatcaaaaaccgt

SEQ ID NO: 16760 - DNA, 25 bp, Artificial sequence
  SiRNA target sequence
taaaaccgaaatatcaaaaaccgta

SEQ ID NO: 16761 - DNA, 25 bp, Artificial sequence
  SiRNA target sequence
aaaaccgaaatatcaaaaaccgtat

SEQ ID NO: 16762 - DNA, 25 bp, Artificial sequence
  SiRNA target sequence
aaaccgaaatatcaaaaaccgtatc

SEQ ID NO: 16763 - DNA, 25 bp, Artificial sequence
  SiRNA target sequence
aaccgaaatatcaaaaaccgtatca

SEQ ID NO: 16764 - DNA, 25 bp, Artificial sequence
  SiRNA target sequence
accgaaatatcaaaaaccgtatcac

SEQ ID NO: 16765 - DNA, 25 bp, Artificial sequence
  SiRNA target sequence
ccgaaatatcaaaaaccgtatcacc

SEQ ID NO: 16766 - DNA, 25 bp, Artificial sequence
  SiRNA target sequence
cgaaatatcaaaaaccgtatcacca

SEQ ID NO: 16767 - DNA, 25 bp, Artificial sequence
  SiRNA target sequence
gaaatatcaaaaaccgtatcaccac

SEQ ID NO: 16768 - DNA, 25 bp, Artificial sequence
  SiRNA target sequence
aaatatcaaaaaccgtatcaccaca

SEQ ID NO: 16769 - DNA, 25 bp, Artificial sequence
  SiRNA target sequence
aatatcaaaaaccgtatcaccacac

SEQ ID NO: 16770 - DNA, 25 bp, Artificial sequence
  SiRNA target sequence
atatcaaaaaccgtatcaccacact

SEQ ID NO: 16771 - DNA, 25 bp, Artificial sequence
  SiRNA target sequence
tatcaaaaaccgtatcaccacactt

SEQ ID NO: 16772 - DNA, 25 bp, Artificial sequence
  SiRNA target sequence
atcaaaaaccgtatcaccacacttc

SEQ ID NO: 16773 - DNA, 25 bp, Artificial sequence
  SiRNA target sequence
tcaaaaaccgtatcaccacacttcc

SEQ ID NO: 16774 - DNA, 25 bp, Artificial sequence
  SiRNA target sequence
caaaaaccgtatcaccacacttcca

SEQ ID NO: 16775 - DNA, 25 bp, Artificial sequence
  SiRNA target sequence
aaaaaccgtatcaccacacttccag

SEQ ID NO: 16776 - DNA, 25 bp, Artificial sequence
  SiRNA target sequence
aaaaccgtatcaccacacttccaga

SEQ ID NO: 16777 - DNA, 25 bp, Artificial sequence
  SiRNA target sequence
aaaccgtatcaccacacttccagat

SEQ ID NO: 16778 - DNA, 25 bp, Artificial sequence
  SiRNA target sequence
aaccgtatcaccacacttccagatt

SEQ ID NO: 16779 - DNA, 25 bp, Artificial sequence
  SiRNA target sequence
accgtatcaccacacttccagattt

SEQ ID NO: 16780 - DNA, 25 bp, Artificial sequence
  SiRNA target sequence
ccgtatcaccacacttccagatttc

SEQ ID NO: 16781 - DNA, 25 bp, Artificial sequence
  SiRNA target sequence
cgtatcaccacacttccagatttct

SEQ ID NO: 16782 - DNA, 25 bp, Artificial sequence
  SiRNA target sequence
gtatcaccacacttccagatttctc

SEQ ID NO: 16783 - DNA, 25 bp, Artificial sequence
  SiRNA target sequence
tatcaccacacttccagatttctca

SEQ ID NO: 16784 - DNA, 25 bp, Artificial sequence
  SiRNA target sequence
atcaccacacttccagatttctcat

SEQ ID NO: 16785 - DNA, 25 bp, Artificial sequence
  SiRNA target sequence
tcaccacacttccagatttctcatg

SEQ ID NO: 16786 - DNA, 25 bp, Artificial sequence
  SiRNA target sequence
caccacacttccagatttctcatgt

SEQ ID NO: 16787 - DNA, 25 bp, Artificial sequence
  SiRNA target sequence
accacacttccagatttctcatgtc

SEQ ID NO: 16788 - DNA, 25 bp, Artificial sequence
  SiRNA target sequence
ccacacttccagatttctcatgtct

SEQ ID NO: 16789 - DNA, 25 bp, Artificial sequence
  SiRNA target sequence
cacacttccagatttctcatgtctc

SEQ ID NO: 16790 - DNA, 25 bp, Artificial sequence
  SiRNA target sequence
acacttccagatttctcatgtctct

SEQ ID NO: 16791 - DNA, 25 bp, Artificial sequence
  SiRNA target sequence
cacttccagatttctcatgtctctt

SEQ ID NO: 16792 - DNA, 25 bp, Artificial sequence
  SiRNA target sequence
acttccagatttctcatgtctcttc

SEQ ID NO: 16793 - DNA, 25 bp, Artificial sequence
  SiRNA target sequence
cttccagatttctcatgtctcttct

SEQ ID NO: 16794 - DNA, 25 bp, Artificial sequence
  SiRNA target sequence
ttccagatttctcatgtctcttcta

SEQ ID NO: 16795 - DNA, 25 bp, Artificial sequence
  SiRNA target sequence
tccagatttctcatgtctcttctat

SEQ ID NO: 16796 - DNA, 25 bp, Artificial sequence
  SiRNA target sequence
ccagatttctcatgtctcttctatg

SEQ ID NO: 16797 - DNA, 25 bp, Artificial sequence
  SiRNA target sequence
cagatttctcatgtctcttctatgg

SEQ ID NO: 16798 - DNA, 25 bp, Artificial sequence
  SiRNA target sequence
agatttctcatgtctcttctatggg

SEQ ID NO: 16799 - DNA, 25 bp, Artificial sequence
  SiRNA target sequence
gatttctcatgtctcttctatgggc

SEQ ID NO: 16800 - DNA, 25 bp, Artificial sequence
  SiRNA target sequence
atttctcatgtctcttctatgggcg

SEQ ID NO: 16801 - DNA, 25 bp, Artificial sequence
  SiRNA target sequence
tttctcatgtctcttctatgggcgc

SEQ ID NO: 16802 - DNA, 25 bp, Artificial sequence
  SiRNA target sequence
ttctcatgtctcttctatgggcgca

SEQ ID NO: 16803 - DNA, 25 bp, Artificial sequence
  SiRNA target sequence
tctcatgtctcttctatgggcgcag

SEQ ID NO: 16804 - DNA, 25 bp, Artificial sequence
  SiRNA target sequence
ctcatgtctcttctatgggcgcaga

SEQ ID NO: 16805 - DNA, 25 bp, Artificial sequence
  SiRNA target sequence
tcatgtctcttctatgggcgcagat

SEQ ID NO: 16806 - DNA, 25 bp, Artificial sequence
  SiRNA target sequence
catgtctcttctatgggcgcagatt

SEQ ID NO: 16807 - DNA, 25 bp, Artificial sequence
  SiRNA target sequence
atgtctcttctatgggcgcagattt

SEQ ID NO: 16808 - DNA, 25 bp, Artificial sequence
  SiRNA target sequence
tgtctcttctatgggcgcagatttc

SEQ ID NO: 16809 - DNA, 25 bp, Artificial sequence
  SiRNA target sequence
gtctcttctatgggcgcagatttcg

SEQ ID NO: 16810 - DNA, 25 bp, Artificial sequence
  SiRNA target sequence
tctcttctatgggcgcagatttcga

SEQ ID NO: 16811 - DNA, 25 bp, Artificial sequence
  SiRNA target sequence
ctcttctatgggcgcagatttcgac

SEQ ID NO: 16812 - DNA, 25 bp, Artificial sequence
  SiRNA target sequence
tcttctatgggcgcagatttcgaca

SEQ ID NO: 16813 - DNA, 25 bp, Artificial sequence
  SiRNA target sequence
cttctatgggcgcagatttcgacat

SEQ ID NO: 16814 - DNA, 25 bp, Artificial sequence
  SiRNA target sequence
ttctatgggcgcagatttcgacata

SEQ ID NO: 16815 - DNA, 25 bp, Artificial sequence
  SiRNA target sequence
tctatgggcgcagatttcgacataa

SEQ ID NO: 16816 - DNA, 25 bp, Artificial sequence
  SiRNA target sequence
ctatgggcgcagatttcgacataaa

SEQ ID NO: 16817 - DNA, 25 bp, Artificial sequence
  SiRNA target sequence
tatgggcgcagatttcgacataaaa

SEQ ID NO: 16818 - DNA, 25 bp, Artificial sequence
  SiRNA target sequence
atgggcgcagatttcgacataaaac

SEQ ID NO: 16819 - DNA, 25 bp, Artificial sequence
  SiRNA target sequence
tgggcgcagatttcgacataaaaca

SEQ ID NO: 16820 - DNA, 25 bp, Artificial sequence
  SiRNA target sequence
gggcgcagatttcgacataaaacag

SEQ ID NO: 16821 - DNA, 25 bp, Artificial sequence
  SiRNA target sequence
ggcgcagatttcgacataaaacaga

SEQ ID NO: 16822 - DNA, 25 bp, Artificial sequence
  SiRNA target sequence
gcgcagatttcgacataaaacagac

SEQ ID NO: 16823 - DNA, 25 bp, Artificial sequence
  SiRNA target sequence
cgcagatttcgacataaaacagaca

SEQ ID NO: 16824 - DNA, 25 bp, Artificial sequence
  SiRNA target sequence
gcagatttcgacataaaacagacat

SEQ ID NO: 16825 - DNA, 25 bp, Artificial sequence
  SiRNA target sequence
cagatttcgacataaaacagacata

SEQ ID NO: 16826 - DNA, 25 bp, Artificial sequence
  SiRNA target sequence
agatttcgacataaaacagacatac

SEQ ID NO: 16827 - DNA, 25 bp, Artificial sequence
  SiRNA target sequence
gatttcgacataaaacagacatacg

SEQ ID NO: 16828 - DNA, 25 bp, Artificial sequence
  SiRNA target sequence
atttcgacataaaacagacatacgc

SEQ ID NO: 16829 - DNA, 25 bp, Artificial sequence
  SiRNA target sequence
tttcgacataaaacagacatacgcc

SEQ ID NO: 16830 - DNA, 25 bp, Artificial sequence
  SiRNA target sequence
ttcgacataaaacagacatacgcca

SEQ ID NO: 16831 - DNA, 25 bp, Artificial sequence
  SiRNA target sequence
tcgacataaaacagacatacgccac

SEQ ID NO: 16832 - DNA, 25 bp, Artificial sequence
  SiRNA target sequence
cgacataaaacagacatacgccacg

SEQ ID NO: 16833 - DNA, 25 bp, Artificial sequence
  SiRNA target sequence
gacataaaacagacatacgccacgt

SEQ ID NO: 16834 - DNA, 25 bp, Artificial sequence
  SiRNA target sequence
acataaaacagacatacgccacgtt

SEQ ID NO: 16835 - DNA, 25 bp, Artificial sequence
  SiRNA target sequence
cataaaacagacatacgccacgttc

SEQ ID NO: 16836 - DNA, 25 bp, Artificial sequence
  SiRNA target sequence
ataaaacagacatacgccacgttct

SEQ ID NO: 16837 - DNA, 25 bp, Artificial sequence
  SiRNA target sequence
taaaacagacatacgccacgttctg

SEQ ID NO: 16838 - DNA, 25 bp, Artificial sequence
  SiRNA target sequence
aaaacagacatacgccacgttctgc

SEQ ID NO: 16839 - DNA, 25 bp, Artificial sequence
  SiRNA target sequence
aaacagacatacgccacgttctgct

SEQ ID NO: 16840 - DNA, 25 bp, Artificial sequence
  SiRNA target sequence
aacagacatacgccacgttctgctt

SEQ ID NO: 16841 - DNA, 25 bp, Artificial sequence
  SiRNA target sequence
acagacatacgccacgttctgcttt

SEQ ID NO: 16842 - DNA, 25 bp, Artificial sequence
  SiRNA target sequence
cagacatacgccacgttctgcttta

SEQ ID NO: 16843 - DNA, 25 bp, Artificial sequence
  SiRNA target sequence
agacatacgccacgttctgctttaa

SEQ ID NO: 16844 - DNA, 25 bp, Artificial sequence
  SiRNA target sequence
gacatacgccacgttctgctttaac

SEQ ID NO: 16845 - DNA, 25 bp, Artificial sequence
  SiRNA target sequence
acatacgccacgttctgctttaaca

SEQ ID NO: 16846 - DNA, 25 bp, Artificial sequence
  SiRNA target sequence
catacgccacgttctgctttaacaa

SEQ ID NO: 16847 - DNA, 25 bp, Artificial sequence
  SiRNA target sequence
atacgccacgttctgctttaacaat

SEQ ID NO: 16848 - DNA, 25 bp, Artificial sequence
  SiRNA target sequence
tacgccacgttctgctttaacaatc

SEQ ID NO: 16849 - DNA, 25 bp, Artificial sequence
  SiRNA target sequence
acgccacgttctgctttaacaatct

SEQ ID NO: 16850 - DNA, 25 bp, Artificial sequence
  SiRNA target sequence
cgccacgttctgctttaacaatctt

SEQ ID NO: 16851 - DNA, 25 bp, Artificial sequence
  SiRNA target sequence
gccacgttctgctttaacaatcttt

SEQ ID NO: 16852 - DNA, 25 bp, Artificial sequence
  SiRNA target sequence
ccacgttctgctttaacaatctttt

SEQ ID NO: 16853 - DNA, 25 bp, Artificial sequence
  SiRNA target sequence
cacgttctgctttaacaatcttttg

SEQ ID NO: 16854 - DNA, 25 bp, Artificial sequence
  SiRNA target sequence
acgttctgctttaacaatcttttgc

SEQ ID NO: 16855 - DNA, 25 bp, Artificial sequence
  SiRNA target sequence
cgttctgctttaacaatcttttgct

SEQ ID NO: 16856 - DNA, 25 bp, Artificial sequence
  SiRNA target sequence
gttctgctttaacaatcttttgcta

SEQ ID NO: 16857 - DNA, 25 bp, Artificial sequence
  SiRNA target sequence
ttctgctttaacaatcttttgctac

SEQ ID NO: 16858 - DNA, 25 bp, Artificial sequence
  SiRNA target sequence
tctgctttaacaatcttttgctaca

SEQ ID NO: 16859 - DNA, 25 bp, Artificial sequence
  SiRNA target sequence
ctgctttaacaatcttttgctacaa

SEQ ID NO: 16860 - DNA, 25 bp, Artificial sequence
  SiRNA target sequence
tgctttaacaatcttttgctacaaa

SEQ ID NO: 16861 - DNA, 25 bp, Artificial sequence
  SiRNA target sequence
gctttaacaatcttttgctacaaac

SEQ ID NO: 16862 - DNA, 25 bp, Artificial sequence
  SiRNA target sequence
ctttaacaatcttttgctacaaacg

SEQ ID NO: 16863 - DNA, 25 bp, Artificial sequence
  SiRNA target sequence
tttaacaatcttttgctacaaacga

SEQ ID NO: 16864 - DNA, 25 bp, Artificial sequence
  SiRNA target sequence
ttaacaatcttttgctacaaacgag

SEQ ID NO: 16865 - DNA, 25 bp, Artificial sequence
  SiRNA target sequence
taacaatcttttgctacaaacgagc

SEQ ID NO: 16866 - DNA, 25 bp, Artificial sequence
  SiRNA target sequence
aacaatcttttgctacaaacgagca

SEQ ID NO: 16867 - DNA, 25 bp, Artificial sequence
  SiRNA target sequence
acaatcttttgctacaaacgagcat

SEQ ID NO: 16868 - DNA, 25 bp, Artificial sequence
  SiRNA target sequence
caatcttttgctacaaacgagcata

SEQ ID NO: 16869 - DNA, 25 bp, Artificial sequence
  SiRNA target sequence
aatcttttgctacaaacgagcatag

SEQ ID NO: 16870 - DNA, 25 bp, Artificial sequence
  SiRNA target sequence
atcttttgctacaaacgagcataga

SEQ ID NO: 16871 - DNA, 25 bp, Artificial sequence
  SiRNA target sequence
tcttttgctacaaacgagcatagac

SEQ ID NO: 16872 - DNA, 25 bp, Artificial sequence
  SiRNA target sequence
cttttgctacaaacgagcatagacc

SEQ ID NO: 16873 - DNA, 25 bp, Artificial sequence
  SiRNA target sequence
ttttgctacaaacgagcatagacca

SEQ ID NO: 16874 - DNA, 25 bp, Artificial sequence
  SiRNA target sequence
tttgctacaaacgagcatagaccaa

SEQ ID NO: 16875 - DNA, 25 bp, Artificial sequence
  SiRNA target sequence
ttgctacaaacgagcatagaccaag

SEQ ID NO: 16876 - DNA, 25 bp, Artificial sequence
  SiRNA target sequence
tgctacaaacgagcatagaccaaga

SEQ ID NO: 16877 - DNA, 25 bp, Artificial sequence
  SiRNA target sequence
gctacaaacgagcatagaccaagac

SEQ ID NO: 16878 - DNA, 25 bp, Artificial sequence
  SiRNA target sequence
ctacaaacgagcatagaccaagaca

SEQ ID NO: 16879 - DNA, 25 bp, Artificial sequence
  SiRNA target sequence
tacaaacgagcatagaccaagacaa

SEQ ID NO: 16880 - DNA, 25 bp, Artificial sequence
  SiRNA target sequence
acaaacgagcatagaccaagacaaa

SEQ ID NO: 16881 - DNA, 25 bp, Artificial sequence
  SiRNA target sequence
caaacgagcatagaccaagacaaaa

SEQ ID NO: 16882 - DNA, 25 bp, Artificial sequence
  SiRNA target sequence
aaacgagcatagaccaagacaaaat

SEQ ID NO: 16883 - DNA, 25 bp, Artificial sequence
  SiRNA target sequence
aacgagcatagaccaagacaaaata

SEQ ID NO: 16884 - DNA, 25 bp, Artificial sequence
  SiRNA target sequence
acgagcatagaccaagacaaaatat

SEQ ID NO: 16885 - DNA, 25 bp, Artificial sequence
  SiRNA target sequence
cgagcatagaccaagacaaaatatt

SEQ ID NO: 16886 - DNA, 25 bp, Artificial sequence
  SiRNA target sequence
gagcatagaccaagacaaaatattt

SEQ ID NO: 16887 - DNA, 25 bp, Artificial sequence
  SiRNA target sequence
agcatagaccaagacaaaatattta

SEQ ID NO: 16888 - DNA, 25 bp, Artificial sequence
  SiRNA target sequence
gcatagaccaagacaaaatatttag

SEQ ID NO: 16889 - DNA, 25 bp, Artificial sequence
  SiRNA target sequence
catagaccaagacaaaatatttaga

SEQ ID NO: 16890 - DNA, 25 bp, Artificial sequence
  SiRNA target sequence
atagaccaagacaaaatatttagaa

SEQ ID NO: 16891 - DNA, 25 bp, Artificial sequence
  SiRNA target sequence
tagaccaagacaaaatatttagaat

SEQ ID NO: 16892 - DNA, 25 bp, Artificial sequence
  SiRNA target sequence
agaccaagacaaaatatttagaata

SEQ ID NO: 16893 - DNA, 25 bp, Artificial sequence
  SiRNA target sequence
gaccaagacaaaatatttagaataa

SEQ ID NO: 16894 - DNA, 25 bp, Artificial sequence
  SiRNA target sequence
accaagacaaaatatttagaataag

SEQ ID NO: 16895 - DNA, 25 bp, Artificial sequence
  SiRNA target sequence
ccaagacaaaatatttagaataaga

SEQ ID NO: 16896 - DNA, 25 bp, Artificial sequence
  SiRNA target sequence
caagacaaaatatttagaataagag

SEQ ID NO: 16897 - DNA, 25 bp, Artificial sequence
  SiRNA target sequence
aagacaaaatatttagaataagagg

SEQ ID NO: 16898 - DNA, 25 bp, Artificial sequence
  SiRNA target sequence
agacaaaatatttagaataagaggt

SEQ ID NO: 16899 - DNA, 25 bp, Artificial sequence
  SiRNA target sequence
gacaaaatatttagaataagaggta

SEQ ID NO: 16900 - DNA, 25 bp, Artificial sequence
  SiRNA target sequence
acaaaatatttagaataagaggtac

SEQ ID NO: 16901 - DNA, 25 bp, Artificial sequence
  SiRNA target sequence
caaaatatttagaataagaggtacc

SEQ ID NO: 16902 - DNA, 25 bp, Artificial sequence
  SiRNA target sequence
aaaatatttagaataagaggtaccc

SEQ ID NO: 16903 - DNA, 25 bp, Artificial sequence
  SiRNA target sequence
aaatatttagaataagaggtaccca

SEQ ID NO: 16904 - DNA, 25 bp, Artificial sequence
  SiRNA target sequence
aatatttagaataagaggtacccac

SEQ ID NO: 16905 - DNA, 25 bp, Artificial sequence
  SiRNA target sequence
atatttagaataagaggtacccaca

SEQ ID NO: 16906 - DNA, 25 bp, Artificial sequence
  SiRNA target sequence
tatttagaataagaggtacccacat

SEQ ID NO: 16907 - DNA, 25 bp, Artificial sequence
  SiRNA target sequence
atttagaataagaggtacccacatg

SEQ ID NO: 16908 - DNA, 25 bp, Artificial sequence
  SiRNA target sequence
tttagaataagaggtacccacatgt

SEQ ID NO: 16909 - DNA, 25 bp, Artificial sequence
  SiRNA target sequence
ttagaataagaggtacccacatgtt

SEQ ID NO: 16910 - DNA, 25 bp, Artificial sequence
  SiRNA target sequence
tagaataagaggtacccacatgttt

SEQ ID NO: 16911 - DNA, 25 bp, Artificial sequence
  SiRNA target sequence
agaataagaggtacccacatgttta

SEQ ID NO: 16912 - DNA, 25 bp, Artificial sequence
  SiRNA target sequence
gaataagaggtacccacatgtttaa

SEQ ID NO: 16913 - DNA, 25 bp, Artificial sequence
  SiRNA target sequence
aataagaggtacccacatgtttaaa

SEQ ID NO: 16914 - DNA, 25 bp, Artificial sequence
  SiRNA target sequence
ataagaggtacccacatgtttaaaa

SEQ ID NO: 16915 - DNA, 25 bp, Artificial sequence
  SiRNA target sequence
taagaggtacccacatgtttaaaaa

SEQ ID NO: 16916 - DNA, 25 bp, Artificial sequence
  SiRNA target sequence
aagaggtacccacatgtttaaaaat

SEQ ID NO: 16917 - DNA, 25 bp, Artificial sequence
  SiRNA target sequence
agaggtacccacatgtttaaaaatc

SEQ ID NO: 16918 - DNA, 25 bp, Artificial sequence
  SiRNA target sequence
gaggtacccacatgtttaaaaatct

SEQ ID NO: 16919 - DNA, 25 bp, Artificial sequence
  SiRNA target sequence
aggtacccacatgtttaaaaatcta

SEQ ID NO: 16920 - DNA, 25 bp, Artificial sequence
  SiRNA target sequence
ggtacccacatgtttaaaaatctac

SEQ ID NO: 16921 - DNA, 25 bp, Artificial sequence
  SiRNA target sequence
gtacccacatgtttaaaaatctact

SEQ ID NO: 16922 - DNA, 25 bp, Artificial sequence
  SiRNA target sequence
tacccacatgtttaaaaatctactt

SEQ ID NO: 16923 - DNA, 25 bp, Artificial sequence
  SiRNA target sequence
acccacatgtttaaaaatctactta

SEQ ID NO: 16924 - DNA, 25 bp, Artificial sequence
  SiRNA target sequence
cccacatgtttaaaaatctacttac

SEQ ID NO: 16925 - DNA, 25 bp, Artificial sequence
  SiRNA target sequence
ccacatgtttaaaaatctacttact

SEQ ID NO: 16926 - DNA, 25 bp, Artificial sequence
  SiRNA target sequence
cacatgtttaaaaatctacttacta

SEQ ID NO: 16927 - DNA, 25 bp, Artificial sequence
  SiRNA target sequence
acatgtttaaaaatctacttactaa

SEQ ID NO: 16928 - DNA, 25 bp, Artificial sequence
  SiRNA target sequence
catgtttaaaaatctacttactaaa

SEQ ID NO: 16929 - DNA, 25 bp, Artificial sequence
  SiRNA target sequence
atgtttaaaaatctacttactaaat

SEQ ID NO: 16930 - DNA, 25 bp, Artificial sequence
  SiRNA target sequence
tgtttaaaaatctacttactaaatt

SEQ ID NO: 16931 - DNA, 25 bp, Artificial sequence
  SiRNA target sequence
gtttaaaaatctacttactaaattc

SEQ ID NO: 16932 - DNA, 25 bp, Artificial sequence
  SiRNA target sequence
tttaaaaatctacttactaaattcc

SEQ ID NO: 16933 - DNA, 25 bp, Artificial sequence
  SiRNA target sequence
ttaaaaatctacttactaaattcca

SEQ ID NO: 16934 - DNA, 25 bp, Artificial sequence
  SiRNA target sequence
taaaaatctacttactaaattccat

SEQ ID NO: 16935 - DNA, 25 bp, Artificial sequence
  SiRNA target sequence
aaaaatctacttactaaattccata

SEQ ID NO: 16936 - DNA, 25 bp, Artificial sequence
  SiRNA target sequence
aaaatctacttactaaattccatac

SEQ ID NO: 16937 - DNA, 25 bp, Artificial sequence
  SiRNA target sequence
aaatctacttactaaattccataca

SEQ ID NO: 16938 - DNA, 25 bp, Artificial sequence
  SiRNA target sequence
aatctacttactaaattccatacag

SEQ ID NO: 16939 - DNA, 25 bp, Artificial sequence
  SiRNA target sequence
atctacttactaaattccatacagt

SEQ ID NO: 16940 - DNA, 25 bp, Artificial sequence
  SiRNA target sequence
tctacttactaaattccatacagta

SEQ ID NO: 16941 - DNA, 25 bp, Artificial sequence
  SiRNA target sequence
ctacttactaaattccatacagtaa

SEQ ID NO: 16942 - DNA, 25 bp, Artificial sequence
  SiRNA target sequence
tacttactaaattccatacagtaat

SEQ ID NO: 16943 - DNA, 25 bp, Artificial sequence
  SiRNA target sequence
acttactaaattccatacagtaatt

SEQ ID NO: 16944 - DNA, 25 bp, Artificial sequence
  SiRNA target sequence
cttactaaattccatacagtaattg

SEQ ID NO: 16945 - DNA, 25 bp, Artificial sequence
  SiRNA target sequence
ttactaaattccatacagtaattgg

SEQ ID NO: 16946 - DNA, 25 bp, Artificial sequence
  SiRNA target sequence
tactaaattccatacagtaattggt

SEQ ID NO: 16947 - DNA, 25 bp, Artificial sequence
  SiRNA target sequence
actaaattccatacagtaattggta

SEQ ID NO: 16948 - DNA, 25 bp, Artificial sequence
  SiRNA target sequence
ctaaattccatacagtaattggtag

SEQ ID NO: 16949 - DNA, 25 bp, Artificial sequence
  SiRNA target sequence
taaattccatacagtaattggtaga

SEQ ID NO: 16950 - DNA, 25 bp, Artificial sequence
  SiRNA target sequence
aaattccatacagtaattggtagaa

SEQ ID NO: 16951 - DNA, 25 bp, Artificial sequence
  SiRNA target sequence
aattccatacagtaattggtagaag

SEQ ID NO: 16952 - DNA, 25 bp, Artificial sequence
  SiRNA target sequence
attccatacagtaattggtagaagt

SEQ ID NO: 16953 - DNA, 25 bp, Artificial sequence
  SiRNA target sequence
ttccatacagtaattggtagaagta

SEQ ID NO: 16954 - DNA, 25 bp, Artificial sequence
  SiRNA target sequence
tccatacagtaattggtagaagtaa

SEQ ID NO: 16955 - DNA, 25 bp, Artificial sequence
  SiRNA target sequence
ccatacagtaattggtagaagtaaa

SEQ ID NO: 16956 - DNA, 25 bp, Artificial sequence
  SiRNA target sequence
catacagtaattggtagaagtaaag

SEQ ID NO: 16957 - DNA, 25 bp, Artificial sequence
  SiRNA target sequence
atacagtaattggtagaagtaaaga

SEQ ID NO: 16958 - DNA, 25 bp, Artificial sequence
  SiRNA target sequence
tacagtaattggtagaagtaaagat

SEQ ID NO: 16959 - DNA, 25 bp, Artificial sequence
  SiRNA target sequence
acagtaattggtagaagtaaagata

SEQ ID NO: 16960 - DNA, 25 bp, Artificial sequence
  SiRNA target sequence
cagtaattggtagaagtaaagatat

SEQ ID NO: 16961 - DNA, 25 bp, Artificial sequence
  SiRNA target sequence
agtaattggtagaagtaaagatatc

SEQ ID NO: 16962 - DNA, 25 bp, Artificial sequence
  SiRNA target sequence
gtaattggtagaagtaaagatatct

SEQ ID NO: 16963 - DNA, 25 bp, Artificial sequence
  SiRNA target sequence
taattggtagaagtaaagatatctt

SEQ ID NO: 16964 - DNA, 25 bp, Artificial sequence
  SiRNA target sequence
aattggtagaagtaaagatatcttt

SEQ ID NO: 16965 - DNA, 25 bp, Artificial sequence
  SiRNA target sequence
attggtagaagtaaagatatcttta

SEQ ID NO: 16966 - DNA, 25 bp, Artificial sequence
  SiRNA target sequence
ttggtagaagtaaagatatctttac

SEQ ID NO: 16967 - DNA, 25 bp, Artificial sequence
  SiRNA target sequence
tggtagaagtaaagatatctttaca

SEQ ID NO: 16968 - DNA, 25 bp, Artificial sequence
  SiRNA target sequence
ggtagaagtaaagatatctttacac

SEQ ID NO: 16969 - DNA, 25 bp, Artificial sequence
  SiRNA target sequence
gtagaagtaaagatatctttacaca

SEQ ID NO: 16970 - DNA, 25 bp, Artificial sequence
  SiRNA target sequence
tagaagtaaagatatctttacacaa

SEQ ID NO: 16971 - DNA, 25 bp, Artificial sequence
  SiRNA target sequence
agaagtaaagatatctttacacaaa

SEQ ID NO: 16972 - DNA, 25 bp, Artificial sequence
  SiRNA target sequence
gaagtaaagatatctttacacaaat

SEQ ID NO: 16973 - DNA, 25 bp, Artificial sequence
  SiRNA target sequence
aagtaaagatatctttacacaaata

SEQ ID NO: 16974 - DNA, 25 bp, Artificial sequence
  SiRNA target sequence
agtaaagatatctttacacaaatag

SEQ ID NO: 16975 - DNA, 25 bp, Artificial sequence
  SiRNA target sequence
gtaaagatatctttacacaaataga

SEQ ID NO: 16976 - DNA, 25 bp, Artificial sequence
  SiRNA target sequence
taaagatatctttacacaaatagag

SEQ ID NO: 16977 - DNA, 25 bp, Artificial sequence
  SiRNA target sequence
aaagatatctttacacaaatagagg

SEQ ID NO: 16978 - DNA, 25 bp, Artificial sequence
  SiRNA target sequence
aagatatctttacacaaatagaggt

SEQ ID NO: 16979 - DNA, 25 bp, Artificial sequence
  SiRNA target sequence
agatatctttacacaaatagaggta

SEQ ID NO: 16980 - DNA, 25 bp, Artificial sequence
  SiRNA target sequence
gatatctttacacaaatagaggtag

SEQ ID NO: 16981 - DNA, 25 bp, Artificial sequence
  SiRNA target sequence
atatctttacacaaatagaggtaga

SEQ ID NO: 16982 - DNA, 25 bp, Artificial sequence
  SiRNA target sequence
tatctttacacaaatagaggtagac

SEQ ID NO: 16983 - DNA, 25 bp, Artificial sequence
  SiRNA target sequence
atctttacacaaatagaggtagaca

SEQ ID NO: 16984 - DNA, 25 bp, Artificial sequence
  SiRNA target sequence
tctttacacaaatagaggtagacat

SEQ ID NO: 16985 - DNA, 25 bp, Artificial sequence
  SiRNA target sequence
ctttacacaaatagaggtagacata

SEQ ID NO: 16986 - DNA, 25 bp, Artificial sequence
  SiRNA target sequence
tttacacaaatagaggtagacataa

SEQ ID NO: 16987 - DNA, 25 bp, Artificial sequence
  SiRNA target sequence
ttacacaaatagaggtagacataaa

SEQ ID NO: 16988 - DNA, 25 bp, Artificial sequence
  SiRNA target sequence
tacacaaatagaggtagacataaaa

SEQ ID NO: 16989 - DNA, 25 bp, Artificial sequence
  SiRNA target sequence
acacaaatagaggtagacataaaaa

SEQ ID NO: 16990 - DNA, 25 bp, Artificial sequence
  SiRNA target sequence
cacaaatagaggtagacataaaaaa

SEQ ID NO: 16991 - DNA, 25 bp, Artificial sequence
  SiRNA target sequence
acaaatagaggtagacataaaaaat

SEQ ID NO: 16992 - DNA, 25 bp, Artificial sequence
  SiRNA target sequence
caaatagaggtagacataaaaaata

SEQ ID NO: 16993 - DNA, 25 bp, Artificial sequence
  SiRNA target sequence
aaatagaggtagacataaaaaataa

SEQ ID NO: 16994 - DNA, 25 bp, Artificial sequence
  SiRNA target sequence
aatagaggtagacataaaaaataaa

SEQ ID NO: 16995 - DNA, 25 bp, Artificial sequence
  SiRNA target sequence
atagaggtagacataaaaaataaat

SEQ ID NO: 16996 - DNA, 25 bp, Artificial sequence
  SiRNA target sequence
tagaggtagacataaaaaataaata

SEQ ID NO: 16997 - DNA, 25 bp, Artificial sequence
  SiRNA target sequence
agaggtagacataaaaaataaatac

SEQ ID NO: 16998 - DNA, 25 bp, Artificial sequence
  SiRNA target sequence
gaggtagacataaaaaataaataca

SEQ ID NO: 16999 - DNA, 25 bp, Artificial sequence
  SiRNA target sequence
aggtagacataaaaaataaatacaa

SEQ ID NO: 17000 - DNA, 25 bp, Artificial sequence
  SiRNA target sequence
ggtagacataaaaaataaatacaat

SEQ ID NO: 17001 - DNA, 25 bp, Artificial sequence
  SiRNA target sequence
gtagacataaaaaataaatacaata

SEQ ID NO: 17002 - DNA, 25 bp, Artificial sequence
  SiRNA target sequence
tagacataaaaaataaatacaataa

SEQ ID NO: 17003 - DNA, 25 bp, Artificial sequence
  SiRNA target sequence
agacataaaaaataaatacaataat

SEQ ID NO: 17004 - DNA, 25 bp, Artificial sequence
  SiRNA target sequence
gacataaaaaataaatacaataata

SEQ ID NO: 17005 - DNA, 25 bp, Artificial sequence
  SiRNA target sequence
acataaaaaataaatacaataatat

SEQ ID NO: 17006 - DNA, 25 bp, Artificial sequence
  SiRNA target sequence
cataaaaaataaatacaataatatg

SEQ ID NO: 17007 - DNA, 25 bp, Artificial sequence
  SiRNA target sequence
ataaaaaataaatacaataatatgt

SEQ ID NO: 17008 - DNA, 25 bp, Artificial sequence
  SiRNA target sequence
taaaaaataaatacaataatatgtg

SEQ ID NO: 17009 - DNA, 25 bp, Artificial sequence
  SiRNA target sequence
aaaaaataaatacaataatatgtgt

SEQ ID NO: 17010 - DNA, 25 bp, Artificial sequence
  SiRNA target sequence
aaaaataaatacaataatatgtgta

SEQ ID NO: 17011 - DNA, 25 bp, Artificial sequence
  SiRNA target sequence
aaaataaatacaataatatgtgtat

SEQ ID NO: 17012 - DNA, 25 bp, Artificial sequence
  SiRNA target sequence
aaataaatacaataatatgtgtata

SEQ ID NO: 17013 - DNA, 25 bp, Artificial sequence
  SiRNA target sequence
aataaatacaataatatgtgtataa

SEQ ID NO: 17014 - DNA, 25 bp, Artificial sequence
  SiRNA target sequence
ataaatacaataatatgtgtataaa

SEQ ID NO: 17015 - DNA, 25 bp, Artificial sequence
  SiRNA target sequence
taaatacaataatatgtgtataaaa

SEQ ID NO: 17016 - DNA, 25 bp, Artificial sequence
  SiRNA target sequence
aaatacaataatatgtgtataaaaa

SEQ ID NO: 17017 - DNA, 25 bp, Artificial sequence
  SiRNA target sequence
aatacaataatatgtgtataaaaat

SEQ ID NO: 17018 - DNA, 25 bp, Artificial sequence
  SiRNA target sequence
atacaataatatgtgtataaaaatg

SEQ ID NO: 17019 - DNA, 25 bp, Artificial sequence
  SiRNA target sequence
tacaataatatgtgtataaaaatga

SEQ ID NO: 17020 - DNA, 25 bp, Artificial sequence
  SiRNA target sequence
acaataatatgtgtataaaaatgat

SEQ ID NO: 17021 - DNA, 25 bp, Artificial sequence
  SiRNA target sequence
caataatatgtgtataaaaatgata

SEQ ID NO: 17022 - DNA, 25 bp, Artificial sequence
  SiRNA target sequence
aataatatgtgtataaaaatgatac

SEQ ID NO: 17023 - DNA, 25 bp, Artificial sequence
  SiRNA target sequence
ataatatgtgtataaaaatgataca

SEQ ID NO: 17024 - DNA, 25 bp, Artificial sequence
  SiRNA target sequence
taatatgtgtataaaaatgatacag

SEQ ID NO: 17025 - DNA, 25 bp, Artificial sequence
  SiRNA target sequence
aatatgtgtataaaaatgatacagc

SEQ ID NO: 17026 - DNA, 25 bp, Artificial sequence
  SiRNA target sequence
atatgtgtataaaaatgatacagcc

SEQ ID NO: 17027 - DNA, 25 bp, Artificial sequence
  SiRNA target sequence
tatgtgtataaaaatgatacagcca

SEQ ID NO: 17028 - DNA, 25 bp, Artificial sequence
  SiRNA target sequence
atgtgtataaaaatgatacagccag

SEQ ID NO: 17029 - DNA, 25 bp, Artificial sequence
  SiRNA target sequence
tgtgtataaaaatgatacagccagc

SEQ ID NO: 17030 - DNA, 25 bp, Artificial sequence
  SiRNA target sequence
gtgtataaaaatgatacagccagct

SEQ ID NO: 17031 - DNA, 25 bp, Artificial sequence
  SiRNA target sequence
tgtataaaaatgatacagccagcta

SEQ ID NO: 17032 - DNA, 25 bp, Artificial sequence
  SiRNA target sequence
gtataaaaatgatacagccagctat

SEQ ID NO: 17033 - DNA, 25 bp, Artificial sequence
  SiRNA target sequence
tataaaaatgatacagccagctatt

SEQ ID NO: 17034 - DNA, 25 bp, Artificial sequence
  SiRNA target sequence
ataaaaatgatacagccagctatta

SEQ ID NO: 17035 - DNA, 25 bp, Artificial sequence
  SiRNA target sequence
taaaaatgatacagccagctattaa

SEQ ID NO: 17036 - DNA, 25 bp, Artificial sequence
  SiRNA target sequence
aaaaatgatacagccagctattaaa

SEQ ID NO: 17037 - DNA, 25 bp, Artificial sequence
  SiRNA target sequence
aaaatgatacagccagctattaaag

SEQ ID NO: 17038 - DNA, 25 bp, Artificial sequence
  SiRNA target sequence
aaatgatacagccagctattaaagg

SEQ ID NO: 17039 - DNA, 25 bp, Artificial sequence
  SiRNA target sequence
aatgatacagccagctattaaaggt

SEQ ID NO: 17040 - DNA, 25 bp, Artificial sequence
  SiRNA target sequence
atgatacagccagctattaaaggtg

SEQ ID NO: 17041 - DNA, 25 bp, Artificial sequence
  SiRNA target sequence
tgatacagccagctattaaaggtgc

SEQ ID NO: 17042 - DNA, 25 bp, Artificial sequence
  SiRNA target sequence
gatacagccagctattaaaggtgct

SEQ ID NO: 17043 - DNA, 25 bp, Artificial sequence
  SiRNA target sequence
atacagccagctattaaaggtgctt

SEQ ID NO: 17044 - DNA, 25 bp, Artificial sequence
  SiRNA target sequence
tacagccagctattaaaggtgcttc

SEQ ID NO: 17045 - DNA, 25 bp, Artificial sequence
  SiRNA target sequence
acagccagctattaaaggtgcttca

SEQ ID NO: 17046 - DNA, 25 bp, Artificial sequence
  SiRNA target sequence
cagccagctattaaaggtgcttcat

SEQ ID NO: 17047 - DNA, 25 bp, Artificial sequence
  SiRNA target sequence
agccagctattaaaggtgcttcatg

SEQ ID NO: 17048 - DNA, 25 bp, Artificial sequence
  SiRNA target sequence
gccagctattaaaggtgcttcatgt

SEQ ID NO: 17049 - DNA, 25 bp, Artificial sequence
  SiRNA target sequence
ccagctattaaaggtgcttcatgta

SEQ ID NO: 17050 - DNA, 25 bp, Artificial sequence
  SiRNA target sequence
cagctattaaaggtgcttcatgtat

SEQ ID NO: 17051 - DNA, 25 bp, Artificial sequence
  SiRNA target sequence
agctattaaaggtgcttcatgtata

SEQ ID NO: 17052 - DNA, 25 bp, Artificial sequence
  SiRNA target sequence
gctattaaaggtgcttcatgtatat

SEQ ID NO: 17053 - DNA, 25 bp, Artificial sequence
  SiRNA target sequence
ctattaaaggtgcttcatgtatata

SEQ ID NO: 17054 - DNA, 25 bp, Artificial sequence
  SiRNA target sequence
tattaaaggtgcttcatgtatatac

SEQ ID NO: 17055 - DNA, 25 bp, Artificial sequence
  SiRNA target sequence
attaaaggtgcttcatgtatatacg

SEQ ID NO: 17056 - DNA, 25 bp, Artificial sequence
  SiRNA target sequence
ttaaaggtgcttcatgtatatacgt

SEQ ID NO: 17057 - DNA, 25 bp, Artificial sequence
  SiRNA target sequence
taaaggtgcttcatgtatatacgtg

SEQ ID NO: 17058 - DNA, 25 bp, Artificial sequence
  SiRNA target sequence
aaaggtgcttcatgtatatacgtgg

SEQ ID NO: 17059 - DNA, 25 bp, Artificial sequence
  SiRNA target sequence
aaggtgcttcatgtatatacgtggg

SEQ ID NO: 17060 - DNA, 25 bp, Artificial sequence
  SiRNA target sequence
aggtgcttcatgtatatacgtgggt

SEQ ID NO: 17061 - DNA, 25 bp, Artificial sequence
  SiRNA target sequence
ggtgcttcatgtatatacgtgggta

SEQ ID NO: 17062 - DNA, 25 bp, Artificial sequence
  SiRNA target sequence
gtgcttcatgtatatacgtgggtaa

SEQ ID NO: 17063 - DNA, 25 bp, Artificial sequence
  SiRNA target sequence
tgcttcatgtatatacgtgggtaat

SEQ ID NO: 17064 - DNA, 25 bp, Artificial sequence
  SiRNA target sequence
gcttcatgtatatacgtgggtaatt

SEQ ID NO: 17065 - DNA, 25 bp, Artificial sequence
  SiRNA target sequence
cttcatgtatatacgtgggtaatta

SEQ ID NO: 17066 - DNA, 25 bp, Artificial sequence
  SiRNA target sequence
ttcatgtatatacgtgggtaattat

SEQ ID NO: 17067 - DNA, 25 bp, Artificial sequence
  SiRNA target sequence
tcatgtatatacgtgggtaattata

SEQ ID NO: 17068 - DNA, 25 bp, Artificial sequence
  SiRNA target sequence
catgtatatacgtgggtaattatat

SEQ ID NO: 17069 - DNA, 25 bp, Artificial sequence
  SiRNA target sequence
atgtatatacgtgggtaattatatg

SEQ ID NO: 17070 - DNA, 25 bp, Artificial sequence
  SiRNA target sequence
tgtatatacgtgggtaattatatgc

SEQ ID NO: 17071 - DNA, 25 bp, Artificial sequence
  SiRNA target sequence
gtatatacgtgggtaattatatgca

SEQ ID NO: 17072 - DNA, 25 bp, Artificial sequence
  SiRNA target sequence
tatatacgtgggtaattatatgcag

SEQ ID NO: 17073 - DNA, 25 bp, Artificial sequence
  SiRNA target sequence
atatacgtgggtaattatatgcagc

SEQ ID NO: 17074 - DNA, 25 bp, Artificial sequence
  SiRNA target sequence
tatacgtgggtaattatatgcagca

SEQ ID NO: 17075 - DNA, 25 bp, Artificial sequence
  SiRNA target sequence
atacgtgggtaattatatgcagcag

SEQ ID NO: 17076 - DNA, 25 bp, Artificial sequence
  SiRNA target sequence
tacgtgggtaattatatgcagcagc

SEQ ID NO: 17077 - DNA, 25 bp, Artificial sequence
  SiRNA target sequence
acgtgggtaattatatgcagcagct

SEQ ID NO: 17078 - DNA, 25 bp, Artificial sequence
  SiRNA target sequence
cgtgggtaattatatgcagcagcta

SEQ ID NO: 17079 - DNA, 25 bp, Artificial sequence
  SiRNA target sequence
gtgggtaattatatgcagcagctag

SEQ ID NO: 17080 - DNA, 25 bp, Artificial sequence
  SiRNA target sequence
tgggtaattatatgcagcagctagg

SEQ ID NO: 17081 - DNA, 25 bp, Artificial sequence
  SiRNA target sequence
gggtaattatatgcagcagctagga

SEQ ID NO: 17082 - DNA, 25 bp, Artificial sequence
  SiRNA target sequence
ggtaattatatgcagcagctaggag

SEQ ID NO: 17083 - DNA, 25 bp, Artificial sequence
  SiRNA target sequence
gtaattatatgcagcagctaggagt

SEQ ID NO: 17084 - DNA, 25 bp, Artificial sequence
  SiRNA target sequence
taattatatgcagcagctaggagta

SEQ ID NO: 17085 - DNA, 25 bp, Artificial sequence
  SiRNA target sequence
aattatatgcagcagctaggagtaa

SEQ ID NO: 17086 - DNA, 25 bp, Artificial sequence
  SiRNA target sequence
attatatgcagcagctaggagtaat

SEQ ID NO: 17087 - DNA, 25 bp, Artificial sequence
  SiRNA target sequence
ttatatgcagcagctaggagtaatt

SEQ ID NO: 17088 - DNA, 25 bp, Artificial sequence
  SiRNA target sequence
tatatgcagcagctaggagtaatta

SEQ ID NO: 17089 - DNA, 25 bp, Artificial sequence
  SiRNA target sequence
atatgcagcagctaggagtaattag

SEQ ID NO: 17090 - DNA, 25 bp, Artificial sequence
  SiRNA target sequence
tatgcagcagctaggagtaattagt

SEQ ID NO: 17091 - DNA, 25 bp, Artificial sequence
  SiRNA target sequence
atgcagcagctaggagtaattagtc

SEQ ID NO: 17092 - DNA, 25 bp, Artificial sequence
  SiRNA target sequence
tgcagcagctaggagtaattagtct

SEQ ID NO: 17093 - DNA, 25 bp, Artificial sequence
  SiRNA target sequence
gcagcagctaggagtaattagtctt

SEQ ID NO: 17094 - DNA, 25 bp, Artificial sequence
  SiRNA target sequence
cagcagctaggagtaattagtcttg

SEQ ID NO: 17095 - DNA, 25 bp, Artificial sequence
  SiRNA target sequence
agcagctaggagtaattagtcttgg

SEQ ID NO: 17096 - DNA, 25 bp, Artificial sequence
  SiRNA target sequence
gcagctaggagtaattagtcttggt

SEQ ID NO: 17097 - DNA, 25 bp, Artificial sequence
  SiRNA target sequence
cagctaggagtaattagtcttggtg

SEQ ID NO: 17098 - DNA, 25 bp, Artificial sequence
  SiRNA target sequence
agctaggagtaattagtcttggtgg

SEQ ID NO: 17099 - DNA, 25 bp, Artificial sequence
  SiRNA target sequence
gctaggagtaattagtcttggtggg

SEQ ID NO: 17100 - DNA, 25 bp, Artificial sequence
  SiRNA target sequence
ctaggagtaattagtcttggtgggg

SEQ ID NO: 17101 - DNA, 25 bp, Artificial sequence
  SiRNA target sequence
taggagtaattagtcttggtgggga

SEQ ID NO: 17102 - DNA, 25 bp, Artificial sequence
  SiRNA target sequence
aggagtaattagtcttggtggggag

SEQ ID NO: 17103 - DNA, 25 bp, Artificial sequence
  SiRNA target sequence
ggagtaattagtcttggtggggaga

SEQ ID NO: 17104 - DNA, 25 bp, Artificial sequence
  SiRNA target sequence
gagtaattagtcttggtggggagat

SEQ ID NO: 17105 - DNA, 25 bp, Artificial sequence
  SiRNA target sequence
agtaattagtcttggtggggagatt

SEQ ID NO: 17106 - DNA, 25 bp, Artificial sequence
  SiRNA target sequence
gtaattagtcttggtggggagatta

SEQ ID NO: 17107 - DNA, 25 bp, Artificial sequence
  SiRNA target sequence
taattagtcttggtggggagattat

SEQ ID NO: 17108 - DNA, 25 bp, Artificial sequence
  SiRNA target sequence
aattagtcttggtggggagattatt

SEQ ID NO: 17109 - DNA, 25 bp, Artificial sequence
  SiRNA target sequence
attagtcttggtggggagattatta

SEQ ID NO: 17110 - DNA, 25 bp, Artificial sequence
  SiRNA target sequence
ttagtcttggtggggagattattaa

SEQ ID NO: 17111 - DNA, 25 bp, Artificial sequence
  SiRNA target sequence
tagtcttggtggggagattattaaa

SEQ ID NO: 17112 - DNA, 25 bp, Artificial sequence
  SiRNA target sequence
agtcttggtggggagattattaaag

SEQ ID NO: 17113 - DNA, 25 bp, Artificial sequence
  SiRNA target sequence
gtcttggtggggagattattaaagc

SEQ ID NO: 17114 - DNA, 25 bp, Artificial sequence
  SiRNA target sequence
tcttggtggggagattattaaagct

SEQ ID NO: 17115 - DNA, 25 bp, Artificial sequence
  SiRNA target sequence
cttggtggggagattattaaagctg

SEQ ID NO: 17116 - DNA, 25 bp, Artificial sequence
  SiRNA target sequence
ttggtggggagattattaaagctga

SEQ ID NO: 17117 - DNA, 25 bp, Artificial sequence
  SiRNA target sequence
tggtggggagattattaaagctgat

SEQ ID NO: 17118 - DNA, 25 bp, Artificial sequence
  SiRNA target sequence
ggtggggagattattaaagctgatg

SEQ ID NO: 17119 - DNA, 25 bp, Artificial sequence
  SiRNA target sequence
gtggggagattattaaagctgatga

SEQ ID NO: 17120 - DNA, 25 bp, Artificial sequence
  SiRNA target sequence
tggggagattattaaagctgatgaa

SEQ ID NO: 17121 - DNA, 25 bp, Artificial sequence
  SiRNA target sequence
ggggagattattaaagctgatgaat

SEQ ID NO: 17122 - DNA, 25 bp, Artificial sequence
  SiRNA target sequence
gggagattattaaagctgatgaata

SEQ ID NO: 17123 - DNA, 25 bp, Artificial sequence
  SiRNA target sequence
ggagattattaaagctgatgaatac

SEQ ID NO: 17124 - DNA, 25 bp, Artificial sequence
  SiRNA target sequence
gagattattaaagctgatgaataca

SEQ ID NO: 17125 - DNA, 25 bp, Artificial sequence
  SiRNA target sequence
agattattaaagctgatgaatacat

SEQ ID NO: 17126 - DNA, 25 bp, Artificial sequence
  SiRNA target sequence
gattattaaagctgatgaatacatt

SEQ ID NO: 17127 - DNA, 25 bp, Artificial sequence
  SiRNA target sequence
attattaaagctgatgaatacattg

SEQ ID NO: 17128 - DNA, 25 bp, Artificial sequence
  SiRNA target sequence
ttattaaagctgatgaatacattgg

SEQ ID NO: 17129 - DNA, 25 bp, Artificial sequence
  SiRNA target sequence
tattaaagctgatgaatacattgga

SEQ ID NO: 17130 - DNA, 25 bp, Artificial sequence
  SiRNA target sequence
attaaagctgatgaatacattggac

SEQ ID NO: 17131 - DNA, 25 bp, Artificial sequence
  SiRNA target sequence
ttaaagctgatgaatacattggact

SEQ ID NO: 17132 - DNA, 25 bp, Artificial sequence
  SiRNA target sequence
taaagctgatgaatacattggacta

SEQ ID NO: 17133 - DNA, 25 bp, Artificial sequence
  SiRNA target sequence
aaagctgatgaatacattggactat

SEQ ID NO: 17134 - DNA, 25 bp, Artificial sequence
  SiRNA target sequence
aagctgatgaatacattggactatc

SEQ ID NO: 17135 - DNA, 25 bp, Artificial sequence
  SiRNA target sequence
agctgatgaatacattggactatct

SEQ ID NO: 17136 - DNA, 25 bp, Artificial sequence
  SiRNA target sequence
gctgatgaatacattggactatctt

SEQ ID NO: 17137 - DNA, 25 bp, Artificial sequence
  SiRNA target sequence
ctgatgaatacattggactatcttt

SEQ ID NO: 17138 - DNA, 25 bp, Artificial sequence
  SiRNA target sequence
tgatgaatacattggactatctttt

SEQ ID NO: 17139 - DNA, 25 bp, Artificial sequence
  SiRNA target sequence
gatgaatacattggactatcttttg

SEQ ID NO: 17140 - DNA, 25 bp, Artificial sequence
  SiRNA target sequence
atgaatacattggactatcttttgt

SEQ ID NO: 17141 - DNA, 25 bp, Artificial sequence
  SiRNA target sequence
tgaatacattggactatcttttgta

SEQ ID NO: 17142 - DNA, 25 bp, Artificial sequence
  SiRNA target sequence
gaatacattggactatcttttgtag

SEQ ID NO: 17143 - DNA, 25 bp, Artificial sequence
  SiRNA target sequence
aatacattggactatcttttgtagg

SEQ ID NO: 17144 - DNA, 25 bp, Artificial sequence
  SiRNA target sequence
atacattggactatcttttgtaggg

SEQ ID NO: 17145 - DNA, 25 bp, Artificial sequence
  SiRNA target sequence
tacattggactatcttttgtaggga

SEQ ID NO: 17146 - DNA, 25 bp, Artificial sequence
  SiRNA target sequence
acattggactatcttttgtagggag

SEQ ID NO: 17147 - DNA, 25 bp, Artificial sequence
  SiRNA target sequence
cattggactatcttttgtagggaga

SEQ ID NO: 17148 - DNA, 25 bp, Artificial sequence
  SiRNA target sequence
attggactatcttttgtagggagat

SEQ ID NO: 17149 - DNA, 25 bp, Artificial sequence
  SiRNA target sequence
ttggactatcttttgtagggagata

SEQ ID NO: 17150 - DNA, 25 bp, Artificial sequence
  SiRNA target sequence
tggactatcttttgtagggagatat

SEQ ID NO: 17151 - DNA, 25 bp, Artificial sequence
  SiRNA target sequence
ggactatcttttgtagggagatatg

SEQ ID NO: 17152 - DNA, 25 bp, Artificial sequence
  SiRNA target sequence
gactatcttttgtagggagatatga

SEQ ID NO: 17153 - DNA, 25 bp, Artificial sequence
  SiRNA target sequence
actatcttttgtagggagatatgaa

SEQ ID NO: 17154 - DNA, 25 bp, Artificial sequence
  SiRNA target sequence
ctatcttttgtagggagatatgaag

SEQ ID NO: 17155 - DNA, 25 bp, Artificial sequence
  SiRNA target sequence
tatcttttgtagggagatatgaagg

SEQ ID NO: 17156 - DNA, 25 bp, Artificial sequence
  SiRNA target sequence
atcttttgtagggagatatgaaggg

SEQ ID NO: 17157 - DNA, 25 bp, Artificial sequence
  SiRNA target sequence
tcttttgtagggagatatgaaggga

SEQ ID NO: 17158 - DNA, 25 bp, Artificial sequence
  SiRNA target sequence
cttttgtagggagatatgaagggat

SEQ ID NO: 17159 - DNA, 25 bp, Artificial sequence
  SiRNA target sequence
ttttgtagggagatatgaagggatt

SEQ ID NO: 17160 - DNA, 25 bp, Artificial sequence
  SiRNA target sequence
tttgtagggagatatgaagggattg

SEQ ID NO: 17161 - DNA, 25 bp, Artificial sequence
  SiRNA target sequence
ttgtagggagatatgaagggattgg

SEQ ID NO: 17162 - DNA, 25 bp, Artificial sequence
  SiRNA target sequence
tgtagggagatatgaagggattggt

SEQ ID NO: 17163 - DNA, 25 bp, Artificial sequence
  SiRNA target sequence
gtagggagatatgaagggattggtt

SEQ ID NO: 17164 - DNA, 25 bp, Artificial sequence
  SiRNA target sequence
tagggagatatgaagggattggttc

SEQ ID NO: 17165 - DNA, 25 bp, Artificial sequence
  SiRNA target sequence
agggagatatgaagggattggttct

SEQ ID NO: 17166 - DNA, 25 bp, Artificial sequence
  SiRNA target sequence
gggagatatgaagggattggttcta

SEQ ID NO: 17167 - DNA, 25 bp, Artificial sequence
  SiRNA target sequence
ggagatatgaagggattggttctat

SEQ ID NO: 17168 - DNA, 25 bp, Artificial sequence
  SiRNA target sequence
gagatatgaagggattggttctatt

SEQ ID NO: 17169 - DNA, 25 bp, Artificial sequence
  SiRNA target sequence
agatatgaagggattggttctattt

SEQ ID NO: 17170 - DNA, 25 bp, Artificial sequence
  SiRNA target sequence
gatatgaagggattggttctatttc

SEQ ID NO: 17171 - DNA, 25 bp, Artificial sequence
  SiRNA target sequence
atatgaagggattggttctatttct

SEQ ID NO: 17172 - DNA, 25 bp, Artificial sequence
  SiRNA target sequence
tatgaagggattggttctatttcta

SEQ ID NO: 17173 - DNA, 25 bp, Artificial sequence
  SiRNA target sequence
atgaagggattggttctatttctac

SEQ ID NO: 17174 - DNA, 25 bp, Artificial sequence
  SiRNA target sequence
tgaagggattggttctatttctact

SEQ ID NO: 17175 - DNA, 25 bp, Artificial sequence
  SiRNA target sequence
gaagggattggttctatttctacta

SEQ ID NO: 17176 - DNA, 25 bp, Artificial sequence
  SiRNA target sequence
aagggattggttctatttctactat

SEQ ID NO: 17177 - DNA, 25 bp, Artificial sequence
  SiRNA target sequence
agggattggttctatttctactata

SEQ ID NO: 17178 - DNA, 25 bp, Artificial sequence
  SiRNA target sequence
gggattggttctatttctactatat

SEQ ID NO: 17179 - DNA, 25 bp, Artificial sequence
  SiRNA target sequence
ggattggttctatttctactatatc

SEQ ID NO: 17180 - DNA, 25 bp, Artificial sequence
  SiRNA target sequence
gattggttctatttctactatatca

SEQ ID NO: 17181 - DNA, 25 bp, Artificial sequence
  SiRNA target sequence
attggttctatttctactatatcac

SEQ ID NO: 17182 - DNA, 25 bp, Artificial sequence
  SiRNA target sequence
ttggttctatttctactatatcact

SEQ ID NO: 17183 - DNA, 25 bp, Artificial sequence
  SiRNA target sequence
tggttctatttctactatatcactt

SEQ ID NO: 17184 - DNA, 25 bp, Artificial sequence
  SiRNA target sequence
ggttctatttctactatatcacttc

SEQ ID NO: 17185 - DNA, 25 bp, Artificial sequence
  SiRNA target sequence
gttctatttctactatatcacttca

SEQ ID NO: 17186 - DNA, 25 bp, Artificial sequence
  SiRNA target sequence
ttctatttctactatatcacttcag

SEQ ID NO: 17187 - DNA, 25 bp, Artificial sequence
  SiRNA target sequence
tctatttctactatatcacttcagc

SEQ ID NO: 17188 - DNA, 25 bp, Artificial sequence
  SiRNA target sequence
ctatttctactatatcacttcagca

SEQ ID NO: 17189 - DNA, 25 bp, Artificial sequence
  SiRNA target sequence
tatttctactatatcacttcagcag

SEQ ID NO: 17190 - DNA, 25 bp, Artificial sequence
  SiRNA target sequence
atttctactatatcacttcagcagt

SEQ ID NO: 17191 - DNA, 25 bp, Artificial sequence
  SiRNA target sequence
tttctactatatcacttcagcagtt

SEQ ID NO: 17192 - DNA, 25 bp, Artificial sequence
  SiRNA target sequence
ttctactatatcacttcagcagttt

SEQ ID NO: 17193 - DNA, 25 bp, Artificial sequence
  SiRNA target sequence
tctactatatcacttcagcagttta

SEQ ID NO: 17194 - DNA, 25 bp, Artificial sequence
  SiRNA target sequence
ctactatatcacttcagcagtttaa

SEQ ID NO: 17195 - DNA, 25 bp, Artificial sequence
  SiRNA target sequence
tactatatcacttcagcagtttaat

SEQ ID NO: 17196 - DNA, 25 bp, Artificial sequence
  SiRNA target sequence
actatatcacttcagcagtttaata

SEQ ID NO: 17197 - DNA, 25 bp, Artificial sequence
  SiRNA target sequence
ctatatcacttcagcagtttaatac

SEQ ID NO: 17198 - DNA, 25 bp, Artificial sequence
  SiRNA target sequence
tatatcacttcagcagtttaataca

SEQ ID NO: 17199 - DNA, 25 bp, Artificial sequence
  SiRNA target sequence
atatcacttcagcagtttaatacac

SEQ ID NO: 17200 - DNA, 25 bp, Artificial sequence
  SiRNA target sequence
tatcacttcagcagtttaatacact

SEQ ID NO: 17201 - DNA, 25 bp, Artificial sequence
  SiRNA target sequence
atcacttcagcagtttaatacactg

SEQ ID NO: 17202 - DNA, 25 bp, Artificial sequence
  SiRNA target sequence
tcacttcagcagtttaatacactgt

SEQ ID NO: 17203 - DNA, 25 bp, Artificial sequence
  SiRNA target sequence
cacttcagcagtttaatacactgtc

SEQ ID NO: 17204 - DNA, 25 bp, Artificial sequence
  SiRNA target sequence
acttcagcagtttaatacactgtct

SEQ ID NO: 17205 - DNA, 25 bp, Artificial sequence
  SiRNA target sequence
cttcagcagtttaatacactgtcta

SEQ ID NO: 17206 - DNA, 25 bp, Artificial sequence
  SiRNA target sequence
ttcagcagtttaatacactgtctat

SEQ ID NO: 17207 - DNA, 25 bp, Artificial sequence
  SiRNA target sequence
tcagcagtttaatacactgtctata

SEQ ID NO: 17208 - DNA, 25 bp, Artificial sequence
  SiRNA target sequence
cagcagtttaatacactgtctatag

SEQ ID NO: 17209 - DNA, 25 bp, Artificial sequence
  SiRNA target sequence
agcagtttaatacactgtctataga

SEQ ID NO: 17210 - DNA, 25 bp, Artificial sequence
  SiRNA target sequence
gcagtttaatacactgtctatagat

SEQ ID NO: 17211 - DNA, 25 bp, Artificial sequence
  SiRNA target sequence
cagtttaatacactgtctatagatt

SEQ ID NO: 17212 - DNA, 25 bp, Artificial sequence
  SiRNA target sequence
agtttaatacactgtctatagatta

SEQ ID NO: 17213 - DNA, 25 bp, Artificial sequence
  SiRNA target sequence
gtttaatacactgtctatagattat

SEQ ID NO: 17214 - DNA, 25 bp, Artificial sequence
  SiRNA target sequence
tttaatacactgtctatagattatt

SEQ ID NO: 17215 - DNA, 25 bp, Artificial sequence
  SiRNA target sequence
ttaatacactgtctatagattatta

SEQ ID NO: 17216 - DNA, 25 bp, Artificial sequence
  SiRNA target sequence
taatacactgtctatagattattac

SEQ ID NO: 17217 - DNA, 25 bp, Artificial sequence
  SiRNA target sequence
aatacactgtctatagattattaca

SEQ ID NO: 17218 - DNA, 25 bp, Artificial sequence
  SiRNA target sequence
atacactgtctatagattattacaa

SEQ ID NO: 17219 - DNA, 25 bp, Artificial sequence
  SiRNA target sequence
tacactgtctatagattattacaag

SEQ ID NO: 17220 - DNA, 25 bp, Artificial sequence
  SiRNA target sequence
acactgtctatagattattacaaga

SEQ ID NO: 17221 - DNA, 25 bp, Artificial sequence
  SiRNA target sequence
cactgtctatagattattacaagac

SEQ ID NO: 17222 - DNA, 25 bp, Artificial sequence
  SiRNA target sequence
actgtctatagattattacaagaca

SEQ ID NO: 17223 - DNA, 25 bp, Artificial sequence
  SiRNA target sequence
ctgtctatagattattacaagacat

SEQ ID NO: 17224 - DNA, 25 bp, Artificial sequence
  SiRNA target sequence
tgtctatagattattacaagacatt

SEQ ID NO: 17225 - DNA, 25 bp, Artificial sequence
  SiRNA target sequence
gtctatagattattacaagacattg

SEQ ID NO: 17226 - DNA, 25 bp, Artificial sequence
  SiRNA target sequence
tctatagattattacaagacattgt

SEQ ID NO: 17227 - DNA, 25 bp, Artificial sequence
  SiRNA target sequence
ctatagattattacaagacattgtc

SEQ ID NO: 17228 - DNA, 25 bp, Artificial sequence
  SiRNA target sequence
tatagattattacaagacattgtct

SEQ ID NO: 17229 - DNA, 25 bp, Artificial sequence
  SiRNA target sequence
atagattattacaagacattgtctt

SEQ ID NO: 17230 - DNA, 25 bp, Artificial sequence
  SiRNA target sequence
tagattattacaagacattgtcttc

SEQ ID NO: 17231 - DNA, 25 bp, Artificial sequence
  SiRNA target sequence
agattattacaagacattgtcttct

SEQ ID NO: 17232 - DNA, 25 bp, Artificial sequence
  SiRNA target sequence
gattattacaagacattgtcttcta

SEQ ID NO: 17233 - DNA, 25 bp, Artificial sequence
  SiRNA target sequence
attattacaagacattgtcttctat

SEQ ID NO: 17234 - DNA, 25 bp, Artificial sequence
  SiRNA target sequence
ttattacaagacattgtcttctatt

SEQ ID NO: 17235 - DNA, 25 bp, Artificial sequence
  SiRNA target sequence
tattacaagacattgtcttctattt

SEQ ID NO: 17236 - DNA, 25 bp, Artificial sequence
  SiRNA target sequence
attacaagacattgtcttctatttg

SEQ ID NO: 17237 - DNA, 25 bp, Artificial sequence
  SiRNA target sequence
ttacaagacattgtcttctatttgt

SEQ ID NO: 17238 - DNA, 25 bp, Artificial sequence
  SiRNA target sequence
tacaagacattgtcttctatttgtg

SEQ ID NO: 17239 - DNA, 25 bp, Artificial sequence
  SiRNA target sequence
acaagacattgtcttctatttgtga

SEQ ID NO: 17240 - DNA, 25 bp, Artificial sequence
  SiRNA target sequence
caagacattgtcttctatttgtgac

SEQ ID NO: 17241 - DNA, 25 bp, Artificial sequence
  SiRNA target sequence
aagacattgtcttctatttgtgacg

SEQ ID NO: 17242 - DNA, 25 bp, Artificial sequence
  SiRNA target sequence
agacattgtcttctatttgtgacgt

SEQ ID NO: 17243 - DNA, 25 bp, Artificial sequence
  SiRNA target sequence
gacattgtcttctatttgtgacgta

SEQ ID NO: 17244 - DNA, 25 bp, Artificial sequence
  SiRNA target sequence
acattgtcttctatttgtgacgtag

SEQ ID NO: 17245 - DNA, 25 bp, Artificial sequence
  SiRNA target sequence
cattgtcttctatttgtgacgtagg

SEQ ID NO: 17246 - DNA, 25 bp, Artificial sequence
  SiRNA target sequence
attgtcttctatttgtgacgtaggt

SEQ ID NO: 17247 - DNA, 25 bp, Artificial sequence
  SiRNA target sequence
ttgtcttctatttgtgacgtaggta

SEQ ID NO: 17248 - DNA, 25 bp, Artificial sequence
  SiRNA target sequence
tgtcttctatttgtgacgtaggtat

SEQ ID NO: 17249 - DNA, 25 bp, Artificial sequence
  SiRNA target sequence
gtcttctatttgtgacgtaggtatt

SEQ ID NO: 17250 - DNA, 25 bp, Artificial sequence
  SiRNA target sequence
tcttctatttgtgacgtaggtatta

SEQ ID NO: 17251 - DNA, 25 bp, Artificial sequence
  SiRNA target sequence
cttctatttgtgacgtaggtattaa

SEQ ID NO: 17252 - DNA, 25 bp, Artificial sequence
  SiRNA target sequence
ttctatttgtgacgtaggtattaaa

SEQ ID NO: 17253 - DNA, 25 bp, Artificial sequence
  SiRNA target sequence
tctatttgtgacgtaggtattaaaa

SEQ ID NO: 17254 - DNA, 25 bp, Artificial sequence
  SiRNA target sequence
ctatttgtgacgtaggtattaaaat

SEQ ID NO: 17255 - DNA, 25 bp, Artificial sequence
  SiRNA target sequence
tatttgtgacgtaggtattaaaata

SEQ ID NO: 17256 - DNA, 25 bp, Artificial sequence
  SiRNA target sequence
atttgtgacgtaggtattaaaatat

SEQ ID NO: 17257 - DNA, 25 bp, Artificial sequence
  SiRNA target sequence
tttgtgacgtaggtattaaaatatc

SEQ ID NO: 17258 - DNA, 25 bp, Artificial sequence
  SiRNA target sequence
ttgtgacgtaggtattaaaatatca

SEQ ID NO: 17259 - DNA, 25 bp, Artificial sequence
  SiRNA target sequence
tgtgacgtaggtattaaaatatcaa

SEQ ID NO: 17260 - DNA, 25 bp, Artificial sequence
  SiRNA target sequence
gtgacgtaggtattaaaatatcaac

SEQ ID NO: 17261 - DNA, 25 bp, Artificial sequence
  SiRNA target sequence
tgacgtaggtattaaaatatcaact

SEQ ID NO: 17262 - DNA, 25 bp, Artificial sequence
  SiRNA target sequence
gacgtaggtattaaaatatcaactg

SEQ ID NO: 17263 - DNA, 25 bp, Artificial sequence
  SiRNA target sequence
acgtaggtattaaaatatcaactga

SEQ ID NO: 17264 - DNA, 25 bp, Artificial sequence
  SiRNA target sequence
cgtaggtattaaaatatcaactgat

SEQ ID NO: 17265 - DNA, 25 bp, Artificial sequence
  SiRNA target sequence
gtaggtattaaaatatcaactgata

SEQ ID NO: 17266 - DNA, 25 bp, Artificial sequence
  SiRNA target sequence
taggtattaaaatatcaactgatag

SEQ ID NO: 17267 - DNA, 25 bp, Artificial sequence
  SiRNA target sequence
aggtattaaaatatcaactgatagg

SEQ ID NO: 17268 - DNA, 25 bp, Artificial sequence
  SiRNA target sequence
ggtattaaaatatcaactgataggg

SEQ ID NO: 17269 - DNA, 25 bp, Artificial sequence
  SiRNA target sequence
gtattaaaatatcaactgataggga

SEQ ID NO: 17270 - DNA, 25 bp, Artificial sequence
  SiRNA target sequence
tattaaaatatcaactgatagggaa

SEQ ID NO: 17271 - DNA, 25 bp, Artificial sequence
  SiRNA target sequence
attaaaatatcaactgatagggaaa

SEQ ID NO: 17272 - DNA, 25 bp, Artificial sequence
  SiRNA target sequence
ttaaaatatcaactgatagggaaaa

SEQ ID NO: 17273 - DNA, 25 bp, Artificial sequence
  SiRNA target sequence
taaaatatcaactgatagggaaaaa

SEQ ID NO: 17274 - DNA, 25 bp, Artificial sequence
  SiRNA target sequence
aaaatatcaactgatagggaaaaat

SEQ ID NO: 17275 - DNA, 25 bp, Artificial sequence
  SiRNA target sequence
aaatatcaactgatagggaaaaatc

SEQ ID NO: 17276 - DNA, 25 bp, Artificial sequence
  SiRNA target sequence
aatatcaactgatagggaaaaatca

SEQ ID NO: 17277 - DNA, 25 bp, Artificial sequence
  SiRNA target sequence
atatcaactgatagggaaaaatcag

SEQ ID NO: 17278 - DNA, 25 bp, Artificial sequence
  SiRNA target sequence
tatcaactgatagggaaaaatcagt

SEQ ID NO: 17279 - DNA, 25 bp, Artificial sequence
  SiRNA target sequence
atcaactgatagggaaaaatcagtt

SEQ ID NO: 17280 - DNA, 25 bp, Artificial sequence
  SiRNA target sequence
tcaactgatagggaaaaatcagtta

SEQ ID NO: 17281 - DNA, 25 bp, Artificial sequence
  SiRNA target sequence
caactgatagggaaaaatcagttaa

SEQ ID NO: 17282 - DNA, 25 bp, Artificial sequence
  SiRNA target sequence
aactgatagggaaaaatcagttaat

SEQ ID NO: 17283 - DNA, 25 bp, Artificial sequence
  SiRNA target sequence
actgatagggaaaaatcagttaatt

SEQ ID NO: 17284 - DNA, 25 bp, Artificial sequence
  SiRNA target sequence
ctgatagggaaaaatcagttaatta

SEQ ID NO: 17285 - DNA, 25 bp, Artificial sequence
  SiRNA target sequence
tgatagggaaaaatcagttaattat

SEQ ID NO: 17286 - DNA, 25 bp, Artificial sequence
  SiRNA target sequence
gatagggaaaaatcagttaattatg

SEQ ID NO: 17287 - DNA, 25 bp, Artificial sequence
  SiRNA target sequence
atagggaaaaatcagttaattatgg

SEQ ID NO: 17288 - DNA, 25 bp, Artificial sequence
  SiRNA target sequence
tagggaaaaatcagttaattatgga

SEQ ID NO: 17289 - DNA, 25 bp, Artificial sequence
  SiRNA target sequence
agggaaaaatcagttaattatggat

SEQ ID NO: 17290 - DNA, 25 bp, Artificial sequence
  SiRNA target sequence
gggaaaaatcagttaattatggatt

SEQ ID NO: 17291 - DNA, 25 bp, Artificial sequence
  SiRNA target sequence
ggaaaaatcagttaattatggatta

SEQ ID NO: 17292 - DNA, 25 bp, Artificial sequence
  SiRNA target sequence
gaaaaatcagttaattatggattag

SEQ ID NO: 17293 - DNA, 25 bp, Artificial sequence
  SiRNA target sequence
aaaaatcagttaattatggattagg

SEQ ID NO: 17294 - DNA, 25 bp, Artificial sequence
  SiRNA target sequence
aaaatcagttaattatggattagga

SEQ ID NO: 17295 - DNA, 25 bp, Artificial sequence
  SiRNA target sequence
aaatcagttaattatggattaggag

SEQ ID NO: 17296 - DNA, 25 bp, Artificial sequence
  SiRNA target sequence
aatcagttaattatggattaggagt

SEQ ID NO: 17297 - DNA, 25 bp, Artificial sequence
  SiRNA target sequence
atcagttaattatggattaggagtt

SEQ ID NO: 17298 - DNA, 25 bp, Artificial sequence
  SiRNA target sequence
tcagttaattatggattaggagtta

SEQ ID NO: 17299 - DNA, 25 bp, Artificial sequence
  SiRNA target sequence
cagttaattatggattaggagttaa

SEQ ID NO: 17300 - DNA, 25 bp, Artificial sequence
  SiRNA target sequence
agttaattatggattaggagttaaa

SEQ ID NO: 17301 - DNA, 25 bp, Artificial sequence
  SiRNA target sequence
gttaattatggattaggagttaaac

SEQ ID NO: 17302 - DNA, 25 bp, Artificial sequence
  SiRNA target sequence
ttaattatggattaggagttaaact

SEQ ID NO: 17303 - DNA, 25 bp, Artificial sequence
  SiRNA target sequence
taattatggattaggagttaaacta

SEQ ID NO: 17304 - DNA, 25 bp, Artificial sequence
  SiRNA target sequence
aattatggattaggagttaaactac

SEQ ID NO: 17305 - DNA, 25 bp, Artificial sequence
  SiRNA target sequence
attatggattaggagttaaactaca

SEQ ID NO: 17306 - DNA, 25 bp, Artificial sequence
  SiRNA target sequence
ttatggattaggagttaaactacac

SEQ ID NO: 17307 - DNA, 25 bp, Artificial sequence
  SiRNA target sequence
tatggattaggagttaaactacaca

SEQ ID NO: 17308 - DNA, 25 bp, Artificial sequence
  SiRNA target sequence
atggattaggagttaaactacacag

SEQ ID NO: 17309 - DNA, 25 bp, Artificial sequence
  SiRNA target sequence
tggattaggagttaaactacacagt

SEQ ID NO: 17310 - DNA, 25 bp, Artificial sequence
  SiRNA target sequence
ggattaggagttaaactacacagta

SEQ ID NO: 17311 - DNA, 25 bp, Artificial sequence
  SiRNA target sequence
gattaggagttaaactacacagtaa

SEQ ID NO: 17312 - DNA, 25 bp, Artificial sequence
  SiRNA target sequence
attaggagttaaactacacagtaaa

SEQ ID NO: 17313 - DNA, 25 bp, Artificial sequence
  SiRNA target sequence
ttaggagttaaactacacagtaaaa

SEQ ID NO: 17314 - DNA, 25 bp, Artificial sequence
  SiRNA target sequence
taggagttaaactacacagtaaaaa

SEQ ID NO: 17315 - DNA, 25 bp, Artificial sequence
  SiRNA target sequence
aggagttaaactacacagtaaaaaa

SEQ ID NO: 17316 - DNA, 25 bp, Artificial sequence
  SiRNA target sequence
ggagttaaactacacagtaaaaaag

SEQ ID NO: 17317 - DNA, 25 bp, Artificial sequence
  SiRNA target sequence
gagttaaactacacagtaaaaaagg

SEQ ID NO: 17318 - DNA, 25 bp, Artificial sequence
  SiRNA target sequence
agttaaactacacagtaaaaaagga

SEQ ID NO: 17319 - DNA, 25 bp, Artificial sequence
  SiRNA target sequence
gttaaactacacagtaaaaaaggag

SEQ ID NO: 17320 - DNA, 25 bp, Artificial sequence
  SiRNA target sequence
ttaaactacacagtaaaaaaggaga

SEQ ID NO: 17321 - DNA, 25 bp, Artificial sequence
  SiRNA target sequence
taaactacacagtaaaaaaggagaa

SEQ ID NO: 17322 - DNA, 25 bp, Artificial sequence
  SiRNA target sequence
aaactacacagtaaaaaaggagaaa

SEQ ID NO: 17323 - DNA, 25 bp, Artificial sequence
  SiRNA target sequence
aactacacagtaaaaaaggagaaat

SEQ ID NO: 17324 - DNA, 25 bp, Artificial sequence
  SiRNA target sequence
actacacagtaaaaaaggagaaatt

SEQ ID NO: 17325 - DNA, 25 bp, Artificial sequence
  SiRNA target sequence
ctacacagtaaaaaaggagaaatta

SEQ ID NO: 17326 - DNA, 25 bp, Artificial sequence
  SiRNA target sequence
tacacagtaaaaaaggagaaattat

SEQ ID NO: 17327 - DNA, 25 bp, Artificial sequence
  SiRNA target sequence
acacagtaaaaaaggagaaattatc

SEQ ID NO: 17328 - DNA, 25 bp, Artificial sequence
  SiRNA target sequence
cacagtaaaaaaggagaaattatcg

SEQ ID NO: 17329 - DNA, 25 bp, Artificial sequence
  SiRNA target sequence
acagtaaaaaaggagaaattatcgg

SEQ ID NO: 17330 - DNA, 25 bp, Artificial sequence
  SiRNA target sequence
cagtaaaaaaggagaaattatcgga

SEQ ID NO: 17331 - DNA, 25 bp, Artificial sequence
  SiRNA target sequence
agtaaaaaaggagaaattatcggat

SEQ ID NO: 17332 - DNA, 25 bp, Artificial sequence
  SiRNA target sequence
gtaaaaaaggagaaattatcggatg

SEQ ID NO: 17333 - DNA, 25 bp, Artificial sequence
  SiRNA target sequence
taaaaaaggagaaattatcggatgt

SEQ ID NO: 17334 - DNA, 25 bp, Artificial sequence
  SiRNA target sequence
aaaaaaggagaaattatcggatgtg

SEQ ID NO: 17335 - DNA, 25 bp, Artificial sequence
  SiRNA target sequence
aaaaaggagaaattatcggatgtgt

SEQ ID NO: 17336 - DNA, 25 bp, Artificial sequence
  SiRNA target sequence
aaaaggagaaattatcggatgtgta

SEQ ID NO: 17337 - DNA, 25 bp, Artificial sequence
  SiRNA target sequence
aaaggagaaattatcggatgtgtag

SEQ ID NO: 17338 - DNA, 25 bp, Artificial sequence
  SiRNA target sequence
aaggagaaattatcggatgtgtaga

SEQ ID NO: 17339 - DNA, 25 bp, Artificial sequence
  SiRNA target sequence
aggagaaattatcggatgtgtagat

SEQ ID NO: 17340 - DNA, 25 bp, Artificial sequence
  SiRNA target sequence
ggagaaattatcggatgtgtagata

SEQ ID NO: 17341 - DNA, 25 bp, Artificial sequence
  SiRNA target sequence
gagaaattatcggatgtgtagataa

SEQ ID NO: 17342 - DNA, 25 bp, Artificial sequence
  SiRNA target sequence
agaaattatcggatgtgtagataac

SEQ ID NO: 17343 - DNA, 25 bp, Artificial sequence
  SiRNA target sequence
gaaattatcggatgtgtagataaca

SEQ ID NO: 17344 - DNA, 25 bp, Artificial sequence
  SiRNA target sequence
aaattatcggatgtgtagataacaa

SEQ ID NO: 17345 - DNA, 25 bp, Artificial sequence
  SiRNA target sequence
aattatcggatgtgtagataacaat

SEQ ID NO: 17346 - DNA, 25 bp, Artificial sequence
  SiRNA target sequence
attatcggatgtgtagataacaatc

SEQ ID NO: 17347 - DNA, 25 bp, Artificial sequence
  SiRNA target sequence
ttatcggatgtgtagataacaatca

SEQ ID NO: 17348 - DNA, 25 bp, Artificial sequence
  SiRNA target sequence
tatcggatgtgtagataacaatcat

SEQ ID NO: 17349 - DNA, 25 bp, Artificial sequence
  SiRNA target sequence
atcggatgtgtagataacaatcata

SEQ ID NO: 17350 - DNA, 25 bp, Artificial sequence
  SiRNA target sequence
tcggatgtgtagataacaatcatat

SEQ ID NO: 17351 - DNA, 25 bp, Artificial sequence
  SiRNA target sequence
cggatgtgtagataacaatcatatt

SEQ ID NO: 17352 - DNA, 25 bp, Artificial sequence
  SiRNA target sequence
ggatgtgtagataacaatcatattt

SEQ ID NO: 17353 - DNA, 25 bp, Artificial sequence
  SiRNA target sequence
gatgtgtagataacaatcatatttt

SEQ ID NO: 17354 - DNA, 25 bp, Artificial sequence
  SiRNA target sequence
atgtgtagataacaatcatatttta

SEQ ID NO: 17355 - DNA, 25 bp, Artificial sequence
  SiRNA target sequence
tgtgtagataacaatcatattttaa

SEQ ID NO: 17356 - DNA, 25 bp, Artificial sequence
  SiRNA target sequence
gtgtagataacaatcatattttaag

SEQ ID NO: 17357 - DNA, 25 bp, Artificial sequence
  SiRNA target sequence
tgtagataacaatcatattttaagc

SEQ ID NO: 17358 - DNA, 25 bp, Artificial sequence
  SiRNA target sequence
gtagataacaatcatattttaagca

SEQ ID NO: 17359 - DNA, 25 bp, Artificial sequence
  SiRNA target sequence
tagataacaatcatattttaagcat

SEQ ID NO: 17360 - DNA, 25 bp, Artificial sequence
  SiRNA target sequence
agataacaatcatattttaagcata

SEQ ID NO: 17361 - DNA, 25 bp, Artificial sequence
  SiRNA target sequence
gataacaatcatattttaagcataa

SEQ ID NO: 17362 - DNA, 25 bp, Artificial sequence
  SiRNA target sequence
ataacaatcatattttaagcataat

SEQ ID NO: 17363 - DNA, 25 bp, Artificial sequence
  SiRNA target sequence
taacaatcatattttaagcataatt

SEQ ID NO: 17364 - DNA, 25 bp, Artificial sequence
  SiRNA target sequence
aacaatcatattttaagcataattt

SEQ ID NO: 17365 - DNA, 25 bp, Artificial sequence
  SiRNA target sequence
acaatcatattttaagcataattta

SEQ ID NO: 17366 - DNA, 25 bp, Artificial sequence
  SiRNA target sequence
caatcatattttaagcataatttat

SEQ ID NO: 17367 - DNA, 25 bp, Artificial sequence
  SiRNA target sequence
aatcatattttaagcataatttata

SEQ ID NO: 17368 - DNA, 25 bp, Artificial sequence
  SiRNA target sequence
atcatattttaagcataatttataa

SEQ ID NO: 17369 - DNA, 25 bp, Artificial sequence
  SiRNA target sequence
tcatattttaagcataatttataat

SEQ ID NO: 17370 - DNA, 25 bp, Artificial sequence
  SiRNA target sequence
catattttaagcataatttataatg

SEQ ID NO: 17371 - DNA, 25 bp, Artificial sequence
  SiRNA target sequence
atattttaagcataatttataatga

SEQ ID NO: 17372 - DNA, 25 bp, Artificial sequence
  SiRNA target sequence
tattttaagcataatttataatgat

SEQ ID NO: 17373 - DNA, 25 bp, Artificial sequence
  SiRNA target sequence
attttaagcataatttataatgata

SEQ ID NO: 17374 - DNA, 25 bp, Artificial sequence
  SiRNA target sequence
ttttaagcataatttataatgataa

SEQ ID NO: 17375 - DNA, 25 bp, Artificial sequence
  SiRNA target sequence
tttaagcataatttataatgataaa

SEQ ID NO: 17376 - DNA, 25 bp, Artificial sequence
  SiRNA target sequence
ttaagcataatttataatgataaat

SEQ ID NO: 17377 - DNA, 25 bp, Artificial sequence
  SiRNA target sequence
taagcataatttataatgataaatt

SEQ ID NO: 17378 - DNA, 25 bp, Artificial sequence
  SiRNA target sequence
aagcataatttataatgataaatta

SEQ ID NO: 17379 - DNA, 25 bp, Artificial sequence
  SiRNA target sequence
agcataatttataatgataaattat

SEQ ID NO: 17380 - DNA, 25 bp, Artificial sequence
  SiRNA target sequence
gcataatttataatgataaattatc

SEQ ID NO: 17381 - DNA, 25 bp, Artificial sequence
  SiRNA target sequence
cataatttataatgataaattatct

SEQ ID NO: 17382 - DNA, 25 bp, Artificial sequence
  SiRNA target sequence
ataatttataatgataaattatctg

SEQ ID NO: 17383 - DNA, 25 bp, Artificial sequence
  SiRNA target sequence
taatttataatgataaattatctga

SEQ ID NO: 17384 - DNA, 25 bp, Artificial sequence
  SiRNA target sequence
aatttataatgataaattatctgaa

SEQ ID NO: 17385 - DNA, 25 bp, Artificial sequence
  SiRNA target sequence
atttataatgataaattatctgaag

SEQ ID NO: 17386 - DNA, 25 bp, Artificial sequence
  SiRNA target sequence
tttataatgataaattatctgaagg

SEQ ID NO: 17387 - DNA, 25 bp, Artificial sequence
  SiRNA target sequence
ttataatgataaattatctgaaggg

SEQ ID NO: 17388 - DNA, 25 bp, Artificial sequence
  SiRNA target sequence
tataatgataaattatctgaagggt

SEQ ID NO: 17389 - DNA, 25 bp, Artificial sequence
  SiRNA target sequence
ataatgataaattatctgaagggtt

SEQ ID NO: 17390 - DNA, 25 bp, Artificial sequence
  SiRNA target sequence
taatgataaattatctgaagggtta

SEQ ID NO: 17391 - DNA, 25 bp, Artificial sequence
  SiRNA target sequence
aatgataaattatctgaagggttaa

SEQ ID NO: 17392 - DNA, 25 bp, Artificial sequence
  SiRNA target sequence
atgataaattatctgaagggttaac

SEQ ID NO: 17393 - DNA, 25 bp, Artificial sequence
  SiRNA target sequence
tgataaattatctgaagggttaaca

SEQ ID NO: 17394 - DNA, 25 bp, Artificial sequence
  SiRNA target sequence
gataaattatctgaagggttaacac

SEQ ID NO: 17395 - DNA, 25 bp, Artificial sequence
  SiRNA target sequence
ataaattatctgaagggttaacact

SEQ ID NO: 17396 - DNA, 25 bp, Artificial sequence
  SiRNA target sequence
taaattatctgaagggttaacactt

SEQ ID NO: 17397 - DNA, 25 bp, Artificial sequence
  SiRNA target sequence
aaattatctgaagggttaacactta

SEQ ID NO: 17398 - DNA, 25 bp, Artificial sequence
  SiRNA target sequence
aattatctgaagggttaacacttaa

SEQ ID NO: 17399 - DNA, 25 bp, Artificial sequence
  SiRNA target sequence
attatctgaagggttaacacttaat

SEQ ID NO: 17400 - DNA, 25 bp, Artificial sequence
  SiRNA target sequence
ttatctgaagggttaacacttaatt

SEQ ID NO: 17401 - DNA, 25 bp, Artificial sequence
  SiRNA target sequence
tatctgaagggttaacacttaattt

SEQ ID NO: 17402 - DNA, 25 bp, Artificial sequence
  SiRNA target sequence
atctgaagggttaacacttaatttg

SEQ ID NO: 17403 - DNA, 25 bp, Artificial sequence
  SiRNA target sequence
tctgaagggttaacacttaatttga

SEQ ID NO: 17404 - DNA, 25 bp, Artificial sequence
  SiRNA target sequence
ctgaagggttaacacttaatttgag

SEQ ID NO: 17405 - DNA, 25 bp, Artificial sequence
  SiRNA target sequence
tgaagggttaacacttaatttgagt

SEQ ID NO: 17406 - DNA, 25 bp, Artificial sequence
  SiRNA target sequence
gaagggttaacacttaatttgagtt

SEQ ID NO: 17407 - DNA, 25 bp, Artificial sequence
  SiRNA target sequence
aagggttaacacttaatttgagttg

SEQ ID NO: 17408 - DNA, 25 bp, Artificial sequence
  SiRNA target sequence
agggttaacacttaatttgagttgt

SEQ ID NO: 17409 - DNA, 25 bp, Artificial sequence
  SiRNA target sequence
gggttaacacttaatttgagttgta

SEQ ID NO: 17410 - DNA, 25 bp, Artificial sequence
  SiRNA target sequence
ggttaacacttaatttgagttgtag

SEQ ID NO: 17411 - DNA, 25 bp, Artificial sequence
  SiRNA target sequence
gttaacacttaatttgagttgtaga

SEQ ID NO: 17412 - DNA, 25 bp, Artificial sequence
  SiRNA target sequence
ttaacacttaatttgagttgtagat

SEQ ID NO: 17413 - DNA, 25 bp, Artificial sequence
  SiRNA target sequence
taacacttaatttgagttgtagatt

SEQ ID NO: 17414 - DNA, 25 bp, Artificial sequence
  SiRNA target sequence
aacacttaatttgagttgtagattt

SEQ ID NO: 17415 - DNA, 25 bp, Artificial sequence
  SiRNA target sequence
acacttaatttgagttgtagatttg

SEQ ID NO: 17416 - DNA, 25 bp, Artificial sequence
  SiRNA target sequence
cacttaatttgagttgtagatttgg

SEQ ID NO: 17417 - DNA, 25 bp, Artificial sequence
  SiRNA target sequence
acttaatttgagttgtagatttggt

SEQ ID NO: 17418 - DNA, 25 bp, Artificial sequence
  SiRNA target sequence
cttaatttgagttgtagatttggta

SEQ ID NO: 17419 - DNA, 25 bp, Artificial sequence
  SiRNA target sequence
ttaatttgagttgtagatttggtaa

SEQ ID NO: 17420 - DNA, 25 bp, Artificial sequence
  SiRNA target sequence
taatttgagttgtagatttggtaag

SEQ ID NO: 17421 - DNA, 25 bp, Artificial sequence
  SiRNA target sequence
aatttgagttgtagatttggtaaga

SEQ ID NO: 17422 - DNA, 25 bp, Artificial sequence
  SiRNA target sequence
atttgagttgtagatttggtaagaa

SEQ ID NO: 17423 - DNA, 25 bp, Artificial sequence
  SiRNA target sequence
tttgagttgtagatttggtaagaaa

SEQ ID NO: 17424 - DNA, 25 bp, Artificial sequence
  SiRNA target sequence
ttgagttgtagatttggtaagaaag

SEQ ID NO: 17425 - DNA, 25 bp, Artificial sequence
  SiRNA target sequence
tgagttgtagatttggtaagaaagt

SEQ ID NO: 17426 - DNA, 25 bp, Artificial sequence
  SiRNA target sequence
gagttgtagatttggtaagaaagta

SEQ ID NO: 17427 - DNA, 25 bp, Artificial sequence
  SiRNA target sequence
agttgtagatttggtaagaaagtat

SEQ ID NO: 17428 - DNA, 25 bp, Artificial sequence
  SiRNA target sequence
gttgtagatttggtaagaaagtatt

SEQ ID NO: 17429 - DNA, 25 bp, Artificial sequence
  SiRNA target sequence
ttgtagatttggtaagaaagtattt

SEQ ID NO: 17430 - DNA, 25 bp, Artificial sequence
  SiRNA target sequence
tgtagatttggtaagaaagtatttg

SEQ ID NO: 17431 - DNA, 25 bp, Artificial sequence
  SiRNA target sequence
gtagatttggtaagaaagtatttga

SEQ ID NO: 17432 - DNA, 25 bp, Artificial sequence
  SiRNA target sequence
tagatttggtaagaaagtatttgat

SEQ ID NO: 17433 - DNA, 25 bp, Artificial sequence
  SiRNA target sequence
agatttggtaagaaagtatttgatt

SEQ ID NO: 17434 - DNA, 25 bp, Artificial sequence
  SiRNA target sequence
gatttggtaagaaagtatttgatta

SEQ ID NO: 17435 - DNA, 25 bp, Artificial sequence
  SiRNA target sequence
atttggtaagaaagtatttgattat

SEQ ID NO: 17436 - DNA, 25 bp, Artificial sequence
  SiRNA target sequence
tttggtaagaaagtatttgattatg

SEQ ID NO: 17437 - DNA, 25 bp, Artificial sequence
  SiRNA target sequence
ttggtaagaaagtatttgattatgg

SEQ ID NO: 17438 - DNA, 25 bp, Artificial sequence
  SiRNA target sequence
tggtaagaaagtatttgattatggc

SEQ ID NO: 17439 - DNA, 25 bp, Artificial sequence
  SiRNA target sequence
ggtaagaaagtatttgattatggct

SEQ ID NO: 17440 - DNA, 25 bp, Artificial sequence
  SiRNA target sequence
gtaagaaagtatttgattatggcta

SEQ ID NO: 17441 - DNA, 25 bp, Artificial sequence
  SiRNA target sequence
taagaaagtatttgattatggctat

SEQ ID NO: 17442 - DNA, 25 bp, Artificial sequence
  SiRNA target sequence
aagaaagtatttgattatggctatg

SEQ ID NO: 17443 - DNA, 25 bp, Artificial sequence
  SiRNA target sequence
agaaagtatttgattatggctatgg

SEQ ID NO: 17444 - DNA, 25 bp, Artificial sequence
  SiRNA target sequence
gaaagtatttgattatggctatggg

SEQ ID NO: 17445 - DNA, 25 bp, Artificial sequence
  SiRNA target sequence
aaagtatttgattatggctatgggt

SEQ ID NO: 17446 - DNA, 25 bp, Artificial sequence
  SiRNA target sequence
aagtatttgattatggctatgggtt

SEQ ID NO: 17447 - DNA, 25 bp, Artificial sequence
  SiRNA target sequence
agtatttgattatggctatgggttt

SEQ ID NO: 17448 - DNA, 25 bp, Artificial sequence
  SiRNA target sequence
gtatttgattatggctatgggttta

SEQ ID NO: 17449 - DNA, 25 bp, Artificial sequence
  SiRNA target sequence
tatttgattatggctatgggtttat

SEQ ID NO: 17450 - DNA, 25 bp, Artificial sequence
  SiRNA target sequence
atttgattatggctatgggtttatt

SEQ ID NO: 17451 - DNA, 25 bp, Artificial sequence
  SiRNA target sequence
tttgattatggctatgggtttattt

SEQ ID NO: 17452 - DNA, 25 bp, Artificial sequence
  SiRNA target sequence
ttgattatggctatgggtttattta

SEQ ID NO: 17453 - DNA, 25 bp, Artificial sequence
  SiRNA target sequence
tgattatggctatgggtttatttat

SEQ ID NO: 17454 - DNA, 25 bp, Artificial sequence
  SiRNA target sequence
gattatggctatgggtttatttatg

SEQ ID NO: 17455 - DNA, 25 bp, Artificial sequence
  SiRNA target sequence
attatggctatgggtttatttatga

SEQ ID NO: 17456 - DNA, 25 bp, Artificial sequence
  SiRNA target sequence
ttatggctatgggtttatttatgaa

SEQ ID NO: 17457 - DNA, 25 bp, Artificial sequence
  SiRNA target sequence
tatggctatgggtttatttatgaat

SEQ ID NO: 17458 - DNA, 25 bp, Artificial sequence
  SiRNA target sequence
atggctatgggtttatttatgaatt

SEQ ID NO: 17459 - DNA, 25 bp, Artificial sequence
  SiRNA target sequence
tggctatgggtttatttatgaattt

SEQ ID NO: 17460 - DNA, 25 bp, Artificial sequence
  SiRNA target sequence
ggctatgggtttatttatgaatttt

SEQ ID NO: 17461 - DNA, 25 bp, Artificial sequence
  SiRNA target sequence
gctatgggtttatttatgaatttta

SEQ ID NO: 17462 - DNA, 25 bp, Artificial sequence
  SiRNA target sequence
ctatgggtttatttatgaattttaa

SEQ ID NO: 17463 - DNA, 26 bp, Artificial sequence
  SiRNA target sequence
atgaaatctttctacaaaaaaataaa

SEQ ID NO: 17464 - DNA, 26 bp, Artificial sequence
  SiRNA target sequence
tgaaatctttctacaaaaaaataaaa

SEQ ID NO: 17465 - DNA, 26 bp, Artificial sequence
  SiRNA target sequence
gaaatctttctacaaaaaaataaaaa

SEQ ID NO: 17466 - DNA, 26 bp, Artificial sequence
  SiRNA target sequence
aaatctttctacaaaaaaataaaaag

SEQ ID NO: 17467 - DNA, 26 bp, Artificial sequence
  SiRNA target sequence
aatctttctacaaaaaaataaaaagt

SEQ ID NO: 17468 - DNA, 26 bp, Artificial sequence
  SiRNA target sequence
atctttctacaaaaaaataaaaagtt

SEQ ID NO: 17469 - DNA, 26 bp, Artificial sequence
  SiRNA target sequence
tctttctacaaaaaaataaaaagtta

SEQ ID NO: 17470 - DNA, 26 bp, Artificial sequence
  SiRNA target sequence
ctttctacaaaaaaataaaaagttat

SEQ ID NO: 17471 - DNA, 26 bp, Artificial sequence
  SiRNA target sequence
tttctacaaaaaaataaaaagttatt

SEQ ID NO: 17472 - DNA, 26 bp, Artificial sequence
  SiRNA target sequence
ttctacaaaaaaataaaaagttattt

SEQ ID NO: 17473 - DNA, 26 bp, Artificial sequence
  SiRNA target sequence
tctacaaaaaaataaaaagttattta

SEQ ID NO: 17474 - DNA, 26 bp, Artificial sequence
  SiRNA target sequence
ctacaaaaaaataaaaagttatttat

SEQ ID NO: 17475 - DNA, 26 bp, Artificial sequence
  SiRNA target sequence
tacaaaaaaataaaaagttatttatt

SEQ ID NO: 17476 - DNA, 26 bp, Artificial sequence
  SiRNA target sequence
acaaaaaaataaaaagttatttattc

SEQ ID NO: 17477 - DNA, 26 bp, Artificial sequence
  SiRNA target sequence
caaaaaaataaaaagttatttattca

SEQ ID NO: 17478 - DNA, 26 bp, Artificial sequence
  SiRNA target sequence
aaaaaaataaaaagttatttattcaa

SEQ ID NO: 17479 - DNA, 26 bp, Artificial sequence
  SiRNA target sequence
aaaaaataaaaagttatttattcaaa

SEQ ID NO: 17480 - DNA, 26 bp, Artificial sequence
  SiRNA target sequence
aaaaataaaaagttatttattcaaat

SEQ ID NO: 17481 - DNA, 26 bp, Artificial sequence
  SiRNA target sequence
aaaataaaaagttatttattcaaatc

SEQ ID NO: 17482 - DNA, 26 bp, Artificial sequence
  SiRNA target sequence
aaataaaaagttatttattcaaatct

SEQ ID NO: 17483 - DNA, 26 bp, Artificial sequence
  SiRNA target sequence
aataaaaagttatttattcaaatctg

SEQ ID NO: 17484 - DNA, 26 bp, Artificial sequence
  SiRNA target sequence
ataaaaagttatttattcaaatctgc

SEQ ID NO: 17485 - DNA, 26 bp, Artificial sequence
  SiRNA target sequence
taaaaagttatttattcaaatctgcc

SEQ ID NO: 17486 - DNA, 26 bp, Artificial sequence
  SiRNA target sequence
aaaaagttatttattcaaatctgcca

SEQ ID NO: 17487 - DNA, 26 bp, Artificial sequence
  SiRNA target sequence
aaaagttatttattcaaatctgccat

SEQ ID NO: 17488 - DNA, 26 bp, Artificial sequence
  SiRNA target sequence
aaagttatttattcaaatctgccatt

SEQ ID NO: 17489 - DNA, 26 bp, Artificial sequence
  SiRNA target sequence
aagttatttattcaaatctgccatta

SEQ ID NO: 17490 - DNA, 26 bp, Artificial sequence
  SiRNA target sequence
agttatttattcaaatctgccattaa

SEQ ID NO: 17491 - DNA, 26 bp, Artificial sequence
  SiRNA target sequence
gttatttattcaaatctgccattaat

SEQ ID NO: 17492 - DNA, 26 bp, Artificial sequence
  SiRNA target sequence
ttatttattcaaatctgccattaata

SEQ ID NO: 17493 - DNA, 26 bp, Artificial sequence
  SiRNA target sequence
tatttattcaaatctgccattaatac

SEQ ID NO: 17494 - DNA, 26 bp, Artificial sequence
  SiRNA target sequence
atttattcaaatctgccattaataca

SEQ ID NO: 17495 - DNA, 26 bp, Artificial sequence
  SiRNA target sequence
tttattcaaatctgccattaatacat

SEQ ID NO: 17496 - DNA, 26 bp, Artificial sequence
  SiRNA target sequence
ttattcaaatctgccattaatacatc

SEQ ID NO: 17497 - DNA, 26 bp, Artificial sequence
  SiRNA target sequence
tattcaaatctgccattaatacatct

SEQ ID NO: 17498 - DNA, 26 bp, Artificial sequence
  SiRNA target sequence
attcaaatctgccattaatacatctt

SEQ ID NO: 17499 - DNA, 26 bp, Artificial sequence
  SiRNA target sequence
ttcaaatctgccattaatacatcttt

SEQ ID NO: 17500 - DNA, 26 bp, Artificial sequence
  SiRNA target sequence
tcaaatctgccattaatacatctttt

SEQ ID NO: 17501 - DNA, 26 bp, Artificial sequence
  SiRNA target sequence
caaatctgccattaatacatcttttg

SEQ ID NO: 17502 - DNA, 26 bp, Artificial sequence
  SiRNA target sequence
aaatctgccattaatacatcttttga

SEQ ID NO: 17503 - DNA, 26 bp, Artificial sequence
  SiRNA target sequence
aatctgccattaatacatcttttgat

SEQ ID NO: 17504 - DNA, 26 bp, Artificial sequence
  SiRNA target sequence
atctgccattaatacatcttttgata

SEQ ID NO: 17505 - DNA, 26 bp, Artificial sequence
  SiRNA target sequence
tctgccattaatacatcttttgatac

SEQ ID NO: 17506 - DNA, 26 bp, Artificial sequence
  SiRNA target sequence
ctgccattaatacatcttttgatact

SEQ ID NO: 17507 - DNA, 26 bp, Artificial sequence
  SiRNA target sequence
tgccattaatacatcttttgatactt

SEQ ID NO: 17508 - DNA, 26 bp, Artificial sequence
  SiRNA target sequence
gccattaatacatcttttgatacttt

SEQ ID NO: 17509 - DNA, 26 bp, Artificial sequence
  SiRNA target sequence
ccattaatacatcttttgatactttt

SEQ ID NO: 17510 - DNA, 26 bp, Artificial sequence
  SiRNA target sequence
cattaatacatcttttgatactttta

SEQ ID NO: 17511 - DNA, 26 bp, Artificial sequence
  SiRNA target sequence
attaatacatcttttgatacttttaa

SEQ ID NO: 17512 - DNA, 26 bp, Artificial sequence
  SiRNA target sequence
ttaatacatcttttgatacttttaat

SEQ ID NO: 17513 - DNA, 26 bp, Artificial sequence
  SiRNA target sequence
taatacatcttttgatacttttaatt

SEQ ID NO: 17514 - DNA, 26 bp, Artificial sequence
  SiRNA target sequence
aatacatcttttgatacttttaattt

SEQ ID NO: 17515 - DNA, 26 bp, Artificial sequence
  SiRNA target sequence
atacatcttttgatacttttaattta

SEQ ID NO: 17516 - DNA, 26 bp, Artificial sequence
  SiRNA target sequence
tacatcttttgatacttttaatttag

SEQ ID NO: 17517 - DNA, 26 bp, Artificial sequence
  SiRNA target sequence
acatcttttgatacttttaatttaga

SEQ ID NO: 17518 - DNA, 26 bp, Artificial sequence
  SiRNA target sequence
catcttttgatacttttaatttagaa

SEQ ID NO: 17519 - DNA, 26 bp, Artificial sequence
  SiRNA target sequence
atcttttgatacttttaatttagaaa

SEQ ID NO: 17520 - DNA, 26 bp, Artificial sequence
  SiRNA target sequence
tcttttgatacttttaatttagaaaa

SEQ ID NO: 17521 - DNA, 26 bp, Artificial sequence
  SiRNA target sequence
cttttgatacttttaatttagaaaat

SEQ ID NO: 17522 - DNA, 26 bp, Artificial sequence
  SiRNA target sequence
ttttgatacttttaatttagaaaatg

SEQ ID NO: 17523 - DNA, 26 bp, Artificial sequence
  SiRNA target sequence
tttgatacttttaatttagaaaatgt

SEQ ID NO: 17524 - DNA, 26 bp, Artificial sequence
  SiRNA target sequence
ttgatacttttaatttagaaaatgta

SEQ ID NO: 17525 - DNA, 26 bp, Artificial sequence
  SiRNA target sequence
tgatacttttaatttagaaaatgtaa

SEQ ID NO: 17526 - DNA, 26 bp, Artificial sequence
  SiRNA target sequence
gatacttttaatttagaaaatgtaag

SEQ ID NO: 17527 - DNA, 26 bp, Artificial sequence
  SiRNA target sequence
atacttttaatttagaaaatgtaagc

SEQ ID NO: 17528 - DNA, 26 bp, Artificial sequence
  SiRNA target sequence
tacttttaatttagaaaatgtaagca

SEQ ID NO: 17529 - DNA, 26 bp, Artificial sequence
  SiRNA target sequence
acttttaatttagaaaatgtaagcat

SEQ ID NO: 17530 - DNA, 26 bp, Artificial sequence
  SiRNA target sequence
cttttaatttagaaaatgtaagcatt

SEQ ID NO: 17531 - DNA, 26 bp, Artificial sequence
  SiRNA target sequence
ttttaatttagaaaatgtaagcatta

SEQ ID NO: 17532 - DNA, 26 bp, Artificial sequence
  SiRNA target sequence
tttaatttagaaaatgtaagcattac

SEQ ID NO: 17533 - DNA, 26 bp, Artificial sequence
  SiRNA target sequence
ttaatttagaaaatgtaagcattact

SEQ ID NO: 17534 - DNA, 26 bp, Artificial sequence
  SiRNA target sequence
taatttagaaaatgtaagcattacta

SEQ ID NO: 17535 - DNA, 26 bp, Artificial sequence
  SiRNA target sequence
aatttagaaaatgtaagcattactag

SEQ ID NO: 17536 - DNA, 26 bp, Artificial sequence
  SiRNA target sequence
atttagaaaatgtaagcattactagc

SEQ ID NO: 17537 - DNA, 26 bp, Artificial sequence
  SiRNA target sequence
tttagaaaatgtaagcattactagct

SEQ ID NO: 17538 - DNA, 26 bp, Artificial sequence
  SiRNA target sequence
ttagaaaatgtaagcattactagctt

SEQ ID NO: 17539 - DNA, 26 bp, Artificial sequence
  SiRNA target sequence
tagaaaatgtaagcattactagctta

SEQ ID NO: 17540 - DNA, 26 bp, Artificial sequence
  SiRNA target sequence
agaaaatgtaagcattactagcttaa

SEQ ID NO: 17541 - DNA, 26 bp, Artificial sequence
  SiRNA target sequence
gaaaatgtaagcattactagcttaaa

SEQ ID NO: 17542 - DNA, 26 bp, Artificial sequence
  SiRNA target sequence
aaaatgtaagcattactagcttaaat

SEQ ID NO: 17543 - DNA, 26 bp, Artificial sequence
  SiRNA target sequence
aaatgtaagcattactagcttaaata

SEQ ID NO: 17544 - DNA, 26 bp, Artificial sequence
  SiRNA target sequence
aatgtaagcattactagcttaaatac

SEQ ID NO: 17545 - DNA, 26 bp, Artificial sequence
  SiRNA target sequence
atgtaagcattactagcttaaatacg

SEQ ID NO: 17546 - DNA, 26 bp, Artificial sequence
  SiRNA target sequence
tgtaagcattactagcttaaatacgt

SEQ ID NO: 17547 - DNA, 26 bp, Artificial sequence
  SiRNA target sequence
gtaagcattactagcttaaatacgta

SEQ ID NO: 17548 - DNA, 26 bp, Artificial sequence
  SiRNA target sequence
taagcattactagcttaaatacgtac

SEQ ID NO: 17549 - DNA, 26 bp, Artificial sequence
  SiRNA target sequence
aagcattactagcttaaatacgtaca

SEQ ID NO: 17550 - DNA, 26 bp, Artificial sequence
  SiRNA target sequence
agcattactagcttaaatacgtacac

SEQ ID NO: 17551 - DNA, 26 bp, Artificial sequence
  SiRNA target sequence
gcattactagcttaaatacgtacacc

SEQ ID NO: 17552 - DNA, 26 bp, Artificial sequence
  SiRNA target sequence
cattactagcttaaatacgtacaccg

SEQ ID NO: 17553 - DNA, 26 bp, Artificial sequence
  SiRNA target sequence
attactagcttaaatacgtacaccgg

SEQ ID NO: 17554 - DNA, 26 bp, Artificial sequence
  SiRNA target sequence
ttactagcttaaatacgtacaccggt

SEQ ID NO: 17555 - DNA, 26 bp, Artificial sequence
  SiRNA target sequence
tactagcttaaatacgtacaccggtg

SEQ ID NO: 17556 - DNA, 26 bp, Artificial sequence
  SiRNA target sequence
actagcttaaatacgtacaccggtgt

SEQ ID NO: 17557 - DNA, 26 bp, Artificial sequence
  SiRNA target sequence
ctagcttaaatacgtacaccggtgtt

SEQ ID NO: 17558 - DNA, 26 bp, Artificial sequence
  SiRNA target sequence
tagcttaaatacgtacaccggtgtta

SEQ ID NO: 17559 - DNA, 26 bp, Artificial sequence
  SiRNA target sequence
agcttaaatacgtacaccggtgttaa

SEQ ID NO: 17560 - DNA, 26 bp, Artificial sequence
  SiRNA target sequence
gcttaaatacgtacaccggtgttaaa

SEQ ID NO: 17561 - DNA, 26 bp, Artificial sequence
  SiRNA target sequence
cttaaatacgtacaccggtgttaaaa

SEQ ID NO: 17562 - DNA, 26 bp, Artificial sequence
  SiRNA target sequence
ttaaatacgtacaccggtgttaaaac

SEQ ID NO: 17563 - DNA, 26 bp, Artificial sequence
  SiRNA target sequence
taaatacgtacaccggtgttaaaacc

SEQ ID NO: 17564 - DNA, 26 bp, Artificial sequence
  SiRNA target sequence
aaatacgtacaccggtgttaaaaccg

SEQ ID NO: 17565 - DNA, 26 bp, Artificial sequence
  SiRNA target sequence
aatacgtacaccggtgttaaaaccga

SEQ ID NO: 17566 - DNA, 26 bp, Artificial sequence
  SiRNA target sequence
atacgtacaccggtgttaaaaccgaa

SEQ ID NO: 17567 - DNA, 26 bp, Artificial sequence
  SiRNA target sequence
tacgtacaccggtgttaaaaccgaaa

SEQ ID NO: 17568 - DNA, 26 bp, Artificial sequence
  SiRNA target sequence
acgtacaccggtgttaaaaccgaaat

SEQ ID NO: 17569 - DNA, 26 bp, Artificial sequence
  SiRNA target sequence
cgtacaccggtgttaaaaccgaaata

SEQ ID NO: 17570 - DNA, 26 bp, Artificial sequence
  SiRNA target sequence
gtacaccggtgttaaaaccgaaatat

SEQ ID NO: 17571 - DNA, 26 bp, Artificial sequence
  SiRNA target sequence
tacaccggtgttaaaaccgaaatatc

SEQ ID NO: 17572 - DNA, 26 bp, Artificial sequence
  SiRNA target sequence
acaccggtgttaaaaccgaaatatca

SEQ ID NO: 17573 - DNA, 26 bp, Artificial sequence
  SiRNA target sequence
caccggtgttaaaaccgaaatatcaa

SEQ ID NO: 17574 - DNA, 26 bp, Artificial sequence
  SiRNA target sequence
accggtgttaaaaccgaaatatcaaa

SEQ ID NO: 17575 - DNA, 26 bp, Artificial sequence
  SiRNA target sequence
ccggtgttaaaaccgaaatatcaaaa

SEQ ID NO: 17576 - DNA, 26 bp, Artificial sequence
  SiRNA target sequence
cggtgttaaaaccgaaatatcaaaaa

SEQ ID NO: 17577 - DNA, 26 bp, Artificial sequence
  SiRNA target sequence
ggtgttaaaaccgaaatatcaaaaac

SEQ ID NO: 17578 - DNA, 26 bp, Artificial sequence
  SiRNA target sequence
gtgttaaaaccgaaatatcaaaaacc

SEQ ID NO: 17579 - DNA, 26 bp, Artificial sequence
  SiRNA target sequence
tgttaaaaccgaaatatcaaaaaccg

SEQ ID NO: 17580 - DNA, 26 bp, Artificial sequence
  SiRNA target sequence
gttaaaaccgaaatatcaaaaaccgt

SEQ ID NO: 17581 - DNA, 26 bp, Artificial sequence
  SiRNA target sequence
ttaaaaccgaaatatcaaaaaccgta

SEQ ID NO: 17582 - DNA, 26 bp, Artificial sequence
  SiRNA target sequence
taaaaccgaaatatcaaaaaccgtat

SEQ ID NO: 17583 - DNA, 26 bp, Artificial sequence
  SiRNA target sequence
aaaaccgaaatatcaaaaaccgtatc

SEQ ID NO: 17584 - DNA, 26 bp, Artificial sequence
  SiRNA target sequence
aaaccgaaatatcaaaaaccgtatca

SEQ ID NO: 17585 - DNA, 26 bp, Artificial sequence
  SiRNA target sequence
aaccgaaatatcaaaaaccgtatcac

SEQ ID NO: 17586 - DNA, 26 bp, Artificial sequence
  SiRNA target sequence
accgaaatatcaaaaaccgtatcacc

SEQ ID NO: 17587 - DNA, 26 bp, Artificial sequence
  SiRNA target sequence
ccgaaatatcaaaaaccgtatcacca

SEQ ID NO: 17588 - DNA, 26 bp, Artificial sequence
  SiRNA target sequence
cgaaatatcaaaaaccgtatcaccac

SEQ ID NO: 17589 - DNA, 26 bp, Artificial sequence
  SiRNA target sequence
gaaatatcaaaaaccgtatcaccaca

SEQ ID NO: 17590 - DNA, 26 bp, Artificial sequence
  SiRNA target sequence
aaatatcaaaaaccgtatcaccacac

SEQ ID NO: 17591 - DNA, 26 bp, Artificial sequence
  SiRNA target sequence
aatatcaaaaaccgtatcaccacact

SEQ ID NO: 17592 - DNA, 26 bp, Artificial sequence
  SiRNA target sequence
atatcaaaaaccgtatcaccacactt

SEQ ID NO: 17593 - DNA, 26 bp, Artificial sequence
  SiRNA target sequence
tatcaaaaaccgtatcaccacacttc

SEQ ID NO: 17594 - DNA, 26 bp, Artificial sequence
  SiRNA target sequence
atcaaaaaccgtatcaccacacttcc

SEQ ID NO: 17595 - DNA, 26 bp, Artificial sequence
  SiRNA target sequence
tcaaaaaccgtatcaccacacttcca

SEQ ID NO: 17596 - DNA, 26 bp, Artificial sequence
  SiRNA target sequence
caaaaaccgtatcaccacacttccag

SEQ ID NO: 17597 - DNA, 26 bp, Artificial sequence
  SiRNA target sequence
aaaaaccgtatcaccacacttccaga

SEQ ID NO: 17598 - DNA, 26 bp, Artificial sequence
  SiRNA target sequence
aaaaccgtatcaccacacttccagat

SEQ ID NO: 17599 - DNA, 26 bp, Artificial sequence
  SiRNA target sequence
aaaccgtatcaccacacttccagatt

SEQ ID NO: 17600 - DNA, 26 bp, Artificial sequence
  SiRNA target sequence
aaccgtatcaccacacttccagattt

SEQ ID NO: 17601 - DNA, 26 bp, Artificial sequence
  SiRNA target sequence
accgtatcaccacacttccagatttc

SEQ ID NO: 17602 - DNA, 26 bp, Artificial sequence
  SiRNA target sequence
ccgtatcaccacacttccagatttct

SEQ ID NO: 17603 - DNA, 26 bp, Artificial sequence
  SiRNA target sequence
cgtatcaccacacttccagatttctc

SEQ ID NO: 17604 - DNA, 26 bp, Artificial sequence
  SiRNA target sequence
gtatcaccacacttccagatttctca

SEQ ID NO: 17605 - DNA, 26 bp, Artificial sequence
  SiRNA target sequence
tatcaccacacttccagatttctcat

SEQ ID NO: 17606 - DNA, 26 bp, Artificial sequence
  SiRNA target sequence
atcaccacacttccagatttctcatg

SEQ ID NO: 17607 - DNA, 26 bp, Artificial sequence
  SiRNA target sequence
tcaccacacttccagatttctcatgt

SEQ ID NO: 17608 - DNA, 26 bp, Artificial sequence
  SiRNA target sequence
caccacacttccagatttctcatgtc

SEQ ID NO: 17609 - DNA, 26 bp, Artificial sequence
  SiRNA target sequence
accacacttccagatttctcatgtct

SEQ ID NO: 17610 - DNA, 26 bp, Artificial sequence
  SiRNA target sequence
ccacacttccagatttctcatgtctc

SEQ ID NO: 17611 - DNA, 26 bp, Artificial sequence
  SiRNA target sequence
cacacttccagatttctcatgtctct

SEQ ID NO: 17612 - DNA, 26 bp, Artificial sequence
  SiRNA target sequence
acacttccagatttctcatgtctctt

SEQ ID NO: 17613 - DNA, 26 bp, Artificial sequence
  SiRNA target sequence
cacttccagatttctcatgtctcttc

SEQ ID NO: 17614 - DNA, 26 bp, Artificial sequence
  SiRNA target sequence
acttccagatttctcatgtctcttct

SEQ ID NO: 17615 - DNA, 26 bp, Artificial sequence
  SiRNA target sequence
cttccagatttctcatgtctcttcta

SEQ ID NO: 17616 - DNA, 26 bp, Artificial sequence
  SiRNA target sequence
ttccagatttctcatgtctcttctat

SEQ ID NO: 17617 - DNA, 26 bp, Artificial sequence
  SiRNA target sequence
tccagatttctcatgtctcttctatg

SEQ ID NO: 17618 - DNA, 26 bp, Artificial sequence
  SiRNA target sequence
ccagatttctcatgtctcttctatgg

SEQ ID NO: 17619 - DNA, 26 bp, Artificial sequence
  SiRNA target sequence
cagatttctcatgtctcttctatggg

SEQ ID NO: 17620 - DNA, 26 bp, Artificial sequence
  SiRNA target sequence
agatttctcatgtctcttctatgggc

SEQ ID NO: 17621 - DNA, 26 bp, Artificial sequence
  SiRNA target sequence
gatttctcatgtctcttctatgggcg

SEQ ID NO: 17622 - DNA, 26 bp, Artificial sequence
  SiRNA target sequence
atttctcatgtctcttctatgggcgc

SEQ ID NO: 17623 - DNA, 26 bp, Artificial sequence
  SiRNA target sequence
tttctcatgtctcttctatgggcgca

SEQ ID NO: 17624 - DNA, 26 bp, Artificial sequence
  SiRNA target sequence
ttctcatgtctcttctatgggcgcag

SEQ ID NO: 17625 - DNA, 26 bp, Artificial sequence
  SiRNA target sequence
tctcatgtctcttctatgggcgcaga

SEQ ID NO: 17626 - DNA, 26 bp, Artificial sequence
  SiRNA target sequence
ctcatgtctcttctatgggcgcagat

SEQ ID NO: 17627 - DNA, 26 bp, Artificial sequence
  SiRNA target sequence
tcatgtctcttctatgggcgcagatt

SEQ ID NO: 17628 - DNA, 26 bp, Artificial sequence
  SiRNA target sequence
catgtctcttctatgggcgcagattt

SEQ ID NO: 17629 - DNA, 26 bp, Artificial sequence
  SiRNA target sequence
atgtctcttctatgggcgcagatttc

SEQ ID NO: 17630 - DNA, 26 bp, Artificial sequence
  SiRNA target sequence
tgtctcttctatgggcgcagatttcg

SEQ ID NO: 17631 - DNA, 26 bp, Artificial sequence
  SiRNA target sequence
gtctcttctatgggcgcagatttcga

SEQ ID NO: 17632 - DNA, 26 bp, Artificial sequence
  SiRNA target sequence
tctcttctatgggcgcagatttcgac

SEQ ID NO: 17633 - DNA, 26 bp, Artificial sequence
  SiRNA target sequence
ctcttctatgggcgcagatttcgaca

SEQ ID NO: 17634 - DNA, 26 bp, Artificial sequence
  SiRNA target sequence
tcttctatgggcgcagatttcgacat

SEQ ID NO: 17635 - DNA, 26 bp, Artificial sequence
  SiRNA target sequence
cttctatgggcgcagatttcgacata

SEQ ID NO: 17636 - DNA, 26 bp, Artificial sequence
  SiRNA target sequence
ttctatgggcgcagatttcgacataa

SEQ ID NO: 17637 - DNA, 26 bp, Artificial sequence
  SiRNA target sequence
tctatgggcgcagatttcgacataaa

SEQ ID NO: 17638 - DNA, 26 bp, Artificial sequence
  SiRNA target sequence
ctatgggcgcagatttcgacataaaa

SEQ ID NO: 17639 - DNA, 26 bp, Artificial sequence
  SiRNA target sequence
tatgggcgcagatttcgacataaaac

SEQ ID NO: 17640 - DNA, 26 bp, Artificial sequence
  SiRNA target sequence
atgggcgcagatttcgacataaaaca

SEQ ID NO: 17641 - DNA, 26 bp, Artificial sequence
  SiRNA target sequence
tgggcgcagatttcgacataaaacag

SEQ ID NO: 17642 - DNA, 26 bp, Artificial sequence
  SiRNA target sequence
gggcgcagatttcgacataaaacaga

SEQ ID NO: 17643 - DNA, 26 bp, Artificial sequence
  SiRNA target sequence
ggcgcagatttcgacataaaacagac

SEQ ID NO: 17644 - DNA, 26 bp, Artificial sequence
  SiRNA target sequence
gcgcagatttcgacataaaacagaca

SEQ ID NO: 17645 - DNA, 26 bp, Artificial sequence
  SiRNA target sequence
cgcagatttcgacataaaacagacat

SEQ ID NO: 17646 - DNA, 26 bp, Artificial sequence
  SiRNA target sequence
gcagatttcgacataaaacagacata

SEQ ID NO: 17647 - DNA, 26 bp, Artificial sequence
  SiRNA target sequence
cagatttcgacataaaacagacatac

SEQ ID NO: 17648 - DNA, 26 bp, Artificial sequence
  SiRNA target sequence
agatttcgacataaaacagacatacg

SEQ ID NO: 17649 - DNA, 26 bp, Artificial sequence
  SiRNA target sequence
gatttcgacataaaacagacatacgc

SEQ ID NO: 17650 - DNA, 26 bp, Artificial sequence
  SiRNA target sequence
atttcgacataaaacagacatacgcc

SEQ ID NO: 17651 - DNA, 26 bp, Artificial sequence
  SiRNA target sequence
tttcgacataaaacagacatacgcca

SEQ ID NO: 17652 - DNA, 26 bp, Artificial sequence
  SiRNA target sequence
ttcgacataaaacagacatacgccac

SEQ ID NO: 17653 - DNA, 26 bp, Artificial sequence
  SiRNA target sequence
tcgacataaaacagacatacgccacg

SEQ ID NO: 17654 - DNA, 26 bp, Artificial sequence
  SiRNA target sequence
cgacataaaacagacatacgccacgt

SEQ ID NO: 17655 - DNA, 26 bp, Artificial sequence
  SiRNA target sequence
gacataaaacagacatacgccacgtt

SEQ ID NO: 17656 - DNA, 26 bp, Artificial sequence
  SiRNA target sequence
acataaaacagacatacgccacgttc

SEQ ID NO: 17657 - DNA, 26 bp, Artificial sequence
  SiRNA target sequence
cataaaacagacatacgccacgttct

SEQ ID NO: 17658 - DNA, 26 bp, Artificial sequence
  SiRNA target sequence
ataaaacagacatacgccacgttctg

SEQ ID NO: 17659 - DNA, 26 bp, Artificial sequence
  SiRNA target sequence
taaaacagacatacgccacgttctgc

SEQ ID NO: 17660 - DNA, 26 bp, Artificial sequence
  SiRNA target sequence
aaaacagacatacgccacgttctgct

SEQ ID NO: 17661 - DNA, 26 bp, Artificial sequence
  SiRNA target sequence
aaacagacatacgccacgttctgctt

SEQ ID NO: 17662 - DNA, 26 bp, Artificial sequence
  SiRNA target sequence
aacagacatacgccacgttctgcttt

SEQ ID NO: 17663 - DNA, 26 bp, Artificial sequence
  SiRNA target sequence
acagacatacgccacgttctgcttta

SEQ ID NO: 17664 - DNA, 26 bp, Artificial sequence
  SiRNA target sequence
cagacatacgccacgttctgctttaa

SEQ ID NO: 17665 - DNA, 26 bp, Artificial sequence
  SiRNA target sequence
agacatacgccacgttctgctttaac

SEQ ID NO: 17666 - DNA, 26 bp, Artificial sequence
  SiRNA target sequence
gacatacgccacgttctgctttaaca

SEQ ID NO: 17667 - DNA, 26 bp, Artificial sequence
  SiRNA target sequence
acatacgccacgttctgctttaacaa

SEQ ID NO: 17668 - DNA, 26 bp, Artificial sequence
  SiRNA target sequence
catacgccacgttctgctttaacaat

SEQ ID NO: 17669 - DNA, 26 bp, Artificial sequence
  SiRNA target sequence
atacgccacgttctgctttaacaatc

SEQ ID NO: 17670 - DNA, 26 bp, Artificial sequence
  SiRNA target sequence
tacgccacgttctgctttaacaatct

SEQ ID NO: 17671 - DNA, 26 bp, Artificial sequence
  SiRNA target sequence
acgccacgttctgctttaacaatctt

SEQ ID NO: 17672 - DNA, 26 bp, Artificial sequence
  SiRNA target sequence
cgccacgttctgctttaacaatcttt

SEQ ID NO: 17673 - DNA, 26 bp, Artificial sequence
  SiRNA target sequence
gccacgttctgctttaacaatctttt

SEQ ID NO: 17674 - DNA, 26 bp, Artificial sequence
  SiRNA target sequence
ccacgttctgctttaacaatcttttg

SEQ ID NO: 17675 - DNA, 26 bp, Artificial sequence
  SiRNA target sequence
cacgttctgctttaacaatcttttgc

SEQ ID NO: 17676 - DNA, 26 bp, Artificial sequence
  SiRNA target sequence
acgttctgctttaacaatcttttgct

SEQ ID NO: 17677 - DNA, 26 bp, Artificial sequence
  SiRNA target sequence
cgttctgctttaacaatcttttgcta

SEQ ID NO: 17678 - DNA, 26 bp, Artificial sequence
  SiRNA target sequence
gttctgctttaacaatcttttgctac

SEQ ID NO: 17679 - DNA, 26 bp, Artificial sequence
  SiRNA target sequence
ttctgctttaacaatcttttgctaca

SEQ ID NO: 17680 - DNA, 26 bp, Artificial sequence
  SiRNA target sequence
tctgctttaacaatcttttgctacaa

SEQ ID NO: 17681 - DNA, 26 bp, Artificial sequence
  SiRNA target sequence
ctgctttaacaatcttttgctacaaa

SEQ ID NO: 17682 - DNA, 26 bp, Artificial sequence
  SiRNA target sequence
tgctttaacaatcttttgctacaaac

SEQ ID NO: 17683 - DNA, 26 bp, Artificial sequence
  SiRNA target sequence
gctttaacaatcttttgctacaaacg

SEQ ID NO: 17684 - DNA, 26 bp, Artificial sequence
  SiRNA target sequence
ctttaacaatcttttgctacaaacga

SEQ ID NO: 17685 - DNA, 26 bp, Artificial sequence
  SiRNA target sequence
tttaacaatcttttgctacaaacgag

SEQ ID NO: 17686 - DNA, 26 bp, Artificial sequence
  SiRNA target sequence
ttaacaatcttttgctacaaacgagc

SEQ ID NO: 17687 - DNA, 26 bp, Artificial sequence
  SiRNA target sequence
taacaatcttttgctacaaacgagca

SEQ ID NO: 17688 - DNA, 26 bp, Artificial sequence
  SiRNA target sequence
aacaatcttttgctacaaacgagcat

SEQ ID NO: 17689 - DNA, 26 bp, Artificial sequence
  SiRNA target sequence
acaatcttttgctacaaacgagcata

SEQ ID NO: 17690 - DNA, 26 bp, Artificial sequence
  SiRNA target sequence
caatcttttgctacaaacgagcatag

SEQ ID NO: 17691 - DNA, 26 bp, Artificial sequence
  SiRNA target sequence
aatcttttgctacaaacgagcataga

SEQ ID NO: 17692 - DNA, 26 bp, Artificial sequence
  SiRNA target sequence
atcttttgctacaaacgagcatagac

SEQ ID NO: 17693 - DNA, 26 bp, Artificial sequence
  SiRNA target sequence
tcttttgctacaaacgagcatagacc

SEQ ID NO: 17694 - DNA, 26 bp, Artificial sequence
  SiRNA target sequence
cttttgctacaaacgagcatagacca

SEQ ID NO: 17695 - DNA, 26 bp, Artificial sequence
  SiRNA target sequence
ttttgctacaaacgagcatagaccaa

SEQ ID NO: 17696 - DNA, 26 bp, Artificial sequence
  SiRNA target sequence
tttgctacaaacgagcatagaccaag

SEQ ID NO: 17697 - DNA, 26 bp, Artificial sequence
  SiRNA target sequence
ttgctacaaacgagcatagaccaaga

SEQ ID NO: 17698 - DNA, 26 bp, Artificial sequence
  SiRNA target sequence
tgctacaaacgagcatagaccaagac

SEQ ID NO: 17699 - DNA, 26 bp, Artificial sequence
  SiRNA target sequence
gctacaaacgagcatagaccaagaca

SEQ ID NO: 17700 - DNA, 26 bp, Artificial sequence
  SiRNA target sequence
ctacaaacgagcatagaccaagacaa

SEQ ID NO: 17701 - DNA, 26 bp, Artificial sequence
  SiRNA target sequence
tacaaacgagcatagaccaagacaaa

SEQ ID NO: 17702 - DNA, 26 bp, Artificial sequence
  SiRNA target sequence
acaaacgagcatagaccaagacaaaa

SEQ ID NO: 17703 - DNA, 26 bp, Artificial sequence
  SiRNA target sequence
caaacgagcatagaccaagacaaaat

SEQ ID NO: 17704 - DNA, 26 bp, Artificial sequence
  SiRNA target sequence
aaacgagcatagaccaagacaaaata

SEQ ID NO: 17705 - DNA, 26 bp, Artificial sequence
  SiRNA target sequence
aacgagcatagaccaagacaaaatat

SEQ ID NO: 17706 - DNA, 26 bp, Artificial sequence
  SiRNA target sequence
acgagcatagaccaagacaaaatatt

SEQ ID NO: 17707 - DNA, 26 bp, Artificial sequence
  SiRNA target sequence
cgagcatagaccaagacaaaatattt

SEQ ID NO: 17708 - DNA, 26 bp, Artificial sequence
  SiRNA target sequence
gagcatagaccaagacaaaatattta

SEQ ID NO: 17709 - DNA, 26 bp, Artificial sequence
  SiRNA target sequence
agcatagaccaagacaaaatatttag

SEQ ID NO: 17710 - DNA, 26 bp, Artificial sequence
  SiRNA target sequence
gcatagaccaagacaaaatatttaga

SEQ ID NO: 17711 - DNA, 26 bp, Artificial sequence
  SiRNA target sequence
catagaccaagacaaaatatttagaa

SEQ ID NO: 17712 - DNA, 26 bp, Artificial sequence
  SiRNA target sequence
atagaccaagacaaaatatttagaat

SEQ ID NO: 17713 - DNA, 26 bp, Artificial sequence
  SiRNA target sequence
tagaccaagacaaaatatttagaata

SEQ ID NO: 17714 - DNA, 26 bp, Artificial sequence
  SiRNA target sequence
agaccaagacaaaatatttagaataa

SEQ ID NO: 17715 - DNA, 26 bp, Artificial sequence
  SiRNA target sequence
gaccaagacaaaatatttagaataag

SEQ ID NO: 17716 - DNA, 26 bp, Artificial sequence
  SiRNA target sequence
accaagacaaaatatttagaataaga

SEQ ID NO: 17717 - DNA, 26 bp, Artificial sequence
  SiRNA target sequence
ccaagacaaaatatttagaataagag

SEQ ID NO: 17718 - DNA, 26 bp, Artificial sequence
  SiRNA target sequence
caagacaaaatatttagaataagagg

SEQ ID NO: 17719 - DNA, 26 bp, Artificial sequence
  SiRNA target sequence
aagacaaaatatttagaataagaggt

SEQ ID NO: 17720 - DNA, 26 bp, Artificial sequence
  SiRNA target sequence
agacaaaatatttagaataagaggta

SEQ ID NO: 17721 - DNA, 26 bp, Artificial sequence
  SiRNA target sequence
gacaaaatatttagaataagaggtac

SEQ ID NO: 17722 - DNA, 26 bp, Artificial sequence
  SiRNA target sequence
acaaaatatttagaataagaggtacc

SEQ ID NO: 17723 - DNA, 26 bp, Artificial sequence
  SiRNA target sequence
caaaatatttagaataagaggtaccc

SEQ ID NO: 17724 - DNA, 26 bp, Artificial sequence
  SiRNA target sequence
aaaatatttagaataagaggtaccca

SEQ ID NO: 17725 - DNA, 26 bp, Artificial sequence
  SiRNA target sequence
aaatatttagaataagaggtacccac

SEQ ID NO: 17726 - DNA, 26 bp, Artificial sequence
  SiRNA target sequence
aatatttagaataagaggtacccaca

SEQ ID NO: 17727 - DNA, 26 bp, Artificial sequence
  SiRNA target sequence
atatttagaataagaggtacccacat

SEQ ID NO: 17728 - DNA, 26 bp, Artificial sequence
  SiRNA target sequence
tatttagaataagaggtacccacatg

SEQ ID NO: 17729 - DNA, 26 bp, Artificial sequence
  SiRNA target sequence
atttagaataagaggtacccacatgt

SEQ ID NO: 17730 - DNA, 26 bp, Artificial sequence
  SiRNA target sequence
tttagaataagaggtacccacatgtt

SEQ ID NO: 17731 - DNA, 26 bp, Artificial sequence
  SiRNA target sequence
ttagaataagaggtacccacatgttt

SEQ ID NO: 17732 - DNA, 26 bp, Artificial sequence
  SiRNA target sequence
tagaataagaggtacccacatgttta

SEQ ID NO: 17733 - DNA, 26 bp, Artificial sequence
  SiRNA target sequence
agaataagaggtacccacatgtttaa

SEQ ID NO: 17734 - DNA, 26 bp, Artificial sequence
  SiRNA target sequence
gaataagaggtacccacatgtttaaa

SEQ ID NO: 17735 - DNA, 26 bp, Artificial sequence
  SiRNA target sequence
aataagaggtacccacatgtttaaaa

SEQ ID NO: 17736 - DNA, 26 bp, Artificial sequence
  SiRNA target sequence
ataagaggtacccacatgtttaaaaa

SEQ ID NO: 17737 - DNA, 26 bp, Artificial sequence
  SiRNA target sequence
taagaggtacccacatgtttaaaaat

SEQ ID NO: 17738 - DNA, 26 bp, Artificial sequence
  SiRNA target sequence
aagaggtacccacatgtttaaaaatc

SEQ ID NO: 17739 - DNA, 26 bp, Artificial sequence
  SiRNA target sequence
agaggtacccacatgtttaaaaatct

SEQ ID NO: 17740 - DNA, 26 bp, Artificial sequence
  SiRNA target sequence
gaggtacccacatgtttaaaaatcta

SEQ ID NO: 17741 - DNA, 26 bp, Artificial sequence
  SiRNA target sequence
aggtacccacatgtttaaaaatctac

SEQ ID NO: 17742 - DNA, 26 bp, Artificial sequence
  SiRNA target sequence
ggtacccacatgtttaaaaatctact

SEQ ID NO: 17743 - DNA, 26 bp, Artificial sequence
  SiRNA target sequence
gtacccacatgtttaaaaatctactt

SEQ ID NO: 17744 - DNA, 26 bp, Artificial sequence
  SiRNA target sequence
tacccacatgtttaaaaatctactta

SEQ ID NO: 17745 - DNA, 26 bp, Artificial sequence
  SiRNA target sequence
acccacatgtttaaaaatctacttac

SEQ ID NO: 17746 - DNA, 26 bp, Artificial sequence
  SiRNA target sequence
cccacatgtttaaaaatctacttact

SEQ ID NO: 17747 - DNA, 26 bp, Artificial sequence
  SiRNA target sequence
ccacatgtttaaaaatctacttacta

SEQ ID NO: 17748 - DNA, 26 bp, Artificial sequence
  SiRNA target sequence
cacatgtttaaaaatctacttactaa

SEQ ID NO: 17749 - DNA, 26 bp, Artificial sequence
  SiRNA target sequence
acatgtttaaaaatctacttactaaa

SEQ ID NO: 17750 - DNA, 26 bp, Artificial sequence
  SiRNA target sequence
catgtttaaaaatctacttactaaat

SEQ ID NO: 17751 - DNA, 26 bp, Artificial sequence
  SiRNA target sequence
atgtttaaaaatctacttactaaatt

SEQ ID NO: 17752 - DNA, 26 bp, Artificial sequence
  SiRNA target sequence
tgtttaaaaatctacttactaaattc

SEQ ID NO: 17753 - DNA, 26 bp, Artificial sequence
  SiRNA target sequence
gtttaaaaatctacttactaaattcc

SEQ ID NO: 17754 - DNA, 26 bp, Artificial sequence
  SiRNA target sequence
tttaaaaatctacttactaaattcca

SEQ ID NO: 17755 - DNA, 26 bp, Artificial sequence
  SiRNA target sequence
ttaaaaatctacttactaaattccat

SEQ ID NO: 17756 - DNA, 26 bp, Artificial sequence
  SiRNA target sequence
taaaaatctacttactaaattccata

SEQ ID NO: 17757 - DNA, 26 bp, Artificial sequence
  SiRNA target sequence
aaaaatctacttactaaattccatac

SEQ ID NO: 17758 - DNA, 26 bp, Artificial sequence
  SiRNA target sequence
aaaatctacttactaaattccataca

SEQ ID NO: 17759 - DNA, 26 bp, Artificial sequence
  SiRNA target sequence
aaatctacttactaaattccatacag

SEQ ID NO: 17760 - DNA, 26 bp, Artificial sequence
  SiRNA target sequence
aatctacttactaaattccatacagt

SEQ ID NO: 17761 - DNA, 26 bp, Artificial sequence
  SiRNA target sequence
atctacttactaaattccatacagta

SEQ ID NO: 17762 - DNA, 26 bp, Artificial sequence
  SiRNA target sequence
tctacttactaaattccatacagtaa

SEQ ID NO: 17763 - DNA, 26 bp, Artificial sequence
  SiRNA target sequence
ctacttactaaattccatacagtaat

SEQ ID NO: 17764 - DNA, 26 bp, Artificial sequence
  SiRNA target sequence
tacttactaaattccatacagtaatt

SEQ ID NO: 17765 - DNA, 26 bp, Artificial sequence
  SiRNA target sequence
acttactaaattccatacagtaattg

SEQ ID NO: 17766 - DNA, 26 bp, Artificial sequence
  SiRNA target sequence
cttactaaattccatacagtaattgg

SEQ ID NO: 17767 - DNA, 26 bp, Artificial sequence
  SiRNA target sequence
ttactaaattccatacagtaattggt

SEQ ID NO: 17768 - DNA, 26 bp, Artificial sequence
  SiRNA target sequence
tactaaattccatacagtaattggta

SEQ ID NO: 17769 - DNA, 26 bp, Artificial sequence
  SiRNA target sequence
actaaattccatacagtaattggtag

SEQ ID NO: 17770 - DNA, 26 bp, Artificial sequence
  SiRNA target sequence
ctaaattccatacagtaattggtaga

SEQ ID NO: 17771 - DNA, 26 bp, Artificial sequence
  SiRNA target sequence
taaattccatacagtaattggtagaa

SEQ ID NO: 17772 - DNA, 26 bp, Artificial sequence
  SiRNA target sequence
aaattccatacagtaattggtagaag

SEQ ID NO: 17773 - DNA, 26 bp, Artificial sequence
  SiRNA target sequence
aattccatacagtaattggtagaagt

SEQ ID NO: 17774 - DNA, 26 bp, Artificial sequence
  SiRNA target sequence
attccatacagtaattggtagaagta

SEQ ID NO: 17775 - DNA, 26 bp, Artificial sequence
  SiRNA target sequence
ttccatacagtaattggtagaagtaa

SEQ ID NO: 17776 - DNA, 26 bp, Artificial sequence
  SiRNA target sequence
tccatacagtaattggtagaagtaaa

SEQ ID NO: 17777 - DNA, 26 bp, Artificial sequence
  SiRNA target sequence
ccatacagtaattggtagaagtaaag

SEQ ID NO: 17778 - DNA, 26 bp, Artificial sequence
  SiRNA target sequence
catacagtaattggtagaagtaaaga

SEQ ID NO: 17779 - DNA, 26 bp, Artificial sequence
  SiRNA target sequence
atacagtaattggtagaagtaaagat

SEQ ID NO: 17780 - DNA, 26 bp, Artificial sequence
  SiRNA target sequence
tacagtaattggtagaagtaaagata

SEQ ID NO: 17781 - DNA, 26 bp, Artificial sequence
  SiRNA target sequence
acagtaattggtagaagtaaagatat

SEQ ID NO: 17782 - DNA, 26 bp, Artificial sequence
  SiRNA target sequence
cagtaattggtagaagtaaagatatc

SEQ ID NO: 17783 - DNA, 26 bp, Artificial sequence
  SiRNA target sequence
agtaattggtagaagtaaagatatct

SEQ ID NO: 17784 - DNA, 26 bp, Artificial sequence
  SiRNA target sequence
gtaattggtagaagtaaagatatctt

SEQ ID NO: 17785 - DNA, 26 bp, Artificial sequence
  SiRNA target sequence
taattggtagaagtaaagatatcttt

SEQ ID NO: 17786 - DNA, 26 bp, Artificial sequence
  SiRNA target sequence
aattggtagaagtaaagatatcttta

SEQ ID NO: 17787 - DNA, 26 bp, Artificial sequence
  SiRNA target sequence
attggtagaagtaaagatatctttac

SEQ ID NO: 17788 - DNA, 26 bp, Artificial sequence
  SiRNA target sequence
ttggtagaagtaaagatatctttaca

SEQ ID NO: 17789 - DNA, 26 bp, Artificial sequence
  SiRNA target sequence
tggtagaagtaaagatatctttacac

SEQ ID NO: 17790 - DNA, 26 bp, Artificial sequence
  SiRNA target sequence
ggtagaagtaaagatatctttacaca

SEQ ID NO: 17791 - DNA, 26 bp, Artificial sequence
  SiRNA target sequence
gtagaagtaaagatatctttacacaa

SEQ ID NO: 17792 - DNA, 26 bp, Artificial sequence
  SiRNA target sequence
tagaagtaaagatatctttacacaaa

SEQ ID NO: 17793 - DNA, 26 bp, Artificial sequence
  SiRNA target sequence
agaagtaaagatatctttacacaaat

SEQ ID NO: 17794 - DNA, 26 bp, Artificial sequence
  SiRNA target sequence
gaagtaaagatatctttacacaaata

SEQ ID NO: 17795 - DNA, 26 bp, Artificial sequence
  SiRNA target sequence
aagtaaagatatctttacacaaatag

SEQ ID NO: 17796 - DNA, 26 bp, Artificial sequence
  SiRNA target sequence
agtaaagatatctttacacaaataga

SEQ ID NO: 17797 - DNA, 26 bp, Artificial sequence
  SiRNA target sequence
gtaaagatatctttacacaaatagag

SEQ ID NO: 17798 - DNA, 26 bp, Artificial sequence
  SiRNA target sequence
taaagatatctttacacaaatagagg

SEQ ID NO: 17799 - DNA, 26 bp, Artificial sequence
  SiRNA target sequence
aaagatatctttacacaaatagaggt

SEQ ID NO: 17800 - DNA, 26 bp, Artificial sequence
  SiRNA target sequence
aagatatctttacacaaatagaggta

SEQ ID NO: 17801 - DNA, 26 bp, Artificial sequence
  SiRNA target sequence
agatatctttacacaaatagaggtag

SEQ ID NO: 17802 - DNA, 26 bp, Artificial sequence
  SiRNA target sequence
gatatctttacacaaatagaggtaga

SEQ ID NO: 17803 - DNA, 26 bp, Artificial sequence
  SiRNA target sequence
atatctttacacaaatagaggtagac

SEQ ID NO: 17804 - DNA, 26 bp, Artificial sequence
  SiRNA target sequence
tatctttacacaaatagaggtagaca

SEQ ID NO: 17805 - DNA, 26 bp, Artificial sequence
  SiRNA target sequence
atctttacacaaatagaggtagacat

SEQ ID NO: 17806 - DNA, 26 bp, Artificial sequence
  SiRNA target sequence
tctttacacaaatagaggtagacata

SEQ ID NO: 17807 - DNA, 26 bp, Artificial sequence
  SiRNA target sequence
ctttacacaaatagaggtagacataa

SEQ ID NO: 17808 - DNA, 26 bp, Artificial sequence
  SiRNA target sequence
tttacacaaatagaggtagacataaa

SEQ ID NO: 17809 - DNA, 26 bp, Artificial sequence
  SiRNA target sequence
ttacacaaatagaggtagacataaaa

SEQ ID NO: 17810 - DNA, 26 bp, Artificial sequence
  SiRNA target sequence
tacacaaatagaggtagacataaaaa

SEQ ID NO: 17811 - DNA, 26 bp, Artificial sequence
  SiRNA target sequence
acacaaatagaggtagacataaaaaa

SEQ ID NO: 17812 - DNA, 26 bp, Artificial sequence
  SiRNA target sequence
cacaaatagaggtagacataaaaaat

SEQ ID NO: 17813 - DNA, 26 bp, Artificial sequence
  SiRNA target sequence
acaaatagaggtagacataaaaaata

SEQ ID NO: 17814 - DNA, 26 bp, Artificial sequence
  SiRNA target sequence
caaatagaggtagacataaaaaataa

SEQ ID NO: 17815 - DNA, 26 bp, Artificial sequence
  SiRNA target sequence
aaatagaggtagacataaaaaataaa

SEQ ID NO: 17816 - DNA, 26 bp, Artificial sequence
  SiRNA target sequence
aatagaggtagacataaaaaataaat

SEQ ID NO: 17817 - DNA, 26 bp, Artificial sequence
  SiRNA target sequence
atagaggtagacataaaaaataaata

SEQ ID NO: 17818 - DNA, 26 bp, Artificial sequence
  SiRNA target sequence
tagaggtagacataaaaaataaatac

SEQ ID NO: 17819 - DNA, 26 bp, Artificial sequence
  SiRNA target sequence
agaggtagacataaaaaataaataca

SEQ ID NO: 17820 - DNA, 26 bp, Artificial sequence
  SiRNA target sequence
gaggtagacataaaaaataaatacaa

SEQ ID NO: 17821 - DNA, 26 bp, Artificial sequence
  SiRNA target sequence
aggtagacataaaaaataaatacaat

SEQ ID NO: 17822 - DNA, 26 bp, Artificial sequence
  SiRNA target sequence
ggtagacataaaaaataaatacaata

SEQ ID NO: 17823 - DNA, 26 bp, Artificial sequence
  SiRNA target sequence
gtagacataaaaaataaatacaataa

SEQ ID NO: 17824 - DNA, 26 bp, Artificial sequence
  SiRNA target sequence
tagacataaaaaataaatacaataat

SEQ ID NO: 17825 - DNA, 26 bp, Artificial sequence
  SiRNA target sequence
agacataaaaaataaatacaataata

SEQ ID NO: 17826 - DNA, 26 bp, Artificial sequence
  SiRNA target sequence
gacataaaaaataaatacaataatat

SEQ ID NO: 17827 - DNA, 26 bp, Artificial sequence
  SiRNA target sequence
acataaaaaataaatacaataatatg

SEQ ID NO: 17828 - DNA, 26 bp, Artificial sequence
  SiRNA target sequence
cataaaaaataaatacaataatatgt

SEQ ID NO: 17829 - DNA, 26 bp, Artificial sequence
  SiRNA target sequence
ataaaaaataaatacaataatatgtg

SEQ ID NO: 17830 - DNA, 26 bp, Artificial sequence
  SiRNA target sequence
taaaaaataaatacaataatatgtgt

SEQ ID NO: 17831 - DNA, 26 bp, Artificial sequence
  SiRNA target sequence
aaaaaataaatacaataatatgtgta

SEQ ID NO: 17832 - DNA, 26 bp, Artificial sequence
  SiRNA target sequence
aaaaataaatacaataatatgtgtat

SEQ ID NO: 17833 - DNA, 26 bp, Artificial sequence
  SiRNA target sequence
aaaataaatacaataatatgtgtata

SEQ ID NO: 17834 - DNA, 26 bp, Artificial sequence
  SiRNA target sequence
aaataaatacaataatatgtgtataa

SEQ ID NO: 17835 - DNA, 26 bp, Artificial sequence
  SiRNA target sequence
aataaatacaataatatgtgtataaa

SEQ ID NO: 17836 - DNA, 26 bp, Artificial sequence
  SiRNA target sequence
ataaatacaataatatgtgtataaaa

SEQ ID NO: 17837 - DNA, 26 bp, Artificial sequence
  SiRNA target sequence
taaatacaataatatgtgtataaaaa

SEQ ID NO: 17838 - DNA, 26 bp, Artificial sequence
  SiRNA target sequence
aaatacaataatatgtgtataaaaat

SEQ ID NO: 17839 - DNA, 26 bp, Artificial sequence
  SiRNA target sequence
aatacaataatatgtgtataaaaatg

SEQ ID NO: 17840 - DNA, 26 bp, Artificial sequence
  SiRNA target sequence
atacaataatatgtgtataaaaatga

SEQ ID NO: 17841 - DNA, 26 bp, Artificial sequence
  SiRNA target sequence
tacaataatatgtgtataaaaatgat

SEQ ID NO: 17842 - DNA, 26 bp, Artificial sequence
  SiRNA target sequence
acaataatatgtgtataaaaatgata

SEQ ID NO: 17843 - DNA, 26 bp, Artificial sequence
  SiRNA target sequence
caataatatgtgtataaaaatgatac

SEQ ID NO: 17844 - DNA, 26 bp, Artificial sequence
  SiRNA target sequence
aataatatgtgtataaaaatgataca

SEQ ID NO: 17845 - DNA, 26 bp, Artificial sequence
  SiRNA target sequence
ataatatgtgtataaaaatgatacag

SEQ ID NO: 17846 - DNA, 26 bp, Artificial sequence
  SiRNA target sequence
taatatgtgtataaaaatgatacagc

SEQ ID NO: 17847 - DNA, 26 bp, Artificial sequence
  SiRNA target sequence
aatatgtgtataaaaatgatacagcc

SEQ ID NO: 17848 - DNA, 26 bp, Artificial sequence
  SiRNA target sequence
atatgtgtataaaaatgatacagcca

SEQ ID NO: 17849 - DNA, 26 bp, Artificial sequence
  SiRNA target sequence
tatgtgtataaaaatgatacagccag

SEQ ID NO: 17850 - DNA, 26 bp, Artificial sequence
  SiRNA target sequence
atgtgtataaaaatgatacagccagc

SEQ ID NO: 17851 - DNA, 26 bp, Artificial sequence
  SiRNA target sequence
tgtgtataaaaatgatacagccagct

SEQ ID NO: 17852 - DNA, 26 bp, Artificial sequence
  SiRNA target sequence
gtgtataaaaatgatacagccagcta

SEQ ID NO: 17853 - DNA, 26 bp, Artificial sequence
  SiRNA target sequence
tgtataaaaatgatacagccagctat

SEQ ID NO: 17854 - DNA, 26 bp, Artificial sequence
  SiRNA target sequence
gtataaaaatgatacagccagctatt

SEQ ID NO: 17855 - DNA, 26 bp, Artificial sequence
  SiRNA target sequence
tataaaaatgatacagccagctatta

SEQ ID NO: 17856 - DNA, 26 bp, Artificial sequence
  SiRNA target sequence
ataaaaatgatacagccagctattaa

SEQ ID NO: 17857 - DNA, 26 bp, Artificial sequence
  SiRNA target sequence
taaaaatgatacagccagctattaaa

SEQ ID NO: 17858 - DNA, 26 bp, Artificial sequence
  SiRNA target sequence
aaaaatgatacagccagctattaaag

SEQ ID NO: 17859 - DNA, 26 bp, Artificial sequence
  SiRNA target sequence
aaaatgatacagccagctattaaagg

SEQ ID NO: 17860 - DNA, 26 bp, Artificial sequence
  SiRNA target sequence
aaatgatacagccagctattaaaggt

SEQ ID NO: 17861 - DNA, 26 bp, Artificial sequence
  SiRNA target sequence
aatgatacagccagctattaaaggtg

SEQ ID NO: 17862 - DNA, 26 bp, Artificial sequence
  SiRNA target sequence
atgatacagccagctattaaaggtgc

SEQ ID NO: 17863 - DNA, 26 bp, Artificial sequence
  SiRNA target sequence
tgatacagccagctattaaaggtgct

SEQ ID NO: 17864 - DNA, 26 bp, Artificial sequence
  SiRNA target sequence
gatacagccagctattaaaggtgctt

SEQ ID NO: 17865 - DNA, 26 bp, Artificial sequence
  SiRNA target sequence
atacagccagctattaaaggtgcttc

SEQ ID NO: 17866 - DNA, 26 bp, Artificial sequence
  SiRNA target sequence
tacagccagctattaaaggtgcttca

SEQ ID NO: 17867 - DNA, 26 bp, Artificial sequence
  SiRNA target sequence
acagccagctattaaaggtgcttcat

SEQ ID NO: 17868 - DNA, 26 bp, Artificial sequence
  SiRNA target sequence
cagccagctattaaaggtgcttcatg

SEQ ID NO: 17869 - DNA, 26 bp, Artificial sequence
  SiRNA target sequence
agccagctattaaaggtgcttcatgt

SEQ ID NO: 17870 - DNA, 26 bp, Artificial sequence
  SiRNA target sequence
gccagctattaaaggtgcttcatgta

SEQ ID NO: 17871 - DNA, 26 bp, Artificial sequence
  SiRNA target sequence
ccagctattaaaggtgcttcatgtat

SEQ ID NO: 17872 - DNA, 26 bp, Artificial sequence
  SiRNA target sequence
cagctattaaaggtgcttcatgtata

SEQ ID NO: 17873 - DNA, 26 bp, Artificial sequence
  SiRNA target sequence
agctattaaaggtgcttcatgtatat

SEQ ID NO: 17874 - DNA, 26 bp, Artificial sequence
  SiRNA target sequence
gctattaaaggtgcttcatgtatata

SEQ ID NO: 17875 - DNA, 26 bp, Artificial sequence
  SiRNA target sequence
ctattaaaggtgcttcatgtatatac

SEQ ID NO: 17876 - DNA, 26 bp, Artificial sequence
  SiRNA target sequence
tattaaaggtgcttcatgtatatacg

SEQ ID NO: 17877 - DNA, 26 bp, Artificial sequence
  SiRNA target sequence
attaaaggtgcttcatgtatatacgt

SEQ ID NO: 17878 - DNA, 26 bp, Artificial sequence
  SiRNA target sequence
ttaaaggtgcttcatgtatatacgtg

SEQ ID NO: 17879 - DNA, 26 bp, Artificial sequence
  SiRNA target sequence
taaaggtgcttcatgtatatacgtgg

SEQ ID NO: 17880 - DNA, 26 bp, Artificial sequence
  SiRNA target sequence
aaaggtgcttcatgtatatacgtggg

SEQ ID NO: 17881 - DNA, 26 bp, Artificial sequence
  SiRNA target sequence
aaggtgcttcatgtatatacgtgggt

SEQ ID NO: 17882 - DNA, 26 bp, Artificial sequence
  SiRNA target sequence
aggtgcttcatgtatatacgtgggta

SEQ ID NO: 17883 - DNA, 26 bp, Artificial sequence
  SiRNA target sequence
ggtgcttcatgtatatacgtgggtaa

SEQ ID NO: 17884 - DNA, 26 bp, Artificial sequence
  SiRNA target sequence
gtgcttcatgtatatacgtgggtaat

SEQ ID NO: 17885 - DNA, 26 bp, Artificial sequence
  SiRNA target sequence
tgcttcatgtatatacgtgggtaatt

SEQ ID NO: 17886 - DNA, 26 bp, Artificial sequence
  SiRNA target sequence
gcttcatgtatatacgtgggtaatta

SEQ ID NO: 17887 - DNA, 26 bp, Artificial sequence
  SiRNA target sequence
cttcatgtatatacgtgggtaattat

SEQ ID NO: 17888 - DNA, 26 bp, Artificial sequence
  SiRNA target sequence
ttcatgtatatacgtgggtaattata

SEQ ID NO: 17889 - DNA, 26 bp, Artificial sequence
  SiRNA target sequence
tcatgtatatacgtgggtaattatat

SEQ ID NO: 17890 - DNA, 26 bp, Artificial sequence
  SiRNA target sequence
catgtatatacgtgggtaattatatg

SEQ ID NO: 17891 - DNA, 26 bp, Artificial sequence
  SiRNA target sequence
atgtatatacgtgggtaattatatgc

SEQ ID NO: 17892 - DNA, 26 bp, Artificial sequence
  SiRNA target sequence
tgtatatacgtgggtaattatatgca

SEQ ID NO: 17893 - DNA, 26 bp, Artificial sequence
  SiRNA target sequence
gtatatacgtgggtaattatatgcag

SEQ ID NO: 17894 - DNA, 26 bp, Artificial sequence
  SiRNA target sequence
tatatacgtgggtaattatatgcagc

SEQ ID NO: 17895 - DNA, 26 bp, Artificial sequence
  SiRNA target sequence
atatacgtgggtaattatatgcagca

SEQ ID NO: 17896 - DNA, 26 bp, Artificial sequence
  SiRNA target sequence
tatacgtgggtaattatatgcagcag

SEQ ID NO: 17897 - DNA, 26 bp, Artificial sequence
  SiRNA target sequence
atacgtgggtaattatatgcagcagc

SEQ ID NO: 17898 - DNA, 26 bp, Artificial sequence
  SiRNA target sequence
tacgtgggtaattatatgcagcagct

SEQ ID NO: 17899 - DNA, 26 bp, Artificial sequence
  SiRNA target sequence
acgtgggtaattatatgcagcagcta

SEQ ID NO: 17900 - DNA, 26 bp, Artificial sequence
  SiRNA target sequence
cgtgggtaattatatgcagcagctag

SEQ ID NO: 17901 - DNA, 26 bp, Artificial sequence
  SiRNA target sequence
gtgggtaattatatgcagcagctagg

SEQ ID NO: 17902 - DNA, 26 bp, Artificial sequence
  SiRNA target sequence
tgggtaattatatgcagcagctagga

SEQ ID NO: 17903 - DNA, 26 bp, Artificial sequence
  SiRNA target sequence
gggtaattatatgcagcagctaggag

SEQ ID NO: 17904 - DNA, 26 bp, Artificial sequence
  SiRNA target sequence
ggtaattatatgcagcagctaggagt

SEQ ID NO: 17905 - DNA, 26 bp, Artificial sequence
  SiRNA target sequence
gtaattatatgcagcagctaggagta

SEQ ID NO: 17906 - DNA, 26 bp, Artificial sequence
  SiRNA target sequence
taattatatgcagcagctaggagtaa

SEQ ID NO: 17907 - DNA, 26 bp, Artificial sequence
  SiRNA target sequence
aattatatgcagcagctaggagtaat

SEQ ID NO: 17908 - DNA, 26 bp, Artificial sequence
  SiRNA target sequence
attatatgcagcagctaggagtaatt

SEQ ID NO: 17909 - DNA, 26 bp, Artificial sequence
  SiRNA target sequence
ttatatgcagcagctaggagtaatta

SEQ ID NO: 17910 - DNA, 26 bp, Artificial sequence
  SiRNA target sequence
tatatgcagcagctaggagtaattag

SEQ ID NO: 17911 - DNA, 26 bp, Artificial sequence
  SiRNA target sequence
atatgcagcagctaggagtaattagt

SEQ ID NO: 17912 - DNA, 26 bp, Artificial sequence
  SiRNA target sequence
tatgcagcagctaggagtaattagtc

SEQ ID NO: 17913 - DNA, 26 bp, Artificial sequence
  SiRNA target sequence
atgcagcagctaggagtaattagtct

SEQ ID NO: 17914 - DNA, 26 bp, Artificial sequence
  SiRNA target sequence
tgcagcagctaggagtaattagtctt

SEQ ID NO: 17915 - DNA, 26 bp, Artificial sequence
  SiRNA target sequence
gcagcagctaggagtaattagtcttg

SEQ ID NO: 17916 - DNA, 26 bp, Artificial sequence
  SiRNA target sequence
cagcagctaggagtaattagtcttgg

SEQ ID NO: 17917 - DNA, 26 bp, Artificial sequence
  SiRNA target sequence
agcagctaggagtaattagtcttggt

SEQ ID NO: 17918 - DNA, 26 bp, Artificial sequence
  SiRNA target sequence
gcagctaggagtaattagtcttggtg

SEQ ID NO: 17919 - DNA, 26 bp, Artificial sequence
  SiRNA target sequence
cagctaggagtaattagtcttggtgg

SEQ ID NO: 17920 - DNA, 26 bp, Artificial sequence
  SiRNA target sequence
agctaggagtaattagtcttggtggg

SEQ ID NO: 17921 - DNA, 26 bp, Artificial sequence
  SiRNA target sequence
gctaggagtaattagtcttggtgggg

SEQ ID NO: 17922 - DNA, 26 bp, Artificial sequence
  SiRNA target sequence
ctaggagtaattagtcttggtgggga

SEQ ID NO: 17923 - DNA, 26 bp, Artificial sequence
  SiRNA target sequence
taggagtaattagtcttggtggggag

SEQ ID NO: 17924 - DNA, 26 bp, Artificial sequence
  SiRNA target sequence
aggagtaattagtcttggtggggaga

SEQ ID NO: 17925 - DNA, 26 bp, Artificial sequence
  SiRNA target sequence
ggagtaattagtcttggtggggagat

SEQ ID NO: 17926 - DNA, 26 bp, Artificial sequence
  SiRNA target sequence
gagtaattagtcttggtggggagatt

SEQ ID NO: 17927 - DNA, 26 bp, Artificial sequence
  SiRNA target sequence
agtaattagtcttggtggggagatta

SEQ ID NO: 17928 - DNA, 26 bp, Artificial sequence
  SiRNA target sequence
gtaattagtcttggtggggagattat

SEQ ID NO: 17929 - DNA, 26 bp, Artificial sequence
  SiRNA target sequence
taattagtcttggtggggagattatt

SEQ ID NO: 17930 - DNA, 26 bp, Artificial sequence
  SiRNA target sequence
aattagtcttggtggggagattatta

SEQ ID NO: 17931 - DNA, 26 bp, Artificial sequence
  SiRNA target sequence
attagtcttggtggggagattattaa

SEQ ID NO: 17932 - DNA, 26 bp, Artificial sequence
  SiRNA target sequence
ttagtcttggtggggagattattaaa

SEQ ID NO: 17933 - DNA, 26 bp, Artificial sequence
  SiRNA target sequence
tagtcttggtggggagattattaaag

SEQ ID NO: 17934 - DNA, 26 bp, Artificial sequence
  SiRNA target sequence
agtcttggtggggagattattaaagc

SEQ ID NO: 17935 - DNA, 26 bp, Artificial sequence
  SiRNA target sequence
gtcttggtggggagattattaaagct

SEQ ID NO: 17936 - DNA, 26 bp, Artificial sequence
  SiRNA target sequence
tcttggtggggagattattaaagctg

SEQ ID NO: 17937 - DNA, 26 bp, Artificial sequence
  SiRNA target sequence
cttggtggggagattattaaagctga

SEQ ID NO: 17938 - DNA, 26 bp, Artificial sequence
  SiRNA target sequence
ttggtggggagattattaaagctgat

SEQ ID NO: 17939 - DNA, 26 bp, Artificial sequence
  SiRNA target sequence
tggtggggagattattaaagctgatg

SEQ ID NO: 17940 - DNA, 26 bp, Artificial sequence
  SiRNA target sequence
ggtggggagattattaaagctgatga

SEQ ID NO: 17941 - DNA, 26 bp, Artificial sequence
  SiRNA target sequence
gtggggagattattaaagctgatgaa

SEQ ID NO: 17942 - DNA, 26 bp, Artificial sequence
  SiRNA target sequence
tggggagattattaaagctgatgaat

SEQ ID NO: 17943 - DNA, 26 bp, Artificial sequence
  SiRNA target sequence
ggggagattattaaagctgatgaata

SEQ ID NO: 17944 - DNA, 26 bp, Artificial sequence
  SiRNA target sequence
gggagattattaaagctgatgaatac

SEQ ID NO: 17945 - DNA, 26 bp, Artificial sequence
  SiRNA target sequence
ggagattattaaagctgatgaataca

SEQ ID NO: 17946 - DNA, 26 bp, Artificial sequence
  SiRNA target sequence
gagattattaaagctgatgaatacat

SEQ ID NO: 17947 - DNA, 26 bp, Artificial sequence
  SiRNA target sequence
agattattaaagctgatgaatacatt

SEQ ID NO: 17948 - DNA, 26 bp, Artificial sequence
  SiRNA target sequence
gattattaaagctgatgaatacattg

SEQ ID NO: 17949 - DNA, 26 bp, Artificial sequence
  SiRNA target sequence
attattaaagctgatgaatacattgg

SEQ ID NO: 17950 - DNA, 26 bp, Artificial sequence
  SiRNA target sequence
ttattaaagctgatgaatacattgga

SEQ ID NO: 17951 - DNA, 26 bp, Artificial sequence
  SiRNA target sequence
tattaaagctgatgaatacattggac

SEQ ID NO: 17952 - DNA, 26 bp, Artificial sequence
  SiRNA target sequence
attaaagctgatgaatacattggact

SEQ ID NO: 17953 - DNA, 26 bp, Artificial sequence
  SiRNA target sequence
ttaaagctgatgaatacattggacta

SEQ ID NO: 17954 - DNA, 26 bp, Artificial sequence
  SiRNA target sequence
taaagctgatgaatacattggactat

SEQ ID NO: 17955 - DNA, 26 bp, Artificial sequence
  SiRNA target sequence
aaagctgatgaatacattggactatc

SEQ ID NO: 17956 - DNA, 26 bp, Artificial sequence
  SiRNA target sequence
aagctgatgaatacattggactatct

SEQ ID NO: 17957 - DNA, 26 bp, Artificial sequence
  SiRNA target sequence
agctgatgaatacattggactatctt

SEQ ID NO: 17958 - DNA, 26 bp, Artificial sequence
  SiRNA target sequence
gctgatgaatacattggactatcttt

SEQ ID NO: 17959 - DNA, 26 bp, Artificial sequence
  SiRNA target sequence
ctgatgaatacattggactatctttt

SEQ ID NO: 17960 - DNA, 26 bp, Artificial sequence
  SiRNA target sequence
tgatgaatacattggactatcttttg

SEQ ID NO: 17961 - DNA, 26 bp, Artificial sequence
  SiRNA target sequence
gatgaatacattggactatcttttgt

SEQ ID NO: 17962 - DNA, 26 bp, Artificial sequence
  SiRNA target sequence
atgaatacattggactatcttttgta

SEQ ID NO: 17963 - DNA, 26 bp, Artificial sequence
  SiRNA target sequence
tgaatacattggactatcttttgtag

SEQ ID NO: 17964 - DNA, 26 bp, Artificial sequence
  SiRNA target sequence
gaatacattggactatcttttgtagg

SEQ ID NO: 17965 - DNA, 26 bp, Artificial sequence
  SiRNA target sequence
aatacattggactatcttttgtaggg

SEQ ID NO: 17966 - DNA, 26 bp, Artificial sequence
  SiRNA target sequence
atacattggactatcttttgtaggga

SEQ ID NO: 17967 - DNA, 26 bp, Artificial sequence
  SiRNA target sequence
tacattggactatcttttgtagggag

SEQ ID NO: 17968 - DNA, 26 bp, Artificial sequence
  SiRNA target sequence
acattggactatcttttgtagggaga

SEQ ID NO: 17969 - DNA, 26 bp, Artificial sequence
  SiRNA target sequence
cattggactatcttttgtagggagat

SEQ ID NO: 17970 - DNA, 26 bp, Artificial sequence
  SiRNA target sequence
attggactatcttttgtagggagata

SEQ ID NO: 17971 - DNA, 26 bp, Artificial sequence
  SiRNA target sequence
ttggactatcttttgtagggagatat

SEQ ID NO: 17972 - DNA, 26 bp, Artificial sequence
  SiRNA target sequence
tggactatcttttgtagggagatatg

SEQ ID NO: 17973 - DNA, 26 bp, Artificial sequence
  SiRNA target sequence
ggactatcttttgtagggagatatga

SEQ ID NO: 17974 - DNA, 26 bp, Artificial sequence
  SiRNA target sequence
gactatcttttgtagggagatatgaa

SEQ ID NO: 17975 - DNA, 26 bp, Artificial sequence
  SiRNA target sequence
actatcttttgtagggagatatgaag

SEQ ID NO: 17976 - DNA, 26 bp, Artificial sequence
  SiRNA target sequence
ctatcttttgtagggagatatgaagg

SEQ ID NO: 17977 - DNA, 26 bp, Artificial sequence
  SiRNA target sequence
tatcttttgtagggagatatgaaggg

SEQ ID NO: 17978 - DNA, 26 bp, Artificial sequence
  SiRNA target sequence
atcttttgtagggagatatgaaggga

SEQ ID NO: 17979 - DNA, 26 bp, Artificial sequence
  SiRNA target sequence
tcttttgtagggagatatgaagggat

SEQ ID NO: 17980 - DNA, 26 bp, Artificial sequence
  SiRNA target sequence
cttttgtagggagatatgaagggatt

SEQ ID NO: 17981 - DNA, 26 bp, Artificial sequence
  SiRNA target sequence
ttttgtagggagatatgaagggattg

SEQ ID NO: 17982 - DNA, 26 bp, Artificial sequence
  SiRNA target sequence
tttgtagggagatatgaagggattgg

SEQ ID NO: 17983 - DNA, 26 bp, Artificial sequence
  SiRNA target sequence
ttgtagggagatatgaagggattggt

SEQ ID NO: 17984 - DNA, 26 bp, Artificial sequence
  SiRNA target sequence
tgtagggagatatgaagggattggtt

SEQ ID NO: 17985 - DNA, 26 bp, Artificial sequence
  SiRNA target sequence
gtagggagatatgaagggattggttc

SEQ ID NO: 17986 - DNA, 26 bp, Artificial sequence
  SiRNA target sequence
tagggagatatgaagggattggttct

SEQ ID NO: 17987 - DNA, 26 bp, Artificial sequence
  SiRNA target sequence
agggagatatgaagggattggttcta

SEQ ID NO: 17988 - DNA, 26 bp, Artificial sequence
  SiRNA target sequence
gggagatatgaagggattggttctat

SEQ ID NO: 17989 - DNA, 26 bp, Artificial sequence
  SiRNA target sequence
ggagatatgaagggattggttctatt

SEQ ID NO: 17990 - DNA, 26 bp, Artificial sequence
  SiRNA target sequence
gagatatgaagggattggttctattt

SEQ ID NO: 17991 - DNA, 26 bp, Artificial sequence
  SiRNA target sequence
agatatgaagggattggttctatttc

SEQ ID NO: 17992 - DNA, 26 bp, Artificial sequence
  SiRNA target sequence
gatatgaagggattggttctatttct

SEQ ID NO: 17993 - DNA, 26 bp, Artificial sequence
  SiRNA target sequence
atatgaagggattggttctatttcta

SEQ ID NO: 17994 - DNA, 26 bp, Artificial sequence
  SiRNA target sequence
tatgaagggattggttctatttctac

SEQ ID NO: 17995 - DNA, 26 bp, Artificial sequence
  SiRNA target sequence
atgaagggattggttctatttctact

SEQ ID NO: 17996 - DNA, 26 bp, Artificial sequence
  SiRNA target sequence
tgaagggattggttctatttctacta

SEQ ID NO: 17997 - DNA, 26 bp, Artificial sequence
  SiRNA target sequence
gaagggattggttctatttctactat

SEQ ID NO: 17998 - DNA, 26 bp, Artificial sequence
  SiRNA target sequence
aagggattggttctatttctactata

SEQ ID NO: 17999 - DNA, 26 bp, Artificial sequence
  SiRNA target sequence
agggattggttctatttctactatat

SEQ ID NO: 18000 - DNA, 26 bp, Artificial sequence
  SiRNA target sequence
gggattggttctatttctactatatc

SEQ ID NO: 18001 - DNA, 26 bp, Artificial sequence
  SiRNA target sequence
ggattggttctatttctactatatca

SEQ ID NO: 18002 - DNA, 26 bp, Artificial sequence
  SiRNA target sequence
gattggttctatttctactatatcac

SEQ ID NO: 18003 - DNA, 26 bp, Artificial sequence
  SiRNA target sequence
attggttctatttctactatatcact

SEQ ID NO: 18004 - DNA, 26 bp, Artificial sequence
  SiRNA target sequence
ttggttctatttctactatatcactt

SEQ ID NO: 18005 - DNA, 26 bp, Artificial sequence
  SiRNA target sequence
tggttctatttctactatatcacttc

SEQ ID NO: 18006 - DNA, 26 bp, Artificial sequence
  SiRNA target sequence
ggttctatttctactatatcacttca

SEQ ID NO: 18007 - DNA, 26 bp, Artificial sequence
  SiRNA target sequence
gttctatttctactatatcacttcag

SEQ ID NO: 18008 - DNA, 26 bp, Artificial sequence
  SiRNA target sequence
ttctatttctactatatcacttcagc

SEQ ID NO: 18009 - DNA, 26 bp, Artificial sequence
  SiRNA target sequence
tctatttctactatatcacttcagca

SEQ ID NO: 18010 - DNA, 26 bp, Artificial sequence
  SiRNA target sequence
ctatttctactatatcacttcagcag

SEQ ID NO: 18011 - DNA, 26 bp, Artificial sequence
  SiRNA target sequence
tatttctactatatcacttcagcagt

SEQ ID NO: 18012 - DNA, 26 bp, Artificial sequence
  SiRNA target sequence
atttctactatatcacttcagcagtt

SEQ ID NO: 18013 - DNA, 26 bp, Artificial sequence
  SiRNA target sequence
tttctactatatcacttcagcagttt

SEQ ID NO: 18014 - DNA, 26 bp, Artificial sequence
  SiRNA target sequence
ttctactatatcacttcagcagttta

SEQ ID NO: 18015 - DNA, 26 bp, Artificial sequence
  SiRNA target sequence
tctactatatcacttcagcagtttaa

SEQ ID NO: 18016 - DNA, 26 bp, Artificial sequence
  SiRNA target sequence
ctactatatcacttcagcagtttaat

SEQ ID NO: 18017 - DNA, 26 bp, Artificial sequence
  SiRNA target sequence
tactatatcacttcagcagtttaata

SEQ ID NO: 18018 - DNA, 26 bp, Artificial sequence
  SiRNA target sequence
actatatcacttcagcagtttaatac

SEQ ID NO: 18019 - DNA, 26 bp, Artificial sequence
  SiRNA target sequence
ctatatcacttcagcagtttaataca

SEQ ID NO: 18020 - DNA, 26 bp, Artificial sequence
  SiRNA target sequence
tatatcacttcagcagtttaatacac

SEQ ID NO: 18021 - DNA, 26 bp, Artificial sequence
  SiRNA target sequence
atatcacttcagcagtttaatacact

SEQ ID NO: 18022 - DNA, 26 bp, Artificial sequence
  SiRNA target sequence
tatcacttcagcagtttaatacactg

SEQ ID NO: 18023 - DNA, 26 bp, Artificial sequence
  SiRNA target sequence
atcacttcagcagtttaatacactgt

SEQ ID NO: 18024 - DNA, 26 bp, Artificial sequence
  SiRNA target sequence
tcacttcagcagtttaatacactgtc

SEQ ID NO: 18025 - DNA, 26 bp, Artificial sequence
  SiRNA target sequence
cacttcagcagtttaatacactgtct

SEQ ID NO: 18026 - DNA, 26 bp, Artificial sequence
  SiRNA target sequence
acttcagcagtttaatacactgtcta

SEQ ID NO: 18027 - DNA, 26 bp, Artificial sequence
  SiRNA target sequence
cttcagcagtttaatacactgtctat

SEQ ID NO: 18028 - DNA, 26 bp, Artificial sequence
  SiRNA target sequence
ttcagcagtttaatacactgtctata

SEQ ID NO: 18029 - DNA, 26 bp, Artificial sequence
  SiRNA target sequence
tcagcagtttaatacactgtctatag

SEQ ID NO: 18030 - DNA, 26 bp, Artificial sequence
  SiRNA target sequence
cagcagtttaatacactgtctataga

SEQ ID NO: 18031 - DNA, 26 bp, Artificial sequence
  SiRNA target sequence
agcagtttaatacactgtctatagat

SEQ ID NO: 18032 - DNA, 26 bp, Artificial sequence
  SiRNA target sequence
gcagtttaatacactgtctatagatt

SEQ ID NO: 18033 - DNA, 26 bp, Artificial sequence
  SiRNA target sequence
cagtttaatacactgtctatagatta

SEQ ID NO: 18034 - DNA, 26 bp, Artificial sequence
  SiRNA target sequence
agtttaatacactgtctatagattat

SEQ ID NO: 18035 - DNA, 26 bp, Artificial sequence
  SiRNA target sequence
gtttaatacactgtctatagattatt

SEQ ID NO: 18036 - DNA, 26 bp, Artificial sequence
  SiRNA target sequence
tttaatacactgtctatagattatta

SEQ ID NO: 18037 - DNA, 26 bp, Artificial sequence
  SiRNA target sequence
ttaatacactgtctatagattattac

SEQ ID NO: 18038 - DNA, 26 bp, Artificial sequence
  SiRNA target sequence
taatacactgtctatagattattaca

SEQ ID NO: 18039 - DNA, 26 bp, Artificial sequence
  SiRNA target sequence
aatacactgtctatagattattacaa

SEQ ID NO: 18040 - DNA, 26 bp, Artificial sequence
  SiRNA target sequence
atacactgtctatagattattacaag

SEQ ID NO: 18041 - DNA, 26 bp, Artificial sequence
  SiRNA target sequence
tacactgtctatagattattacaaga

SEQ ID NO: 18042 - DNA, 26 bp, Artificial sequence
  SiRNA target sequence
acactgtctatagattattacaagac

SEQ ID NO: 18043 - DNA, 26 bp, Artificial sequence
  SiRNA target sequence
cactgtctatagattattacaagaca

SEQ ID NO: 18044 - DNA, 26 bp, Artificial sequence
  SiRNA target sequence
actgtctatagattattacaagacat

SEQ ID NO: 18045 - DNA, 26 bp, Artificial sequence
  SiRNA target sequence
ctgtctatagattattacaagacatt

SEQ ID NO: 18046 - DNA, 26 bp, Artificial sequence
  SiRNA target sequence
tgtctatagattattacaagacattg

SEQ ID NO: 18047 - DNA, 26 bp, Artificial sequence
  SiRNA target sequence
gtctatagattattacaagacattgt

SEQ ID NO: 18048 - DNA, 26 bp, Artificial sequence
  SiRNA target sequence
tctatagattattacaagacattgtc

SEQ ID NO: 18049 - DNA, 26 bp, Artificial sequence
  SiRNA target sequence
ctatagattattacaagacattgtct

SEQ ID NO: 18050 - DNA, 26 bp, Artificial sequence
  SiRNA target sequence
tatagattattacaagacattgtctt

SEQ ID NO: 18051 - DNA, 26 bp, Artificial sequence
  SiRNA target sequence
atagattattacaagacattgtcttc

SEQ ID NO: 18052 - DNA, 26 bp, Artificial sequence
  SiRNA target sequence
tagattattacaagacattgtcttct

SEQ ID NO: 18053 - DNA, 26 bp, Artificial sequence
  SiRNA target sequence
agattattacaagacattgtcttcta

SEQ ID NO: 18054 - DNA, 26 bp, Artificial sequence
  SiRNA target sequence
gattattacaagacattgtcttctat

SEQ ID NO: 18055 - DNA, 26 bp, Artificial sequence
  SiRNA target sequence
attattacaagacattgtcttctatt

SEQ ID NO: 18056 - DNA, 26 bp, Artificial sequence
  SiRNA target sequence
ttattacaagacattgtcttctattt

SEQ ID NO: 18057 - DNA, 26 bp, Artificial sequence
  SiRNA target sequence
tattacaagacattgtcttctatttg

SEQ ID NO: 18058 - DNA, 26 bp, Artificial sequence
  SiRNA target sequence
attacaagacattgtcttctatttgt

SEQ ID NO: 18059 - DNA, 26 bp, Artificial sequence
  SiRNA target sequence
ttacaagacattgtcttctatttgtg

SEQ ID NO: 18060 - DNA, 26 bp, Artificial sequence
  SiRNA target sequence
tacaagacattgtcttctatttgtga

SEQ ID NO: 18061 - DNA, 26 bp, Artificial sequence
  SiRNA target sequence
acaagacattgtcttctatttgtgac

SEQ ID NO: 18062 - DNA, 26 bp, Artificial sequence
  SiRNA target sequence
caagacattgtcttctatttgtgacg

SEQ ID NO: 18063 - DNA, 26 bp, Artificial sequence
  SiRNA target sequence
aagacattgtcttctatttgtgacgt

SEQ ID NO: 18064 - DNA, 26 bp, Artificial sequence
  SiRNA target sequence
agacattgtcttctatttgtgacgta

SEQ ID NO: 18065 - DNA, 26 bp, Artificial sequence
  SiRNA target sequence
gacattgtcttctatttgtgacgtag

SEQ ID NO: 18066 - DNA, 26 bp, Artificial sequence
  SiRNA target sequence
acattgtcttctatttgtgacgtagg

SEQ ID NO: 18067 - DNA, 26 bp, Artificial sequence
  SiRNA target sequence
cattgtcttctatttgtgacgtaggt

SEQ ID NO: 18068 - DNA, 26 bp, Artificial sequence
  SiRNA target sequence
attgtcttctatttgtgacgtaggta

SEQ ID NO: 18069 - DNA, 26 bp, Artificial sequence
  SiRNA target sequence
ttgtcttctatttgtgacgtaggtat

SEQ ID NO: 18070 - DNA, 26 bp, Artificial sequence
  SiRNA target sequence
tgtcttctatttgtgacgtaggtatt

SEQ ID NO: 18071 - DNA, 26 bp, Artificial sequence
  SiRNA target sequence
gtcttctatttgtgacgtaggtatta

SEQ ID NO: 18072 - DNA, 26 bp, Artificial sequence
  SiRNA target sequence
tcttctatttgtgacgtaggtattaa

SEQ ID NO: 18073 - DNA, 26 bp, Artificial sequence
  SiRNA target sequence
cttctatttgtgacgtaggtattaaa

SEQ ID NO: 18074 - DNA, 26 bp, Artificial sequence
  SiRNA target sequence
ttctatttgtgacgtaggtattaaaa

SEQ ID NO: 18075 - DNA, 26 bp, Artificial sequence
  SiRNA target sequence
tctatttgtgacgtaggtattaaaat

SEQ ID NO: 18076 - DNA, 26 bp, Artificial sequence
  SiRNA target sequence
ctatttgtgacgtaggtattaaaata

SEQ ID NO: 18077 - DNA, 26 bp, Artificial sequence
  SiRNA target sequence
tatttgtgacgtaggtattaaaatat

SEQ ID NO: 18078 - DNA, 26 bp, Artificial sequence
  SiRNA target sequence
atttgtgacgtaggtattaaaatatc

SEQ ID NO: 18079 - DNA, 26 bp, Artificial sequence
  SiRNA target sequence
tttgtgacgtaggtattaaaatatca

SEQ ID NO: 18080 - DNA, 26 bp, Artificial sequence
  SiRNA target sequence
ttgtgacgtaggtattaaaatatcaa

SEQ ID NO: 18081 - DNA, 26 bp, Artificial sequence
  SiRNA target sequence
tgtgacgtaggtattaaaatatcaac

SEQ ID NO: 18082 - DNA, 26 bp, Artificial sequence
  SiRNA target sequence
gtgacgtaggtattaaaatatcaact

SEQ ID NO: 18083 - DNA, 26 bp, Artificial sequence
  SiRNA target sequence
tgacgtaggtattaaaatatcaactg

SEQ ID NO: 18084 - DNA, 26 bp, Artificial sequence
  SiRNA target sequence
gacgtaggtattaaaatatcaactga

SEQ ID NO: 18085 - DNA, 26 bp, Artificial sequence
  SiRNA target sequence
acgtaggtattaaaatatcaactgat

SEQ ID NO: 18086 - DNA, 26 bp, Artificial sequence
  SiRNA target sequence
cgtaggtattaaaatatcaactgata

SEQ ID NO: 18087 - DNA, 26 bp, Artificial sequence
  SiRNA target sequence
gtaggtattaaaatatcaactgatag

SEQ ID NO: 18088 - DNA, 26 bp, Artificial sequence
  SiRNA target sequence
taggtattaaaatatcaactgatagg

SEQ ID NO: 18089 - DNA, 26 bp, Artificial sequence
  SiRNA target sequence
aggtattaaaatatcaactgataggg

SEQ ID NO: 18090 - DNA, 26 bp, Artificial sequence
  SiRNA target sequence
ggtattaaaatatcaactgataggga

SEQ ID NO: 18091 - DNA, 26 bp, Artificial sequence
  SiRNA target sequence
gtattaaaatatcaactgatagggaa

SEQ ID NO: 18092 - DNA, 26 bp, Artificial sequence
  SiRNA target sequence
tattaaaatatcaactgatagggaaa

SEQ ID NO: 18093 - DNA, 26 bp, Artificial sequence
  SiRNA target sequence
attaaaatatcaactgatagggaaaa

SEQ ID NO: 18094 - DNA, 26 bp, Artificial sequence
  SiRNA target sequence
ttaaaatatcaactgatagggaaaaa

SEQ ID NO: 18095 - DNA, 26 bp, Artificial sequence
  SiRNA target sequence
taaaatatcaactgatagggaaaaat

SEQ ID NO: 18096 - DNA, 26 bp, Artificial sequence
  SiRNA target sequence
aaaatatcaactgatagggaaaaatc

SEQ ID NO: 18097 - DNA, 26 bp, Artificial sequence
  SiRNA target sequence
aaatatcaactgatagggaaaaatca

SEQ ID NO: 18098 - DNA, 26 bp, Artificial sequence
  SiRNA target sequence
aatatcaactgatagggaaaaatcag

SEQ ID NO: 18099 - DNA, 26 bp, Artificial sequence
  SiRNA target sequence
atatcaactgatagggaaaaatcagt

SEQ ID NO: 18100 - DNA, 26 bp, Artificial sequence
  SiRNA target sequence
tatcaactgatagggaaaaatcagtt

SEQ ID NO: 18101 - DNA, 26 bp, Artificial sequence
  SiRNA target sequence
atcaactgatagggaaaaatcagtta

SEQ ID NO: 18102 - DNA, 26 bp, Artificial sequence
  SiRNA target sequence
tcaactgatagggaaaaatcagttaa

SEQ ID NO: 18103 - DNA, 26 bp, Artificial sequence
  SiRNA target sequence
caactgatagggaaaaatcagttaat

SEQ ID NO: 18104 - DNA, 26 bp, Artificial sequence
  SiRNA target sequence
aactgatagggaaaaatcagttaatt

SEQ ID NO: 18105 - DNA, 26 bp, Artificial sequence
  SiRNA target sequence
actgatagggaaaaatcagttaatta

SEQ ID NO: 18106 - DNA, 26 bp, Artificial sequence
  SiRNA target sequence
ctgatagggaaaaatcagttaattat

SEQ ID NO: 18107 - DNA, 26 bp, Artificial sequence
  SiRNA target sequence
tgatagggaaaaatcagttaattatg

SEQ ID NO: 18108 - DNA, 26 bp, Artificial sequence
  SiRNA target sequence
gatagggaaaaatcagttaattatgg

SEQ ID NO: 18109 - DNA, 26 bp, Artificial sequence
  SiRNA target sequence
atagggaaaaatcagttaattatgga

SEQ ID NO: 18110 - DNA, 26 bp, Artificial sequence
  SiRNA target sequence
tagggaaaaatcagttaattatggat

SEQ ID NO: 18111 - DNA, 26 bp, Artificial sequence
  SiRNA target sequence
agggaaaaatcagttaattatggatt

SEQ ID NO: 18112 - DNA, 26 bp, Artificial sequence
  SiRNA target sequence
gggaaaaatcagttaattatggatta

SEQ ID NO: 18113 - DNA, 26 bp, Artificial sequence
  SiRNA target sequence
ggaaaaatcagttaattatggattag

SEQ ID NO: 18114 - DNA, 26 bp, Artificial sequence
  SiRNA target sequence
gaaaaatcagttaattatggattagg

SEQ ID NO: 18115 - DNA, 26 bp, Artificial sequence
  SiRNA target sequence
aaaaatcagttaattatggattagga

SEQ ID NO: 18116 - DNA, 26 bp, Artificial sequence
  SiRNA target sequence
aaaatcagttaattatggattaggag

SEQ ID NO: 18117 - DNA, 26 bp, Artificial sequence
  SiRNA target sequence
aaatcagttaattatggattaggagt

SEQ ID NO: 18118 - DNA, 26 bp, Artificial sequence
  SiRNA target sequence
aatcagttaattatggattaggagtt

SEQ ID NO: 18119 - DNA, 26 bp, Artificial sequence
  SiRNA target sequence
atcagttaattatggattaggagtta

SEQ ID NO: 18120 - DNA, 26 bp, Artificial sequence
  SiRNA target sequence
tcagttaattatggattaggagttaa

SEQ ID NO: 18121 - DNA, 26 bp, Artificial sequence
  SiRNA target sequence
cagttaattatggattaggagttaaa

SEQ ID NO: 18122 - DNA, 26 bp, Artificial sequence
  SiRNA target sequence
agttaattatggattaggagttaaac

SEQ ID NO: 18123 - DNA, 26 bp, Artificial sequence
  SiRNA target sequence
gttaattatggattaggagttaaact

SEQ ID NO: 18124 - DNA, 26 bp, Artificial sequence
  SiRNA target sequence
ttaattatggattaggagttaaacta

SEQ ID NO: 18125 - DNA, 26 bp, Artificial sequence
  SiRNA target sequence
taattatggattaggagttaaactac

SEQ ID NO: 18126 - DNA, 26 bp, Artificial sequence
  SiRNA target sequence
aattatggattaggagttaaactaca

SEQ ID NO: 18127 - DNA, 26 bp, Artificial sequence
  SiRNA target sequence
attatggattaggagttaaactacac

SEQ ID NO: 18128 - DNA, 26 bp, Artificial sequence
  SiRNA target sequence
ttatggattaggagttaaactacaca

SEQ ID NO: 18129 - DNA, 26 bp, Artificial sequence
  SiRNA target sequence
tatggattaggagttaaactacacag

SEQ ID NO: 18130 - DNA, 26 bp, Artificial sequence
  SiRNA target sequence
atggattaggagttaaactacacagt

SEQ ID NO: 18131 - DNA, 26 bp, Artificial sequence
  SiRNA target sequence
tggattaggagttaaactacacagta

SEQ ID NO: 18132 - DNA, 26 bp, Artificial sequence
  SiRNA target sequence
ggattaggagttaaactacacagtaa

SEQ ID NO: 18133 - DNA, 26 bp, Artificial sequence
  SiRNA target sequence
gattaggagttaaactacacagtaaa

SEQ ID NO: 18134 - DNA, 26 bp, Artificial sequence
  SiRNA target sequence
attaggagttaaactacacagtaaaa

SEQ ID NO: 18135 - DNA, 26 bp, Artificial sequence
  SiRNA target sequence
ttaggagttaaactacacagtaaaaa

SEQ ID NO: 18136 - DNA, 26 bp, Artificial sequence
  SiRNA target sequence
taggagttaaactacacagtaaaaaa

SEQ ID NO: 18137 - DNA, 26 bp, Artificial sequence
  SiRNA target sequence
aggagttaaactacacagtaaaaaag

SEQ ID NO: 18138 - DNA, 26 bp, Artificial sequence
  SiRNA target sequence
ggagttaaactacacagtaaaaaagg

SEQ ID NO: 18139 - DNA, 26 bp, Artificial sequence
  SiRNA target sequence
gagttaaactacacagtaaaaaagga

SEQ ID NO: 18140 - DNA, 26 bp, Artificial sequence
  SiRNA target sequence
agttaaactacacagtaaaaaaggag

SEQ ID NO: 18141 - DNA, 26 bp, Artificial sequence
  SiRNA target sequence
gttaaactacacagtaaaaaaggaga

SEQ ID NO: 18142 - DNA, 26 bp, Artificial sequence
  SiRNA target sequence
ttaaactacacagtaaaaaaggagaa

SEQ ID NO: 18143 - DNA, 26 bp, Artificial sequence
  SiRNA target sequence
taaactacacagtaaaaaaggagaaa

SEQ ID NO: 18144 - DNA, 26 bp, Artificial sequence
  SiRNA target sequence
aaactacacagtaaaaaaggagaaat

SEQ ID NO: 18145 - DNA, 26 bp, Artificial sequence
  SiRNA target sequence
aactacacagtaaaaaaggagaaatt

SEQ ID NO: 18146 - DNA, 26 bp, Artificial sequence
  SiRNA target sequence
actacacagtaaaaaaggagaaatta

SEQ ID NO: 18147 - DNA, 26 bp, Artificial sequence
  SiRNA target sequence
ctacacagtaaaaaaggagaaattat

SEQ ID NO: 18148 - DNA, 26 bp, Artificial sequence
  SiRNA target sequence
tacacagtaaaaaaggagaaattatc

SEQ ID NO: 18149 - DNA, 26 bp, Artificial sequence
  SiRNA target sequence
acacagtaaaaaaggagaaattatcg

SEQ ID NO: 18150 - DNA, 26 bp, Artificial sequence
  SiRNA target sequence
cacagtaaaaaaggagaaattatcgg

SEQ ID NO: 18151 - DNA, 26 bp, Artificial sequence
  SiRNA target sequence
acagtaaaaaaggagaaattatcgga

SEQ ID NO: 18152 - DNA, 26 bp, Artificial sequence
  SiRNA target sequence
cagtaaaaaaggagaaattatcggat

SEQ ID NO: 18153 - DNA, 26 bp, Artificial sequence
  SiRNA target sequence
agtaaaaaaggagaaattatcggatg

SEQ ID NO: 18154 - DNA, 26 bp, Artificial sequence
  SiRNA target sequence
gtaaaaaaggagaaattatcggatgt

SEQ ID NO: 18155 - DNA, 26 bp, Artificial sequence
  SiRNA target sequence
taaaaaaggagaaattatcggatgtg

SEQ ID NO: 18156 - DNA, 26 bp, Artificial sequence
  SiRNA target sequence
aaaaaaggagaaattatcggatgtgt

SEQ ID NO: 18157 - DNA, 26 bp, Artificial sequence
  SiRNA target sequence
aaaaaggagaaattatcggatgtgta

SEQ ID NO: 18158 - DNA, 26 bp, Artificial sequence
  SiRNA target sequence
aaaaggagaaattatcggatgtgtag

SEQ ID NO: 18159 - DNA, 26 bp, Artificial sequence
  SiRNA target sequence
aaaggagaaattatcggatgtgtaga

SEQ ID NO: 18160 - DNA, 26 bp, Artificial sequence
  SiRNA target sequence
aaggagaaattatcggatgtgtagat

SEQ ID NO: 18161 - DNA, 26 bp, Artificial sequence
  SiRNA target sequence
aggagaaattatcggatgtgtagata

SEQ ID NO: 18162 - DNA, 26 bp, Artificial sequence
  SiRNA target sequence
ggagaaattatcggatgtgtagataa

SEQ ID NO: 18163 - DNA, 26 bp, Artificial sequence
  SiRNA target sequence
gagaaattatcggatgtgtagataac

SEQ ID NO: 18164 - DNA, 26 bp, Artificial sequence
  SiRNA target sequence
agaaattatcggatgtgtagataaca

SEQ ID NO: 18165 - DNA, 26 bp, Artificial sequence
  SiRNA target sequence
gaaattatcggatgtgtagataacaa

SEQ ID NO: 18166 - DNA, 26 bp, Artificial sequence
  SiRNA target sequence
aaattatcggatgtgtagataacaat

SEQ ID NO: 18167 - DNA, 26 bp, Artificial sequence
  SiRNA target sequence
aattatcggatgtgtagataacaatc

SEQ ID NO: 18168 - DNA, 26 bp, Artificial sequence
  SiRNA target sequence
attatcggatgtgtagataacaatca

SEQ ID NO: 18169 - DNA, 26 bp, Artificial sequence
  SiRNA target sequence
ttatcggatgtgtagataacaatcat

SEQ ID NO: 18170 - DNA, 26 bp, Artificial sequence
  SiRNA target sequence
tatcggatgtgtagataacaatcata

SEQ ID NO: 18171 - DNA, 26 bp, Artificial sequence
  SiRNA target sequence
atcggatgtgtagataacaatcatat

SEQ ID NO: 18172 - DNA, 26 bp, Artificial sequence
  SiRNA target sequence
tcggatgtgtagataacaatcatatt

SEQ ID NO: 18173 - DNA, 26 bp, Artificial sequence
  SiRNA target sequence
cggatgtgtagataacaatcatattt

SEQ ID NO: 18174 - DNA, 26 bp, Artificial sequence
  SiRNA target sequence
ggatgtgtagataacaatcatatttt

SEQ ID NO: 18175 - DNA, 26 bp, Artificial sequence
  SiRNA target sequence
gatgtgtagataacaatcatatttta

SEQ ID NO: 18176 - DNA, 26 bp, Artificial sequence
  SiRNA target sequence
atgtgtagataacaatcatattttaa

SEQ ID NO: 18177 - DNA, 26 bp, Artificial sequence
  SiRNA target sequence
tgtgtagataacaatcatattttaag

SEQ ID NO: 18178 - DNA, 26 bp, Artificial sequence
  SiRNA target sequence
gtgtagataacaatcatattttaagc

SEQ ID NO: 18179 - DNA, 26 bp, Artificial sequence
  SiRNA target sequence
tgtagataacaatcatattttaagca

SEQ ID NO: 18180 - DNA, 26 bp, Artificial sequence
  SiRNA target sequence
gtagataacaatcatattttaagcat

SEQ ID NO: 18181 - DNA, 26 bp, Artificial sequence
  SiRNA target sequence
tagataacaatcatattttaagcata

SEQ ID NO: 18182 - DNA, 26 bp, Artificial sequence
  SiRNA target sequence
agataacaatcatattttaagcataa

SEQ ID NO: 18183 - DNA, 26 bp, Artificial sequence
  SiRNA target sequence
gataacaatcatattttaagcataat

SEQ ID NO: 18184 - DNA, 26 bp, Artificial sequence
  SiRNA target sequence
ataacaatcatattttaagcataatt

SEQ ID NO: 18185 - DNA, 26 bp, Artificial sequence
  SiRNA target sequence
taacaatcatattttaagcataattt

SEQ ID NO: 18186 - DNA, 26 bp, Artificial sequence
  SiRNA target sequence
aacaatcatattttaagcataattta

SEQ ID NO: 18187 - DNA, 26 bp, Artificial sequence
  SiRNA target sequence
acaatcatattttaagcataatttat

SEQ ID NO: 18188 - DNA, 26 bp, Artificial sequence
  SiRNA target sequence
caatcatattttaagcataatttata

SEQ ID NO: 18189 - DNA, 26 bp, Artificial sequence
  SiRNA target sequence
aatcatattttaagcataatttataa

SEQ ID NO: 18190 - DNA, 26 bp, Artificial sequence
  SiRNA target sequence
atcatattttaagcataatttataat

SEQ ID NO: 18191 - DNA, 26 bp, Artificial sequence
  SiRNA target sequence
tcatattttaagcataatttataatg

SEQ ID NO: 18192 - DNA, 26 bp, Artificial sequence
  SiRNA target sequence
catattttaagcataatttataatga

SEQ ID NO: 18193 - DNA, 26 bp, Artificial sequence
  SiRNA target sequence
atattttaagcataatttataatgat

SEQ ID NO: 18194 - DNA, 26 bp, Artificial sequence
  SiRNA target sequence
tattttaagcataatttataatgata

SEQ ID NO: 18195 - DNA, 26 bp, Artificial sequence
  SiRNA target sequence
attttaagcataatttataatgataa

SEQ ID NO: 18196 - DNA, 26 bp, Artificial sequence
  SiRNA target sequence
ttttaagcataatttataatgataaa

SEQ ID NO: 18197 - DNA, 26 bp, Artificial sequence
  SiRNA target sequence
tttaagcataatttataatgataaat

SEQ ID NO: 18198 - DNA, 26 bp, Artificial sequence
  SiRNA target sequence
ttaagcataatttataatgataaatt

SEQ ID NO: 18199 - DNA, 26 bp, Artificial sequence
  SiRNA target sequence
taagcataatttataatgataaatta

SEQ ID NO: 18200 - DNA, 26 bp, Artificial sequence
  SiRNA target sequence
aagcataatttataatgataaattat

SEQ ID NO: 18201 - DNA, 26 bp, Artificial sequence
  SiRNA target sequence
agcataatttataatgataaattatc

SEQ ID NO: 18202 - DNA, 26 bp, Artificial sequence
  SiRNA target sequence
gcataatttataatgataaattatct

SEQ ID NO: 18203 - DNA, 26 bp, Artificial sequence
  SiRNA target sequence
cataatttataatgataaattatctg

SEQ ID NO: 18204 - DNA, 26 bp, Artificial sequence
  SiRNA target sequence
ataatttataatgataaattatctga

SEQ ID NO: 18205 - DNA, 26 bp, Artificial sequence
  SiRNA target sequence
taatttataatgataaattatctgaa

SEQ ID NO: 18206 - DNA, 26 bp, Artificial sequence
  SiRNA target sequence
aatttataatgataaattatctgaag

SEQ ID NO: 18207 - DNA, 26 bp, Artificial sequence
  SiRNA target sequence
atttataatgataaattatctgaagg

SEQ ID NO: 18208 - DNA, 26 bp, Artificial sequence
  SiRNA target sequence
tttataatgataaattatctgaaggg

SEQ ID NO: 18209 - DNA, 26 bp, Artificial sequence
  SiRNA target sequence
ttataatgataaattatctgaagggt

SEQ ID NO: 18210 - DNA, 26 bp, Artificial sequence
  SiRNA target sequence
tataatgataaattatctgaagggtt

SEQ ID NO: 18211 - DNA, 26 bp, Artificial sequence
  SiRNA target sequence
ataatgataaattatctgaagggtta

SEQ ID NO: 18212 - DNA, 26 bp, Artificial sequence
  SiRNA target sequence
taatgataaattatctgaagggttaa

SEQ ID NO: 18213 - DNA, 26 bp, Artificial sequence
  SiRNA target sequence
aatgataaattatctgaagggttaac

SEQ ID NO: 18214 - DNA, 26 bp, Artificial sequence
  SiRNA target sequence
atgataaattatctgaagggttaaca

SEQ ID NO: 18215 - DNA, 26 bp, Artificial sequence
  SiRNA target sequence
tgataaattatctgaagggttaacac

SEQ ID NO: 18216 - DNA, 26 bp, Artificial sequence
  SiRNA target sequence
gataaattatctgaagggttaacact

SEQ ID NO: 18217 - DNA, 26 bp, Artificial sequence
  SiRNA target sequence
ataaattatctgaagggttaacactt

SEQ ID NO: 18218 - DNA, 26 bp, Artificial sequence
  SiRNA target sequence
taaattatctgaagggttaacactta

SEQ ID NO: 18219 - DNA, 26 bp, Artificial sequence
  SiRNA target sequence
aaattatctgaagggttaacacttaa

SEQ ID NO: 18220 - DNA, 26 bp, Artificial sequence
  SiRNA target sequence
aattatctgaagggttaacacttaat

SEQ ID NO: 18221 - DNA, 26 bp, Artificial sequence
  SiRNA target sequence
attatctgaagggttaacacttaatt

SEQ ID NO: 18222 - DNA, 26 bp, Artificial sequence
  SiRNA target sequence
ttatctgaagggttaacacttaattt

SEQ ID NO: 18223 - DNA, 26 bp, Artificial sequence
  SiRNA target sequence
tatctgaagggttaacacttaatttg

SEQ ID NO: 18224 - DNA, 26 bp, Artificial sequence
  SiRNA target sequence
atctgaagggttaacacttaatttga

SEQ ID NO: 18225 - DNA, 26 bp, Artificial sequence
  SiRNA target sequence
tctgaagggttaacacttaatttgag

SEQ ID NO: 18226 - DNA, 26 bp, Artificial sequence
  SiRNA target sequence
ctgaagggttaacacttaatttgagt

SEQ ID NO: 18227 - DNA, 26 bp, Artificial sequence
  SiRNA target sequence
tgaagggttaacacttaatttgagtt

SEQ ID NO: 18228 - DNA, 26 bp, Artificial sequence
  SiRNA target sequence
gaagggttaacacttaatttgagttg

SEQ ID NO: 18229 - DNA, 26 bp, Artificial sequence
  SiRNA target sequence
aagggttaacacttaatttgagttgt

SEQ ID NO: 18230 - DNA, 26 bp, Artificial sequence
  SiRNA target sequence
agggttaacacttaatttgagttgta

SEQ ID NO: 18231 - DNA, 26 bp, Artificial sequence
  SiRNA target sequence
gggttaacacttaatttgagttgtag

SEQ ID NO: 18232 - DNA, 26 bp, Artificial sequence
  SiRNA target sequence
ggttaacacttaatttgagttgtaga

SEQ ID NO: 18233 - DNA, 26 bp, Artificial sequence
  SiRNA target sequence
gttaacacttaatttgagttgtagat

SEQ ID NO: 18234 - DNA, 26 bp, Artificial sequence
  SiRNA target sequence
ttaacacttaatttgagttgtagatt

SEQ ID NO: 18235 - DNA, 26 bp, Artificial sequence
  SiRNA target sequence
taacacttaatttgagttgtagattt

SEQ ID NO: 18236 - DNA, 26 bp, Artificial sequence
  SiRNA target sequence
aacacttaatttgagttgtagatttg

SEQ ID NO: 18237 - DNA, 26 bp, Artificial sequence
  SiRNA target sequence
acacttaatttgagttgtagatttgg

SEQ ID NO: 18238 - DNA, 26 bp, Artificial sequence
  SiRNA target sequence
cacttaatttgagttgtagatttggt

SEQ ID NO: 18239 - DNA, 26 bp, Artificial sequence
  SiRNA target sequence
acttaatttgagttgtagatttggta

SEQ ID NO: 18240 - DNA, 26 bp, Artificial sequence
  SiRNA target sequence
cttaatttgagttgtagatttggtaa

SEQ ID NO: 18241 - DNA, 26 bp, Artificial sequence
  SiRNA target sequence
ttaatttgagttgtagatttggtaag

SEQ ID NO: 18242 - DNA, 26 bp, Artificial sequence
  SiRNA target sequence
taatttgagttgtagatttggtaaga

SEQ ID NO: 18243 - DNA, 26 bp, Artificial sequence
  SiRNA target sequence
aatttgagttgtagatttggtaagaa

SEQ ID NO: 18244 - DNA, 26 bp, Artificial sequence
  SiRNA target sequence
atttgagttgtagatttggtaagaaa

SEQ ID NO: 18245 - DNA, 26 bp, Artificial sequence
  SiRNA target sequence
tttgagttgtagatttggtaagaaag

SEQ ID NO: 18246 - DNA, 26 bp, Artificial sequence
  SiRNA target sequence
ttgagttgtagatttggtaagaaagt

SEQ ID NO: 18247 - DNA, 26 bp, Artificial sequence
  SiRNA target sequence
tgagttgtagatttggtaagaaagta

SEQ ID NO: 18248 - DNA, 26 bp, Artificial sequence
  SiRNA target sequence
gagttgtagatttggtaagaaagtat

SEQ ID NO: 18249 - DNA, 26 bp, Artificial sequence
  SiRNA target sequence
agttgtagatttggtaagaaagtatt

SEQ ID NO: 18250 - DNA, 26 bp, Artificial sequence
  SiRNA target sequence
gttgtagatttggtaagaaagtattt

SEQ ID NO: 18251 - DNA, 26 bp, Artificial sequence
  SiRNA target sequence
ttgtagatttggtaagaaagtatttg

SEQ ID NO: 18252 - DNA, 26 bp, Artificial sequence
  SiRNA target sequence
tgtagatttggtaagaaagtatttga

SEQ ID NO: 18253 - DNA, 26 bp, Artificial sequence
  SiRNA target sequence
gtagatttggtaagaaagtatttgat

SEQ ID NO: 18254 - DNA, 26 bp, Artificial sequence
  SiRNA target sequence
tagatttggtaagaaagtatttgatt

SEQ ID NO: 18255 - DNA, 26 bp, Artificial sequence
  SiRNA target sequence
agatttggtaagaaagtatttgatta

SEQ ID NO: 18256 - DNA, 26 bp, Artificial sequence
  SiRNA target sequence
gatttggtaagaaagtatttgattat

SEQ ID NO: 18257 - DNA, 26 bp, Artificial sequence
  SiRNA target sequence
atttggtaagaaagtatttgattatg

SEQ ID NO: 18258 - DNA, 26 bp, Artificial sequence
  SiRNA target sequence
tttggtaagaaagtatttgattatgg

SEQ ID NO: 18259 - DNA, 26 bp, Artificial sequence
  SiRNA target sequence
ttggtaagaaagtatttgattatggc

SEQ ID NO: 18260 - DNA, 26 bp, Artificial sequence
  SiRNA target sequence
tggtaagaaagtatttgattatggct

SEQ ID NO: 18261 - DNA, 26 bp, Artificial sequence
  SiRNA target sequence
ggtaagaaagtatttgattatggcta

SEQ ID NO: 18262 - DNA, 26 bp, Artificial sequence
  SiRNA target sequence
gtaagaaagtatttgattatggctat

SEQ ID NO: 18263 - DNA, 26 bp, Artificial sequence
  SiRNA target sequence
taagaaagtatttgattatggctatg

SEQ ID NO: 18264 - DNA, 26 bp, Artificial sequence
  SiRNA target sequence
aagaaagtatttgattatggctatgg

SEQ ID NO: 18265 - DNA, 26 bp, Artificial sequence
  SiRNA target sequence
agaaagtatttgattatggctatggg

SEQ ID NO: 18266 - DNA, 26 bp, Artificial sequence
  SiRNA target sequence
gaaagtatttgattatggctatgggt

SEQ ID NO: 18267 - DNA, 26 bp, Artificial sequence
  SiRNA target sequence
aaagtatttgattatggctatgggtt

SEQ ID NO: 18268 - DNA, 26 bp, Artificial sequence
  SiRNA target sequence
aagtatttgattatggctatgggttt

SEQ ID NO: 18269 - DNA, 26 bp, Artificial sequence
  SiRNA target sequence
agtatttgattatggctatgggttta

SEQ ID NO: 18270 - DNA, 26 bp, Artificial sequence
  SiRNA target sequence
gtatttgattatggctatgggtttat

SEQ ID NO: 18271 - DNA, 26 bp, Artificial sequence
  SiRNA target sequence
tatttgattatggctatgggtttatt

SEQ ID NO: 18272 - DNA, 26 bp, Artificial sequence
  SiRNA target sequence
atttgattatggctatgggtttattt

SEQ ID NO: 18273 - DNA, 26 bp, Artificial sequence
  SiRNA target sequence
tttgattatggctatgggtttattta

SEQ ID NO: 18274 - DNA, 26 bp, Artificial sequence
  SiRNA target sequence
ttgattatggctatgggtttatttat

SEQ ID NO: 18275 - DNA, 26 bp, Artificial sequence
  SiRNA target sequence
tgattatggctatgggtttatttatg

SEQ ID NO: 18276 - DNA, 26 bp, Artificial sequence
  SiRNA target sequence
gattatggctatgggtttatttatga

SEQ ID NO: 18277 - DNA, 26 bp, Artificial sequence
  SiRNA target sequence
attatggctatgggtttatttatgaa

SEQ ID NO: 18278 - DNA, 26 bp, Artificial sequence
  SiRNA target sequence
ttatggctatgggtttatttatgaat

SEQ ID NO: 18279 - DNA, 26 bp, Artificial sequence
  SiRNA target sequence
tatggctatgggtttatttatgaatt

SEQ ID NO: 18280 - DNA, 26 bp, Artificial sequence
  SiRNA target sequence
atggctatgggtttatttatgaattt

SEQ ID NO: 18281 - DNA, 26 bp, Artificial sequence
  SiRNA target sequence
tggctatgggtttatttatgaatttt

SEQ ID NO: 18282 - DNA, 26 bp, Artificial sequence
  SiRNA target sequence
ggctatgggtttatttatgaatttta

SEQ ID NO: 18283 - DNA, 26 bp, Artificial sequence
  SiRNA target sequence
gctatgggtttatttatgaattttaa

SEQ ID NO: 18284 - DNA, 27 bp, Artificial sequence
  SiRNA target sequence
atgaaatctttctacaaaaaaataaaa

SEQ ID NO: 18285 - DNA, 27 bp, Artificial sequence
  SiRNA target sequence
tgaaatctttctacaaaaaaataaaaa

SEQ ID NO: 18286 - DNA, 27 bp, Artificial sequence
  SiRNA target sequence
gaaatctttctacaaaaaaataaaaag

SEQ ID NO: 18287 - DNA, 27 bp, Artificial sequence
  SiRNA target sequence
aaatctttctacaaaaaaataaaaagt

SEQ ID NO: 18288 - DNA, 27 bp, Artificial sequence
  SiRNA target sequence
aatctttctacaaaaaaataaaaagtt

SEQ ID NO: 18289 - DNA, 27 bp, Artificial sequence
  SiRNA target sequence
atctttctacaaaaaaataaaaagtta

SEQ ID NO: 18290 - DNA, 27 bp, Artificial sequence
  SiRNA target sequence
tctttctacaaaaaaataaaaagttat

SEQ ID NO: 18291 - DNA, 27 bp, Artificial sequence
  SiRNA target sequence
ctttctacaaaaaaataaaaagttatt

SEQ ID NO: 18292 - DNA, 27 bp, Artificial sequence
  SiRNA target sequence
tttctacaaaaaaataaaaagttattt

SEQ ID NO: 18293 - DNA, 27 bp, Artificial sequence
  SiRNA target sequence
ttctacaaaaaaataaaaagttattta

SEQ ID NO: 18294 - DNA, 27 bp, Artificial sequence
  SiRNA target sequence
tctacaaaaaaataaaaagttatttat

SEQ ID NO: 18295 - DNA, 27 bp, Artificial sequence
  SiRNA target sequence
ctacaaaaaaataaaaagttatttatt

SEQ ID NO: 18296 - DNA, 27 bp, Artificial sequence
  SiRNA target sequence
tacaaaaaaataaaaagttatttattc

SEQ ID NO: 18297 - DNA, 27 bp, Artificial sequence
  SiRNA target sequence
acaaaaaaataaaaagttatttattca

SEQ ID NO: 18298 - DNA, 27 bp, Artificial sequence
  SiRNA target sequence
caaaaaaataaaaagttatttattcaa

SEQ ID NO: 18299 - DNA, 27 bp, Artificial sequence
  SiRNA target sequence
aaaaaaataaaaagttatttattcaaa

SEQ ID NO: 18300 - DNA, 27 bp, Artificial sequence
  SiRNA target sequence
aaaaaataaaaagttatttattcaaat

SEQ ID NO: 18301 - DNA, 27 bp, Artificial sequence
  SiRNA target sequence
aaaaataaaaagttatttattcaaatc

SEQ ID NO: 18302 - DNA, 27 bp, Artificial sequence
  SiRNA target sequence
aaaataaaaagttatttattcaaatct

SEQ ID NO: 18303 - DNA, 27 bp, Artificial sequence
  SiRNA target sequence
aaataaaaagttatttattcaaatctg

SEQ ID NO: 18304 - DNA, 27 bp, Artificial sequence
  SiRNA target sequence
aataaaaagttatttattcaaatctgc

SEQ ID NO: 18305 - DNA, 27 bp, Artificial sequence
  SiRNA target sequence
ataaaaagttatttattcaaatctgcc

SEQ ID NO: 18306 - DNA, 27 bp, Artificial sequence
  SiRNA target sequence
taaaaagttatttattcaaatctgcca

SEQ ID NO: 18307 - DNA, 27 bp, Artificial sequence
  SiRNA target sequence
aaaaagttatttattcaaatctgccat

SEQ ID NO: 18308 - DNA, 27 bp, Artificial sequence
  SiRNA target sequence
aaaagttatttattcaaatctgccatt

SEQ ID NO: 18309 - DNA, 27 bp, Artificial sequence
  SiRNA target sequence
aaagttatttattcaaatctgccatta

SEQ ID NO: 18310 - DNA, 27 bp, Artificial sequence
  SiRNA target sequence
aagttatttattcaaatctgccattaa

SEQ ID NO: 18311 - DNA, 27 bp, Artificial sequence
  SiRNA target sequence
agttatttattcaaatctgccattaat

SEQ ID NO: 18312 - DNA, 27 bp, Artificial sequence
  SiRNA target sequence
gttatttattcaaatctgccattaata

SEQ ID NO: 18313 - DNA, 27 bp, Artificial sequence
  SiRNA target sequence
ttatttattcaaatctgccattaatac

SEQ ID NO: 18314 - DNA, 27 bp, Artificial sequence
  SiRNA target sequence
tatttattcaaatctgccattaataca

SEQ ID NO: 18315 - DNA, 27 bp, Artificial sequence
  SiRNA target sequence
atttattcaaatctgccattaatacat

SEQ ID NO: 18316 - DNA, 27 bp, Artificial sequence
  SiRNA target sequence
tttattcaaatctgccattaatacatc

SEQ ID NO: 18317 - DNA, 27 bp, Artificial sequence
  SiRNA target sequence
ttattcaaatctgccattaatacatct

SEQ ID NO: 18318 - DNA, 27 bp, Artificial sequence
  SiRNA target sequence
tattcaaatctgccattaatacatctt

SEQ ID NO: 18319 - DNA, 27 bp, Artificial sequence
  SiRNA target sequence
attcaaatctgccattaatacatcttt

SEQ ID NO: 18320 - DNA, 27 bp, Artificial sequence
  SiRNA target sequence
ttcaaatctgccattaatacatctttt

SEQ ID NO: 18321 - DNA, 27 bp, Artificial sequence
  SiRNA target sequence
tcaaatctgccattaatacatcttttg

SEQ ID NO: 18322 - DNA, 27 bp, Artificial sequence
  SiRNA target sequence
caaatctgccattaatacatcttttga

SEQ ID NO: 18323 - DNA, 27 bp, Artificial sequence
  SiRNA target sequence
aaatctgccattaatacatcttttgat

SEQ ID NO: 18324 - DNA, 27 bp, Artificial sequence
  SiRNA target sequence
aatctgccattaatacatcttttgata

SEQ ID NO: 18325 - DNA, 27 bp, Artificial sequence
  SiRNA target sequence
atctgccattaatacatcttttgatac

SEQ ID NO: 18326 - DNA, 27 bp, Artificial sequence
  SiRNA target sequence
tctgccattaatacatcttttgatact

SEQ ID NO: 18327 - DNA, 27 bp, Artificial sequence
  SiRNA target sequence
ctgccattaatacatcttttgatactt

SEQ ID NO: 18328 - DNA, 27 bp, Artificial sequence
  SiRNA target sequence
tgccattaatacatcttttgatacttt

SEQ ID NO: 18329 - DNA, 27 bp, Artificial sequence
  SiRNA target sequence
gccattaatacatcttttgatactttt

SEQ ID NO: 18330 - DNA, 27 bp, Artificial sequence
  SiRNA target sequence
ccattaatacatcttttgatactttta

SEQ ID NO: 18331 - DNA, 27 bp, Artificial sequence
  SiRNA target sequence
cattaatacatcttttgatacttttaa

SEQ ID NO: 18332 - DNA, 27 bp, Artificial sequence
  SiRNA target sequence
attaatacatcttttgatacttttaat

SEQ ID NO: 18333 - DNA, 27 bp, Artificial sequence
  SiRNA target sequence
ttaatacatcttttgatacttttaatt

SEQ ID NO: 18334 - DNA, 27 bp, Artificial sequence
  SiRNA target sequence
taatacatcttttgatacttttaattt

SEQ ID NO: 18335 - DNA, 27 bp, Artificial sequence
  SiRNA target sequence
aatacatcttttgatacttttaattta

SEQ ID NO: 18336 - DNA, 27 bp, Artificial sequence
  SiRNA target sequence
atacatcttttgatacttttaatttag

SEQ ID NO: 18337 - DNA, 27 bp, Artificial sequence
  SiRNA target sequence
tacatcttttgatacttttaatttaga

SEQ ID NO: 18338 - DNA, 27 bp, Artificial sequence
  SiRNA target sequence
acatcttttgatacttttaatttagaa

SEQ ID NO: 18339 - DNA, 27 bp, Artificial sequence
  SiRNA target sequence
catcttttgatacttttaatttagaaa

SEQ ID NO: 18340 - DNA, 27 bp, Artificial sequence
  SiRNA target sequence
atcttttgatacttttaatttagaaaa

SEQ ID NO: 18341 - DNA, 27 bp, Artificial sequence
  SiRNA target sequence
tcttttgatacttttaatttagaaaat

SEQ ID NO: 18342 - DNA, 27 bp, Artificial sequence
  SiRNA target sequence
cttttgatacttttaatttagaaaatg

SEQ ID NO: 18343 - DNA, 27 bp, Artificial sequence
  SiRNA target sequence
ttttgatacttttaatttagaaaatgt

SEQ ID NO: 18344 - DNA, 27 bp, Artificial sequence
  SiRNA target sequence
tttgatacttttaatttagaaaatgta

SEQ ID NO: 18345 - DNA, 27 bp, Artificial sequence
  SiRNA target sequence
ttgatacttttaatttagaaaatgtaa

SEQ ID NO: 18346 - DNA, 27 bp, Artificial sequence
  SiRNA target sequence
tgatacttttaatttagaaaatgtaag

SEQ ID NO: 18347 - DNA, 27 bp, Artificial sequence
  SiRNA target sequence
gatacttttaatttagaaaatgtaagc

SEQ ID NO: 18348 - DNA, 27 bp, Artificial sequence
  SiRNA target sequence
atacttttaatttagaaaatgtaagca

SEQ ID NO: 18349 - DNA, 27 bp, Artificial sequence
  SiRNA target sequence
tacttttaatttagaaaatgtaagcat

SEQ ID NO: 18350 - DNA, 27 bp, Artificial sequence
  SiRNA target sequence
acttttaatttagaaaatgtaagcatt

SEQ ID NO: 18351 - DNA, 27 bp, Artificial sequence
  SiRNA target sequence
cttttaatttagaaaatgtaagcatta

SEQ ID NO: 18352 - DNA, 27 bp, Artificial sequence
  SiRNA target sequence
ttttaatttagaaaatgtaagcattac

SEQ ID NO: 18353 - DNA, 27 bp, Artificial sequence
  SiRNA target sequence
tttaatttagaaaatgtaagcattact

SEQ ID NO: 18354 - DNA, 27 bp, Artificial sequence
  SiRNA target sequence
ttaatttagaaaatgtaagcattacta

SEQ ID NO: 18355 - DNA, 27 bp, Artificial sequence
  SiRNA target sequence
taatttagaaaatgtaagcattactag

SEQ ID NO: 18356 - DNA, 27 bp, Artificial sequence
  SiRNA target sequence
aatttagaaaatgtaagcattactagc

SEQ ID NO: 18357 - DNA, 27 bp, Artificial sequence
  SiRNA target sequence
atttagaaaatgtaagcattactagct

SEQ ID NO: 18358 - DNA, 27 bp, Artificial sequence
  SiRNA target sequence
tttagaaaatgtaagcattactagctt

SEQ ID NO: 18359 - DNA, 27 bp, Artificial sequence
  SiRNA target sequence
ttagaaaatgtaagcattactagctta

SEQ ID NO: 18360 - DNA, 27 bp, Artificial sequence
  SiRNA target sequence
tagaaaatgtaagcattactagcttaa

SEQ ID NO: 18361 - DNA, 27 bp, Artificial sequence
  SiRNA target sequence
agaaaatgtaagcattactagcttaaa

SEQ ID NO: 18362 - DNA, 27 bp, Artificial sequence
  SiRNA target sequence
gaaaatgtaagcattactagcttaaat

SEQ ID NO: 18363 - DNA, 27 bp, Artificial sequence
  SiRNA target sequence
aaaatgtaagcattactagcttaaata

SEQ ID NO: 18364 - DNA, 27 bp, Artificial sequence
  SiRNA target sequence
aaatgtaagcattactagcttaaatac

SEQ ID NO: 18365 - DNA, 27 bp, Artificial sequence
  SiRNA target sequence
aatgtaagcattactagcttaaatacg

SEQ ID NO: 18366 - DNA, 27 bp, Artificial sequence
  SiRNA target sequence
atgtaagcattactagcttaaatacgt

SEQ ID NO: 18367 - DNA, 27 bp, Artificial sequence
  SiRNA target sequence
tgtaagcattactagcttaaatacgta

SEQ ID NO: 18368 - DNA, 27 bp, Artificial sequence
  SiRNA target sequence
gtaagcattactagcttaaatacgtac

SEQ ID NO: 18369 - DNA, 27 bp, Artificial sequence
  SiRNA target sequence
taagcattactagcttaaatacgtaca

SEQ ID NO: 18370 - DNA, 27 bp, Artificial sequence
  SiRNA target sequence
aagcattactagcttaaatacgtacac

SEQ ID NO: 18371 - DNA, 27 bp, Artificial sequence
  SiRNA target sequence
agcattactagcttaaatacgtacacc

SEQ ID NO: 18372 - DNA, 27 bp, Artificial sequence
  SiRNA target sequence
gcattactagcttaaatacgtacaccg

SEQ ID NO: 18373 - DNA, 27 bp, Artificial sequence
  SiRNA target sequence
cattactagcttaaatacgtacaccgg

SEQ ID NO: 18374 - DNA, 27 bp, Artificial sequence
  SiRNA target sequence
attactagcttaaatacgtacaccggt

SEQ ID NO: 18375 - DNA, 27 bp, Artificial sequence
  SiRNA target sequence
ttactagcttaaatacgtacaccggtg

SEQ ID NO: 18376 - DNA, 27 bp, Artificial sequence
  SiRNA target sequence
tactagcttaaatacgtacaccggtgt

SEQ ID NO: 18377 - DNA, 27 bp, Artificial sequence
  SiRNA target sequence
actagcttaaatacgtacaccggtgtt

SEQ ID NO: 18378 - DNA, 27 bp, Artificial sequence
  SiRNA target sequence
ctagcttaaatacgtacaccggtgtta

SEQ ID NO: 18379 - DNA, 27 bp, Artificial sequence
  SiRNA target sequence
tagcttaaatacgtacaccggtgttaa

SEQ ID NO: 18380 - DNA, 27 bp, Artificial sequence
  SiRNA target sequence
agcttaaatacgtacaccggtgttaaa

SEQ ID NO: 18381 - DNA, 27 bp, Artificial sequence
  SiRNA target sequence
gcttaaatacgtacaccggtgttaaaa

SEQ ID NO: 18382 - DNA, 27 bp, Artificial sequence
  SiRNA target sequence
cttaaatacgtacaccggtgttaaaac

SEQ ID NO: 18383 - DNA, 27 bp, Artificial sequence
  SiRNA target sequence
ttaaatacgtacaccggtgttaaaacc

SEQ ID NO: 18384 - DNA, 27 bp, Artificial sequence
  SiRNA target sequence
taaatacgtacaccggtgttaaaaccg

SEQ ID NO: 18385 - DNA, 27 bp, Artificial sequence
  SiRNA target sequence
aaatacgtacaccggtgttaaaaccga

SEQ ID NO: 18386 - DNA, 27 bp, Artificial sequence
  SiRNA target sequence
aatacgtacaccggtgttaaaaccgaa

SEQ ID NO: 18387 - DNA, 27 bp, Artificial sequence
  SiRNA target sequence
atacgtacaccggtgttaaaaccgaaa

SEQ ID NO: 18388 - DNA, 27 bp, Artificial sequence
  SiRNA target sequence
tacgtacaccggtgttaaaaccgaaat

SEQ ID NO: 18389 - DNA, 27 bp, Artificial sequence
  SiRNA target sequence
acgtacaccggtgttaaaaccgaaata

SEQ ID NO: 18390 - DNA, 27 bp, Artificial sequence
  SiRNA target sequence
cgtacaccggtgttaaaaccgaaatat

SEQ ID NO: 18391 - DNA, 27 bp, Artificial sequence
  SiRNA target sequence
gtacaccggtgttaaaaccgaaatatc

SEQ ID NO: 18392 - DNA, 27 bp, Artificial sequence
  SiRNA target sequence
tacaccggtgttaaaaccgaaatatca

SEQ ID NO: 18393 - DNA, 27 bp, Artificial sequence
  SiRNA target sequence
acaccggtgttaaaaccgaaatatcaa

SEQ ID NO: 18394 - DNA, 27 bp, Artificial sequence
  SiRNA target sequence
caccggtgttaaaaccgaaatatcaaa

SEQ ID NO: 18395 - DNA, 27 bp, Artificial sequence
  SiRNA target sequence
accggtgttaaaaccgaaatatcaaaa

SEQ ID NO: 18396 - DNA, 27 bp, Artificial sequence
  SiRNA target sequence
ccggtgttaaaaccgaaatatcaaaaa

SEQ ID NO: 18397 - DNA, 27 bp, Artificial sequence
  SiRNA target sequence
cggtgttaaaaccgaaatatcaaaaac

SEQ ID NO: 18398 - DNA, 27 bp, Artificial sequence
  SiRNA target sequence
ggtgttaaaaccgaaatatcaaaaacc

SEQ ID NO: 18399 - DNA, 27 bp, Artificial sequence
  SiRNA target sequence
gtgttaaaaccgaaatatcaaaaaccg

SEQ ID NO: 18400 - DNA, 27 bp, Artificial sequence
  SiRNA target sequence
tgttaaaaccgaaatatcaaaaaccgt

SEQ ID NO: 18401 - DNA, 27 bp, Artificial sequence
  SiRNA target sequence
gttaaaaccgaaatatcaaaaaccgta

SEQ ID NO: 18402 - DNA, 27 bp, Artificial sequence
  SiRNA target sequence
ttaaaaccgaaatatcaaaaaccgtat

SEQ ID NO: 18403 - DNA, 27 bp, Artificial sequence
  SiRNA target sequence
taaaaccgaaatatcaaaaaccgtatc

SEQ ID NO: 18404 - DNA, 27 bp, Artificial sequence
  SiRNA target sequence
aaaaccgaaatatcaaaaaccgtatca

SEQ ID NO: 18405 - DNA, 27 bp, Artificial sequence
  SiRNA target sequence
aaaccgaaatatcaaaaaccgtatcac

SEQ ID NO: 18406 - DNA, 27 bp, Artificial sequence
  SiRNA target sequence
aaccgaaatatcaaaaaccgtatcacc

SEQ ID NO: 18407 - DNA, 27 bp, Artificial sequence
  SiRNA target sequence
accgaaatatcaaaaaccgtatcacca

SEQ ID NO: 18408 - DNA, 27 bp, Artificial sequence
  SiRNA target sequence
ccgaaatatcaaaaaccgtatcaccac

SEQ ID NO: 18409 - DNA, 27 bp, Artificial sequence
  SiRNA target sequence
cgaaatatcaaaaaccgtatcaccaca

SEQ ID NO: 18410 - DNA, 27 bp, Artificial sequence
  SiRNA target sequence
gaaatatcaaaaaccgtatcaccacac

SEQ ID NO: 18411 - DNA, 27 bp, Artificial sequence
  SiRNA target sequence
aaatatcaaaaaccgtatcaccacact

SEQ ID NO: 18412 - DNA, 27 bp, Artificial sequence
  SiRNA target sequence
aatatcaaaaaccgtatcaccacactt

SEQ ID NO: 18413 - DNA, 27 bp, Artificial sequence
  SiRNA target sequence
atatcaaaaaccgtatcaccacacttc

SEQ ID NO: 18414 - DNA, 27 bp, Artificial sequence
  SiRNA target sequence
tatcaaaaaccgtatcaccacacttcc

SEQ ID NO: 18415 - DNA, 27 bp, Artificial sequence
  SiRNA target sequence
atcaaaaaccgtatcaccacacttcca

SEQ ID NO: 18416 - DNA, 27 bp, Artificial sequence
  SiRNA target sequence
tcaaaaaccgtatcaccacacttccag

SEQ ID NO: 18417 - DNA, 27 bp, Artificial sequence
  SiRNA target sequence
caaaaaccgtatcaccacacttccaga

SEQ ID NO: 18418 - DNA, 27 bp, Artificial sequence
  SiRNA target sequence
aaaaaccgtatcaccacacttccagat

SEQ ID NO: 18419 - DNA, 27 bp, Artificial sequence
  SiRNA target sequence
aaaaccgtatcaccacacttccagatt

SEQ ID NO: 18420 - DNA, 27 bp, Artificial sequence
  SiRNA target sequence
aaaccgtatcaccacacttccagattt

SEQ ID NO: 18421 - DNA, 27 bp, Artificial sequence
  SiRNA target sequence
aaccgtatcaccacacttccagatttc

SEQ ID NO: 18422 - DNA, 27 bp, Artificial sequence
  SiRNA target sequence
accgtatcaccacacttccagatttct

SEQ ID NO: 18423 - DNA, 27 bp, Artificial sequence
  SiRNA target sequence
ccgtatcaccacacttccagatttctc

SEQ ID NO: 18424 - DNA, 27 bp, Artificial sequence
  SiRNA target sequence
cgtatcaccacacttccagatttctca

SEQ ID NO: 18425 - DNA, 27 bp, Artificial sequence
  SiRNA target sequence
gtatcaccacacttccagatttctcat

SEQ ID NO: 18426 - DNA, 27 bp, Artificial sequence
  SiRNA target sequence
tatcaccacacttccagatttctcatg

SEQ ID NO: 18427 - DNA, 27 bp, Artificial sequence
  SiRNA target sequence
atcaccacacttccagatttctcatgt

SEQ ID NO: 18428 - DNA, 27 bp, Artificial sequence
  SiRNA target sequence
tcaccacacttccagatttctcatgtc

SEQ ID NO: 18429 - DNA, 27 bp, Artificial sequence
  SiRNA target sequence
caccacacttccagatttctcatgtct

SEQ ID NO: 18430 - DNA, 27 bp, Artificial sequence
  SiRNA target sequence
accacacttccagatttctcatgtctc

SEQ ID NO: 18431 - DNA, 27 bp, Artificial sequence
  SiRNA target sequence
ccacacttccagatttctcatgtctct

SEQ ID NO: 18432 - DNA, 27 bp, Artificial sequence
  SiRNA target sequence
cacacttccagatttctcatgtctctt

SEQ ID NO: 18433 - DNA, 27 bp, Artificial sequence
  SiRNA target sequence
acacttccagatttctcatgtctcttc

SEQ ID NO: 18434 - DNA, 27 bp, Artificial sequence
  SiRNA target sequence
cacttccagatttctcatgtctcttct

SEQ ID NO: 18435 - DNA, 27 bp, Artificial sequence
  SiRNA target sequence
acttccagatttctcatgtctcttcta

SEQ ID NO: 18436 - DNA, 27 bp, Artificial sequence
  SiRNA target sequence
cttccagatttctcatgtctcttctat

SEQ ID NO: 18437 - DNA, 27 bp, Artificial sequence
  SiRNA target sequence
ttccagatttctcatgtctcttctatg

SEQ ID NO: 18438 - DNA, 27 bp, Artificial sequence
  SiRNA target sequence
tccagatttctcatgtctcttctatgg

SEQ ID NO: 18439 - DNA, 27 bp, Artificial sequence
  SiRNA target sequence
ccagatttctcatgtctcttctatggg

SEQ ID NO: 18440 - DNA, 27 bp, Artificial sequence
  SiRNA target sequence
cagatttctcatgtctcttctatgggc

SEQ ID NO: 18441 - DNA, 27 bp, Artificial sequence
  SiRNA target sequence
agatttctcatgtctcttctatgggcg

SEQ ID NO: 18442 - DNA, 27 bp, Artificial sequence
  SiRNA target sequence
gatttctcatgtctcttctatgggcgc

SEQ ID NO: 18443 - DNA, 27 bp, Artificial sequence
  SiRNA target sequence
atttctcatgtctcttctatgggcgca

SEQ ID NO: 18444 - DNA, 27 bp, Artificial sequence
  SiRNA target sequence
tttctcatgtctcttctatgggcgcag

SEQ ID NO: 18445 - DNA, 27 bp, Artificial sequence
  SiRNA target sequence
ttctcatgtctcttctatgggcgcaga

SEQ ID NO: 18446 - DNA, 27 bp, Artificial sequence
  SiRNA target sequence
tctcatgtctcttctatgggcgcagat

SEQ ID NO: 18447 - DNA, 27 bp, Artificial sequence
  SiRNA target sequence
ctcatgtctcttctatgggcgcagatt

SEQ ID NO: 18448 - DNA, 27 bp, Artificial sequence
  SiRNA target sequence
tcatgtctcttctatgggcgcagattt

SEQ ID NO: 18449 - DNA, 27 bp, Artificial sequence
  SiRNA target sequence
catgtctcttctatgggcgcagatttc

SEQ ID NO: 18450 - DNA, 27 bp, Artificial sequence
  SiRNA target sequence
atgtctcttctatgggcgcagatttcg

SEQ ID NO: 18451 - DNA, 27 bp, Artificial sequence
  SiRNA target sequence
tgtctcttctatgggcgcagatttcga

SEQ ID NO: 18452 - DNA, 27 bp, Artificial sequence
  SiRNA target sequence
gtctcttctatgggcgcagatttcgac

SEQ ID NO: 18453 - DNA, 27 bp, Artificial sequence
  SiRNA target sequence
tctcttctatgggcgcagatttcgaca

SEQ ID NO: 18454 - DNA, 27 bp, Artificial sequence
  SiRNA target sequence
ctcttctatgggcgcagatttcgacat

SEQ ID NO: 18455 - DNA, 27 bp, Artificial sequence
  SiRNA target sequence
tcttctatgggcgcagatttcgacata

SEQ ID NO: 18456 - DNA, 27 bp, Artificial sequence
  SiRNA target sequence
cttctatgggcgcagatttcgacataa

SEQ ID NO: 18457 - DNA, 27 bp, Artificial sequence
  SiRNA target sequence
ttctatgggcgcagatttcgacataaa

SEQ ID NO: 18458 - DNA, 27 bp, Artificial sequence
  SiRNA target sequence
tctatgggcgcagatttcgacataaaa

SEQ ID NO: 18459 - DNA, 27 bp, Artificial sequence
  SiRNA target sequence
ctatgggcgcagatttcgacataaaac

SEQ ID NO: 18460 - DNA, 27 bp, Artificial sequence
  SiRNA target sequence
tatgggcgcagatttcgacataaaaca

SEQ ID NO: 18461 - DNA, 27 bp, Artificial sequence
  SiRNA target sequence
atgggcgcagatttcgacataaaacag

SEQ ID NO: 18462 - DNA, 27 bp, Artificial sequence
  SiRNA target sequence
tgggcgcagatttcgacataaaacaga

SEQ ID NO: 18463 - DNA, 27 bp, Artificial sequence
  SiRNA target sequence
gggcgcagatttcgacataaaacagac

SEQ ID NO: 18464 - DNA, 27 bp, Artificial sequence
  SiRNA target sequence
ggcgcagatttcgacataaaacagaca

SEQ ID NO: 18465 - DNA, 27 bp, Artificial sequence
  SiRNA target sequence
gcgcagatttcgacataaaacagacat

SEQ ID NO: 18466 - DNA, 27 bp, Artificial sequence
  SiRNA target sequence
cgcagatttcgacataaaacagacata

SEQ ID NO: 18467 - DNA, 27 bp, Artificial sequence
  SiRNA target sequence
gcagatttcgacataaaacagacatac

SEQ ID NO: 18468 - DNA, 27 bp, Artificial sequence
  SiRNA target sequence
cagatttcgacataaaacagacatacg

SEQ ID NO: 18469 - DNA, 27 bp, Artificial sequence
  SiRNA target sequence
agatttcgacataaaacagacatacgc

SEQ ID NO: 18470 - DNA, 27 bp, Artificial sequence
  SiRNA target sequence
gatttcgacataaaacagacatacgcc

SEQ ID NO: 18471 - DNA, 27 bp, Artificial sequence
  SiRNA target sequence
atttcgacataaaacagacatacgcca

SEQ ID NO: 18472 - DNA, 27 bp, Artificial sequence
  SiRNA target sequence
tttcgacataaaacagacatacgccac

SEQ ID NO: 18473 - DNA, 27 bp, Artificial sequence
  SiRNA target sequence
ttcgacataaaacagacatacgccacg

SEQ ID NO: 18474 - DNA, 27 bp, Artificial sequence
  SiRNA target sequence
tcgacataaaacagacatacgccacgt

SEQ ID NO: 18475 - DNA, 27 bp, Artificial sequence
  SiRNA target sequence
cgacataaaacagacatacgccacgtt

SEQ ID NO: 18476 - DNA, 27 bp, Artificial sequence
  SiRNA target sequence
gacataaaacagacatacgccacgttc

SEQ ID NO: 18477 - DNA, 27 bp, Artificial sequence
  SiRNA target sequence
acataaaacagacatacgccacgttct

SEQ ID NO: 18478 - DNA, 27 bp, Artificial sequence
  SiRNA target sequence
cataaaacagacatacgccacgttctg

SEQ ID NO: 18479 - DNA, 27 bp, Artificial sequence
  SiRNA target sequence
ataaaacagacatacgccacgttctgc

SEQ ID NO: 18480 - DNA, 27 bp, Artificial sequence
  SiRNA target sequence
taaaacagacatacgccacgttctgct

SEQ ID NO: 18481 - DNA, 27 bp, Artificial sequence
  SiRNA target sequence
aaaacagacatacgccacgttctgctt

SEQ ID NO: 18482 - DNA, 27 bp, Artificial sequence
  SiRNA target sequence
aaacagacatacgccacgttctgcttt

SEQ ID NO: 18483 - DNA, 27 bp, Artificial sequence
  SiRNA target sequence
aacagacatacgccacgttctgcttta

SEQ ID NO: 18484 - DNA, 27 bp, Artificial sequence
  SiRNA target sequence
acagacatacgccacgttctgctttaa

SEQ ID NO: 18485 - DNA, 27 bp, Artificial sequence
  SiRNA target sequence
cagacatacgccacgttctgctttaac

SEQ ID NO: 18486 - DNA, 27 bp, Artificial sequence
  SiRNA target sequence
agacatacgccacgttctgctttaaca

SEQ ID NO: 18487 - DNA, 27 bp, Artificial sequence
  SiRNA target sequence
gacatacgccacgttctgctttaacaa

SEQ ID NO: 18488 - DNA, 27 bp, Artificial sequence
  SiRNA target sequence
acatacgccacgttctgctttaacaat

SEQ ID NO: 18489 - DNA, 27 bp, Artificial sequence
  SiRNA target sequence
catacgccacgttctgctttaacaatc

SEQ ID NO: 18490 - DNA, 27 bp, Artificial sequence
  SiRNA target sequence
atacgccacgttctgctttaacaatct

SEQ ID NO: 18491 - DNA, 27 bp, Artificial sequence
  SiRNA target sequence
tacgccacgttctgctttaacaatctt

SEQ ID NO: 18492 - DNA, 27 bp, Artificial sequence
  SiRNA target sequence
acgccacgttctgctttaacaatcttt

SEQ ID NO: 18493 - DNA, 27 bp, Artificial sequence
  SiRNA target sequence
cgccacgttctgctttaacaatctttt

SEQ ID NO: 18494 - DNA, 27 bp, Artificial sequence
  SiRNA target sequence
gccacgttctgctttaacaatcttttg

SEQ ID NO: 18495 - DNA, 27 bp, Artificial sequence
  SiRNA target sequence
ccacgttctgctttaacaatcttttgc

SEQ ID NO: 18496 - DNA, 27 bp, Artificial sequence
  SiRNA target sequence
cacgttctgctttaacaatcttttgct

SEQ ID NO: 18497 - DNA, 27 bp, Artificial sequence
  SiRNA target sequence
acgttctgctttaacaatcttttgcta

SEQ ID NO: 18498 - DNA, 27 bp, Artificial sequence
  SiRNA target sequence
cgttctgctttaacaatcttttgctac

SEQ ID NO: 18499 - DNA, 27 bp, Artificial sequence
  SiRNA target sequence
gttctgctttaacaatcttttgctaca

SEQ ID NO: 18500 - DNA, 27 bp, Artificial sequence
  SiRNA target sequence
ttctgctttaacaatcttttgctacaa

SEQ ID NO: 18501 - DNA, 27 bp, Artificial sequence
  SiRNA target sequence
tctgctttaacaatcttttgctacaaa

SEQ ID NO: 18502 - DNA, 27 bp, Artificial sequence
  SiRNA target sequence
ctgctttaacaatcttttgctacaaac

SEQ ID NO: 18503 - DNA, 27 bp, Artificial sequence
  SiRNA target sequence
tgctttaacaatcttttgctacaaacg

SEQ ID NO: 18504 - DNA, 27 bp, Artificial sequence
  SiRNA target sequence
gctttaacaatcttttgctacaaacga

SEQ ID NO: 18505 - DNA, 27 bp, Artificial sequence
  SiRNA target sequence
ctttaacaatcttttgctacaaacgag

SEQ ID NO: 18506 - DNA, 27 bp, Artificial sequence
  SiRNA target sequence
tttaacaatcttttgctacaaacgagc

SEQ ID NO: 18507 - DNA, 27 bp, Artificial sequence
  SiRNA target sequence
ttaacaatcttttgctacaaacgagca

SEQ ID NO: 18508 - DNA, 27 bp, Artificial sequence
  SiRNA target sequence
taacaatcttttgctacaaacgagcat

SEQ ID NO: 18509 - DNA, 27 bp, Artificial sequence
  SiRNA target sequence
aacaatcttttgctacaaacgagcata

SEQ ID NO: 18510 - DNA, 27 bp, Artificial sequence
  SiRNA target sequence
acaatcttttgctacaaacgagcatag

SEQ ID NO: 18511 - DNA, 27 bp, Artificial sequence
  SiRNA target sequence
caatcttttgctacaaacgagcataga

SEQ ID NO: 18512 - DNA, 27 bp, Artificial sequence
  SiRNA target sequence
aatcttttgctacaaacgagcatagac

SEQ ID NO: 18513 - DNA, 27 bp, Artificial sequence
  SiRNA target sequence
atcttttgctacaaacgagcatagacc

SEQ ID NO: 18514 - DNA, 27 bp, Artificial sequence
  SiRNA target sequence
tcttttgctacaaacgagcatagacca

SEQ ID NO: 18515 - DNA, 27 bp, Artificial sequence
  SiRNA target sequence
cttttgctacaaacgagcatagaccaa

SEQ ID NO: 18516 - DNA, 27 bp, Artificial sequence
  SiRNA target sequence
ttttgctacaaacgagcatagaccaag

SEQ ID NO: 18517 - DNA, 27 bp, Artificial sequence
  SiRNA target sequence
tttgctacaaacgagcatagaccaaga

SEQ ID NO: 18518 - DNA, 27 bp, Artificial sequence
  SiRNA target sequence
ttgctacaaacgagcatagaccaagac

SEQ ID NO: 18519 - DNA, 27 bp, Artificial sequence
  SiRNA target sequence
tgctacaaacgagcatagaccaagaca

SEQ ID NO: 18520 - DNA, 27 bp, Artificial sequence
  SiRNA target sequence
gctacaaacgagcatagaccaagacaa

SEQ ID NO: 18521 - DNA, 27 bp, Artificial sequence
  SiRNA target sequence
ctacaaacgagcatagaccaagacaaa

SEQ ID NO: 18522 - DNA, 27 bp, Artificial sequence
  SiRNA target sequence
tacaaacgagcatagaccaagacaaaa

SEQ ID NO: 18523 - DNA, 27 bp, Artificial sequence
  SiRNA target sequence
acaaacgagcatagaccaagacaaaat

SEQ ID NO: 18524 - DNA, 27 bp, Artificial sequence
  SiRNA target sequence
caaacgagcatagaccaagacaaaata

SEQ ID NO: 18525 - DNA, 27 bp, Artificial sequence
  SiRNA target sequence
aaacgagcatagaccaagacaaaatat

SEQ ID NO: 18526 - DNA, 27 bp, Artificial sequence
  SiRNA target sequence
aacgagcatagaccaagacaaaatatt

SEQ ID NO: 18527 - DNA, 27 bp, Artificial sequence
  SiRNA target sequence
acgagcatagaccaagacaaaatattt

SEQ ID NO: 18528 - DNA, 27 bp, Artificial sequence
  SiRNA target sequence
cgagcatagaccaagacaaaatattta

SEQ ID NO: 18529 - DNA, 27 bp, Artificial sequence
  SiRNA target sequence
gagcatagaccaagacaaaatatttag

SEQ ID NO: 18530 - DNA, 27 bp, Artificial sequence
  SiRNA target sequence
agcatagaccaagacaaaatatttaga

SEQ ID NO: 18531 - DNA, 27 bp, Artificial sequence
  SiRNA target sequence
gcatagaccaagacaaaatatttagaa

SEQ ID NO: 18532 - DNA, 27 bp, Artificial sequence
  SiRNA target sequence
catagaccaagacaaaatatttagaat

SEQ ID NO: 18533 - DNA, 27 bp, Artificial sequence
  SiRNA target sequence
atagaccaagacaaaatatttagaata

SEQ ID NO: 18534 - DNA, 27 bp, Artificial sequence
  SiRNA target sequence
tagaccaagacaaaatatttagaataa

SEQ ID NO: 18535 - DNA, 27 bp, Artificial sequence
  SiRNA target sequence
agaccaagacaaaatatttagaataag

SEQ ID NO: 18536 - DNA, 27 bp, Artificial sequence
  SiRNA target sequence
gaccaagacaaaatatttagaataaga

SEQ ID NO: 18537 - DNA, 27 bp, Artificial sequence
  SiRNA target sequence
accaagacaaaatatttagaataagag

SEQ ID NO: 18538 - DNA, 27 bp, Artificial sequence
  SiRNA target sequence
ccaagacaaaatatttagaataagagg

SEQ ID NO: 18539 - DNA, 27 bp, Artificial sequence
  SiRNA target sequence
caagacaaaatatttagaataagaggt

SEQ ID NO: 18540 - DNA, 27 bp, Artificial sequence
  SiRNA target sequence
aagacaaaatatttagaataagaggta

SEQ ID NO: 18541 - DNA, 27 bp, Artificial sequence
  SiRNA target sequence
agacaaaatatttagaataagaggtac

SEQ ID NO: 18542 - DNA, 27 bp, Artificial sequence
  SiRNA target sequence
gacaaaatatttagaataagaggtacc

SEQ ID NO: 18543 - DNA, 27 bp, Artificial sequence
  SiRNA target sequence
acaaaatatttagaataagaggtaccc

SEQ ID NO: 18544 - DNA, 27 bp, Artificial sequence
  SiRNA target sequence
caaaatatttagaataagaggtaccca

SEQ ID NO: 18545 - DNA, 27 bp, Artificial sequence
  SiRNA target sequence
aaaatatttagaataagaggtacccac

SEQ ID NO: 18546 - DNA, 27 bp, Artificial sequence
  SiRNA target sequence
aaatatttagaataagaggtacccaca

SEQ ID NO: 18547 - DNA, 27 bp, Artificial sequence
  SiRNA target sequence
aatatttagaataagaggtacccacat

SEQ ID NO: 18548 - DNA, 27 bp, Artificial sequence
  SiRNA target sequence
atatttagaataagaggtacccacatg

SEQ ID NO: 18549 - DNA, 27 bp, Artificial sequence
  SiRNA target sequence
tatttagaataagaggtacccacatgt

SEQ ID NO: 18550 - DNA, 27 bp, Artificial sequence
  SiRNA target sequence
atttagaataagaggtacccacatgtt

SEQ ID NO: 18551 - DNA, 27 bp, Artificial sequence
  SiRNA target sequence
tttagaataagaggtacccacatgttt

SEQ ID NO: 18552 - DNA, 27 bp, Artificial sequence
  SiRNA target sequence
ttagaataagaggtacccacatgttta

SEQ ID NO: 18553 - DNA, 27 bp, Artificial sequence
  SiRNA target sequence
tagaataagaggtacccacatgtttaa

SEQ ID NO: 18554 - DNA, 27 bp, Artificial sequence
  SiRNA target sequence
agaataagaggtacccacatgtttaaa

SEQ ID NO: 18555 - DNA, 27 bp, Artificial sequence
  SiRNA target sequence
gaataagaggtacccacatgtttaaaa

SEQ ID NO: 18556 - DNA, 27 bp, Artificial sequence
  SiRNA target sequence
aataagaggtacccacatgtttaaaaa

SEQ ID NO: 18557 - DNA, 27 bp, Artificial sequence
  SiRNA target sequence
ataagaggtacccacatgtttaaaaat

SEQ ID NO: 18558 - DNA, 27 bp, Artificial sequence
  SiRNA target sequence
taagaggtacccacatgtttaaaaatc

SEQ ID NO: 18559 - DNA, 27 bp, Artificial sequence
  SiRNA target sequence
aagaggtacccacatgtttaaaaatct

SEQ ID NO: 18560 - DNA, 27 bp, Artificial sequence
  SiRNA target sequence
agaggtacccacatgtttaaaaatcta

SEQ ID NO: 18561 - DNA, 27 bp, Artificial sequence
  SiRNA target sequence
gaggtacccacatgtttaaaaatctac

SEQ ID NO: 18562 - DNA, 27 bp, Artificial sequence
  SiRNA target sequence
aggtacccacatgtttaaaaatctact

SEQ ID NO: 18563 - DNA, 27 bp, Artificial sequence
  SiRNA target sequence
ggtacccacatgtttaaaaatctactt

SEQ ID NO: 18564 - DNA, 27 bp, Artificial sequence
  SiRNA target sequence
gtacccacatgtttaaaaatctactta

SEQ ID NO: 18565 - DNA, 27 bp, Artificial sequence
  SiRNA target sequence
tacccacatgtttaaaaatctacttac

SEQ ID NO: 18566 - DNA, 27 bp, Artificial sequence
  SiRNA target sequence
acccacatgtttaaaaatctacttact

SEQ ID NO: 18567 - DNA, 27 bp, Artificial sequence
  SiRNA target sequence
cccacatgtttaaaaatctacttacta

SEQ ID NO: 18568 - DNA, 27 bp, Artificial sequence
  SiRNA target sequence
ccacatgtttaaaaatctacttactaa

SEQ ID NO: 18569 - DNA, 27 bp, Artificial sequence
  SiRNA target sequence
cacatgtttaaaaatctacttactaaa

SEQ ID NO: 18570 - DNA, 27 bp, Artificial sequence
  SiRNA target sequence
acatgtttaaaaatctacttactaaat

SEQ ID NO: 18571 - DNA, 27 bp, Artificial sequence
  SiRNA target sequence
catgtttaaaaatctacttactaaatt

SEQ ID NO: 18572 - DNA, 27 bp, Artificial sequence
  SiRNA target sequence
atgtttaaaaatctacttactaaattc

SEQ ID NO: 18573 - DNA, 27 bp, Artificial sequence
  SiRNA target sequence
tgtttaaaaatctacttactaaattcc

SEQ ID NO: 18574 - DNA, 27 bp, Artificial sequence
  SiRNA target sequence
gtttaaaaatctacttactaaattcca

SEQ ID NO: 18575 - DNA, 27 bp, Artificial sequence
  SiRNA target sequence
tttaaaaatctacttactaaattccat

SEQ ID NO: 18576 - DNA, 27 bp, Artificial sequence
  SiRNA target sequence
ttaaaaatctacttactaaattccata

SEQ ID NO: 18577 - DNA, 27 bp, Artificial sequence
  SiRNA target sequence
taaaaatctacttactaaattccatac

SEQ ID NO: 18578 - DNA, 27 bp, Artificial sequence
  SiRNA target sequence
aaaaatctacttactaaattccataca

SEQ ID NO: 18579 - DNA, 27 bp, Artificial sequence
  SiRNA target sequence
aaaatctacttactaaattccatacag

SEQ ID NO: 18580 - DNA, 27 bp, Artificial sequence
  SiRNA target sequence
aaatctacttactaaattccatacagt

SEQ ID NO: 18581 - DNA, 27 bp, Artificial sequence
  SiRNA target sequence
aatctacttactaaattccatacagta

SEQ ID NO: 18582 - DNA, 27 bp, Artificial sequence
  SiRNA target sequence
atctacttactaaattccatacagtaa

SEQ ID NO: 18583 - DNA, 27 bp, Artificial sequence
  SiRNA target sequence
tctacttactaaattccatacagtaat

SEQ ID NO: 18584 - DNA, 27 bp, Artificial sequence
  SiRNA target sequence
ctacttactaaattccatacagtaatt

SEQ ID NO: 18585 - DNA, 27 bp, Artificial sequence
  SiRNA target sequence
tacttactaaattccatacagtaattg

SEQ ID NO: 18586 - DNA, 27 bp, Artificial sequence
  SiRNA target sequence
acttactaaattccatacagtaattgg

SEQ ID NO: 18587 - DNA, 27 bp, Artificial sequence
  SiRNA target sequence
cttactaaattccatacagtaattggt

SEQ ID NO: 18588 - DNA, 27 bp, Artificial sequence
  SiRNA target sequence
ttactaaattccatacagtaattggta

SEQ ID NO: 18589 - DNA, 27 bp, Artificial sequence
  SiRNA target sequence
tactaaattccatacagtaattggtag

SEQ ID NO: 18590 - DNA, 27 bp, Artificial sequence
  SiRNA target sequence
actaaattccatacagtaattggtaga

SEQ ID NO: 18591 - DNA, 27 bp, Artificial sequence
  SiRNA target sequence
ctaaattccatacagtaattggtagaa

SEQ ID NO: 18592 - DNA, 27 bp, Artificial sequence
  SiRNA target sequence
taaattccatacagtaattggtagaag

SEQ ID NO: 18593 - DNA, 27 bp, Artificial sequence
  SiRNA target sequence
aaattccatacagtaattggtagaagt

SEQ ID NO: 18594 - DNA, 27 bp, Artificial sequence
  SiRNA target sequence
aattccatacagtaattggtagaagta

SEQ ID NO: 18595 - DNA, 27 bp, Artificial sequence
  SiRNA target sequence
attccatacagtaattggtagaagtaa

SEQ ID NO: 18596 - DNA, 27 bp, Artificial sequence
  SiRNA target sequence
ttccatacagtaattggtagaagtaaa

SEQ ID NO: 18597 - DNA, 27 bp, Artificial sequence
  SiRNA target sequence
tccatacagtaattggtagaagtaaag

SEQ ID NO: 18598 - DNA, 27 bp, Artificial sequence
  SiRNA target sequence
ccatacagtaattggtagaagtaaaga

SEQ ID NO: 18599 - DNA, 27 bp, Artificial sequence
  SiRNA target sequence
catacagtaattggtagaagtaaagat

SEQ ID NO: 18600 - DNA, 27 bp, Artificial sequence
  SiRNA target sequence
atacagtaattggtagaagtaaagata

SEQ ID NO: 18601 - DNA, 27 bp, Artificial sequence
  SiRNA target sequence
tacagtaattggtagaagtaaagatat

SEQ ID NO: 18602 - DNA, 27 bp, Artificial sequence
  SiRNA target sequence
acagtaattggtagaagtaaagatatc

SEQ ID NO: 18603 - DNA, 27 bp, Artificial sequence
  SiRNA target sequence
cagtaattggtagaagtaaagatatct

SEQ ID NO: 18604 - DNA, 27 bp, Artificial sequence
  SiRNA target sequence
agtaattggtagaagtaaagatatctt

SEQ ID NO: 18605 - DNA, 27 bp, Artificial sequence
  SiRNA target sequence
gtaattggtagaagtaaagatatcttt

SEQ ID NO: 18606 - DNA, 27 bp, Artificial sequence
  SiRNA target sequence
taattggtagaagtaaagatatcttta

SEQ ID NO: 18607 - DNA, 27 bp, Artificial sequence
  SiRNA target sequence
aattggtagaagtaaagatatctttac

SEQ ID NO: 18608 - DNA, 27 bp, Artificial sequence
  SiRNA target sequence
attggtagaagtaaagatatctttaca

SEQ ID NO: 18609 - DNA, 27 bp, Artificial sequence
  SiRNA target sequence
ttggtagaagtaaagatatctttacac

SEQ ID NO: 18610 - DNA, 27 bp, Artificial sequence
  SiRNA target sequence
tggtagaagtaaagatatctttacaca

SEQ ID NO: 18611 - DNA, 27 bp, Artificial sequence
  SiRNA target sequence
ggtagaagtaaagatatctttacacaa

SEQ ID NO: 18612 - DNA, 27 bp, Artificial sequence
  SiRNA target sequence
gtagaagtaaagatatctttacacaaa

SEQ ID NO: 18613 - DNA, 27 bp, Artificial sequence
  SiRNA target sequence
tagaagtaaagatatctttacacaaat

SEQ ID NO: 18614 - DNA, 27 bp, Artificial sequence
  SiRNA target sequence
agaagtaaagatatctttacacaaata

SEQ ID NO: 18615 - DNA, 27 bp, Artificial sequence
  SiRNA target sequence
gaagtaaagatatctttacacaaatag

SEQ ID NO: 18616 - DNA, 27 bp, Artificial sequence
  SiRNA target sequence
aagtaaagatatctttacacaaataga

SEQ ID NO: 18617 - DNA, 27 bp, Artificial sequence
  SiRNA target sequence
agtaaagatatctttacacaaatagag

SEQ ID NO: 18618 - DNA, 27 bp, Artificial sequence
  SiRNA target sequence
gtaaagatatctttacacaaatagagg

SEQ ID NO: 18619 - DNA, 27 bp, Artificial sequence
  SiRNA target sequence
taaagatatctttacacaaatagaggt

SEQ ID NO: 18620 - DNA, 27 bp, Artificial sequence
  SiRNA target sequence
aaagatatctttacacaaatagaggta

SEQ ID NO: 18621 - DNA, 27 bp, Artificial sequence
  SiRNA target sequence
aagatatctttacacaaatagaggtag

SEQ ID NO: 18622 - DNA, 27 bp, Artificial sequence
  SiRNA target sequence
agatatctttacacaaatagaggtaga

SEQ ID NO: 18623 - DNA, 27 bp, Artificial sequence
  SiRNA target sequence
gatatctttacacaaatagaggtagac

SEQ ID NO: 18624 - DNA, 27 bp, Artificial sequence
  SiRNA target sequence
atatctttacacaaatagaggtagaca

SEQ ID NO: 18625 - DNA, 27 bp, Artificial sequence
  SiRNA target sequence
tatctttacacaaatagaggtagacat

SEQ ID NO: 18626 - DNA, 27 bp, Artificial sequence
  SiRNA target sequence
atctttacacaaatagaggtagacata

SEQ ID NO: 18627 - DNA, 27 bp, Artificial sequence
  SiRNA target sequence
tctttacacaaatagaggtagacataa

SEQ ID NO: 18628 - DNA, 27 bp, Artificial sequence
  SiRNA target sequence
ctttacacaaatagaggtagacataaa

SEQ ID NO: 18629 - DNA, 27 bp, Artificial sequence
  SiRNA target sequence
tttacacaaatagaggtagacataaaa

SEQ ID NO: 18630 - DNA, 27 bp, Artificial sequence
  SiRNA target sequence
ttacacaaatagaggtagacataaaaa

SEQ ID NO: 18631 - DNA, 27 bp, Artificial sequence
  SiRNA target sequence
tacacaaatagaggtagacataaaaaa

SEQ ID NO: 18632 - DNA, 27 bp, Artificial sequence
  SiRNA target sequence
acacaaatagaggtagacataaaaaat

SEQ ID NO: 18633 - DNA, 27 bp, Artificial sequence
  SiRNA target sequence
cacaaatagaggtagacataaaaaata

SEQ ID NO: 18634 - DNA, 27 bp, Artificial sequence
  SiRNA target sequence
acaaatagaggtagacataaaaaataa

SEQ ID NO: 18635 - DNA, 27 bp, Artificial sequence
  SiRNA target sequence
caaatagaggtagacataaaaaataaa

SEQ ID NO: 18636 - DNA, 27 bp, Artificial sequence
  SiRNA target sequence
aaatagaggtagacataaaaaataaat

SEQ ID NO: 18637 - DNA, 27 bp, Artificial sequence
  SiRNA target sequence
aatagaggtagacataaaaaataaata

SEQ ID NO: 18638 - DNA, 27 bp, Artificial sequence
  SiRNA target sequence
atagaggtagacataaaaaataaatac

SEQ ID NO: 18639 - DNA, 27 bp, Artificial sequence
  SiRNA target sequence
tagaggtagacataaaaaataaataca

SEQ ID NO: 18640 - DNA, 27 bp, Artificial sequence
  SiRNA target sequence
agaggtagacataaaaaataaatacaa

SEQ ID NO: 18641 - DNA, 27 bp, Artificial sequence
  SiRNA target sequence
gaggtagacataaaaaataaatacaat

SEQ ID NO: 18642 - DNA, 27 bp, Artificial sequence
  SiRNA target sequence
aggtagacataaaaaataaatacaata

SEQ ID NO: 18643 - DNA, 27 bp, Artificial sequence
  SiRNA target sequence
ggtagacataaaaaataaatacaataa

SEQ ID NO: 18644 - DNA, 27 bp, Artificial sequence
  SiRNA target sequence
gtagacataaaaaataaatacaataat

SEQ ID NO: 18645 - DNA, 27 bp, Artificial sequence
  SiRNA target sequence
tagacataaaaaataaatacaataata

SEQ ID NO: 18646 - DNA, 27 bp, Artificial sequence
  SiRNA target sequence
agacataaaaaataaatacaataatat

SEQ ID NO: 18647 - DNA, 27 bp, Artificial sequence
  SiRNA target sequence
gacataaaaaataaatacaataatatg

SEQ ID NO: 18648 - DNA, 27 bp, Artificial sequence
  SiRNA target sequence
acataaaaaataaatacaataatatgt

SEQ ID NO: 18649 - DNA, 27 bp, Artificial sequence
  SiRNA target sequence
cataaaaaataaatacaataatatgtg

SEQ ID NO: 18650 - DNA, 27 bp, Artificial sequence
  SiRNA target sequence
ataaaaaataaatacaataatatgtgt

SEQ ID NO: 18651 - DNA, 27 bp, Artificial sequence
  SiRNA target sequence
taaaaaataaatacaataatatgtgta

SEQ ID NO: 18652 - DNA, 27 bp, Artificial sequence
  SiRNA target sequence
aaaaaataaatacaataatatgtgtat

SEQ ID NO: 18653 - DNA, 27 bp, Artificial sequence
  SiRNA target sequence
aaaaataaatacaataatatgtgtata

SEQ ID NO: 18654 - DNA, 27 bp, Artificial sequence
  SiRNA target sequence
aaaataaatacaataatatgtgtataa

SEQ ID NO: 18655 - DNA, 27 bp, Artificial sequence
  SiRNA target sequence
aaataaatacaataatatgtgtataaa

SEQ ID NO: 18656 - DNA, 27 bp, Artificial sequence
  SiRNA target sequence
aataaatacaataatatgtgtataaaa

SEQ ID NO: 18657 - DNA, 27 bp, Artificial sequence
  SiRNA target sequence
ataaatacaataatatgtgtataaaaa

SEQ ID NO: 18658 - DNA, 27 bp, Artificial sequence
  SiRNA target sequence
taaatacaataatatgtgtataaaaat

SEQ ID NO: 18659 - DNA, 27 bp, Artificial sequence
  SiRNA target sequence
aaatacaataatatgtgtataaaaatg

SEQ ID NO: 18660 - DNA, 27 bp, Artificial sequence
  SiRNA target sequence
aatacaataatatgtgtataaaaatga

SEQ ID NO: 18661 - DNA, 27 bp, Artificial sequence
  SiRNA target sequence
atacaataatatgtgtataaaaatgat

SEQ ID NO: 18662 - DNA, 27 bp, Artificial sequence
  SiRNA target sequence
tacaataatatgtgtataaaaatgata

SEQ ID NO: 18663 - DNA, 27 bp, Artificial sequence
  SiRNA target sequence
acaataatatgtgtataaaaatgatac

SEQ ID NO: 18664 - DNA, 27 bp, Artificial sequence
  SiRNA target sequence
caataatatgtgtataaaaatgataca

SEQ ID NO: 18665 - DNA, 27 bp, Artificial sequence
  SiRNA target sequence
aataatatgtgtataaaaatgatacag

SEQ ID NO: 18666 - DNA, 27 bp, Artificial sequence
  SiRNA target sequence
ataatatgtgtataaaaatgatacagc

SEQ ID NO: 18667 - DNA, 27 bp, Artificial sequence
  SiRNA target sequence
taatatgtgtataaaaatgatacagcc

SEQ ID NO: 18668 - DNA, 27 bp, Artificial sequence
  SiRNA target sequence
aatatgtgtataaaaatgatacagcca

SEQ ID NO: 18669 - DNA, 27 bp, Artificial sequence
  SiRNA target sequence
atatgtgtataaaaatgatacagccag

SEQ ID NO: 18670 - DNA, 27 bp, Artificial sequence
  SiRNA target sequence
tatgtgtataaaaatgatacagccagc

SEQ ID NO: 18671 - DNA, 27 bp, Artificial sequence
  SiRNA target sequence
atgtgtataaaaatgatacagccagct

SEQ ID NO: 18672 - DNA, 27 bp, Artificial sequence
  SiRNA target sequence
tgtgtataaaaatgatacagccagcta

SEQ ID NO: 18673 - DNA, 27 bp, Artificial sequence
  SiRNA target sequence
gtgtataaaaatgatacagccagctat

SEQ ID NO: 18674 - DNA, 27 bp, Artificial sequence
  SiRNA target sequence
tgtataaaaatgatacagccagctatt

SEQ ID NO: 18675 - DNA, 27 bp, Artificial sequence
  SiRNA target sequence
gtataaaaatgatacagccagctatta

SEQ ID NO: 18676 - DNA, 27 bp, Artificial sequence
  SiRNA target sequence
tataaaaatgatacagccagctattaa

SEQ ID NO: 18677 - DNA, 27 bp, Artificial sequence
  SiRNA target sequence
ataaaaatgatacagccagctattaaa

SEQ ID NO: 18678 - DNA, 27 bp, Artificial sequence
  SiRNA target sequence
taaaaatgatacagccagctattaaag

SEQ ID NO: 18679 - DNA, 27 bp, Artificial sequence
  SiRNA target sequence
aaaaatgatacagccagctattaaagg

SEQ ID NO: 18680 - DNA, 27 bp, Artificial sequence
  SiRNA target sequence
aaaatgatacagccagctattaaaggt

SEQ ID NO: 18681 - DNA, 27 bp, Artificial sequence
  SiRNA target sequence
aaatgatacagccagctattaaaggtg

SEQ ID NO: 18682 - DNA, 27 bp, Artificial sequence
  SiRNA target sequence
aatgatacagccagctattaaaggtgc

SEQ ID NO: 18683 - DNA, 27 bp, Artificial sequence
  SiRNA target sequence
atgatacagccagctattaaaggtgct

SEQ ID NO: 18684 - DNA, 27 bp, Artificial sequence
  SiRNA target sequence
tgatacagccagctattaaaggtgctt

SEQ ID NO: 18685 - DNA, 27 bp, Artificial sequence
  SiRNA target sequence
gatacagccagctattaaaggtgcttc

SEQ ID NO: 18686 - DNA, 27 bp, Artificial sequence
  SiRNA target sequence
atacagccagctattaaaggtgcttca

SEQ ID NO: 18687 - DNA, 27 bp, Artificial sequence
  SiRNA target sequence
tacagccagctattaaaggtgcttcat

SEQ ID NO: 18688 - DNA, 27 bp, Artificial sequence
  SiRNA target sequence
acagccagctattaaaggtgcttcatg

SEQ ID NO: 18689 - DNA, 27 bp, Artificial sequence
  SiRNA target sequence
cagccagctattaaaggtgcttcatgt

SEQ ID NO: 18690 - DNA, 27 bp, Artificial sequence
  SiRNA target sequence
agccagctattaaaggtgcttcatgta

SEQ ID NO: 18691 - DNA, 27 bp, Artificial sequence
  SiRNA target sequence
gccagctattaaaggtgcttcatgtat

SEQ ID NO: 18692 - DNA, 27 bp, Artificial sequence
  SiRNA target sequence
ccagctattaaaggtgcttcatgtata

SEQ ID NO: 18693 - DNA, 27 bp, Artificial sequence
  SiRNA target sequence
cagctattaaaggtgcttcatgtatat

SEQ ID NO: 18694 - DNA, 27 bp, Artificial sequence
  SiRNA target sequence
agctattaaaggtgcttcatgtatata

SEQ ID NO: 18695 - DNA, 27 bp, Artificial sequence
  SiRNA target sequence
gctattaaaggtgcttcatgtatatac

SEQ ID NO: 18696 - DNA, 27 bp, Artificial sequence
  SiRNA target sequence
ctattaaaggtgcttcatgtatatacg

SEQ ID NO: 18697 - DNA, 27 bp, Artificial sequence
  SiRNA target sequence
tattaaaggtgcttcatgtatatacgt

SEQ ID NO: 18698 - DNA, 27 bp, Artificial sequence
  SiRNA target sequence
attaaaggtgcttcatgtatatacgtg

SEQ ID NO: 18699 - DNA, 27 bp, Artificial sequence
  SiRNA target sequence
ttaaaggtgcttcatgtatatacgtgg

SEQ ID NO: 18700 - DNA, 27 bp, Artificial sequence
  SiRNA target sequence
taaaggtgcttcatgtatatacgtggg

SEQ ID NO: 18701 - DNA, 27 bp, Artificial sequence
  SiRNA target sequence
aaaggtgcttcatgtatatacgtgggt

SEQ ID NO: 18702 - DNA, 27 bp, Artificial sequence
  SiRNA target sequence
aaggtgcttcatgtatatacgtgggta

SEQ ID NO: 18703 - DNA, 27 bp, Artificial sequence
  SiRNA target sequence
aggtgcttcatgtatatacgtgggtaa

SEQ ID NO: 18704 - DNA, 27 bp, Artificial sequence
  SiRNA target sequence
ggtgcttcatgtatatacgtgggtaat

SEQ ID NO: 18705 - DNA, 27 bp, Artificial sequence
  SiRNA target sequence
gtgcttcatgtatatacgtgggtaatt

SEQ ID NO: 18706 - DNA, 27 bp, Artificial sequence
  SiRNA target sequence
tgcttcatgtatatacgtgggtaatta

SEQ ID NO: 18707 - DNA, 27 bp, Artificial sequence
  SiRNA target sequence
gcttcatgtatatacgtgggtaattat

SEQ ID NO: 18708 - DNA, 27 bp, Artificial sequence
  SiRNA target sequence
cttcatgtatatacgtgggtaattata

SEQ ID NO: 18709 - DNA, 27 bp, Artificial sequence
  SiRNA target sequence
ttcatgtatatacgtgggtaattatat

SEQ ID NO: 18710 - DNA, 27 bp, Artificial sequence
  SiRNA target sequence
tcatgtatatacgtgggtaattatatg

SEQ ID NO: 18711 - DNA, 27 bp, Artificial sequence
  SiRNA target sequence
catgtatatacgtgggtaattatatgc

SEQ ID NO: 18712 - DNA, 27 bp, Artificial sequence
  SiRNA target sequence
atgtatatacgtgggtaattatatgca

SEQ ID NO: 18713 - DNA, 27 bp, Artificial sequence
  SiRNA target sequence
tgtatatacgtgggtaattatatgcag

SEQ ID NO: 18714 - DNA, 27 bp, Artificial sequence
  SiRNA target sequence
gtatatacgtgggtaattatatgcagc

SEQ ID NO: 18715 - DNA, 27 bp, Artificial sequence
  SiRNA target sequence
tatatacgtgggtaattatatgcagca

SEQ ID NO: 18716 - DNA, 27 bp, Artificial sequence
  SiRNA target sequence
atatacgtgggtaattatatgcagcag

SEQ ID NO: 18717 - DNA, 27 bp, Artificial sequence
  SiRNA target sequence
tatacgtgggtaattatatgcagcagc

SEQ ID NO: 18718 - DNA, 27 bp, Artificial sequence
  SiRNA target sequence
atacgtgggtaattatatgcagcagct

SEQ ID NO: 18719 - DNA, 27 bp, Artificial sequence
  SiRNA target sequence
tacgtgggtaattatatgcagcagcta

SEQ ID NO: 18720 - DNA, 27 bp, Artificial sequence
  SiRNA target sequence
acgtgggtaattatatgcagcagctag

SEQ ID NO: 18721 - DNA, 27 bp, Artificial sequence
  SiRNA target sequence
cgtgggtaattatatgcagcagctagg

SEQ ID NO: 18722 - DNA, 27 bp, Artificial sequence
  SiRNA target sequence
gtgggtaattatatgcagcagctagga

SEQ ID NO: 18723 - DNA, 27 bp, Artificial sequence
  SiRNA target sequence
tgggtaattatatgcagcagctaggag

SEQ ID NO: 18724 - DNA, 27 bp, Artificial sequence
  SiRNA target sequence
gggtaattatatgcagcagctaggagt

SEQ ID NO: 18725 - DNA, 27 bp, Artificial sequence
  SiRNA target sequence
ggtaattatatgcagcagctaggagta

SEQ ID NO: 18726 - DNA, 27 bp, Artificial sequence
  SiRNA target sequence
gtaattatatgcagcagctaggagtaa

SEQ ID NO: 18727 - DNA, 27 bp, Artificial sequence
  SiRNA target sequence
taattatatgcagcagctaggagtaat

SEQ ID NO: 18728 - DNA, 27 bp, Artificial sequence
  SiRNA target sequence
aattatatgcagcagctaggagtaatt

SEQ ID NO: 18729 - DNA, 27 bp, Artificial sequence
  SiRNA target sequence
attatatgcagcagctaggagtaatta

SEQ ID NO: 18730 - DNA, 27 bp, Artificial sequence
  SiRNA target sequence
ttatatgcagcagctaggagtaattag

SEQ ID NO: 18731 - DNA, 27 bp, Artificial sequence
  SiRNA target sequence
tatatgcagcagctaggagtaattagt

SEQ ID NO: 18732 - DNA, 27 bp, Artificial sequence
  SiRNA target sequence
atatgcagcagctaggagtaattagtc

SEQ ID NO: 18733 - DNA, 27 bp, Artificial sequence
  SiRNA target sequence
tatgcagcagctaggagtaattagtct

SEQ ID NO: 18734 - DNA, 27 bp, Artificial sequence
  SiRNA target sequence
atgcagcagctaggagtaattagtctt

SEQ ID NO: 18735 - DNA, 27 bp, Artificial sequence
  SiRNA target sequence
tgcagcagctaggagtaattagtcttg

SEQ ID NO: 18736 - DNA, 27 bp, Artificial sequence
  SiRNA target sequence
gcagcagctaggagtaattagtcttgg

SEQ ID NO: 18737 - DNA, 27 bp, Artificial sequence
  SiRNA target sequence
cagcagctaggagtaattagtcttggt

SEQ ID NO: 18738 - DNA, 27 bp, Artificial sequence
  SiRNA target sequence
agcagctaggagtaattagtcttggtg

SEQ ID NO: 18739 - DNA, 27 bp, Artificial sequence
  SiRNA target sequence
gcagctaggagtaattagtcttggtgg

SEQ ID NO: 18740 - DNA, 27 bp, Artificial sequence
  SiRNA target sequence
cagctaggagtaattagtcttggtggg

SEQ ID NO: 18741 - DNA, 27 bp, Artificial sequence
  SiRNA target sequence
agctaggagtaattagtcttggtgggg

SEQ ID NO: 18742 - DNA, 27 bp, Artificial sequence
  SiRNA target sequence
gctaggagtaattagtcttggtgggga

SEQ ID NO: 18743 - DNA, 27 bp, Artificial sequence
  SiRNA target sequence
ctaggagtaattagtcttggtggggag

SEQ ID NO: 18744 - DNA, 27 bp, Artificial sequence
  SiRNA target sequence
taggagtaattagtcttggtggggaga

SEQ ID NO: 18745 - DNA, 27 bp, Artificial sequence
  SiRNA target sequence
aggagtaattagtcttggtggggagat

SEQ ID NO: 18746 - DNA, 27 bp, Artificial sequence
  SiRNA target sequence
ggagtaattagtcttggtggggagatt

SEQ ID NO: 18747 - DNA, 27 bp, Artificial sequence
  SiRNA target sequence
gagtaattagtcttggtggggagatta

SEQ ID NO: 18748 - DNA, 27 bp, Artificial sequence
  SiRNA target sequence
agtaattagtcttggtggggagattat

SEQ ID NO: 18749 - DNA, 27 bp, Artificial sequence
  SiRNA target sequence
gtaattagtcttggtggggagattatt

SEQ ID NO: 18750 - DNA, 27 bp, Artificial sequence
  SiRNA target sequence
taattagtcttggtggggagattatta

SEQ ID NO: 18751 - DNA, 27 bp, Artificial sequence
  SiRNA target sequence
aattagtcttggtggggagattattaa

SEQ ID NO: 18752 - DNA, 27 bp, Artificial sequence
  SiRNA target sequence
attagtcttggtggggagattattaaa

SEQ ID NO: 18753 - DNA, 27 bp, Artificial sequence
  SiRNA target sequence
ttagtcttggtggggagattattaaag

SEQ ID NO: 18754 - DNA, 27 bp, Artificial sequence
  SiRNA target sequence
tagtcttggtggggagattattaaagc

SEQ ID NO: 18755 - DNA, 27 bp, Artificial sequence
  SiRNA target sequence
agtcttggtggggagattattaaagct

SEQ ID NO: 18756 - DNA, 27 bp, Artificial sequence
  SiRNA target sequence
gtcttggtggggagattattaaagctg

SEQ ID NO: 18757 - DNA, 27 bp, Artificial sequence
  SiRNA target sequence
tcttggtggggagattattaaagctga

SEQ ID NO: 18758 - DNA, 27 bp, Artificial sequence
  SiRNA target sequence
cttggtggggagattattaaagctgat

SEQ ID NO: 18759 - DNA, 27 bp, Artificial sequence
  SiRNA target sequence
ttggtggggagattattaaagctgatg

SEQ ID NO: 18760 - DNA, 27 bp, Artificial sequence
  SiRNA target sequence
tggtggggagattattaaagctgatga

SEQ ID NO: 18761 - DNA, 27 bp, Artificial sequence
  SiRNA target sequence
ggtggggagattattaaagctgatgaa

SEQ ID NO: 18762 - DNA, 27 bp, Artificial sequence
  SiRNA target sequence
gtggggagattattaaagctgatgaat

SEQ ID NO: 18763 - DNA, 27 bp, Artificial sequence
  SiRNA target sequence
tggggagattattaaagctgatgaata

SEQ ID NO: 18764 - DNA, 27 bp, Artificial sequence
  SiRNA target sequence
ggggagattattaaagctgatgaatac

SEQ ID NO: 18765 - DNA, 27 bp, Artificial sequence
  SiRNA target sequence
gggagattattaaagctgatgaataca

SEQ ID NO: 18766 - DNA, 27 bp, Artificial sequence
  SiRNA target sequence
ggagattattaaagctgatgaatacat

SEQ ID NO: 18767 - DNA, 27 bp, Artificial sequence
  SiRNA target sequence
gagattattaaagctgatgaatacatt

SEQ ID NO: 18768 - DNA, 27 bp, Artificial sequence
  SiRNA target sequence
agattattaaagctgatgaatacattg

SEQ ID NO: 18769 - DNA, 27 bp, Artificial sequence
  SiRNA target sequence
gattattaaagctgatgaatacattgg

SEQ ID NO: 18770 - DNA, 27 bp, Artificial sequence
  SiRNA target sequence
attattaaagctgatgaatacattgga

SEQ ID NO: 18771 - DNA, 27 bp, Artificial sequence
  SiRNA target sequence
ttattaaagctgatgaatacattggac

SEQ ID NO: 18772 - DNA, 27 bp, Artificial sequence
  SiRNA target sequence
tattaaagctgatgaatacattggact

SEQ ID NO: 18773 - DNA, 27 bp, Artificial sequence
  SiRNA target sequence
attaaagctgatgaatacattggacta

SEQ ID NO: 18774 - DNA, 27 bp, Artificial sequence
  SiRNA target sequence
ttaaagctgatgaatacattggactat

SEQ ID NO: 18775 - DNA, 27 bp, Artificial sequence
  SiRNA target sequence
taaagctgatgaatacattggactatc

SEQ ID NO: 18776 - DNA, 27 bp, Artificial sequence
  SiRNA target sequence
aaagctgatgaatacattggactatct

SEQ ID NO: 18777 - DNA, 27 bp, Artificial sequence
  SiRNA target sequence
aagctgatgaatacattggactatctt

SEQ ID NO: 18778 - DNA, 27 bp, Artificial sequence
  SiRNA target sequence
agctgatgaatacattggactatcttt

SEQ ID NO: 18779 - DNA, 27 bp, Artificial sequence
  SiRNA target sequence
gctgatgaatacattggactatctttt

SEQ ID NO: 18780 - DNA, 27 bp, Artificial sequence
  SiRNA target sequence
ctgatgaatacattggactatcttttg

SEQ ID NO: 18781 - DNA, 27 bp, Artificial sequence
  SiRNA target sequence
tgatgaatacattggactatcttttgt

SEQ ID NO: 18782 - DNA, 27 bp, Artificial sequence
  SiRNA target sequence
gatgaatacattggactatcttttgta

SEQ ID NO: 18783 - DNA, 27 bp, Artificial sequence
  SiRNA target sequence
atgaatacattggactatcttttgtag

SEQ ID NO: 18784 - DNA, 27 bp, Artificial sequence
  SiRNA target sequence
tgaatacattggactatcttttgtagg

SEQ ID NO: 18785 - DNA, 27 bp, Artificial sequence
  SiRNA target sequence
gaatacattggactatcttttgtaggg

SEQ ID NO: 18786 - DNA, 27 bp, Artificial sequence
  SiRNA target sequence
aatacattggactatcttttgtaggga

SEQ ID NO: 18787 - DNA, 27 bp, Artificial sequence
  SiRNA target sequence
atacattggactatcttttgtagggag

SEQ ID NO: 18788 - DNA, 27 bp, Artificial sequence
  SiRNA target sequence
tacattggactatcttttgtagggaga

SEQ ID NO: 18789 - DNA, 27 bp, Artificial sequence
  SiRNA target sequence
acattggactatcttttgtagggagat

SEQ ID NO: 18790 - DNA, 27 bp, Artificial sequence
  SiRNA target sequence
cattggactatcttttgtagggagata

SEQ ID NO: 18791 - DNA, 27 bp, Artificial sequence
  SiRNA target sequence
attggactatcttttgtagggagatat

SEQ ID NO: 18792 - DNA, 27 bp, Artificial sequence
  SiRNA target sequence
ttggactatcttttgtagggagatatg

SEQ ID NO: 18793 - DNA, 27 bp, Artificial sequence
  SiRNA target sequence
tggactatcttttgtagggagatatga

SEQ ID NO: 18794 - DNA, 27 bp, Artificial sequence
  SiRNA target sequence
ggactatcttttgtagggagatatgaa

SEQ ID NO: 18795 - DNA, 27 bp, Artificial sequence
  SiRNA target sequence
gactatcttttgtagggagatatgaag

SEQ ID NO: 18796 - DNA, 27 bp, Artificial sequence
  SiRNA target sequence
actatcttttgtagggagatatgaagg

SEQ ID NO: 18797 - DNA, 27 bp, Artificial sequence
  SiRNA target sequence
ctatcttttgtagggagatatgaaggg

SEQ ID NO: 18798 - DNA, 27 bp, Artificial sequence
  SiRNA target sequence
tatcttttgtagggagatatgaaggga

SEQ ID NO: 18799 - DNA, 27 bp, Artificial sequence
  SiRNA target sequence
atcttttgtagggagatatgaagggat

SEQ ID NO: 18800 - DNA, 27 bp, Artificial sequence
  SiRNA target sequence
tcttttgtagggagatatgaagggatt

SEQ ID NO: 18801 - DNA, 27 bp, Artificial sequence
  SiRNA target sequence
cttttgtagggagatatgaagggattg

SEQ ID NO: 18802 - DNA, 27 bp, Artificial sequence
  SiRNA target sequence
ttttgtagggagatatgaagggattgg

SEQ ID NO: 18803 - DNA, 27 bp, Artificial sequence
  SiRNA target sequence
tttgtagggagatatgaagggattggt

SEQ ID NO: 18804 - DNA, 27 bp, Artificial sequence
  SiRNA target sequence
ttgtagggagatatgaagggattggtt

SEQ ID NO: 18805 - DNA, 27 bp, Artificial sequence
  SiRNA target sequence
tgtagggagatatgaagggattggttc

SEQ ID NO: 18806 - DNA, 27 bp, Artificial sequence
  SiRNA target sequence
gtagggagatatgaagggattggttct

SEQ ID NO: 18807 - DNA, 27 bp, Artificial sequence
  SiRNA target sequence
tagggagatatgaagggattggttcta

SEQ ID NO: 18808 - DNA, 27 bp, Artificial sequence
  SiRNA target sequence
agggagatatgaagggattggttctat

SEQ ID NO: 18809 - DNA, 27 bp, Artificial sequence
  SiRNA target sequence
gggagatatgaagggattggttctatt

SEQ ID NO: 18810 - DNA, 27 bp, Artificial sequence
  SiRNA target sequence
ggagatatgaagggattggttctattt

SEQ ID NO: 18811 - DNA, 27 bp, Artificial sequence
  SiRNA target sequence
gagatatgaagggattggttctatttc

SEQ ID NO: 18812 - DNA, 27 bp, Artificial sequence
  SiRNA target sequence
agatatgaagggattggttctatttct

SEQ ID NO: 18813 - DNA, 27 bp, Artificial sequence
  SiRNA target sequence
gatatgaagggattggttctatttcta

SEQ ID NO: 18814 - DNA, 27 bp, Artificial sequence
  SiRNA target sequence
atatgaagggattggttctatttctac

SEQ ID NO: 18815 - DNA, 27 bp, Artificial sequence
  SiRNA target sequence
tatgaagggattggttctatttctact

SEQ ID NO: 18816 - DNA, 27 bp, Artificial sequence
  SiRNA target sequence
atgaagggattggttctatttctacta

SEQ ID NO: 18817 - DNA, 27 bp, Artificial sequence
  SiRNA target sequence
tgaagggattggttctatttctactat

SEQ ID NO: 18818 - DNA, 27 bp, Artificial sequence
  SiRNA target sequence
gaagggattggttctatttctactata

SEQ ID NO: 18819 - DNA, 27 bp, Artificial sequence
  SiRNA target sequence
aagggattggttctatttctactatat

SEQ ID NO: 18820 - DNA, 27 bp, Artificial sequence
  SiRNA target sequence
agggattggttctatttctactatatc

SEQ ID NO: 18821 - DNA, 27 bp, Artificial sequence
  SiRNA target sequence
gggattggttctatttctactatatca

SEQ ID NO: 18822 - DNA, 27 bp, Artificial sequence
  SiRNA target sequence
ggattggttctatttctactatatcac

SEQ ID NO: 18823 - DNA, 27 bp, Artificial sequence
  SiRNA target sequence
gattggttctatttctactatatcact

SEQ ID NO: 18824 - DNA, 27 bp, Artificial sequence
  SiRNA target sequence
attggttctatttctactatatcactt

SEQ ID NO: 18825 - DNA, 27 bp, Artificial sequence
  SiRNA target sequence
ttggttctatttctactatatcacttc

SEQ ID NO: 18826 - DNA, 27 bp, Artificial sequence
  SiRNA target sequence
tggttctatttctactatatcacttca

SEQ ID NO: 18827 - DNA, 27 bp, Artificial sequence
  SiRNA target sequence
ggttctatttctactatatcacttcag

SEQ ID NO: 18828 - DNA, 27 bp, Artificial sequence
  SiRNA target sequence
gttctatttctactatatcacttcagc

SEQ ID NO: 18829 - DNA, 27 bp, Artificial sequence
  SiRNA target sequence
ttctatttctactatatcacttcagca

SEQ ID NO: 18830 - DNA, 27 bp, Artificial sequence
  SiRNA target sequence
tctatttctactatatcacttcagcag

SEQ ID NO: 18831 - DNA, 27 bp, Artificial sequence
  SiRNA target sequence
ctatttctactatatcacttcagcagt

SEQ ID NO: 18832 - DNA, 27 bp, Artificial sequence
  SiRNA target sequence
tatttctactatatcacttcagcagtt

SEQ ID NO: 18833 - DNA, 27 bp, Artificial sequence
  SiRNA target sequence
atttctactatatcacttcagcagttt

SEQ ID NO: 18834 - DNA, 27 bp, Artificial sequence
  SiRNA target sequence
tttctactatatcacttcagcagttta

SEQ ID NO: 18835 - DNA, 27 bp, Artificial sequence
  SiRNA target sequence
ttctactatatcacttcagcagtttaa

SEQ ID NO: 18836 - DNA, 27 bp, Artificial sequence
  SiRNA target sequence
tctactatatcacttcagcagtttaat

SEQ ID NO: 18837 - DNA, 27 bp, Artificial sequence
  SiRNA target sequence
ctactatatcacttcagcagtttaata

SEQ ID NO: 18838 - DNA, 27 bp, Artificial sequence
  SiRNA target sequence
tactatatcacttcagcagtttaatac

SEQ ID NO: 18839 - DNA, 27 bp, Artificial sequence
  SiRNA target sequence
actatatcacttcagcagtttaataca

SEQ ID NO: 18840 - DNA, 27 bp, Artificial sequence
  SiRNA target sequence
ctatatcacttcagcagtttaatacac

SEQ ID NO: 18841 - DNA, 27 bp, Artificial sequence
  SiRNA target sequence
tatatcacttcagcagtttaatacact

SEQ ID NO: 18842 - DNA, 27 bp, Artificial sequence
  SiRNA target sequence
atatcacttcagcagtttaatacactg

SEQ ID NO: 18843 - DNA, 27 bp, Artificial sequence
  SiRNA target sequence
tatcacttcagcagtttaatacactgt

SEQ ID NO: 18844 - DNA, 27 bp, Artificial sequence
  SiRNA target sequence
atcacttcagcagtttaatacactgtc

SEQ ID NO: 18845 - DNA, 27 bp, Artificial sequence
  SiRNA target sequence
tcacttcagcagtttaatacactgtct

SEQ ID NO: 18846 - DNA, 27 bp, Artificial sequence
  SiRNA target sequence
cacttcagcagtttaatacactgtcta

SEQ ID NO: 18847 - DNA, 27 bp, Artificial sequence
  SiRNA target sequence
acttcagcagtttaatacactgtctat

SEQ ID NO: 18848 - DNA, 27 bp, Artificial sequence
  SiRNA target sequence
cttcagcagtttaatacactgtctata

SEQ ID NO: 18849 - DNA, 27 bp, Artificial sequence
  SiRNA target sequence
ttcagcagtttaatacactgtctatag

SEQ ID NO: 18850 - DNA, 27 bp, Artificial sequence
  SiRNA target sequence
tcagcagtttaatacactgtctataga

SEQ ID NO: 18851 - DNA, 27 bp, Artificial sequence
  SiRNA target sequence
cagcagtttaatacactgtctatagat

SEQ ID NO: 18852 - DNA, 27 bp, Artificial sequence
  SiRNA target sequence
agcagtttaatacactgtctatagatt

SEQ ID NO: 18853 - DNA, 27 bp, Artificial sequence
  SiRNA target sequence
gcagtttaatacactgtctatagatta

SEQ ID NO: 18854 - DNA, 27 bp, Artificial sequence
  SiRNA target sequence
cagtttaatacactgtctatagattat

SEQ ID NO: 18855 - DNA, 27 bp, Artificial sequence
  SiRNA target sequence
agtttaatacactgtctatagattatt

SEQ ID NO: 18856 - DNA, 27 bp, Artificial sequence
  SiRNA target sequence
gtttaatacactgtctatagattatta

SEQ ID NO: 18857 - DNA, 27 bp, Artificial sequence
  SiRNA target sequence
tttaatacactgtctatagattattac

SEQ ID NO: 18858 - DNA, 27 bp, Artificial sequence
  SiRNA target sequence
ttaatacactgtctatagattattaca

SEQ ID NO: 18859 - DNA, 27 bp, Artificial sequence
  SiRNA target sequence
taatacactgtctatagattattacaa

SEQ ID NO: 18860 - DNA, 27 bp, Artificial sequence
  SiRNA target sequence
aatacactgtctatagattattacaag

SEQ ID NO: 18861 - DNA, 27 bp, Artificial sequence
  SiRNA target sequence
atacactgtctatagattattacaaga

SEQ ID NO: 18862 - DNA, 27 bp, Artificial sequence
  SiRNA target sequence
tacactgtctatagattattacaagac

SEQ ID NO: 18863 - DNA, 27 bp, Artificial sequence
  SiRNA target sequence
acactgtctatagattattacaagaca

SEQ ID NO: 18864 - DNA, 27 bp, Artificial sequence
  SiRNA target sequence
cactgtctatagattattacaagacat

SEQ ID NO: 18865 - DNA, 27 bp, Artificial sequence
  SiRNA target sequence
actgtctatagattattacaagacatt

SEQ ID NO: 18866 - DNA, 27 bp, Artificial sequence
  SiRNA target sequence
ctgtctatagattattacaagacattg

SEQ ID NO: 18867 - DNA, 27 bp, Artificial sequence
  SiRNA target sequence
tgtctatagattattacaagacattgt

SEQ ID NO: 18868 - DNA, 27 bp, Artificial sequence
  SiRNA target sequence
gtctatagattattacaagacattgtc

SEQ ID NO: 18869 - DNA, 27 bp, Artificial sequence
  SiRNA target sequence
tctatagattattacaagacattgtct

SEQ ID NO: 18870 - DNA, 27 bp, Artificial sequence
  SiRNA target sequence
ctatagattattacaagacattgtctt

SEQ ID NO: 18871 - DNA, 27 bp, Artificial sequence
  SiRNA target sequence
tatagattattacaagacattgtcttc

SEQ ID NO: 18872 - DNA, 27 bp, Artificial sequence
  SiRNA target sequence
atagattattacaagacattgtcttct

SEQ ID NO: 18873 - DNA, 27 bp, Artificial sequence
  SiRNA target sequence
tagattattacaagacattgtcttcta

SEQ ID NO: 18874 - DNA, 27 bp, Artificial sequence
  SiRNA target sequence
agattattacaagacattgtcttctat

SEQ ID NO: 18875 - DNA, 27 bp, Artificial sequence
  SiRNA target sequence
gattattacaagacattgtcttctatt

SEQ ID NO: 18876 - DNA, 27 bp, Artificial sequence
  SiRNA target sequence
attattacaagacattgtcttctattt

SEQ ID NO: 18877 - DNA, 27 bp, Artificial sequence
  SiRNA target sequence
ttattacaagacattgtcttctatttg

SEQ ID NO: 18878 - DNA, 27 bp, Artificial sequence
  SiRNA target sequence
tattacaagacattgtcttctatttgt

SEQ ID NO: 18879 - DNA, 27 bp, Artificial sequence
  SiRNA target sequence
attacaagacattgtcttctatttgtg

SEQ ID NO: 18880 - DNA, 27 bp, Artificial sequence
  SiRNA target sequence
ttacaagacattgtcttctatttgtga

SEQ ID NO: 18881 - DNA, 27 bp, Artificial sequence
  SiRNA target sequence
tacaagacattgtcttctatttgtgac

SEQ ID NO: 18882 - DNA, 27 bp, Artificial sequence
  SiRNA target sequence
acaagacattgtcttctatttgtgacg

SEQ ID NO: 18883 - DNA, 27 bp, Artificial sequence
  SiRNA target sequence
caagacattgtcttctatttgtgacgt

SEQ ID NO: 18884 - DNA, 27 bp, Artificial sequence
  SiRNA target sequence
aagacattgtcttctatttgtgacgta

SEQ ID NO: 18885 - DNA, 27 bp, Artificial sequence
  SiRNA target sequence
agacattgtcttctatttgtgacgtag

SEQ ID NO: 18886 - DNA, 27 bp, Artificial sequence
  SiRNA target sequence
gacattgtcttctatttgtgacgtagg

SEQ ID NO: 18887 - DNA, 27 bp, Artificial sequence
  SiRNA target sequence
acattgtcttctatttgtgacgtaggt

SEQ ID NO: 18888 - DNA, 27 bp, Artificial sequence
  SiRNA target sequence
cattgtcttctatttgtgacgtaggta

SEQ ID NO: 18889 - DNA, 27 bp, Artificial sequence
  SiRNA target sequence
attgtcttctatttgtgacgtaggtat

SEQ ID NO: 18890 - DNA, 27 bp, Artificial sequence
  SiRNA target sequence
ttgtcttctatttgtgacgtaggtatt

SEQ ID NO: 18891 - DNA, 27 bp, Artificial sequence
  SiRNA target sequence
tgtcttctatttgtgacgtaggtatta

SEQ ID NO: 18892 - DNA, 27 bp, Artificial sequence
  SiRNA target sequence
gtcttctatttgtgacgtaggtattaa

SEQ ID NO: 18893 - DNA, 27 bp, Artificial sequence
  SiRNA target sequence
tcttctatttgtgacgtaggtattaaa

SEQ ID NO: 18894 - DNA, 27 bp, Artificial sequence
  SiRNA target sequence
cttctatttgtgacgtaggtattaaaa

SEQ ID NO: 18895 - DNA, 27 bp, Artificial sequence
  SiRNA target sequence
ttctatttgtgacgtaggtattaaaat

SEQ ID NO: 18896 - DNA, 27 bp, Artificial sequence
  SiRNA target sequence
tctatttgtgacgtaggtattaaaata

SEQ ID NO: 18897 - DNA, 27 bp, Artificial sequence
  SiRNA target sequence
ctatttgtgacgtaggtattaaaatat

SEQ ID NO: 18898 - DNA, 27 bp, Artificial sequence
  SiRNA target sequence
tatttgtgacgtaggtattaaaatatc

SEQ ID NO: 18899 - DNA, 27 bp, Artificial sequence
  SiRNA target sequence
atttgtgacgtaggtattaaaatatca

SEQ ID NO: 18900 - DNA, 27 bp, Artificial sequence
  SiRNA target sequence
tttgtgacgtaggtattaaaatatcaa

SEQ ID NO: 18901 - DNA, 27 bp, Artificial sequence
  SiRNA target sequence
ttgtgacgtaggtattaaaatatcaac

SEQ ID NO: 18902 - DNA, 27 bp, Artificial sequence
  SiRNA target sequence
tgtgacgtaggtattaaaatatcaact

SEQ ID NO: 18903 - DNA, 27 bp, Artificial sequence
  SiRNA target sequence
gtgacgtaggtattaaaatatcaactg

SEQ ID NO: 18904 - DNA, 27 bp, Artificial sequence
  SiRNA target sequence
tgacgtaggtattaaaatatcaactga

SEQ ID NO: 18905 - DNA, 27 bp, Artificial sequence
  SiRNA target sequence
gacgtaggtattaaaatatcaactgat

SEQ ID NO: 18906 - DNA, 27 bp, Artificial sequence
  SiRNA target sequence
acgtaggtattaaaatatcaactgata

SEQ ID NO: 18907 - DNA, 27 bp, Artificial sequence
  SiRNA target sequence
cgtaggtattaaaatatcaactgatag

SEQ ID NO: 18908 - DNA, 27 bp, Artificial sequence
  SiRNA target sequence
gtaggtattaaaatatcaactgatagg

SEQ ID NO: 18909 - DNA, 27 bp, Artificial sequence
  SiRNA target sequence
taggtattaaaatatcaactgataggg

SEQ ID NO: 18910 - DNA, 27 bp, Artificial sequence
  SiRNA target sequence
aggtattaaaatatcaactgataggga

SEQ ID NO: 18911 - DNA, 27 bp, Artificial sequence
  SiRNA target sequence
ggtattaaaatatcaactgatagggaa

SEQ ID NO: 18912 - DNA, 27 bp, Artificial sequence
  SiRNA target sequence
gtattaaaatatcaactgatagggaaa

SEQ ID NO: 18913 - DNA, 27 bp, Artificial sequence
  SiRNA target sequence
tattaaaatatcaactgatagggaaaa

SEQ ID NO: 18914 - DNA, 27 bp, Artificial sequence
  SiRNA target sequence
attaaaatatcaactgatagggaaaaa

SEQ ID NO: 18915 - DNA, 27 bp, Artificial sequence
  SiRNA target sequence
ttaaaatatcaactgatagggaaaaat

SEQ ID NO: 18916 - DNA, 27 bp, Artificial sequence
  SiRNA target sequence
taaaatatcaactgatagggaaaaatc

SEQ ID NO: 18917 - DNA, 27 bp, Artificial sequence
  SiRNA target sequence
aaaatatcaactgatagggaaaaatca

SEQ ID NO: 18918 - DNA, 27 bp, Artificial sequence
  SiRNA target sequence
aaatatcaactgatagggaaaaatcag

SEQ ID NO: 18919 - DNA, 27 bp, Artificial sequence
  SiRNA target sequence
aatatcaactgatagggaaaaatcagt

SEQ ID NO: 18920 - DNA, 27 bp, Artificial sequence
  SiRNA target sequence
atatcaactgatagggaaaaatcagtt

SEQ ID NO: 18921 - DNA, 27 bp, Artificial sequence
  SiRNA target sequence
tatcaactgatagggaaaaatcagtta

SEQ ID NO: 18922 - DNA, 27 bp, Artificial sequence
  SiRNA target sequence
atcaactgatagggaaaaatcagttaa

SEQ ID NO: 18923 - DNA, 27 bp, Artificial sequence
  SiRNA target sequence
tcaactgatagggaaaaatcagttaat

SEQ ID NO: 18924 - DNA, 27 bp, Artificial sequence
  SiRNA target sequence
caactgatagggaaaaatcagttaatt

SEQ ID NO: 18925 - DNA, 27 bp, Artificial sequence
  SiRNA target sequence
aactgatagggaaaaatcagttaatta

SEQ ID NO: 18926 - DNA, 27 bp, Artificial sequence
  SiRNA target sequence
actgatagggaaaaatcagttaattat

SEQ ID NO: 18927 - DNA, 27 bp, Artificial sequence
  SiRNA target sequence
ctgatagggaaaaatcagttaattatg

SEQ ID NO: 18928 - DNA, 27 bp, Artificial sequence
  SiRNA target sequence
tgatagggaaaaatcagttaattatgg

SEQ ID NO: 18929 - DNA, 27 bp, Artificial sequence
  SiRNA target sequence
gatagggaaaaatcagttaattatgga

SEQ ID NO: 18930 - DNA, 27 bp, Artificial sequence
  SiRNA target sequence
atagggaaaaatcagttaattatggat

SEQ ID NO: 18931 - DNA, 27 bp, Artificial sequence
  SiRNA target sequence
tagggaaaaatcagttaattatggatt

SEQ ID NO: 18932 - DNA, 27 bp, Artificial sequence
  SiRNA target sequence
agggaaaaatcagttaattatggatta

SEQ ID NO: 18933 - DNA, 27 bp, Artificial sequence
  SiRNA target sequence
gggaaaaatcagttaattatggattag

SEQ ID NO: 18934 - DNA, 27 bp, Artificial sequence
  SiRNA target sequence
ggaaaaatcagttaattatggattagg

SEQ ID NO: 18935 - DNA, 27 bp, Artificial sequence
  SiRNA target sequence
gaaaaatcagttaattatggattagga

SEQ ID NO: 18936 - DNA, 27 bp, Artificial sequence
  SiRNA target sequence
aaaaatcagttaattatggattaggag

SEQ ID NO: 18937 - DNA, 27 bp, Artificial sequence
  SiRNA target sequence
aaaatcagttaattatggattaggagt

SEQ ID NO: 18938 - DNA, 27 bp, Artificial sequence
  SiRNA target sequence
aaatcagttaattatggattaggagtt

SEQ ID NO: 18939 - DNA, 27 bp, Artificial sequence
  SiRNA target sequence
aatcagttaattatggattaggagtta

SEQ ID NO: 18940 - DNA, 27 bp, Artificial sequence
  SiRNA target sequence
atcagttaattatggattaggagttaa

SEQ ID NO: 18941 - DNA, 27 bp, Artificial sequence
  SiRNA target sequence
tcagttaattatggattaggagttaaa

SEQ ID NO: 18942 - DNA, 27 bp, Artificial sequence
  SiRNA target sequence
cagttaattatggattaggagttaaac

SEQ ID NO: 18943 - DNA, 27 bp, Artificial sequence
  SiRNA target sequence
agttaattatggattaggagttaaact

SEQ ID NO: 18944 - DNA, 27 bp, Artificial sequence
  SiRNA target sequence
gttaattatggattaggagttaaacta

SEQ ID NO: 18945 - DNA, 27 bp, Artificial sequence
  SiRNA target sequence
ttaattatggattaggagttaaactac

SEQ ID NO: 18946 - DNA, 27 bp, Artificial sequence
  SiRNA target sequence
taattatggattaggagttaaactaca

SEQ ID NO: 18947 - DNA, 27 bp, Artificial sequence
  SiRNA target sequence
aattatggattaggagttaaactacac

SEQ ID NO: 18948 - DNA, 27 bp, Artificial sequence
  SiRNA target sequence
attatggattaggagttaaactacaca

SEQ ID NO: 18949 - DNA, 27 bp, Artificial sequence
  SiRNA target sequence
ttatggattaggagttaaactacacag

SEQ ID NO: 18950 - DNA, 27 bp, Artificial sequence
  SiRNA target sequence
tatggattaggagttaaactacacagt

SEQ ID NO: 18951 - DNA, 27 bp, Artificial sequence
  SiRNA target sequence
atggattaggagttaaactacacagta

SEQ ID NO: 18952 - DNA, 27 bp, Artificial sequence
  SiRNA target sequence
tggattaggagttaaactacacagtaa

SEQ ID NO: 18953 - DNA, 27 bp, Artificial sequence
  SiRNA target sequence
ggattaggagttaaactacacagtaaa

SEQ ID NO: 18954 - DNA, 27 bp, Artificial sequence
  SiRNA target sequence
gattaggagttaaactacacagtaaaa

SEQ ID NO: 18955 - DNA, 27 bp, Artificial sequence
  SiRNA target sequence
attaggagttaaactacacagtaaaaa

SEQ ID NO: 18956 - DNA, 27 bp, Artificial sequence
  SiRNA target sequence
ttaggagttaaactacacagtaaaaaa

SEQ ID NO: 18957 - DNA, 27 bp, Artificial sequence
  SiRNA target sequence
taggagttaaactacacagtaaaaaag

SEQ ID NO: 18958 - DNA, 27 bp, Artificial sequence
  SiRNA target sequence
aggagttaaactacacagtaaaaaagg

SEQ ID NO: 18959 - DNA, 27 bp, Artificial sequence
  SiRNA target sequence
ggagttaaactacacagtaaaaaagga

SEQ ID NO: 18960 - DNA, 27 bp, Artificial sequence
  SiRNA target sequence
gagttaaactacacagtaaaaaaggag

SEQ ID NO: 18961 - DNA, 27 bp, Artificial sequence
  SiRNA target sequence
agttaaactacacagtaaaaaaggaga

SEQ ID NO: 18962 - DNA, 27 bp, Artificial sequence
  SiRNA target sequence
gttaaactacacagtaaaaaaggagaa

SEQ ID NO: 18963 - DNA, 27 bp, Artificial sequence
  SiRNA target sequence
ttaaactacacagtaaaaaaggagaaa

SEQ ID NO: 18964 - DNA, 27 bp, Artificial sequence
  SiRNA target sequence
taaactacacagtaaaaaaggagaaat

SEQ ID NO: 18965 - DNA, 27 bp, Artificial sequence
  SiRNA target sequence
aaactacacagtaaaaaaggagaaatt

SEQ ID NO: 18966 - DNA, 27 bp, Artificial sequence
  SiRNA target sequence
aactacacagtaaaaaaggagaaatta

SEQ ID NO: 18967 - DNA, 27 bp, Artificial sequence
  SiRNA target sequence
actacacagtaaaaaaggagaaattat

SEQ ID NO: 18968 - DNA, 27 bp, Artificial sequence
  SiRNA target sequence
ctacacagtaaaaaaggagaaattatc

SEQ ID NO: 18969 - DNA, 27 bp, Artificial sequence
  SiRNA target sequence
tacacagtaaaaaaggagaaattatcg

SEQ ID NO: 18970 - DNA, 27 bp, Artificial sequence
  SiRNA target sequence
acacagtaaaaaaggagaaattatcgg

SEQ ID NO: 18971 - DNA, 27 bp, Artificial sequence
  SiRNA target sequence
cacagtaaaaaaggagaaattatcgga

SEQ ID NO: 18972 - DNA, 27 bp, Artificial sequence
  SiRNA target sequence
acagtaaaaaaggagaaattatcggat

SEQ ID NO: 18973 - DNA, 27 bp, Artificial sequence
  SiRNA target sequence
cagtaaaaaaggagaaattatcggatg

SEQ ID NO: 18974 - DNA, 27 bp, Artificial sequence
  SiRNA target sequence
agtaaaaaaggagaaattatcggatgt

SEQ ID NO: 18975 - DNA, 27 bp, Artificial sequence
  SiRNA target sequence
gtaaaaaaggagaaattatcggatgtg

SEQ ID NO: 18976 - DNA, 27 bp, Artificial sequence
  SiRNA target sequence
taaaaaaggagaaattatcggatgtgt

SEQ ID NO: 18977 - DNA, 27 bp, Artificial sequence
  SiRNA target sequence
aaaaaaggagaaattatcggatgtgta

SEQ ID NO: 18978 - DNA, 27 bp, Artificial sequence
  SiRNA target sequence
aaaaaggagaaattatcggatgtgtag

SEQ ID NO: 18979 - DNA, 27 bp, Artificial sequence
  SiRNA target sequence
aaaaggagaaattatcggatgtgtaga

SEQ ID NO: 18980 - DNA, 27 bp, Artificial sequence
  SiRNA target sequence
aaaggagaaattatcggatgtgtagat

SEQ ID NO: 18981 - DNA, 27 bp, Artificial sequence
  SiRNA target sequence
aaggagaaattatcggatgtgtagata

SEQ ID NO: 18982 - DNA, 27 bp, Artificial sequence
  SiRNA target sequence
aggagaaattatcggatgtgtagataa

SEQ ID NO: 18983 - DNA, 27 bp, Artificial sequence
  SiRNA target sequence
ggagaaattatcggatgtgtagataac

SEQ ID NO: 18984 - DNA, 27 bp, Artificial sequence
  SiRNA target sequence
gagaaattatcggatgtgtagataaca

SEQ ID NO: 18985 - DNA, 27 bp, Artificial sequence
  SiRNA target sequence
agaaattatcggatgtgtagataacaa

SEQ ID NO: 18986 - DNA, 27 bp, Artificial sequence
  SiRNA target sequence
gaaattatcggatgtgtagataacaat

SEQ ID NO: 18987 - DNA, 27 bp, Artificial sequence
  SiRNA target sequence
aaattatcggatgtgtagataacaatc

SEQ ID NO: 18988 - DNA, 27 bp, Artificial sequence
  SiRNA target sequence
aattatcggatgtgtagataacaatca

SEQ ID NO: 18989 - DNA, 27 bp, Artificial sequence
  SiRNA target sequence
attatcggatgtgtagataacaatcat

SEQ ID NO: 18990 - DNA, 27 bp, Artificial sequence
  SiRNA target sequence
ttatcggatgtgtagataacaatcata

SEQ ID NO: 18991 - DNA, 27 bp, Artificial sequence
  SiRNA target sequence
tatcggatgtgtagataacaatcatat

SEQ ID NO: 18992 - DNA, 27 bp, Artificial sequence
  SiRNA target sequence
atcggatgtgtagataacaatcatatt

SEQ ID NO: 18993 - DNA, 27 bp, Artificial sequence
  SiRNA target sequence
tcggatgtgtagataacaatcatattt

SEQ ID NO: 18994 - DNA, 27 bp, Artificial sequence
  SiRNA target sequence
cggatgtgtagataacaatcatatttt

SEQ ID NO: 18995 - DNA, 27 bp, Artificial sequence
  SiRNA target sequence
ggatgtgtagataacaatcatatttta

SEQ ID NO: 18996 - DNA, 27 bp, Artificial sequence
  SiRNA target sequence
gatgtgtagataacaatcatattttaa

SEQ ID NO: 18997 - DNA, 27 bp, Artificial sequence
  SiRNA target sequence
atgtgtagataacaatcatattttaag

SEQ ID NO: 18998 - DNA, 27 bp, Artificial sequence
  SiRNA target sequence
tgtgtagataacaatcatattttaagc

SEQ ID NO: 18999 - DNA, 27 bp, Artificial sequence
  SiRNA target sequence
gtgtagataacaatcatattttaagca

SEQ ID NO: 19000 - DNA, 27 bp, Artificial sequence
  SiRNA target sequence
tgtagataacaatcatattttaagcat

SEQ ID NO: 19001 - DNA, 27 bp, Artificial sequence
  SiRNA target sequence
gtagataacaatcatattttaagcata

SEQ ID NO: 19002 - DNA, 27 bp, Artificial sequence
  SiRNA target sequence
tagataacaatcatattttaagcataa

SEQ ID NO: 19003 - DNA, 27 bp, Artificial sequence
  SiRNA target sequence
agataacaatcatattttaagcataat

SEQ ID NO: 19004 - DNA, 27 bp, Artificial sequence
  SiRNA target sequence
gataacaatcatattttaagcataatt

SEQ ID NO: 19005 - DNA, 27 bp, Artificial sequence
  SiRNA target sequence
ataacaatcatattttaagcataattt

SEQ ID NO: 19006 - DNA, 27 bp, Artificial sequence
  SiRNA target sequence
taacaatcatattttaagcataattta

SEQ ID NO: 19007 - DNA, 27 bp, Artificial sequence
  SiRNA target sequence
aacaatcatattttaagcataatttat

SEQ ID NO: 19008 - DNA, 27 bp, Artificial sequence
  SiRNA target sequence
acaatcatattttaagcataatttata

SEQ ID NO: 19009 - DNA, 27 bp, Artificial sequence
  SiRNA target sequence
caatcatattttaagcataatttataa

SEQ ID NO: 19010 - DNA, 27 bp, Artificial sequence
  SiRNA target sequence
aatcatattttaagcataatttataat

SEQ ID NO: 19011 - DNA, 27 bp, Artificial sequence
  SiRNA target sequence
atcatattttaagcataatttataatg

SEQ ID NO: 19012 - DNA, 27 bp, Artificial sequence
  SiRNA target sequence
tcatattttaagcataatttataatga

SEQ ID NO: 19013 - DNA, 27 bp, Artificial sequence
  SiRNA target sequence
catattttaagcataatttataatgat

SEQ ID NO: 19014 - DNA, 27 bp, Artificial sequence
  SiRNA target sequence
atattttaagcataatttataatgata

SEQ ID NO: 19015 - DNA, 27 bp, Artificial sequence
  SiRNA target sequence
tattttaagcataatttataatgataa

SEQ ID NO: 19016 - DNA, 27 bp, Artificial sequence
  SiRNA target sequence
attttaagcataatttataatgataaa

SEQ ID NO: 19017 - DNA, 27 bp, Artificial sequence
  SiRNA target sequence
ttttaagcataatttataatgataaat

SEQ ID NO: 19018 - DNA, 27 bp, Artificial sequence
  SiRNA target sequence
tttaagcataatttataatgataaatt

SEQ ID NO: 19019 - DNA, 27 bp, Artificial sequence
  SiRNA target sequence
ttaagcataatttataatgataaatta

SEQ ID NO: 19020 - DNA, 27 bp, Artificial sequence
  SiRNA target sequence
taagcataatttataatgataaattat

SEQ ID NO: 19021 - DNA, 27 bp, Artificial sequence
  SiRNA target sequence
aagcataatttataatgataaattatc

SEQ ID NO: 19022 - DNA, 27 bp, Artificial sequence
  SiRNA target sequence
agcataatttataatgataaattatct

SEQ ID NO: 19023 - DNA, 27 bp, Artificial sequence
  SiRNA target sequence
gcataatttataatgataaattatctg

SEQ ID NO: 19024 - DNA, 27 bp, Artificial sequence
  SiRNA target sequence
cataatttataatgataaattatctga

SEQ ID NO: 19025 - DNA, 27 bp, Artificial sequence
  SiRNA target sequence
ataatttataatgataaattatctgaa

SEQ ID NO: 19026 - DNA, 27 bp, Artificial sequence
  SiRNA target sequence
taatttataatgataaattatctgaag

SEQ ID NO: 19027 - DNA, 27 bp, Artificial sequence
  SiRNA target sequence
aatttataatgataaattatctgaagg

SEQ ID NO: 19028 - DNA, 27 bp, Artificial sequence
  SiRNA target sequence
atttataatgataaattatctgaaggg

SEQ ID NO: 19029 - DNA, 27 bp, Artificial sequence
  SiRNA target sequence
tttataatgataaattatctgaagggt

SEQ ID NO: 19030 - DNA, 27 bp, Artificial sequence
  SiRNA target sequence
ttataatgataaattatctgaagggtt

SEQ ID NO: 19031 - DNA, 27 bp, Artificial sequence
  SiRNA target sequence
tataatgataaattatctgaagggtta

SEQ ID NO: 19032 - DNA, 27 bp, Artificial sequence
  SiRNA target sequence
ataatgataaattatctgaagggttaa

SEQ ID NO: 19033 - DNA, 27 bp, Artificial sequence
  SiRNA target sequence
taatgataaattatctgaagggttaac

SEQ ID NO: 19034 - DNA, 27 bp, Artificial sequence
  SiRNA target sequence
aatgataaattatctgaagggttaaca

SEQ ID NO: 19035 - DNA, 27 bp, Artificial sequence
  SiRNA target sequence
atgataaattatctgaagggttaacac

SEQ ID NO: 19036 - DNA, 27 bp, Artificial sequence
  SiRNA target sequence
tgataaattatctgaagggttaacact

SEQ ID NO: 19037 - DNA, 27 bp, Artificial sequence
  SiRNA target sequence
gataaattatctgaagggttaacactt

SEQ ID NO: 19038 - DNA, 27 bp, Artificial sequence
  SiRNA target sequence
ataaattatctgaagggttaacactta

SEQ ID NO: 19039 - DNA, 27 bp, Artificial sequence
  SiRNA target sequence
taaattatctgaagggttaacacttaa

SEQ ID NO: 19040 - DNA, 27 bp, Artificial sequence
  SiRNA target sequence
aaattatctgaagggttaacacttaat

SEQ ID NO: 19041 - DNA, 27 bp, Artificial sequence
  SiRNA target sequence
aattatctgaagggttaacacttaatt

SEQ ID NO: 19042 - DNA, 27 bp, Artificial sequence
  SiRNA target sequence
attatctgaagggttaacacttaattt

SEQ ID NO: 19043 - DNA, 27 bp, Artificial sequence
  SiRNA target sequence
ttatctgaagggttaacacttaatttg

SEQ ID NO: 19044 - DNA, 27 bp, Artificial sequence
  SiRNA target sequence
tatctgaagggttaacacttaatttga

SEQ ID NO: 19045 - DNA, 27 bp, Artificial sequence
  SiRNA target sequence
atctgaagggttaacacttaatttgag

SEQ ID NO: 19046 - DNA, 27 bp, Artificial sequence
  SiRNA target sequence
tctgaagggttaacacttaatttgagt

SEQ ID NO: 19047 - DNA, 27 bp, Artificial sequence
  SiRNA target sequence
ctgaagggttaacacttaatttgagtt

SEQ ID NO: 19048 - DNA, 27 bp, Artificial sequence
  SiRNA target sequence
tgaagggttaacacttaatttgagttg

SEQ ID NO: 19049 - DNA, 27 bp, Artificial sequence
  SiRNA target sequence
gaagggttaacacttaatttgagttgt

SEQ ID NO: 19050 - DNA, 27 bp, Artificial sequence
  SiRNA target sequence
aagggttaacacttaatttgagttgta

SEQ ID NO: 19051 - DNA, 27 bp, Artificial sequence
  SiRNA target sequence
agggttaacacttaatttgagttgtag

SEQ ID NO: 19052 - DNA, 27 bp, Artificial sequence
  SiRNA target sequence
gggttaacacttaatttgagttgtaga

SEQ ID NO: 19053 - DNA, 27 bp, Artificial sequence
  SiRNA target sequence
ggttaacacttaatttgagttgtagat

SEQ ID NO: 19054 - DNA, 27 bp, Artificial sequence
  SiRNA target sequence
gttaacacttaatttgagttgtagatt

SEQ ID NO: 19055 - DNA, 27 bp, Artificial sequence
  SiRNA target sequence
ttaacacttaatttgagttgtagattt

SEQ ID NO: 19056 - DNA, 27 bp, Artificial sequence
  SiRNA target sequence
taacacttaatttgagttgtagatttg

SEQ ID NO: 19057 - DNA, 27 bp, Artificial sequence
  SiRNA target sequence
aacacttaatttgagttgtagatttgg

SEQ ID NO: 19058 - DNA, 27 bp, Artificial sequence
  SiRNA target sequence
acacttaatttgagttgtagatttggt

SEQ ID NO: 19059 - DNA, 27 bp, Artificial sequence
  SiRNA target sequence
cacttaatttgagttgtagatttggta

SEQ ID NO: 19060 - DNA, 27 bp, Artificial sequence
  SiRNA target sequence
acttaatttgagttgtagatttggtaa

SEQ ID NO: 19061 - DNA, 27 bp, Artificial sequence
  SiRNA target sequence
cttaatttgagttgtagatttggtaag

SEQ ID NO: 19062 - DNA, 27 bp, Artificial sequence
  SiRNA target sequence
ttaatttgagttgtagatttggtaaga

SEQ ID NO: 19063 - DNA, 27 bp, Artificial sequence
  SiRNA target sequence
taatttgagttgtagatttggtaagaa

SEQ ID NO: 19064 - DNA, 27 bp, Artificial sequence
  SiRNA target sequence
aatttgagttgtagatttggtaagaaa

SEQ ID NO: 19065 - DNA, 27 bp, Artificial sequence
  SiRNA target sequence
atttgagttgtagatttggtaagaaag

SEQ ID NO: 19066 - DNA, 27 bp, Artificial sequence
  SiRNA target sequence
tttgagttgtagatttggtaagaaagt

SEQ ID NO: 19067 - DNA, 27 bp, Artificial sequence
  SiRNA target sequence
ttgagttgtagatttggtaagaaagta

SEQ ID NO: 19068 - DNA, 27 bp, Artificial sequence
  SiRNA target sequence
tgagttgtagatttggtaagaaagtat

SEQ ID NO: 19069 - DNA, 27 bp, Artificial sequence
  SiRNA target sequence
gagttgtagatttggtaagaaagtatt

SEQ ID NO: 19070 - DNA, 27 bp, Artificial sequence
  SiRNA target sequence
agttgtagatttggtaagaaagtattt

SEQ ID NO: 19071 - DNA, 27 bp, Artificial sequence
  SiRNA target sequence
gttgtagatttggtaagaaagtatttg

SEQ ID NO: 19072 - DNA, 27 bp, Artificial sequence
  SiRNA target sequence
ttgtagatttggtaagaaagtatttga

SEQ ID NO: 19073 - DNA, 27 bp, Artificial sequence
  SiRNA target sequence
tgtagatttggtaagaaagtatttgat

SEQ ID NO: 19074 - DNA, 27 bp, Artificial sequence
  SiRNA target sequence
gtagatttggtaagaaagtatttgatt

SEQ ID NO: 19075 - DNA, 27 bp, Artificial sequence
  SiRNA target sequence
tagatttggtaagaaagtatttgatta

SEQ ID NO: 19076 - DNA, 27 bp, Artificial sequence
  SiRNA target sequence
agatttggtaagaaagtatttgattat

SEQ ID NO: 19077 - DNA, 27 bp, Artificial sequence
  SiRNA target sequence
gatttggtaagaaagtatttgattatg

SEQ ID NO: 19078 - DNA, 27 bp, Artificial sequence
  SiRNA target sequence
atttggtaagaaagtatttgattatgg

SEQ ID NO: 19079 - DNA, 27 bp, Artificial sequence
  SiRNA target sequence
tttggtaagaaagtatttgattatggc

SEQ ID NO: 19080 - DNA, 27 bp, Artificial sequence
  SiRNA target sequence
ttggtaagaaagtatttgattatggct

SEQ ID NO: 19081 - DNA, 27 bp, Artificial sequence
  SiRNA target sequence
tggtaagaaagtatttgattatggcta

SEQ ID NO: 19082 - DNA, 27 bp, Artificial sequence
  SiRNA target sequence
ggtaagaaagtatttgattatggctat

SEQ ID NO: 19083 - DNA, 27 bp, Artificial sequence
  SiRNA target sequence
gtaagaaagtatttgattatggctatg

SEQ ID NO: 19084 - DNA, 27 bp, Artificial sequence
  SiRNA target sequence
taagaaagtatttgattatggctatgg

SEQ ID NO: 19085 - DNA, 27 bp, Artificial sequence
  SiRNA target sequence
aagaaagtatttgattatggctatggg

SEQ ID NO: 19086 - DNA, 27 bp, Artificial sequence
  SiRNA target sequence
agaaagtatttgattatggctatgggt

SEQ ID NO: 19087 - DNA, 27 bp, Artificial sequence
  SiRNA target sequence
gaaagtatttgattatggctatgggtt

SEQ ID NO: 19088 - DNA, 27 bp, Artificial sequence
  SiRNA target sequence
aaagtatttgattatggctatgggttt

SEQ ID NO: 19089 - DNA, 27 bp, Artificial sequence
  SiRNA target sequence
aagtatttgattatggctatgggttta

SEQ ID NO: 19090 - DNA, 27 bp, Artificial sequence
  SiRNA target sequence
agtatttgattatggctatgggtttat

SEQ ID NO: 19091 - DNA, 27 bp, Artificial sequence
  SiRNA target sequence
gtatttgattatggctatgggtttatt

SEQ ID NO: 19092 - DNA, 27 bp, Artificial sequence
  SiRNA target sequence
tatttgattatggctatgggtttattt

SEQ ID NO: 19093 - DNA, 27 bp, Artificial sequence
  SiRNA target sequence
atttgattatggctatgggtttattta

SEQ ID NO: 19094 - DNA, 27 bp, Artificial sequence
  SiRNA target sequence
tttgattatggctatgggtttatttat

SEQ ID NO: 19095 - DNA, 27 bp, Artificial sequence
  SiRNA target sequence
ttgattatggctatgggtttatttatg

SEQ ID NO: 19096 - DNA, 27 bp, Artificial sequence
  SiRNA target sequence
tgattatggctatgggtttatttatga

SEQ ID NO: 19097 - DNA, 27 bp, Artificial sequence
  SiRNA target sequence
gattatggctatgggtttatttatgaa

SEQ ID NO: 19098 - DNA, 27 bp, Artificial sequence
  SiRNA target sequence
attatggctatgggtttatttatgaat

SEQ ID NO: 19099 - DNA, 27 bp, Artificial sequence
  SiRNA target sequence
ttatggctatgggtttatttatgaatt

SEQ ID NO: 19100 - DNA, 27 bp, Artificial sequence
  SiRNA target sequence
tatggctatgggtttatttatgaattt

SEQ ID NO: 19101 - DNA, 27 bp, Artificial sequence
  SiRNA target sequence
atggctatgggtttatttatgaatttt

SEQ ID NO: 19102 - DNA, 27 bp, Artificial sequence
  SiRNA target sequence
tggctatgggtttatttatgaatttta

SEQ ID NO: 19103 - DNA, 27 bp, Artificial sequence
  SiRNA target sequence
ggctatgggtttatttatgaattttaa

SEQ ID NO: 19104 - DNA, 19 bp, Artificial sequence
  SiRNA target sequence
ttaagaatttttcaatatt

SEQ ID NO: 19105 - DNA, 19 bp, Artificial sequence
  SiRNA target sequence
taagaatttttcaatattt

SEQ ID NO: 19106 - DNA, 19 bp, Artificial sequence
  SiRNA target sequence
aagaatttttcaatatttt

SEQ ID NO: 19107 - DNA, 19 bp, Artificial sequence
  SiRNA target sequence
agaatttttcaatattttt

SEQ ID NO: 19108 - DNA, 19 bp, Artificial sequence
  SiRNA target sequence
gaatttttcaatatttttt

SEQ ID NO: 19109 - DNA, 19 bp, Artificial sequence
  SiRNA target sequence
aatttttcaatattttttt

SEQ ID NO: 19110 - DNA, 19 bp, Artificial sequence
  SiRNA target sequence
atttttcaatatttttttt

SEQ ID NO: 19111 - DNA, 19 bp, Artificial sequence
  SiRNA target sequence
tttttcaatattttttttg

SEQ ID NO: 19112 - DNA, 19 bp, Artificial sequence
  SiRNA target sequence
ttttcaatattttttttgc

SEQ ID NO: 19113 - DNA, 19 bp, Artificial sequence
  SiRNA target sequence
tttcaatattttttttgct

SEQ ID NO: 19114 - DNA, 19 bp, Artificial sequence
  SiRNA target sequence
ttcaatattttttttgctt

SEQ ID NO: 19115 - DNA, 19 bp, Artificial sequence
  SiRNA target sequence
tcaatattttttttgcttg

SEQ ID NO: 19116 - DNA, 19 bp, Artificial sequence
  SiRNA target sequence
caatattttttttgcttgt

SEQ ID NO: 19117 - DNA, 19 bp, Artificial sequence
  SiRNA target sequence
aatattttttttgcttgtt

SEQ ID NO: 19118 - DNA, 19 bp, Artificial sequence
  SiRNA target sequence
atattttttttgcttgttc

SEQ ID NO: 19119 - DNA, 19 bp, Artificial sequence
  SiRNA target sequence
tattttttttgcttgttct

SEQ ID NO: 19120 - DNA, 19 bp, Artificial sequence
  SiRNA target sequence
attttttttgcttgttcta

SEQ ID NO: 19121 - DNA, 19 bp, Artificial sequence
  SiRNA target sequence
ttttttttgcttgttctaa

SEQ ID NO: 19122 - DNA, 19 bp, Artificial sequence
  SiRNA target sequence
tttttttgcttgttctaag

SEQ ID NO: 19123 - DNA, 19 bp, Artificial sequence
  SiRNA target sequence
ttttttgcttgttctaagt

SEQ ID NO: 19124 - DNA, 19 bp, Artificial sequence
  SiRNA target sequence
tttttgcttgttctaagtc

SEQ ID NO: 19125 - DNA, 19 bp, Artificial sequence
  SiRNA target sequence
ttttgcttgttctaagtca

SEQ ID NO: 19126 - DNA, 19 bp, Artificial sequence
  SiRNA target sequence
tttgcttgttctaagtcat

SEQ ID NO: 19127 - DNA, 19 bp, Artificial sequence
  SiRNA target sequence
ttgcttgttctaagtcata

SEQ ID NO: 19128 - DNA, 19 bp, Artificial sequence
  SiRNA target sequence
tgcttgttctaagtcataa

SEQ ID NO: 19129 - DNA, 19 bp, Artificial sequence
  SiRNA target sequence
gcttgttctaagtcataaa

SEQ ID NO: 19130 - DNA, 19 bp, Artificial sequence
  SiRNA target sequence
cttgttctaagtcataaat

SEQ ID NO: 19131 - DNA, 19 bp, Artificial sequence
  SiRNA target sequence
ttgttctaagtcataaatt

SEQ ID NO: 19132 - DNA, 19 bp, Artificial sequence
  SiRNA target sequence
tgttctaagtcataaattt

SEQ ID NO: 19133 - DNA, 19 bp, Artificial sequence
  SiRNA target sequence
gttctaagtcataaatttt

SEQ ID NO: 19134 - DNA, 19 bp, Artificial sequence
  SiRNA target sequence
ttctaagtcataaattttt

SEQ ID NO: 19135 - DNA, 19 bp, Artificial sequence
  SiRNA target sequence
tctaagtcataaatttttt

SEQ ID NO: 19136 - DNA, 19 bp, Artificial sequence
  SiRNA target sequence
ctaagtcataaattttttt

SEQ ID NO: 19137 - DNA, 19 bp, Artificial sequence
  SiRNA target sequence
taagtcataaattttttta

SEQ ID NO: 19138 - DNA, 19 bp, Artificial sequence
  SiRNA target sequence
aagtcataaatttttttag

SEQ ID NO: 19139 - DNA, 19 bp, Artificial sequence
  SiRNA target sequence
agtcataaatttttttagt

SEQ ID NO: 19140 - DNA, 19 bp, Artificial sequence
  SiRNA target sequence
gtcataaatttttttagtc

SEQ ID NO: 19141 - DNA, 19 bp, Artificial sequence
  SiRNA target sequence
tcataaatttttttagtca

SEQ ID NO: 19142 - DNA, 19 bp, Artificial sequence
  SiRNA target sequence
cataaatttttttagtcaa

SEQ ID NO: 19143 - DNA, 19 bp, Artificial sequence
  SiRNA target sequence
ataaatttttttagtcaaa

SEQ ID NO: 19144 - DNA, 19 bp, Artificial sequence
  SiRNA target sequence
taaatttttttagtcaaat

SEQ ID NO: 19145 - DNA, 19 bp, Artificial sequence
  SiRNA target sequence
aaatttttttagtcaaata

SEQ ID NO: 19146 - DNA, 19 bp, Artificial sequence
  SiRNA target sequence
aatttttttagtcaaatat

SEQ ID NO: 19147 - DNA, 19 bp, Artificial sequence
  SiRNA target sequence
atttttttagtcaaatatg

SEQ ID NO: 19148 - DNA, 19 bp, Artificial sequence
  SiRNA target sequence
tttttttagtcaaatatga

SEQ ID NO: 19149 - DNA, 19 bp, Artificial sequence
  SiRNA target sequence
ttttttagtcaaatatgac

SEQ ID NO: 19150 - DNA, 19 bp, Artificial sequence
  SiRNA target sequence
tttttagtcaaatatgact

SEQ ID NO: 19151 - DNA, 19 bp, Artificial sequence
  SiRNA target sequence
ttttagtcaaatatgactt

SEQ ID NO: 19152 - DNA, 19 bp, Artificial sequence
  SiRNA target sequence
tttagtcaaatatgacttt

SEQ ID NO: 19153 - DNA, 19 bp, Artificial sequence
  SiRNA target sequence
ttagtcaaatatgacttta

SEQ ID NO: 19154 - DNA, 19 bp, Artificial sequence
  SiRNA target sequence
tagtcaaatatgactttaa

SEQ ID NO: 19155 - DNA, 19 bp, Artificial sequence
  SiRNA target sequence
agtcaaatatgactttaaa

SEQ ID NO: 19156 - DNA, 19 bp, Artificial sequence
  SiRNA target sequence
gtcaaatatgactttaaaa

SEQ ID NO: 19157 - DNA, 19 bp, Artificial sequence
  SiRNA target sequence
tcaaatatgactttaaaat

SEQ ID NO: 19158 - DNA, 19 bp, Artificial sequence
  SiRNA target sequence
caaatatgactttaaaatc

SEQ ID NO: 19159 - DNA, 19 bp, Artificial sequence
  SiRNA target sequence
aaatatgactttaaaatct

SEQ ID NO: 19160 - DNA, 19 bp, Artificial sequence
  SiRNA target sequence
aatatgactttaaaatctc

SEQ ID NO: 19161 - DNA, 19 bp, Artificial sequence
  SiRNA target sequence
atatgactttaaaatctct

SEQ ID NO: 19162 - DNA, 19 bp, Artificial sequence
  SiRNA target sequence
tatgactttaaaatctctt

SEQ ID NO: 19163 - DNA, 19 bp, Artificial sequence
  SiRNA target sequence
atgactttaaaatctcttt

SEQ ID NO: 19164 - DNA, 19 bp, Artificial sequence
  SiRNA target sequence
tgactttaaaatctctttt

SEQ ID NO: 19165 - DNA, 19 bp, Artificial sequence
  SiRNA target sequence
gactttaaaatctcttttg

SEQ ID NO: 19166 - DNA, 19 bp, Artificial sequence
  SiRNA target sequence
actttaaaatctcttttgt

SEQ ID NO: 19167 - DNA, 19 bp, Artificial sequence
  SiRNA target sequence
ctttaaaatctcttttgtt

SEQ ID NO: 19168 - DNA, 19 bp, Artificial sequence
  SiRNA target sequence
tttaaaatctcttttgttt

SEQ ID NO: 19169 - DNA, 19 bp, Artificial sequence
  SiRNA target sequence
ttaaaatctcttttgtttc

SEQ ID NO: 19170 - DNA, 19 bp, Artificial sequence
  SiRNA target sequence
taaaatctcttttgtttca

SEQ ID NO: 19171 - DNA, 19 bp, Artificial sequence
  SiRNA target sequence
aaaatctcttttgtttcat

SEQ ID NO: 19172 - DNA, 19 bp, Artificial sequence
  SiRNA target sequence
aaatctcttttgtttcatc

SEQ ID NO: 19173 - DNA, 19 bp, Artificial sequence
  SiRNA target sequence
aatctcttttgtttcatct

SEQ ID NO: 19174 - DNA, 19 bp, Artificial sequence
  SiRNA target sequence
atctcttttgtttcatctg

SEQ ID NO: 19175 - DNA, 19 bp, Artificial sequence
  SiRNA target sequence
tctcttttgtttcatctgt

SEQ ID NO: 19176 - DNA, 19 bp, Artificial sequence
  SiRNA target sequence
ctcttttgtttcatctgtt

SEQ ID NO: 19177 - DNA, 19 bp, Artificial sequence
  SiRNA target sequence
tcttttgtttcatctgtta

SEQ ID NO: 19178 - DNA, 19 bp, Artificial sequence
  SiRNA target sequence
cttttgtttcatctgttac

SEQ ID NO: 19179 - DNA, 19 bp, Artificial sequence
  SiRNA target sequence
ttttgtttcatctgttact

SEQ ID NO: 19180 - DNA, 19 bp, Artificial sequence
  SiRNA target sequence
tttgtttcatctgttactt

SEQ ID NO: 19181 - DNA, 19 bp, Artificial sequence
  SiRNA target sequence
ttgtttcatctgttacttg

SEQ ID NO: 19182 - DNA, 19 bp, Artificial sequence
  SiRNA target sequence
tgtttcatctgttacttgt

SEQ ID NO: 19183 - DNA, 19 bp, Artificial sequence
  SiRNA target sequence
gtttcatctgttacttgtt

SEQ ID NO: 19184 - DNA, 19 bp, Artificial sequence
  SiRNA target sequence
tttcatctgttacttgttt

SEQ ID NO: 19185 - DNA, 19 bp, Artificial sequence
  SiRNA target sequence
ttcatctgttacttgtttg

SEQ ID NO: 19186 - DNA, 19 bp, Artificial sequence
  SiRNA target sequence
tcatctgttacttgtttgt

SEQ ID NO: 19187 - DNA, 19 bp, Artificial sequence
  SiRNA target sequence
catctgttacttgtttgta

SEQ ID NO: 19188 - DNA, 19 bp, Artificial sequence
  SiRNA target sequence
atctgttacttgtttgtac

SEQ ID NO: 19189 - DNA, 19 bp, Artificial sequence
  SiRNA target sequence
tctgttacttgtttgtact

SEQ ID NO: 19190 - DNA, 19 bp, Artificial sequence
  SiRNA target sequence
ctgttacttgtttgtactt

SEQ ID NO: 19191 - DNA, 19 bp, Artificial sequence
  SiRNA target sequence
tgttacttgtttgtacttt

SEQ ID NO: 19192 - DNA, 19 bp, Artificial sequence
  SiRNA target sequence
gttacttgtttgtacttta

SEQ ID NO: 19193 - DNA, 19 bp, Artificial sequence
  SiRNA target sequence
ttacttgtttgtactttaa

SEQ ID NO: 19194 - DNA, 19 bp, Artificial sequence
  SiRNA target sequence
tacttgtttgtactttaaa

SEQ ID NO: 19195 - DNA, 19 bp, Artificial sequence
  SiRNA target sequence
acttgtttgtactttaaaa

SEQ ID NO: 19196 - DNA, 19 bp, Artificial sequence
  SiRNA target sequence
cttgtttgtactttaaaaa

SEQ ID NO: 19197 - DNA, 19 bp, Artificial sequence
  SiRNA target sequence
ttgtttgtactttaaaaat

SEQ ID NO: 19198 - DNA, 19 bp, Artificial sequence
  SiRNA target sequence
tgtttgtactttaaaaatt

SEQ ID NO: 19199 - DNA, 19 bp, Artificial sequence
  SiRNA target sequence
gtttgtactttaaaaattg

SEQ ID NO: 19200 - DNA, 19 bp, Artificial sequence
  SiRNA target sequence
tttgtactttaaaaattgt

SEQ ID NO: 19201 - DNA, 19 bp, Artificial sequence
  SiRNA target sequence
ttgtactttaaaaattgtt

SEQ ID NO: 19202 - DNA, 19 bp, Artificial sequence
  SiRNA target sequence
tgtactttaaaaattgttg

SEQ ID NO: 19203 - DNA, 19 bp, Artificial sequence
  SiRNA target sequence
gtactttaaaaattgttga

SEQ ID NO: 19204 - DNA, 19 bp, Artificial sequence
  SiRNA target sequence
tactttaaaaattgttgaa

SEQ ID NO: 19205 - DNA, 19 bp, Artificial sequence
  SiRNA target sequence
actttaaaaattgttgaat

SEQ ID NO: 19206 - DNA, 19 bp, Artificial sequence
  SiRNA target sequence
ctttaaaaattgttgaatt

SEQ ID NO: 19207 - DNA, 19 bp, Artificial sequence
  SiRNA target sequence
tttaaaaattgttgaattt

SEQ ID NO: 19208 - DNA, 19 bp, Artificial sequence
  SiRNA target sequence
ttaaaaattgttgaatttc

SEQ ID NO: 19209 - DNA, 19 bp, Artificial sequence
  SiRNA target sequence
taaaaattgttgaatttca

SEQ ID NO: 19210 - DNA, 19 bp, Artificial sequence
  SiRNA target sequence
aaaaattgttgaatttcaa

SEQ ID NO: 19211 - DNA, 19 bp, Artificial sequence
  SiRNA target sequence
aaaattgttgaatttcaat

SEQ ID NO: 19212 - DNA, 19 bp, Artificial sequence
  SiRNA target sequence
aaattgttgaatttcaatt

SEQ ID NO: 19213 - DNA, 19 bp, Artificial sequence
  SiRNA target sequence
aattgttgaatttcaattt

SEQ ID NO: 19214 - DNA, 19 bp, Artificial sequence
  SiRNA target sequence
attgttgaatttcaatttt

SEQ ID NO: 19215 - DNA, 19 bp, Artificial sequence
  SiRNA target sequence
ttgttgaatttcaatttta

SEQ ID NO: 19216 - DNA, 19 bp, Artificial sequence
  SiRNA target sequence
tgttgaatttcaattttaa

SEQ ID NO: 19217 - DNA, 19 bp, Artificial sequence
  SiRNA target sequence
gttgaatttcaattttaaa

SEQ ID NO: 19218 - DNA, 19 bp, Artificial sequence
  SiRNA target sequence
ttgaatttcaattttaaat

SEQ ID NO: 19219 - DNA, 19 bp, Artificial sequence
  SiRNA target sequence
tgaatttcaattttaaatt

SEQ ID NO: 19220 - DNA, 19 bp, Artificial sequence
  SiRNA target sequence
gaatttcaattttaaattc

SEQ ID NO: 19221 - DNA, 19 bp, Artificial sequence
  SiRNA target sequence
aatttcaattttaaattcg

SEQ ID NO: 19222 - DNA, 19 bp, Artificial sequence
  SiRNA target sequence
atttcaattttaaattcgg

SEQ ID NO: 19223 - DNA, 19 bp, Artificial sequence
  SiRNA target sequence
tttcaattttaaattcggc

SEQ ID NO: 19224 - DNA, 19 bp, Artificial sequence
  SiRNA target sequence
ttcaattttaaattcggca

SEQ ID NO: 19225 - DNA, 19 bp, Artificial sequence
  SiRNA target sequence
tcaattttaaattcggcac

SEQ ID NO: 19226 - DNA, 19 bp, Artificial sequence
  SiRNA target sequence
caattttaaattcggcaca

SEQ ID NO: 19227 - DNA, 19 bp, Artificial sequence
  SiRNA target sequence
aattttaaattcggcacaa

SEQ ID NO: 19228 - DNA, 19 bp, Artificial sequence
  SiRNA target sequence
attttaaattcggcacaat

SEQ ID NO: 19229 - DNA, 19 bp, Artificial sequence
  SiRNA target sequence
ttttaaattcggcacaatt

SEQ ID NO: 19230 - DNA, 19 bp, Artificial sequence
  SiRNA target sequence
tttaaattcggcacaattt

SEQ ID NO: 19231 - DNA, 19 bp, Artificial sequence
  SiRNA target sequence
ttaaattcggcacaatttt

SEQ ID NO: 19232 - DNA, 19 bp, Artificial sequence
  SiRNA target sequence
taaattcggcacaattttt

SEQ ID NO: 19233 - DNA, 19 bp, Artificial sequence
  SiRNA target sequence
aaattcggcacaatttttt

SEQ ID NO: 19234 - DNA, 19 bp, Artificial sequence
  SiRNA target sequence
aattcggcacaattttttt

SEQ ID NO: 19235 - DNA, 19 bp, Artificial sequence
  SiRNA target sequence
attcggcacaatttttttc

SEQ ID NO: 19236 - DNA, 19 bp, Artificial sequence
  SiRNA target sequence
ttcggcacaatttttttca

SEQ ID NO: 19237 - DNA, 19 bp, Artificial sequence
  SiRNA target sequence
tcggcacaatttttttcaa

SEQ ID NO: 19238 - DNA, 19 bp, Artificial sequence
  SiRNA target sequence
cggcacaatttttttcaat

SEQ ID NO: 19239 - DNA, 19 bp, Artificial sequence
  SiRNA target sequence
ggcacaatttttttcaatt

SEQ ID NO: 19240 - DNA, 19 bp, Artificial sequence
  SiRNA target sequence
gcacaatttttttcaattt

SEQ ID NO: 19241 - DNA, 19 bp, Artificial sequence
  SiRNA target sequence
cacaatttttttcaatttc

SEQ ID NO: 19242 - DNA, 19 bp, Artificial sequence
  SiRNA target sequence
acaatttttttcaatttca

SEQ ID NO: 19243 - DNA, 19 bp, Artificial sequence
  SiRNA target sequence
caatttttttcaatttcat

SEQ ID NO: 19244 - DNA, 19 bp, Artificial sequence
  SiRNA target sequence
aatttttttcaatttcatc

SEQ ID NO: 19245 - DNA, 19 bp, Artificial sequence
  SiRNA target sequence
atttttttcaatttcatct

SEQ ID NO: 19246 - DNA, 19 bp, Artificial sequence
  SiRNA target sequence
tttttttcaatttcatctt

SEQ ID NO: 19247 - DNA, 19 bp, Artificial sequence
  SiRNA target sequence
ttttttcaatttcatcttt

SEQ ID NO: 19248 - DNA, 19 bp, Artificial sequence
  SiRNA target sequence
tttttcaatttcatctttt

SEQ ID NO: 19249 - DNA, 19 bp, Artificial sequence
  SiRNA target sequence
ttttcaatttcatcttttt

SEQ ID NO: 19250 - DNA, 19 bp, Artificial sequence
  SiRNA target sequence
tttcaatttcatctttttt

SEQ ID NO: 19251 - DNA, 19 bp, Artificial sequence
  SiRNA target sequence
ttcaatttcatcttttttc

SEQ ID NO: 19252 - DNA, 19 bp, Artificial sequence
  SiRNA target sequence
tcaatttcatcttttttcg

SEQ ID NO: 19253 - DNA, 19 bp, Artificial sequence
  SiRNA target sequence
caatttcatcttttttcga

SEQ ID NO: 19254 - DNA, 19 bp, Artificial sequence
  SiRNA target sequence
aatttcatcttttttcgaa

SEQ ID NO: 19255 - DNA, 19 bp, Artificial sequence
  SiRNA target sequence
atttcatcttttttcgaat

SEQ ID NO: 19256 - DNA, 19 bp, Artificial sequence
  SiRNA target sequence
tttcatcttttttcgaatt

SEQ ID NO: 19257 - DNA, 19 bp, Artificial sequence
  SiRNA target sequence
ttcatcttttttcgaattt

SEQ ID NO: 19258 - DNA, 19 bp, Artificial sequence
  SiRNA target sequence
tcatcttttttcgaatttt

SEQ ID NO: 19259 - DNA, 19 bp, Artificial sequence
  SiRNA target sequence
catcttttttcgaattttc

SEQ ID NO: 19260 - DNA, 19 bp, Artificial sequence
  SiRNA target sequence
atcttttttcgaattttct

SEQ ID NO: 19261 - DNA, 19 bp, Artificial sequence
  SiRNA target sequence
tcttttttcgaattttctt

SEQ ID NO: 19262 - DNA, 19 bp, Artificial sequence
  SiRNA target sequence
cttttttcgaattttcttc

SEQ ID NO: 19263 - DNA, 19 bp, Artificial sequence
  SiRNA target sequence
ttttttcgaattttcttcg

SEQ ID NO: 19264 - DNA, 19 bp, Artificial sequence
  SiRNA target sequence
tttttcgaattttcttcgg

SEQ ID NO: 19265 - DNA, 19 bp, Artificial sequence
  SiRNA target sequence
ttttcgaattttcttcggc

SEQ ID NO: 19266 - DNA, 19 bp, Artificial sequence
  SiRNA target sequence
tttcgaattttcttcggct

SEQ ID NO: 19267 - DNA, 19 bp, Artificial sequence
  SiRNA target sequence
ttcgaattttcttcggctt

SEQ ID NO: 19268 - DNA, 19 bp, Artificial sequence
  SiRNA target sequence
tcgaattttcttcggcttc

SEQ ID NO: 19269 - DNA, 19 bp, Artificial sequence
  SiRNA target sequence
cgaattttcttcggcttct

SEQ ID NO: 19270 - DNA, 19 bp, Artificial sequence
  SiRNA target sequence
gaattttcttcggcttctc

SEQ ID NO: 19271 - DNA, 19 bp, Artificial sequence
  SiRNA target sequence
aattttcttcggcttctcg

SEQ ID NO: 19272 - DNA, 19 bp, Artificial sequence
  SiRNA target sequence
attttcttcggcttctcgt

SEQ ID NO: 19273 - DNA, 19 bp, Artificial sequence
  SiRNA target sequence
ttttcttcggcttctcgta

SEQ ID NO: 19274 - DNA, 19 bp, Artificial sequence
  SiRNA target sequence
tttcttcggcttctcgtat

SEQ ID NO: 19275 - DNA, 19 bp, Artificial sequence
  SiRNA target sequence
ttcttcggcttctcgtatc

SEQ ID NO: 19276 - DNA, 19 bp, Artificial sequence
  SiRNA target sequence
tcttcggcttctcgtatca

SEQ ID NO: 19277 - DNA, 19 bp, Artificial sequence
  SiRNA target sequence
cttcggcttctcgtatcat

SEQ ID NO: 19278 - DNA, 19 bp, Artificial sequence
  SiRNA target sequence
ttcggcttctcgtatcatt

SEQ ID NO: 19279 - DNA, 19 bp, Artificial sequence
  SiRNA target sequence
tcggcttctcgtatcattt

SEQ ID NO: 19280 - DNA, 19 bp, Artificial sequence
  SiRNA target sequence
cggcttctcgtatcatttg

SEQ ID NO: 19281 - DNA, 19 bp, Artificial sequence
  SiRNA target sequence
ggcttctcgtatcatttgc

SEQ ID NO: 19282 - DNA, 19 bp, Artificial sequence
  SiRNA target sequence
gcttctcgtatcatttgcg

SEQ ID NO: 19283 - DNA, 19 bp, Artificial sequence
  SiRNA target sequence
cttctcgtatcatttgcga

SEQ ID NO: 19284 - DNA, 19 bp, Artificial sequence
  SiRNA target sequence
ttctcgtatcatttgcgaa

SEQ ID NO: 19285 - DNA, 19 bp, Artificial sequence
  SiRNA target sequence
tctcgtatcatttgcgaaa

SEQ ID NO: 19286 - DNA, 19 bp, Artificial sequence
  SiRNA target sequence
ctcgtatcatttgcgaaat

SEQ ID NO: 19287 - DNA, 19 bp, Artificial sequence
  SiRNA target sequence
tcgtatcatttgcgaaatt

SEQ ID NO: 19288 - DNA, 19 bp, Artificial sequence
  SiRNA target sequence
cgtatcatttgcgaaattt

SEQ ID NO: 19289 - DNA, 19 bp, Artificial sequence
  SiRNA target sequence
gtatcatttgcgaaatttc

SEQ ID NO: 19290 - DNA, 19 bp, Artificial sequence
  SiRNA target sequence
tatcatttgcgaaatttca

SEQ ID NO: 19291 - DNA, 19 bp, Artificial sequence
  SiRNA target sequence
atcatttgcgaaatttcac

SEQ ID NO: 19292 - DNA, 19 bp, Artificial sequence
  SiRNA target sequence
tcatttgcgaaatttcacc

SEQ ID NO: 19293 - DNA, 19 bp, Artificial sequence
  SiRNA target sequence
catttgcgaaatttcacct

SEQ ID NO: 19294 - DNA, 19 bp, Artificial sequence
  SiRNA target sequence
atttgcgaaatttcacctt

SEQ ID NO: 19295 - DNA, 19 bp, Artificial sequence
  SiRNA target sequence
tttgcgaaatttcaccttc

SEQ ID NO: 19296 - DNA, 19 bp, Artificial sequence
  SiRNA target sequence
ttgcgaaatttcaccttca

SEQ ID NO: 19297 - DNA, 19 bp, Artificial sequence
  SiRNA target sequence
tgcgaaatttcaccttcat

SEQ ID NO: 19298 - DNA, 19 bp, Artificial sequence
  SiRNA target sequence
gcgaaatttcaccttcatt

SEQ ID NO: 19299 - DNA, 19 bp, Artificial sequence
  SiRNA target sequence
cgaaatttcaccttcattt

SEQ ID NO: 19300 - DNA, 19 bp, Artificial sequence
  SiRNA target sequence
gaaatttcaccttcattta

SEQ ID NO: 19301 - DNA, 19 bp, Artificial sequence
  SiRNA target sequence
aaatttcaccttcatttaa

SEQ ID NO: 19302 - DNA, 19 bp, Artificial sequence
  SiRNA target sequence
aatttcaccttcatttaat

SEQ ID NO: 19303 - DNA, 19 bp, Artificial sequence
  SiRNA target sequence
atttcaccttcatttaatc

SEQ ID NO: 19304 - DNA, 19 bp, Artificial sequence
  SiRNA target sequence
tttcaccttcatttaatcc

SEQ ID NO: 19305 - DNA, 19 bp, Artificial sequence
  SiRNA target sequence
ttcaccttcatttaatcca

SEQ ID NO: 19306 - DNA, 19 bp, Artificial sequence
  SiRNA target sequence
tcaccttcatttaatccac

SEQ ID NO: 19307 - DNA, 19 bp, Artificial sequence
  SiRNA target sequence
caccttcatttaatccact

SEQ ID NO: 19308 - DNA, 19 bp, Artificial sequence
  SiRNA target sequence
accttcatttaatccactt

SEQ ID NO: 19309 - DNA, 19 bp, Artificial sequence
  SiRNA target sequence
ccttcatttaatccacttg

SEQ ID NO: 19310 - DNA, 19 bp, Artificial sequence
  SiRNA target sequence
cttcatttaatccacttga

SEQ ID NO: 19311 - DNA, 19 bp, Artificial sequence
  SiRNA target sequence
ttcatttaatccacttgaa

SEQ ID NO: 19312 - DNA, 19 bp, Artificial sequence
  SiRNA target sequence
tcatttaatccacttgaag

SEQ ID NO: 19313 - DNA, 19 bp, Artificial sequence
  SiRNA target sequence
catttaatccacttgaagg

SEQ ID NO: 19314 - DNA, 19 bp, Artificial sequence
  SiRNA target sequence
atttaatccacttgaaggc

SEQ ID NO: 19315 - DNA, 19 bp, Artificial sequence
  SiRNA target sequence
tttaatccacttgaaggca

SEQ ID NO: 19316 - DNA, 19 bp, Artificial sequence
  SiRNA target sequence
ttaatccacttgaaggcac

SEQ ID NO: 19317 - DNA, 19 bp, Artificial sequence
  SiRNA target sequence
taatccacttgaaggcaca

SEQ ID NO: 19318 - DNA, 19 bp, Artificial sequence
  SiRNA target sequence
aatccacttgaaggcacaa

SEQ ID NO: 19319 - DNA, 19 bp, Artificial sequence
  SiRNA target sequence
atccacttgaaggcacaat

SEQ ID NO: 19320 - DNA, 19 bp, Artificial sequence
  SiRNA target sequence
tccacttgaaggcacaatt

SEQ ID NO: 19321 - DNA, 19 bp, Artificial sequence
  SiRNA target sequence
ccacttgaaggcacaattt

SEQ ID NO: 19322 - DNA, 19 bp, Artificial sequence
  SiRNA target sequence
cacttgaaggcacaatttc

SEQ ID NO: 19323 - DNA, 19 bp, Artificial sequence
  SiRNA target sequence
acttgaaggcacaatttcg

SEQ ID NO: 19324 - DNA, 19 bp, Artificial sequence
  SiRNA target sequence
cttgaaggcacaatttcga

SEQ ID NO: 19325 - DNA, 19 bp, Artificial sequence
  SiRNA target sequence
ttgaaggcacaatttcgat

SEQ ID NO: 19326 - DNA, 19 bp, Artificial sequence
  SiRNA target sequence
tgaaggcacaatttcgatt

SEQ ID NO: 19327 - DNA, 19 bp, Artificial sequence
  SiRNA target sequence
gaaggcacaatttcgattt

SEQ ID NO: 19328 - DNA, 19 bp, Artificial sequence
  SiRNA target sequence
aaggcacaatttcgatttc

SEQ ID NO: 19329 - DNA, 19 bp, Artificial sequence
  SiRNA target sequence
aggcacaatttcgatttct

SEQ ID NO: 19330 - DNA, 19 bp, Artificial sequence
  SiRNA target sequence
ggcacaatttcgatttctt

SEQ ID NO: 19331 - DNA, 19 bp, Artificial sequence
  SiRNA target sequence
gcacaatttcgatttcttg

SEQ ID NO: 19332 - DNA, 19 bp, Artificial sequence
  SiRNA target sequence
cacaatttcgatttcttgc

SEQ ID NO: 19333 - DNA, 19 bp, Artificial sequence
  SiRNA target sequence
acaatttcgatttcttgct

SEQ ID NO: 19334 - DNA, 19 bp, Artificial sequence
  SiRNA target sequence
caatttcgatttcttgctt

SEQ ID NO: 19335 - DNA, 19 bp, Artificial sequence
  SiRNA target sequence
aatttcgatttcttgcttt

SEQ ID NO: 19336 - DNA, 19 bp, Artificial sequence
  SiRNA target sequence
atttcgatttcttgctttt

SEQ ID NO: 19337 - DNA, 19 bp, Artificial sequence
  SiRNA target sequence
tttcgatttcttgcttttt

SEQ ID NO: 19338 - DNA, 19 bp, Artificial sequence
  SiRNA target sequence
ttcgatttcttgctttttt

SEQ ID NO: 19339 - DNA, 19 bp, Artificial sequence
  SiRNA target sequence
tcgatttcttgcttttttt

SEQ ID NO: 19340 - DNA, 19 bp, Artificial sequence
  SiRNA target sequence
cgatttcttgctttttttt

SEQ ID NO: 19341 - DNA, 19 bp, Artificial sequence
  SiRNA target sequence
gatttcttgcttttttttc

SEQ ID NO: 19342 - DNA, 19 bp, Artificial sequence
  SiRNA target sequence
atttcttgcttttttttcg

SEQ ID NO: 19343 - DNA, 19 bp, Artificial sequence
  SiRNA target sequence
tttcttgcttttttttcgt

SEQ ID NO: 19344 - DNA, 19 bp, Artificial sequence
  SiRNA target sequence
ttcttgcttttttttcgtt

SEQ ID NO: 19345 - DNA, 19 bp, Artificial sequence
  SiRNA target sequence
tcttgcttttttttcgtta

SEQ ID NO: 19346 - DNA, 19 bp, Artificial sequence
  SiRNA target sequence
cttgcttttttttcgttat

SEQ ID NO: 19347 - DNA, 19 bp, Artificial sequence
  SiRNA target sequence
ttgcttttttttcgttatc

SEQ ID NO: 19348 - DNA, 19 bp, Artificial sequence
  SiRNA target sequence
tgcttttttttcgttatcc

SEQ ID NO: 19349 - DNA, 19 bp, Artificial sequence
  SiRNA target sequence
gcttttttttcgttatccc

SEQ ID NO: 19350 - DNA, 19 bp, Artificial sequence
  SiRNA target sequence
cttttttttcgttatcccg

SEQ ID NO: 19351 - DNA, 19 bp, Artificial sequence
  SiRNA target sequence
ttttttttcgttatcccgt

SEQ ID NO: 19352 - DNA, 19 bp, Artificial sequence
  SiRNA target sequence
tttttttcgttatcccgtc

SEQ ID NO: 19353 - DNA, 19 bp, Artificial sequence
  SiRNA target sequence
ttttttcgttatcccgtct

SEQ ID NO: 19354 - DNA, 19 bp, Artificial sequence
  SiRNA target sequence
tttttcgttatcccgtctt

SEQ ID NO: 19355 - DNA, 19 bp, Artificial sequence
  SiRNA target sequence
ttttcgttatcccgtcttg

SEQ ID NO: 19356 - DNA, 19 bp, Artificial sequence
  SiRNA target sequence
tttcgttatcccgtcttgc

SEQ ID NO: 19357 - DNA, 19 bp, Artificial sequence
  SiRNA target sequence
ttcgttatcccgtcttgcg

SEQ ID NO: 19358 - DNA, 19 bp, Artificial sequence
  SiRNA target sequence
tcgttatcccgtcttgcgc

SEQ ID NO: 19359 - DNA, 19 bp, Artificial sequence
  SiRNA target sequence
cgttatcccgtcttgcgca

SEQ ID NO: 19360 - DNA, 19 bp, Artificial sequence
  SiRNA target sequence
gttatcccgtcttgcgcag

SEQ ID NO: 19361 - DNA, 19 bp, Artificial sequence
  SiRNA target sequence
ttatcccgtcttgcgcaga

SEQ ID NO: 19362 - DNA, 19 bp, Artificial sequence
  SiRNA target sequence
tatcccgtcttgcgcagat

SEQ ID NO: 19363 - DNA, 19 bp, Artificial sequence
  SiRNA target sequence
atcccgtcttgcgcagata

SEQ ID NO: 19364 - DNA, 19 bp, Artificial sequence
  SiRNA target sequence
tcccgtcttgcgcagatac

SEQ ID NO: 19365 - DNA, 19 bp, Artificial sequence
  SiRNA target sequence
cccgtcttgcgcagatact

SEQ ID NO: 19366 - DNA, 19 bp, Artificial sequence
  SiRNA target sequence
ccgtcttgcgcagatactt

SEQ ID NO: 19367 - DNA, 19 bp, Artificial sequence
  SiRNA target sequence
cgtcttgcgcagatacttt

SEQ ID NO: 19368 - DNA, 19 bp, Artificial sequence
  SiRNA target sequence
gtcttgcgcagatactttg

SEQ ID NO: 19369 - DNA, 19 bp, Artificial sequence
  SiRNA target sequence
tcttgcgcagatactttgt

SEQ ID NO: 19370 - DNA, 19 bp, Artificial sequence
  SiRNA target sequence
cttgcgcagatactttgta

SEQ ID NO: 19371 - DNA, 19 bp, Artificial sequence
  SiRNA target sequence
ttgcgcagatactttgtat

SEQ ID NO: 19372 - DNA, 19 bp, Artificial sequence
  SiRNA target sequence
tgcgcagatactttgtata

SEQ ID NO: 19373 - DNA, 19 bp, Artificial sequence
  SiRNA target sequence
gcgcagatactttgtatat

SEQ ID NO: 19374 - DNA, 19 bp, Artificial sequence
  SiRNA target sequence
cgcagatactttgtatatt

SEQ ID NO: 19375 - DNA, 19 bp, Artificial sequence
  SiRNA target sequence
gcagatactttgtatattc

SEQ ID NO: 19376 - DNA, 19 bp, Artificial sequence
  SiRNA target sequence
cagatactttgtatattcc

SEQ ID NO: 19377 - DNA, 19 bp, Artificial sequence
  SiRNA target sequence
agatactttgtatattccg

SEQ ID NO: 19378 - DNA, 19 bp, Artificial sequence
  SiRNA target sequence
gatactttgtatattccgt

SEQ ID NO: 19379 - DNA, 19 bp, Artificial sequence
  SiRNA target sequence
atactttgtatattccgtt

SEQ ID NO: 19380 - DNA, 19 bp, Artificial sequence
  SiRNA target sequence
tactttgtatattccgtta

SEQ ID NO: 19381 - DNA, 19 bp, Artificial sequence
  SiRNA target sequence
actttgtatattccgttag

SEQ ID NO: 19382 - DNA, 19 bp, Artificial sequence
  SiRNA target sequence
ctttgtatattccgttagc

SEQ ID NO: 19383 - DNA, 19 bp, Artificial sequence
  SiRNA target sequence
tttgtatattccgttagca

SEQ ID NO: 19384 - DNA, 19 bp, Artificial sequence
  SiRNA target sequence
ttgtatattccgttagcat

SEQ ID NO: 19385 - DNA, 19 bp, Artificial sequence
  SiRNA target sequence
tgtatattccgttagcatc

SEQ ID NO: 19386 - DNA, 19 bp, Artificial sequence
  SiRNA target sequence
gtatattccgttagcatcg

SEQ ID NO: 19387 - DNA, 19 bp, Artificial sequence
  SiRNA target sequence
tatattccgttagcatcgg

SEQ ID NO: 19388 - DNA, 19 bp, Artificial sequence
  SiRNA target sequence
atattccgttagcatcggc

SEQ ID NO: 19389 - DNA, 19 bp, Artificial sequence
  SiRNA target sequence
tattccgttagcatcggct

SEQ ID NO: 19390 - DNA, 19 bp, Artificial sequence
  SiRNA target sequence
attccgttagcatcggctt

SEQ ID NO: 19391 - DNA, 19 bp, Artificial sequence
  SiRNA target sequence
ttccgttagcatcggcttc

SEQ ID NO: 19392 - DNA, 19 bp, Artificial sequence
  SiRNA target sequence
tccgttagcatcggcttca

SEQ ID NO: 19393 - DNA, 19 bp, Artificial sequence
  SiRNA target sequence
ccgttagcatcggcttcaa

SEQ ID NO: 19394 - DNA, 19 bp, Artificial sequence
  SiRNA target sequence
cgttagcatcggcttcaaa

SEQ ID NO: 19395 - DNA, 19 bp, Artificial sequence
  SiRNA target sequence
gttagcatcggcttcaaat

SEQ ID NO: 19396 - DNA, 19 bp, Artificial sequence
  SiRNA target sequence
ttagcatcggcttcaaatg

SEQ ID NO: 19397 - DNA, 19 bp, Artificial sequence
  SiRNA target sequence
tagcatcggcttcaaatgt

SEQ ID NO: 19398 - DNA, 19 bp, Artificial sequence
  SiRNA target sequence
agcatcggcttcaaatgta

SEQ ID NO: 19399 - DNA, 19 bp, Artificial sequence
  SiRNA target sequence
gcatcggcttcaaatgtaa

SEQ ID NO: 19400 - DNA, 19 bp, Artificial sequence
  SiRNA target sequence
catcggcttcaaatgtaac

SEQ ID NO: 19401 - DNA, 19 bp, Artificial sequence
  SiRNA target sequence
atcggcttcaaatgtaaca

SEQ ID NO: 19402 - DNA, 19 bp, Artificial sequence
  SiRNA target sequence
tcggcttcaaatgtaacat

SEQ ID NO: 19403 - DNA, 19 bp, Artificial sequence
  SiRNA target sequence
cggcttcaaatgtaacatc

SEQ ID NO: 19404 - DNA, 19 bp, Artificial sequence
  SiRNA target sequence
ggcttcaaatgtaacatct

SEQ ID NO: 19405 - DNA, 19 bp, Artificial sequence
  SiRNA target sequence
gcttcaaatgtaacatcta

SEQ ID NO: 19406 - DNA, 19 bp, Artificial sequence
  SiRNA target sequence
cttcaaatgtaacatctat

SEQ ID NO: 19407 - DNA, 19 bp, Artificial sequence
  SiRNA target sequence
ttcaaatgtaacatctatc

SEQ ID NO: 19408 - DNA, 19 bp, Artificial sequence
  SiRNA target sequence
tcaaatgtaacatctatct

SEQ ID NO: 19409 - DNA, 19 bp, Artificial sequence
  SiRNA target sequence
caaatgtaacatctatctt

SEQ ID NO: 19410 - DNA, 19 bp, Artificial sequence
  SiRNA target sequence
aaatgtaacatctatcttt

SEQ ID NO: 19411 - DNA, 19 bp, Artificial sequence
  SiRNA target sequence
aatgtaacatctatctttg

SEQ ID NO: 19412 - DNA, 19 bp, Artificial sequence
  SiRNA target sequence
atgtaacatctatctttgg

SEQ ID NO: 19413 - DNA, 19 bp, Artificial sequence
  SiRNA target sequence
tgtaacatctatctttgga

SEQ ID NO: 19414 - DNA, 19 bp, Artificial sequence
  SiRNA target sequence
gtaacatctatctttggaa

SEQ ID NO: 19415 - DNA, 19 bp, Artificial sequence
  SiRNA target sequence
taacatctatctttggaat

SEQ ID NO: 19416 - DNA, 19 bp, Artificial sequence
  SiRNA target sequence
aacatctatctttggaata

SEQ ID NO: 19417 - DNA, 19 bp, Artificial sequence
  SiRNA target sequence
acatctatctttggaatac

SEQ ID NO: 19418 - DNA, 19 bp, Artificial sequence
  SiRNA target sequence
catctatctttggaatacc

SEQ ID NO: 19419 - DNA, 19 bp, Artificial sequence
  SiRNA target sequence
atctatctttggaatacct

SEQ ID NO: 19420 - DNA, 19 bp, Artificial sequence
  SiRNA target sequence
tctatctttggaatacctg

SEQ ID NO: 19421 - DNA, 19 bp, Artificial sequence
  SiRNA target sequence
ctatctttggaatacctgc

SEQ ID NO: 19422 - DNA, 19 bp, Artificial sequence
  SiRNA target sequence
tatctttggaatacctgca

SEQ ID NO: 19423 - DNA, 19 bp, Artificial sequence
  SiRNA target sequence
atctttggaatacctgcag

SEQ ID NO: 19424 - DNA, 19 bp, Artificial sequence
  SiRNA target sequence
tctttggaatacctgcagg

SEQ ID NO: 19425 - DNA, 19 bp, Artificial sequence
  SiRNA target sequence
ctttggaatacctgcaggt

SEQ ID NO: 19426 - DNA, 19 bp, Artificial sequence
  SiRNA target sequence
tttggaatacctgcaggtg

SEQ ID NO: 19427 - DNA, 19 bp, Artificial sequence
  SiRNA target sequence
ttggaatacctgcaggtgc

SEQ ID NO: 19428 - DNA, 19 bp, Artificial sequence
  SiRNA target sequence
tggaatacctgcaggtgct

SEQ ID NO: 19429 - DNA, 19 bp, Artificial sequence
  SiRNA target sequence
ggaatacctgcaggtgctt

SEQ ID NO: 19430 - DNA, 19 bp, Artificial sequence
  SiRNA target sequence
gaatacctgcaggtgcttt

SEQ ID NO: 19431 - DNA, 19 bp, Artificial sequence
  SiRNA target sequence
aatacctgcaggtgcttta

SEQ ID NO: 19432 - DNA, 19 bp, Artificial sequence
  SiRNA target sequence
atacctgcaggtgctttag

SEQ ID NO: 19433 - DNA, 19 bp, Artificial sequence
  SiRNA target sequence
tacctgcaggtgctttagg

SEQ ID NO: 19434 - DNA, 19 bp, Artificial sequence
  SiRNA target sequence
acctgcaggtgctttagga

SEQ ID NO: 19435 - DNA, 19 bp, Artificial sequence
  SiRNA target sequence
cctgcaggtgctttaggaa

SEQ ID NO: 19436 - DNA, 19 bp, Artificial sequence
  SiRNA target sequence
ctgcaggtgctttaggaat

SEQ ID NO: 19437 - DNA, 19 bp, Artificial sequence
  SiRNA target sequence
tgcaggtgctttaggaatg

SEQ ID NO: 19438 - DNA, 19 bp, Artificial sequence
  SiRNA target sequence
gcaggtgctttaggaatgt

SEQ ID NO: 19439 - DNA, 19 bp, Artificial sequence
  SiRNA target sequence
caggtgctttaggaatgtt

SEQ ID NO: 19440 - DNA, 19 bp, Artificial sequence
  SiRNA target sequence
aggtgctttaggaatgttt

SEQ ID NO: 19441 - DNA, 19 bp, Artificial sequence
  SiRNA target sequence
ggtgctttaggaatgtttt

SEQ ID NO: 19442 - DNA, 19 bp, Artificial sequence
  SiRNA target sequence
gtgctttaggaatgttttt

SEQ ID NO: 19443 - DNA, 19 bp, Artificial sequence
  SiRNA target sequence
tgctttaggaatgtttttg

SEQ ID NO: 19444 - DNA, 19 bp, Artificial sequence
  SiRNA target sequence
gctttaggaatgtttttga

SEQ ID NO: 19445 - DNA, 19 bp, Artificial sequence
  SiRNA target sequence
ctttaggaatgtttttgag

SEQ ID NO: 19446 - DNA, 19 bp, Artificial sequence
  SiRNA target sequence
tttaggaatgtttttgagc

SEQ ID NO: 19447 - DNA, 19 bp, Artificial sequence
  SiRNA target sequence
ttaggaatgtttttgagct

SEQ ID NO: 19448 - DNA, 19 bp, Artificial sequence
  SiRNA target sequence
taggaatgtttttgagctt

SEQ ID NO: 19449 - DNA, 19 bp, Artificial sequence
  SiRNA target sequence
aggaatgtttttgagcttt

SEQ ID NO: 19450 - DNA, 19 bp, Artificial sequence
  SiRNA target sequence
ggaatgtttttgagcttta

SEQ ID NO: 19451 - DNA, 19 bp, Artificial sequence
  SiRNA target sequence
gaatgtttttgagctttat

SEQ ID NO: 19452 - DNA, 19 bp, Artificial sequence
  SiRNA target sequence
aatgtttttgagctttata

SEQ ID NO: 19453 - DNA, 19 bp, Artificial sequence
  SiRNA target sequence
atgtttttgagctttatag

SEQ ID NO: 19454 - DNA, 19 bp, Artificial sequence
  SiRNA target sequence
tgtttttgagctttatagc

SEQ ID NO: 19455 - DNA, 19 bp, Artificial sequence
  SiRNA target sequence
gtttttgagctttatagct

SEQ ID NO: 19456 - DNA, 19 bp, Artificial sequence
  SiRNA target sequence
tttttgagctttatagctc

SEQ ID NO: 19457 - DNA, 19 bp, Artificial sequence
  SiRNA target sequence
ttttgagctttatagctcc

SEQ ID NO: 19458 - DNA, 19 bp, Artificial sequence
  SiRNA target sequence
tttgagctttatagctcct

SEQ ID NO: 19459 - DNA, 19 bp, Artificial sequence
  SiRNA target sequence
ttgagctttatagctccta

SEQ ID NO: 19460 - DNA, 19 bp, Artificial sequence
  SiRNA target sequence
tgagctttatagctcctaa

SEQ ID NO: 19461 - DNA, 19 bp, Artificial sequence
  SiRNA target sequence
gagctttatagctcctaaa

SEQ ID NO: 19462 - DNA, 19 bp, Artificial sequence
  SiRNA target sequence
agctttatagctcctaaat

SEQ ID NO: 19463 - DNA, 19 bp, Artificial sequence
  SiRNA target sequence
gctttatagctcctaaata

SEQ ID NO: 19464 - DNA, 19 bp, Artificial sequence
  SiRNA target sequence
ctttatagctcctaaatat

SEQ ID NO: 19465 - DNA, 19 bp, Artificial sequence
  SiRNA target sequence
tttatagctcctaaatatt

SEQ ID NO: 19466 - DNA, 19 bp, Artificial sequence
  SiRNA target sequence
ttatagctcctaaatattt

SEQ ID NO: 19467 - DNA, 19 bp, Artificial sequence
  SiRNA target sequence
tatagctcctaaatattta

SEQ ID NO: 19468 - DNA, 19 bp, Artificial sequence
  SiRNA target sequence
atagctcctaaatatttat

SEQ ID NO: 19469 - DNA, 19 bp, Artificial sequence
  SiRNA target sequence
tagctcctaaatatttatt

SEQ ID NO: 19470 - DNA, 19 bp, Artificial sequence
  SiRNA target sequence
agctcctaaatatttattg

SEQ ID NO: 19471 - DNA, 19 bp, Artificial sequence
  SiRNA target sequence
gctcctaaatatttattgt

SEQ ID NO: 19472 - DNA, 19 bp, Artificial sequence
  SiRNA target sequence
ctcctaaatatttattgtc

SEQ ID NO: 19473 - DNA, 19 bp, Artificial sequence
  SiRNA target sequence
tcctaaatatttattgtct

SEQ ID NO: 19474 - DNA, 19 bp, Artificial sequence
  SiRNA target sequence
cctaaatatttattgtctt

SEQ ID NO: 19475 - DNA, 19 bp, Artificial sequence
  SiRNA target sequence
ctaaatatttattgtcttt

SEQ ID NO: 19476 - DNA, 19 bp, Artificial sequence
  SiRNA target sequence
taaatatttattgtctttt

SEQ ID NO: 19477 - DNA, 19 bp, Artificial sequence
  SiRNA target sequence
aaatatttattgtctttta

SEQ ID NO: 19478 - DNA, 19 bp, Artificial sequence
  SiRNA target sequence
aatatttattgtcttttac

SEQ ID NO: 19479 - DNA, 19 bp, Artificial sequence
  SiRNA target sequence
atatttattgtcttttacc

SEQ ID NO: 19480 - DNA, 19 bp, Artificial sequence
  SiRNA target sequence
tatttattgtcttttacca

SEQ ID NO: 19481 - DNA, 19 bp, Artificial sequence
  SiRNA target sequence
atttattgtcttttaccat

SEQ ID NO: 19482 - DNA, 19 bp, Artificial sequence
  SiRNA target sequence
tttattgtcttttaccatc

SEQ ID NO: 19483 - DNA, 19 bp, Artificial sequence
  SiRNA target sequence
ttattgtcttttaccatct

SEQ ID NO: 19484 - DNA, 19 bp, Artificial sequence
  SiRNA target sequence
tattgtcttttaccatctt

SEQ ID NO: 19485 - DNA, 19 bp, Artificial sequence
  SiRNA target sequence
attgtcttttaccatcttt

SEQ ID NO: 19486 - DNA, 19 bp, Artificial sequence
  SiRNA target sequence
ttgtcttttaccatctttc

SEQ ID NO: 19487 - DNA, 19 bp, Artificial sequence
  SiRNA target sequence
tgtcttttaccatctttct

SEQ ID NO: 19488 - DNA, 19 bp, Artificial sequence
  SiRNA target sequence
gtcttttaccatctttctt

SEQ ID NO: 19489 - DNA, 19 bp, Artificial sequence
  SiRNA target sequence
tcttttaccatctttcttt

SEQ ID NO: 19490 - DNA, 19 bp, Artificial sequence
  SiRNA target sequence
cttttaccatctttctttc

SEQ ID NO: 19491 - DNA, 19 bp, Artificial sequence
  SiRNA target sequence
ttttaccatctttctttct

SEQ ID NO: 19492 - DNA, 19 bp, Artificial sequence
  SiRNA target sequence
tttaccatctttctttctc

SEQ ID NO: 19493 - DNA, 19 bp, Artificial sequence
  SiRNA target sequence
ttaccatctttctttctcc

SEQ ID NO: 19494 - DNA, 19 bp, Artificial sequence
  SiRNA target sequence
taccatctttctttctcct

SEQ ID NO: 19495 - DNA, 19 bp, Artificial sequence
  SiRNA target sequence
accatctttctttctcctt

SEQ ID NO: 19496 - DNA, 19 bp, Artificial sequence
  SiRNA target sequence
ccatctttctttctccttg

SEQ ID NO: 19497 - DNA, 19 bp, Artificial sequence
  SiRNA target sequence
catctttctttctccttga

SEQ ID NO: 19498 - DNA, 19 bp, Artificial sequence
  SiRNA target sequence
atctttctttctccttgat

SEQ ID NO: 19499 - DNA, 19 bp, Artificial sequence
  SiRNA target sequence
tctttctttctccttgata

SEQ ID NO: 19500 - DNA, 19 bp, Artificial sequence
  SiRNA target sequence
ctttctttctccttgatat

SEQ ID NO: 19501 - DNA, 19 bp, Artificial sequence
  SiRNA target sequence
tttctttctccttgatata

SEQ ID NO: 19502 - DNA, 19 bp, Artificial sequence
  SiRNA target sequence
ttctttctccttgatatat

SEQ ID NO: 19503 - DNA, 19 bp, Artificial sequence
  SiRNA target sequence
tctttctccttgatatatt

SEQ ID NO: 19504 - DNA, 19 bp, Artificial sequence
  SiRNA target sequence
ctttctccttgatatattc

SEQ ID NO: 19505 - DNA, 19 bp, Artificial sequence
  SiRNA target sequence
tttctccttgatatattct

SEQ ID NO: 19506 - DNA, 19 bp, Artificial sequence
  SiRNA target sequence
ttctccttgatatattcta

SEQ ID NO: 19507 - DNA, 19 bp, Artificial sequence
  SiRNA target sequence
tctccttgatatattctaa

SEQ ID NO: 19508 - DNA, 19 bp, Artificial sequence
  SiRNA target sequence
ctccttgatatattctaat

SEQ ID NO: 19509 - DNA, 19 bp, Artificial sequence
  SiRNA target sequence
tccttgatatattctaata

SEQ ID NO: 19510 - DNA, 19 bp, Artificial sequence
  SiRNA target sequence
ccttgatatattctaatat

SEQ ID NO: 19511 - DNA, 19 bp, Artificial sequence
  SiRNA target sequence
cttgatatattctaatatc

SEQ ID NO: 19512 - DNA, 19 bp, Artificial sequence
  SiRNA target sequence
ttgatatattctaatatct

SEQ ID NO: 19513 - DNA, 19 bp, Artificial sequence
  SiRNA target sequence
tgatatattctaatatcta

SEQ ID NO: 19514 - DNA, 19 bp, Artificial sequence
  SiRNA target sequence
gatatattctaatatctac

SEQ ID NO: 19515 - DNA, 19 bp, Artificial sequence
  SiRNA target sequence
atatattctaatatctact

SEQ ID NO: 19516 - DNA, 19 bp, Artificial sequence
  SiRNA target sequence
tatattctaatatctactt

SEQ ID NO: 19517 - DNA, 19 bp, Artificial sequence
  SiRNA target sequence
atattctaatatctacttc

SEQ ID NO: 19518 - DNA, 19 bp, Artificial sequence
  SiRNA target sequence
tattctaatatctacttcg

SEQ ID NO: 19519 - DNA, 19 bp, Artificial sequence
  SiRNA target sequence
attctaatatctacttcgg

SEQ ID NO: 19520 - DNA, 19 bp, Artificial sequence
  SiRNA target sequence
ttctaatatctacttcgga

SEQ ID NO: 19521 - DNA, 19 bp, Artificial sequence
  SiRNA target sequence
tctaatatctacttcggat

SEQ ID NO: 19522 - DNA, 19 bp, Artificial sequence
  SiRNA target sequence
ctaatatctacttcggatt

SEQ ID NO: 19523 - DNA, 19 bp, Artificial sequence
  SiRNA target sequence
taatatctacttcggattg

SEQ ID NO: 19524 - DNA, 19 bp, Artificial sequence
  SiRNA target sequence
aatatctacttcggattga

SEQ ID NO: 19525 - DNA, 19 bp, Artificial sequence
  SiRNA target sequence
atatctacttcggattgat

SEQ ID NO: 19526 - DNA, 19 bp, Artificial sequence
  SiRNA target sequence
tatctacttcggattgatt

SEQ ID NO: 19527 - DNA, 19 bp, Artificial sequence
  SiRNA target sequence
atctacttcggattgatta

SEQ ID NO: 19528 - DNA, 19 bp, Artificial sequence
  SiRNA target sequence
tctacttcggattgattat

SEQ ID NO: 19529 - DNA, 19 bp, Artificial sequence
  SiRNA target sequence
ctacttcggattgattatc

SEQ ID NO: 19530 - DNA, 19 bp, Artificial sequence
  SiRNA target sequence
tacttcggattgattatct

SEQ ID NO: 19531 - DNA, 19 bp, Artificial sequence
  SiRNA target sequence
acttcggattgattatctt

SEQ ID NO: 19532 - DNA, 19 bp, Artificial sequence
  SiRNA target sequence
cttcggattgattatcttc

SEQ ID NO: 19533 - DNA, 19 bp, Artificial sequence
  SiRNA target sequence
ttcggattgattatcttca

SEQ ID NO: 19534 - DNA, 19 bp, Artificial sequence
  SiRNA target sequence
tcggattgattatcttcag

SEQ ID NO: 19535 - DNA, 19 bp, Artificial sequence
  SiRNA target sequence
cggattgattatcttcaga

SEQ ID NO: 19536 - DNA, 19 bp, Artificial sequence
  SiRNA target sequence
ggattgattatcttcagag

SEQ ID NO: 19537 - DNA, 19 bp, Artificial sequence
  SiRNA target sequence
gattgattatcttcagagg

SEQ ID NO: 19538 - DNA, 19 bp, Artificial sequence
  SiRNA target sequence
attgattatcttcagaggt

SEQ ID NO: 19539 - DNA, 19 bp, Artificial sequence
  SiRNA target sequence
ttgattatcttcagaggta

SEQ ID NO: 19540 - DNA, 19 bp, Artificial sequence
  SiRNA target sequence
tgattatcttcagaggtag

SEQ ID NO: 19541 - DNA, 19 bp, Artificial sequence
  SiRNA target sequence
gattatcttcagaggtaga

SEQ ID NO: 19542 - DNA, 19 bp, Artificial sequence
  SiRNA target sequence
attatcttcagaggtagaa

SEQ ID NO: 19543 - DNA, 19 bp, Artificial sequence
  SiRNA target sequence
ttatcttcagaggtagaaa

SEQ ID NO: 19544 - DNA, 19 bp, Artificial sequence
  SiRNA target sequence
tatcttcagaggtagaaaa

SEQ ID NO: 19545 - DNA, 19 bp, Artificial sequence
  SiRNA target sequence
atcttcagaggtagaaaaa

SEQ ID NO: 19546 - DNA, 19 bp, Artificial sequence
  SiRNA target sequence
tcttcagaggtagaaaaac

SEQ ID NO: 19547 - DNA, 19 bp, Artificial sequence
  SiRNA target sequence
cttcagaggtagaaaaact

SEQ ID NO: 19548 - DNA, 19 bp, Artificial sequence
  SiRNA target sequence
ttcagaggtagaaaaactg

SEQ ID NO: 19549 - DNA, 19 bp, Artificial sequence
  SiRNA target sequence
tcagaggtagaaaaactgt

SEQ ID NO: 19550 - DNA, 19 bp, Artificial sequence
  SiRNA target sequence
cagaggtagaaaaactgtg

SEQ ID NO: 19551 - DNA, 19 bp, Artificial sequence
  SiRNA target sequence
agaggtagaaaaactgtgt

SEQ ID NO: 19552 - DNA, 19 bp, Artificial sequence
  SiRNA target sequence
gaggtagaaaaactgtgtg

SEQ ID NO: 19553 - DNA, 19 bp, Artificial sequence
  SiRNA target sequence
aggtagaaaaactgtgtgt

SEQ ID NO: 19554 - DNA, 19 bp, Artificial sequence
  SiRNA target sequence
ggtagaaaaactgtgtgtt

SEQ ID NO: 19555 - DNA, 19 bp, Artificial sequence
  SiRNA target sequence
gtagaaaaactgtgtgttt

SEQ ID NO: 19556 - DNA, 19 bp, Artificial sequence
  SiRNA target sequence
tagaaaaactgtgtgtttc

SEQ ID NO: 19557 - DNA, 19 bp, Artificial sequence
  SiRNA target sequence
agaaaaactgtgtgtttcc

SEQ ID NO: 19558 - DNA, 19 bp, Artificial sequence
  SiRNA target sequence
gaaaaactgtgtgtttcct

SEQ ID NO: 19559 - DNA, 19 bp, Artificial sequence
  SiRNA target sequence
aaaaactgtgtgtttcctt

SEQ ID NO: 19560 - DNA, 19 bp, Artificial sequence
  SiRNA target sequence
aaaactgtgtgtttcctta

SEQ ID NO: 19561 - DNA, 19 bp, Artificial sequence
  SiRNA target sequence
aaactgtgtgtttccttaa

SEQ ID NO: 19562 - DNA, 19 bp, Artificial sequence
  SiRNA target sequence
aactgtgtgtttccttaaa

SEQ ID NO: 19563 - DNA, 19 bp, Artificial sequence
  SiRNA target sequence
actgtgtgtttccttaaat

SEQ ID NO: 19564 - DNA, 19 bp, Artificial sequence
  SiRNA target sequence
ctgtgtgtttccttaaatg

SEQ ID NO: 19565 - DNA, 19 bp, Artificial sequence
  SiRNA target sequence
tgtgtgtttccttaaatgg

SEQ ID NO: 19566 - DNA, 19 bp, Artificial sequence
  SiRNA target sequence
gtgtgtttccttaaatgga

SEQ ID NO: 19567 - DNA, 19 bp, Artificial sequence
  SiRNA target sequence
tgtgtttccttaaatggaa

SEQ ID NO: 19568 - DNA, 19 bp, Artificial sequence
  SiRNA target sequence
gtgtttccttaaatggaat

SEQ ID NO: 19569 - DNA, 19 bp, Artificial sequence
  SiRNA target sequence
tgtttccttaaatggaata

SEQ ID NO: 19570 - DNA, 19 bp, Artificial sequence
  SiRNA target sequence
gtttccttaaatggaatag

SEQ ID NO: 19571 - DNA, 19 bp, Artificial sequence
  SiRNA target sequence
tttccttaaatggaatagt

SEQ ID NO: 19572 - DNA, 19 bp, Artificial sequence
  SiRNA target sequence
ttccttaaatggaatagta

SEQ ID NO: 19573 - DNA, 19 bp, Artificial sequence
  SiRNA target sequence
tccttaaatggaatagtag

SEQ ID NO: 19574 - DNA, 19 bp, Artificial sequence
  SiRNA target sequence
ccttaaatggaatagtaga

SEQ ID NO: 19575 - DNA, 19 bp, Artificial sequence
  SiRNA target sequence
cttaaatggaatagtagaa

SEQ ID NO: 19576 - DNA, 19 bp, Artificial sequence
  SiRNA target sequence
ttaaatggaatagtagaat

SEQ ID NO: 19577 - DNA, 19 bp, Artificial sequence
  SiRNA target sequence
taaatggaatagtagaatt

SEQ ID NO: 19578 - DNA, 19 bp, Artificial sequence
  SiRNA target sequence
aaatggaatagtagaattt

SEQ ID NO: 19579 - DNA, 19 bp, Artificial sequence
  SiRNA target sequence
aatggaatagtagaatttc

SEQ ID NO: 19580 - DNA, 19 bp, Artificial sequence
  SiRNA target sequence
atggaatagtagaatttct

SEQ ID NO: 19581 - DNA, 19 bp, Artificial sequence
  SiRNA target sequence
tggaatagtagaatttcta

SEQ ID NO: 19582 - DNA, 19 bp, Artificial sequence
  SiRNA target sequence
ggaatagtagaatttctat

SEQ ID NO: 19583 - DNA, 19 bp, Artificial sequence
  SiRNA target sequence
gaatagtagaatttctatg

SEQ ID NO: 19584 - DNA, 19 bp, Artificial sequence
  SiRNA target sequence
aatagtagaatttctatga

SEQ ID NO: 19585 - DNA, 19 bp, Artificial sequence
  SiRNA target sequence
atagtagaatttctatgaa

SEQ ID NO: 19586 - DNA, 19 bp, Artificial sequence
  SiRNA target sequence
tagtagaatttctatgaat

SEQ ID NO: 19587 - DNA, 19 bp, Artificial sequence
  SiRNA target sequence
agtagaatttctatgaatt

SEQ ID NO: 19588 - DNA, 19 bp, Artificial sequence
  SiRNA target sequence
gtagaatttctatgaatta

SEQ ID NO: 19589 - DNA, 19 bp, Artificial sequence
  SiRNA target sequence
tagaatttctatgaattat

SEQ ID NO: 19590 - DNA, 19 bp, Artificial sequence
  SiRNA target sequence
agaatttctatgaattatc

SEQ ID NO: 19591 - DNA, 19 bp, Artificial sequence
  SiRNA target sequence
gaatttctatgaattatct

SEQ ID NO: 19592 - DNA, 19 bp, Artificial sequence
  SiRNA target sequence
aatttctatgaattatctt

SEQ ID NO: 19593 - DNA, 19 bp, Artificial sequence
  SiRNA target sequence
atttctatgaattatctta

SEQ ID NO: 19594 - DNA, 19 bp, Artificial sequence
  SiRNA target sequence
tttctatgaattatcttat

SEQ ID NO: 19595 - DNA, 19 bp, Artificial sequence
  SiRNA target sequence
ttctatgaattatcttatt

SEQ ID NO: 19596 - DNA, 19 bp, Artificial sequence
  SiRNA target sequence
tctatgaattatcttatta

SEQ ID NO: 19597 - DNA, 19 bp, Artificial sequence
  SiRNA target sequence
ctatgaattatcttattaa

SEQ ID NO: 19598 - DNA, 19 bp, Artificial sequence
  SiRNA target sequence
tatgaattatcttattaaa

SEQ ID NO: 19599 - DNA, 19 bp, Artificial sequence
  SiRNA target sequence
atgaattatcttattaaaa

SEQ ID NO: 19600 - DNA, 19 bp, Artificial sequence
  SiRNA target sequence
tgaattatcttattaaaaa

SEQ ID NO: 19601 - DNA, 19 bp, Artificial sequence
  SiRNA target sequence
gaattatcttattaaaaat

SEQ ID NO: 19602 - DNA, 19 bp, Artificial sequence
  SiRNA target sequence
aattatcttattaaaaatc

SEQ ID NO: 19603 - DNA, 19 bp, Artificial sequence
  SiRNA target sequence
attatcttattaaaaatcc

SEQ ID NO: 19604 - DNA, 19 bp, Artificial sequence
  SiRNA target sequence
ttatcttattaaaaatccc

SEQ ID NO: 19605 - DNA, 19 bp, Artificial sequence
  SiRNA target sequence
tatcttattaaaaatcccg

SEQ ID NO: 19606 - DNA, 19 bp, Artificial sequence
  SiRNA target sequence
atcttattaaaaatcccgc

SEQ ID NO: 19607 - DNA, 19 bp, Artificial sequence
  SiRNA target sequence
tcttattaaaaatcccgcc

SEQ ID NO: 19608 - DNA, 19 bp, Artificial sequence
  SiRNA target sequence
cttattaaaaatcccgccc

SEQ ID NO: 19609 - DNA, 19 bp, Artificial sequence
  SiRNA target sequence
ttattaaaaatcccgccca

SEQ ID NO: 19610 - DNA, 19 bp, Artificial sequence
  SiRNA target sequence
tattaaaaatcccgcccaa

SEQ ID NO: 19611 - DNA, 19 bp, Artificial sequence
  SiRNA target sequence
attaaaaatcccgcccaaa

SEQ ID NO: 19612 - DNA, 19 bp, Artificial sequence
  SiRNA target sequence
ttaaaaatcccgcccaaaa

SEQ ID NO: 19613 - DNA, 19 bp, Artificial sequence
  SiRNA target sequence
taaaaatcccgcccaaaag

SEQ ID NO: 19614 - DNA, 19 bp, Artificial sequence
  SiRNA target sequence
aaaaatcccgcccaaaagc

SEQ ID NO: 19615 - DNA, 19 bp, Artificial sequence
  SiRNA target sequence
aaaatcccgcccaaaagct

SEQ ID NO: 19616 - DNA, 19 bp, Artificial sequence
  SiRNA target sequence
aaatcccgcccaaaagctc

SEQ ID NO: 19617 - DNA, 19 bp, Artificial sequence
  SiRNA target sequence
aatcccgcccaaaagctct

SEQ ID NO: 19618 - DNA, 19 bp, Artificial sequence
  SiRNA target sequence
atcccgcccaaaagctcta

SEQ ID NO: 19619 - DNA, 19 bp, Artificial sequence
  SiRNA target sequence
tcccgcccaaaagctctat

SEQ ID NO: 19620 - DNA, 19 bp, Artificial sequence
  SiRNA target sequence
cccgcccaaaagctctata

SEQ ID NO: 19621 - DNA, 19 bp, Artificial sequence
  SiRNA target sequence
ccgcccaaaagctctatac

SEQ ID NO: 19622 - DNA, 19 bp, Artificial sequence
  SiRNA target sequence
cgcccaaaagctctatacc

SEQ ID NO: 19623 - DNA, 19 bp, Artificial sequence
  SiRNA target sequence
gcccaaaagctctatacct

SEQ ID NO: 19624 - DNA, 19 bp, Artificial sequence
  SiRNA target sequence
cccaaaagctctataccta

SEQ ID NO: 19625 - DNA, 19 bp, Artificial sequence
  SiRNA target sequence
ccaaaagctctatacctaa

SEQ ID NO: 19626 - DNA, 19 bp, Artificial sequence
  SiRNA target sequence
caaaagctctatacctaaa

SEQ ID NO: 19627 - DNA, 19 bp, Artificial sequence
  SiRNA target sequence
aaaagctctatacctaaac

SEQ ID NO: 19628 - DNA, 19 bp, Artificial sequence
  SiRNA target sequence
aaagctctatacctaaact

SEQ ID NO: 19629 - DNA, 19 bp, Artificial sequence
  SiRNA target sequence
aagctctatacctaaactc

SEQ ID NO: 19630 - DNA, 19 bp, Artificial sequence
  SiRNA target sequence
agctctatacctaaactca

SEQ ID NO: 19631 - DNA, 19 bp, Artificial sequence
  SiRNA target sequence
gctctatacctaaactcaa

SEQ ID NO: 19632 - DNA, 19 bp, Artificial sequence
  SiRNA target sequence
ctctatacctaaactcaat

SEQ ID NO: 19633 - DNA, 19 bp, Artificial sequence
  SiRNA target sequence
tctatacctaaactcaatg

SEQ ID NO: 19634 - DNA, 19 bp, Artificial sequence
  SiRNA target sequence
ctatacctaaactcaatgg

SEQ ID NO: 19635 - DNA, 19 bp, Artificial sequence
  SiRNA target sequence
tatacctaaactcaatggt

SEQ ID NO: 19636 - DNA, 19 bp, Artificial sequence
  SiRNA target sequence
atacctaaactcaatggta

SEQ ID NO: 19637 - DNA, 19 bp, Artificial sequence
  SiRNA target sequence
tacctaaactcaatggtac

SEQ ID NO: 19638 - DNA, 19 bp, Artificial sequence
  SiRNA target sequence
acctaaactcaatggtact

SEQ ID NO: 19639 - DNA, 19 bp, Artificial sequence
  SiRNA target sequence
cctaaactcaatggtacta

SEQ ID NO: 19640 - DNA, 19 bp, Artificial sequence
  SiRNA target sequence
ctaaactcaatggtactac

SEQ ID NO: 19641 - DNA, 19 bp, Artificial sequence
  SiRNA target sequence
taaactcaatggtactaca

SEQ ID NO: 19642 - DNA, 19 bp, Artificial sequence
  SiRNA target sequence
aaactcaatggtactacat

SEQ ID NO: 19643 - DNA, 19 bp, Artificial sequence
  SiRNA target sequence
aactcaatggtactacatc

SEQ ID NO: 19644 - DNA, 19 bp, Artificial sequence
  SiRNA target sequence
actcaatggtactacatcc

SEQ ID NO: 19645 - DNA, 19 bp, Artificial sequence
  SiRNA target sequence
ctcaatggtactacatcca

SEQ ID NO: 19646 - DNA, 19 bp, Artificial sequence
  SiRNA target sequence
tcaatggtactacatccaa

SEQ ID NO: 19647 - DNA, 19 bp, Artificial sequence
  SiRNA target sequence
caatggtactacatccaat

SEQ ID NO: 19648 - DNA, 19 bp, Artificial sequence
  SiRNA target sequence
aatggtactacatccaata

SEQ ID NO: 19649 - DNA, 19 bp, Artificial sequence
  SiRNA target sequence
atggtactacatccaataa

SEQ ID NO: 19650 - DNA, 19 bp, Artificial sequence
  SiRNA target sequence
tggtactacatccaataat

SEQ ID NO: 19651 - DNA, 19 bp, Artificial sequence
  SiRNA target sequence
ggtactacatccaataata

SEQ ID NO: 19652 - DNA, 19 bp, Artificial sequence
  SiRNA target sequence
gtactacatccaataatag

SEQ ID NO: 19653 - DNA, 19 bp, Artificial sequence
  SiRNA target sequence
tactacatccaataatagg

SEQ ID NO: 19654 - DNA, 19 bp, Artificial sequence
  SiRNA target sequence
actacatccaataatagga

SEQ ID NO: 19655 - DNA, 19 bp, Artificial sequence
  SiRNA target sequence
ctacatccaataataggac

SEQ ID NO: 19656 - DNA, 19 bp, Artificial sequence
  SiRNA target sequence
tacatccaataataggaca

SEQ ID NO: 19657 - DNA, 19 bp, Artificial sequence
  SiRNA target sequence
acatccaataataggacat

SEQ ID NO: 19658 - DNA, 19 bp, Artificial sequence
  SiRNA target sequence
catccaataataggacatc

SEQ ID NO: 19659 - DNA, 19 bp, Artificial sequence
  SiRNA target sequence
atccaataataggacatct

SEQ ID NO: 19660 - DNA, 19 bp, Artificial sequence
  SiRNA target sequence
tccaataataggacatctt

SEQ ID NO: 19661 - DNA, 19 bp, Artificial sequence
  SiRNA target sequence
ccaataataggacatcttt

SEQ ID NO: 19662 - DNA, 19 bp, Artificial sequence
  SiRNA target sequence
caataataggacatctttt

SEQ ID NO: 19663 - DNA, 19 bp, Artificial sequence
  SiRNA target sequence
aataataggacatctttta

SEQ ID NO: 19664 - DNA, 19 bp, Artificial sequence
  SiRNA target sequence
ataataggacatcttttat

SEQ ID NO: 19665 - DNA, 19 bp, Artificial sequence
  SiRNA target sequence
taataggacatcttttatt

SEQ ID NO: 19666 - DNA, 19 bp, Artificial sequence
  SiRNA target sequence
aataggacatcttttattt

SEQ ID NO: 19667 - DNA, 19 bp, Artificial sequence
  SiRNA target sequence
ataggacatcttttatttt

SEQ ID NO: 19668 - DNA, 19 bp, Artificial sequence
  SiRNA target sequence
taggacatcttttattttt

SEQ ID NO: 19669 - DNA, 19 bp, Artificial sequence
  SiRNA target sequence
aggacatcttttatttttc

SEQ ID NO: 19670 - DNA, 19 bp, Artificial sequence
  SiRNA target sequence
ggacatcttttatttttcc

SEQ ID NO: 19671 - DNA, 19 bp, Artificial sequence
  SiRNA target sequence
gacatcttttatttttcct

SEQ ID NO: 19672 - DNA, 19 bp, Artificial sequence
  SiRNA target sequence
acatcttttatttttcctt

SEQ ID NO: 19673 - DNA, 19 bp, Artificial sequence
  SiRNA target sequence
catcttttatttttccttc

SEQ ID NO: 19674 - DNA, 19 bp, Artificial sequence
  SiRNA target sequence
atcttttatttttccttct

SEQ ID NO: 19675 - DNA, 19 bp, Artificial sequence
  SiRNA target sequence
tcttttatttttccttcta

SEQ ID NO: 19676 - DNA, 19 bp, Artificial sequence
  SiRNA target sequence
cttttatttttccttctaa

SEQ ID NO: 19677 - DNA, 19 bp, Artificial sequence
  SiRNA target sequence
ttttatttttccttctaac

SEQ ID NO: 19678 - DNA, 19 bp, Artificial sequence
  SiRNA target sequence
tttatttttccttctaaca

SEQ ID NO: 19679 - DNA, 19 bp, Artificial sequence
  SiRNA target sequence
ttatttttccttctaacac

SEQ ID NO: 19680 - DNA, 19 bp, Artificial sequence
  SiRNA target sequence
tatttttccttctaacacg

SEQ ID NO: 19681 - DNA, 19 bp, Artificial sequence
  SiRNA target sequence
atttttccttctaacacgc

SEQ ID NO: 19682 - DNA, 19 bp, Artificial sequence
  SiRNA target sequence
tttttccttctaacacgcc

SEQ ID NO: 19683 - DNA, 19 bp, Artificial sequence
  SiRNA target sequence
ttttccttctaacacgcct

SEQ ID NO: 19684 - DNA, 19 bp, Artificial sequence
  SiRNA target sequence
tttccttctaacacgcctg

SEQ ID NO: 19685 - DNA, 19 bp, Artificial sequence
  SiRNA target sequence
ttccttctaacacgcctgc

SEQ ID NO: 19686 - DNA, 19 bp, Artificial sequence
  SiRNA target sequence
tccttctaacacgcctgct

SEQ ID NO: 19687 - DNA, 19 bp, Artificial sequence
  SiRNA target sequence
ccttctaacacgcctgctt

SEQ ID NO: 19688 - DNA, 19 bp, Artificial sequence
  SiRNA target sequence
cttctaacacgcctgcttg

SEQ ID NO: 19689 - DNA, 19 bp, Artificial sequence
  SiRNA target sequence
ttctaacacgcctgcttgt

SEQ ID NO: 19690 - DNA, 19 bp, Artificial sequence
  SiRNA target sequence
tctaacacgcctgcttgta

SEQ ID NO: 19691 - DNA, 19 bp, Artificial sequence
  SiRNA target sequence
ctaacacgcctgcttgtag

SEQ ID NO: 19692 - DNA, 19 bp, Artificial sequence
  SiRNA target sequence
taacacgcctgcttgtaga

SEQ ID NO: 19693 - DNA, 19 bp, Artificial sequence
  SiRNA target sequence
aacacgcctgcttgtagag

SEQ ID NO: 19694 - DNA, 19 bp, Artificial sequence
  SiRNA target sequence
acacgcctgcttgtagagc

SEQ ID NO: 19695 - DNA, 19 bp, Artificial sequence
  SiRNA target sequence
cacgcctgcttgtagagcg

SEQ ID NO: 19696 - DNA, 19 bp, Artificial sequence
  SiRNA target sequence
acgcctgcttgtagagcgg

SEQ ID NO: 19697 - DNA, 19 bp, Artificial sequence
  SiRNA target sequence
cgcctgcttgtagagcggc

SEQ ID NO: 19698 - DNA, 19 bp, Artificial sequence
  SiRNA target sequence
gcctgcttgtagagcggcc

SEQ ID NO: 19699 - DNA, 19 bp, Artificial sequence
  SiRNA target sequence
cctgcttgtagagcggccc

SEQ ID NO: 19700 - DNA, 19 bp, Artificial sequence
  SiRNA target sequence
ctgcttgtagagcggcccc

SEQ ID NO: 19701 - DNA, 19 bp, Artificial sequence
  SiRNA target sequence
tgcttgtagagcggcccct

SEQ ID NO: 19702 - DNA, 19 bp, Artificial sequence
  SiRNA target sequence
gcttgtagagcggcccctt

SEQ ID NO: 19703 - DNA, 19 bp, Artificial sequence
  SiRNA target sequence
cttgtagagcggccccttt

SEQ ID NO: 19704 - DNA, 19 bp, Artificial sequence
  SiRNA target sequence
ttgtagagcggccccttta

SEQ ID NO: 19705 - DNA, 19 bp, Artificial sequence
  SiRNA target sequence
tgtagagcggcccctttag

SEQ ID NO: 19706 - DNA, 19 bp, Artificial sequence
  SiRNA target sequence
gtagagcggcccctttagc

SEQ ID NO: 19707 - DNA, 19 bp, Artificial sequence
  SiRNA target sequence
tagagcggcccctttagca

SEQ ID NO: 19708 - DNA, 19 bp, Artificial sequence
  SiRNA target sequence
agagcggcccctttagcaa

SEQ ID NO: 19709 - DNA, 19 bp, Artificial sequence
  SiRNA target sequence
gagcggcccctttagcaac

SEQ ID NO: 19710 - DNA, 19 bp, Artificial sequence
  SiRNA target sequence
agcggcccctttagcaaca

SEQ ID NO: 19711 - DNA, 19 bp, Artificial sequence
  SiRNA target sequence
gcggcccctttagcaacag

SEQ ID NO: 19712 - DNA, 19 bp, Artificial sequence
  SiRNA target sequence
cggcccctttagcaacagc

SEQ ID NO: 19713 - DNA, 19 bp, Artificial sequence
  SiRNA target sequence
ggcccctttagcaacagct

SEQ ID NO: 19714 - DNA, 19 bp, Artificial sequence
  SiRNA target sequence
gcccctttagcaacagctt

SEQ ID NO: 19715 - DNA, 19 bp, Artificial sequence
  SiRNA target sequence
cccctttagcaacagcttc

SEQ ID NO: 19716 - DNA, 19 bp, Artificial sequence
  SiRNA target sequence
ccctttagcaacagcttca

SEQ ID NO: 19717 - DNA, 19 bp, Artificial sequence
  SiRNA target sequence
cctttagcaacagcttcat

SEQ ID NO: 19718 - DNA, 19 bp, Artificial sequence
  SiRNA target sequence
ctttagcaacagcttcatc

SEQ ID NO: 19719 - DNA, 19 bp, Artificial sequence
  SiRNA target sequence
tttagcaacagcttcatct

SEQ ID NO: 19720 - DNA, 19 bp, Artificial sequence
  SiRNA target sequence
ttagcaacagcttcatctg

SEQ ID NO: 19721 - DNA, 19 bp, Artificial sequence
  SiRNA target sequence
tagcaacagcttcatctgg

SEQ ID NO: 19722 - DNA, 19 bp, Artificial sequence
  SiRNA target sequence
agcaacagcttcatctgga

SEQ ID NO: 19723 - DNA, 19 bp, Artificial sequence
  SiRNA target sequence
gcaacagcttcatctggat

SEQ ID NO: 19724 - DNA, 19 bp, Artificial sequence
  SiRNA target sequence
caacagcttcatctggatt

SEQ ID NO: 19725 - DNA, 19 bp, Artificial sequence
  SiRNA target sequence
aacagcttcatctggatta

SEQ ID NO: 19726 - DNA, 19 bp, Artificial sequence
  SiRNA target sequence
acagcttcatctggattaa

SEQ ID NO: 19727 - DNA, 19 bp, Artificial sequence
  SiRNA target sequence
cagcttcatctggattaat

SEQ ID NO: 19728 - DNA, 19 bp, Artificial sequence
  SiRNA target sequence
agcttcatctggattaata

SEQ ID NO: 19729 - DNA, 19 bp, Artificial sequence
  SiRNA target sequence
gcttcatctggattaatat

SEQ ID NO: 19730 - DNA, 19 bp, Artificial sequence
  SiRNA target sequence
cttcatctggattaatatt

SEQ ID NO: 19731 - DNA, 19 bp, Artificial sequence
  SiRNA target sequence
ttcatctggattaatattt

SEQ ID NO: 19732 - DNA, 19 bp, Artificial sequence
  SiRNA target sequence
tcatctggattaatatttg

SEQ ID NO: 19733 - DNA, 19 bp, Artificial sequence
  SiRNA target sequence
catctggattaatatttgt

SEQ ID NO: 19734 - DNA, 19 bp, Artificial sequence
  SiRNA target sequence
atctggattaatatttgta

SEQ ID NO: 19735 - DNA, 19 bp, Artificial sequence
  SiRNA target sequence
tctggattaatatttgtag

SEQ ID NO: 19736 - DNA, 19 bp, Artificial sequence
  SiRNA target sequence
ctggattaatatttgtaga

SEQ ID NO: 19737 - DNA, 19 bp, Artificial sequence
  SiRNA target sequence
tggattaatatttgtagaa

SEQ ID NO: 19738 - DNA, 19 bp, Artificial sequence
  SiRNA target sequence
ggattaatatttgtagaag

SEQ ID NO: 19739 - DNA, 19 bp, Artificial sequence
  SiRNA target sequence
gattaatatttgtagaagg

SEQ ID NO: 19740 - DNA, 19 bp, Artificial sequence
  SiRNA target sequence
attaatatttgtagaaggc

SEQ ID NO: 19741 - DNA, 19 bp, Artificial sequence
  SiRNA target sequence
ttaatatttgtagaaggct

SEQ ID NO: 19742 - DNA, 19 bp, Artificial sequence
  SiRNA target sequence
taatatttgtagaaggctc

SEQ ID NO: 19743 - DNA, 19 bp, Artificial sequence
  SiRNA target sequence
aatatttgtagaaggctcg

SEQ ID NO: 19744 - DNA, 19 bp, Artificial sequence
  SiRNA target sequence
atatttgtagaaggctcga

SEQ ID NO: 19745 - DNA, 19 bp, Artificial sequence
  SiRNA target sequence
tatttgtagaaggctcgat

SEQ ID NO: 19746 - DNA, 19 bp, Artificial sequence
  SiRNA target sequence
atttgtagaaggctcgata

SEQ ID NO: 19747 - DNA, 19 bp, Artificial sequence
  SiRNA target sequence
tttgtagaaggctcgatac

SEQ ID NO: 19748 - DNA, 19 bp, Artificial sequence
  SiRNA target sequence
ttgtagaaggctcgatacc

SEQ ID NO: 19749 - DNA, 19 bp, Artificial sequence
  SiRNA target sequence
tgtagaaggctcgatacca

SEQ ID NO: 19750 - DNA, 19 bp, Artificial sequence
  SiRNA target sequence
gtagaaggctcgataccaa

SEQ ID NO: 19751 - DNA, 19 bp, Artificial sequence
  SiRNA target sequence
tagaaggctcgataccaaa

SEQ ID NO: 19752 - DNA, 19 bp, Artificial sequence
  SiRNA target sequence
agaaggctcgataccaaaa

SEQ ID NO: 19753 - DNA, 19 bp, Artificial sequence
  SiRNA target sequence
gaaggctcgataccaaaaa

SEQ ID NO: 19754 - DNA, 19 bp, Artificial sequence
  SiRNA target sequence
aaggctcgataccaaaaat

SEQ ID NO: 19755 - DNA, 19 bp, Artificial sequence
  SiRNA target sequence
aggctcgataccaaaaatc

SEQ ID NO: 19756 - DNA, 19 bp, Artificial sequence
  SiRNA target sequence
ggctcgataccaaaaatct

SEQ ID NO: 19757 - DNA, 19 bp, Artificial sequence
  SiRNA target sequence
gctcgataccaaaaatctt

SEQ ID NO: 19758 - DNA, 19 bp, Artificial sequence
  SiRNA target sequence
ctcgataccaaaaatcttc

SEQ ID NO: 19759 - DNA, 19 bp, Artificial sequence
  SiRNA target sequence
tcgataccaaaaatcttct

SEQ ID NO: 19760 - DNA, 19 bp, Artificial sequence
  SiRNA target sequence
cgataccaaaaatcttctt

SEQ ID NO: 19761 - DNA, 19 bp, Artificial sequence
  SiRNA target sequence
gataccaaaaatcttctta

SEQ ID NO: 19762 - DNA, 19 bp, Artificial sequence
  SiRNA target sequence
ataccaaaaatcttcttaa

SEQ ID NO: 19763 - DNA, 19 bp, Artificial sequence
  SiRNA target sequence
taccaaaaatcttcttaac

SEQ ID NO: 19764 - DNA, 19 bp, Artificial sequence
  SiRNA target sequence
accaaaaatcttcttaaca

SEQ ID NO: 19765 - DNA, 19 bp, Artificial sequence
  SiRNA target sequence
ccaaaaatcttcttaacaa

SEQ ID NO: 19766 - DNA, 19 bp, Artificial sequence
  SiRNA target sequence
caaaaatcttcttaacaag

SEQ ID NO: 19767 - DNA, 19 bp, Artificial sequence
  SiRNA target sequence
aaaaatcttcttaacaagt

SEQ ID NO: 19768 - DNA, 19 bp, Artificial sequence
  SiRNA target sequence
aaaatcttcttaacaagtt

SEQ ID NO: 19769 - DNA, 19 bp, Artificial sequence
  SiRNA target sequence
aaatcttcttaacaagttt

SEQ ID NO: 19770 - DNA, 19 bp, Artificial sequence
  SiRNA target sequence
aatcttcttaacaagtttt

SEQ ID NO: 19771 - DNA, 19 bp, Artificial sequence
  SiRNA target sequence
atcttcttaacaagttttc

SEQ ID NO: 19772 - DNA, 19 bp, Artificial sequence
  SiRNA target sequence
tcttcttaacaagttttct

SEQ ID NO: 19773 - DNA, 19 bp, Artificial sequence
  SiRNA target sequence
cttcttaacaagttttcta

SEQ ID NO: 19774 - DNA, 19 bp, Artificial sequence
  SiRNA target sequence
ttcttaacaagttttctaa

SEQ ID NO: 19775 - DNA, 19 bp, Artificial sequence
  SiRNA target sequence
tcttaacaagttttctaac

SEQ ID NO: 19776 - DNA, 19 bp, Artificial sequence
  SiRNA target sequence
cttaacaagttttctaaca

SEQ ID NO: 19777 - DNA, 19 bp, Artificial sequence
  SiRNA target sequence
ttaacaagttttctaacat

SEQ ID NO: 19778 - DNA, 19 bp, Artificial sequence
  SiRNA target sequence
taacaagttttctaacata

SEQ ID NO: 19779 - DNA, 19 bp, Artificial sequence
  SiRNA target sequence
aacaagttttctaacatac

SEQ ID NO: 19780 - DNA, 19 bp, Artificial sequence
  SiRNA target sequence
acaagttttctaacatacg

SEQ ID NO: 19781 - DNA, 19 bp, Artificial sequence
  SiRNA target sequence
caagttttctaacatacgg

SEQ ID NO: 19782 - DNA, 19 bp, Artificial sequence
  SiRNA target sequence
aagttttctaacatacggc

SEQ ID NO: 19783 - DNA, 19 bp, Artificial sequence
  SiRNA target sequence
agttttctaacatacggca

SEQ ID NO: 19784 - DNA, 19 bp, Artificial sequence
  SiRNA target sequence
gttttctaacatacggcat

SEQ ID NO: 19785 - DNA, 19 bp, Artificial sequence
  SiRNA target sequence
ttttctaacatacggcatt

SEQ ID NO: 19786 - DNA, 19 bp, Artificial sequence
  SiRNA target sequence
tttctaacatacggcattc

SEQ ID NO: 19787 - DNA, 19 bp, Artificial sequence
  SiRNA target sequence
ttctaacatacggcattcg

SEQ ID NO: 19788 - DNA, 19 bp, Artificial sequence
  SiRNA target sequence
tctaacatacggcattcgt

SEQ ID NO: 19789 - DNA, 19 bp, Artificial sequence
  SiRNA target sequence
ctaacatacggcattcgtg

SEQ ID NO: 19790 - DNA, 19 bp, Artificial sequence
  SiRNA target sequence
taacatacggcattcgtgt

SEQ ID NO: 19791 - DNA, 19 bp, Artificial sequence
  SiRNA target sequence
aacatacggcattcgtgtc

SEQ ID NO: 19792 - DNA, 19 bp, Artificial sequence
  SiRNA target sequence
acatacggcattcgtgtca

SEQ ID NO: 19793 - DNA, 19 bp, Artificial sequence
  SiRNA target sequence
catacggcattcgtgtcat

SEQ ID NO: 19794 - DNA, 19 bp, Artificial sequence
  SiRNA target sequence
atacggcattcgtgtcatt

SEQ ID NO: 19795 - DNA, 19 bp, Artificial sequence
  SiRNA target sequence
tacggcattcgtgtcattc

SEQ ID NO: 19796 - DNA, 19 bp, Artificial sequence
  SiRNA target sequence
acggcattcgtgtcattcc

SEQ ID NO: 19797 - DNA, 19 bp, Artificial sequence
  SiRNA target sequence
cggcattcgtgtcattcca

SEQ ID NO: 19798 - DNA, 19 bp, Artificial sequence
  SiRNA target sequence
ggcattcgtgtcattccac

SEQ ID NO: 19799 - DNA, 19 bp, Artificial sequence
  SiRNA target sequence
gcattcgtgtcattccacc

SEQ ID NO: 19800 - DNA, 19 bp, Artificial sequence
  SiRNA target sequence
cattcgtgtcattccaccc

SEQ ID NO: 19801 - DNA, 19 bp, Artificial sequence
  SiRNA target sequence
attcgtgtcattccaccca

SEQ ID NO: 19802 - DNA, 19 bp, Artificial sequence
  SiRNA target sequence
ttcgtgtcattccacccac

SEQ ID NO: 19803 - DNA, 19 bp, Artificial sequence
  SiRNA target sequence
tcgtgtcattccacccaca

SEQ ID NO: 19804 - DNA, 19 bp, Artificial sequence
  SiRNA target sequence
cgtgtcattccacccacaa

SEQ ID NO: 19805 - DNA, 19 bp, Artificial sequence
  SiRNA target sequence
gtgtcattccacccacaag

SEQ ID NO: 19806 - DNA, 19 bp, Artificial sequence
  SiRNA target sequence
tgtcattccacccacaagt

SEQ ID NO: 19807 - DNA, 19 bp, Artificial sequence
  SiRNA target sequence
gtcattccacccacaagta

SEQ ID NO: 19808 - DNA, 19 bp, Artificial sequence
  SiRNA target sequence
tcattccacccacaagtat

SEQ ID NO: 19809 - DNA, 19 bp, Artificial sequence
  SiRNA target sequence
cattccacccacaagtata

SEQ ID NO: 19810 - DNA, 19 bp, Artificial sequence
  SiRNA target sequence
attccacccacaagtataa

SEQ ID NO: 19811 - DNA, 19 bp, Artificial sequence
  SiRNA target sequence
ttccacccacaagtataac

SEQ ID NO: 19812 - DNA, 19 bp, Artificial sequence
  SiRNA target sequence
tccacccacaagtataacg

SEQ ID NO: 19813 - DNA, 19 bp, Artificial sequence
  SiRNA target sequence
ccacccacaagtataacgt

SEQ ID NO: 19814 - DNA, 19 bp, Artificial sequence
  SiRNA target sequence
cacccacaagtataacgtg

SEQ ID NO: 19815 - DNA, 19 bp, Artificial sequence
  SiRNA target sequence
acccacaagtataacgtgt

SEQ ID NO: 19816 - DNA, 19 bp, Artificial sequence
  SiRNA target sequence
cccacaagtataacgtgtt

SEQ ID NO: 19817 - DNA, 19 bp, Artificial sequence
  SiRNA target sequence
ccacaagtataacgtgttt

SEQ ID NO: 19818 - DNA, 19 bp, Artificial sequence
  SiRNA target sequence
cacaagtataacgtgttta

SEQ ID NO: 19819 - DNA, 19 bp, Artificial sequence
  SiRNA target sequence
acaagtataacgtgtttaa

SEQ ID NO: 19820 - DNA, 19 bp, Artificial sequence
  SiRNA target sequence
caagtataacgtgtttaat

SEQ ID NO: 19821 - DNA, 19 bp, Artificial sequence
  SiRNA target sequence
aagtataacgtgtttaata

SEQ ID NO: 19822 - DNA, 19 bp, Artificial sequence
  SiRNA target sequence
agtataacgtgtttaatat

SEQ ID NO: 19823 - DNA, 19 bp, Artificial sequence
  SiRNA target sequence
gtataacgtgtttaatatc

SEQ ID NO: 19824 - DNA, 19 bp, Artificial sequence
  SiRNA target sequence
tataacgtgtttaatatca

SEQ ID NO: 19825 - DNA, 19 bp, Artificial sequence
  SiRNA target sequence
ataacgtgtttaatatcac

SEQ ID NO: 19826 - DNA, 19 bp, Artificial sequence
  SiRNA target sequence
taacgtgtttaatatcact

SEQ ID NO: 19827 - DNA, 19 bp, Artificial sequence
  SiRNA target sequence
aacgtgtttaatatcactt

SEQ ID NO: 19828 - DNA, 19 bp, Artificial sequence
  SiRNA target sequence
acgtgtttaatatcacttt

SEQ ID NO: 19829 - DNA, 19 bp, Artificial sequence
  SiRNA target sequence
cgtgtttaatatcactttt

SEQ ID NO: 19830 - DNA, 19 bp, Artificial sequence
  SiRNA target sequence
gtgtttaatatcactttta

SEQ ID NO: 19831 - DNA, 19 bp, Artificial sequence
  SiRNA target sequence
tgtttaatatcacttttag

SEQ ID NO: 19832 - DNA, 19 bp, Artificial sequence
  SiRNA target sequence
gtttaatatcacttttagt

SEQ ID NO: 19833 - DNA, 19 bp, Artificial sequence
  SiRNA target sequence
tttaatatcacttttagtt

SEQ ID NO: 19834 - DNA, 19 bp, Artificial sequence
  SiRNA target sequence
ttaatatcacttttagtta

SEQ ID NO: 19835 - DNA, 19 bp, Artificial sequence
  SiRNA target sequence
taatatcacttttagttat

SEQ ID NO: 19836 - DNA, 19 bp, Artificial sequence
  SiRNA target sequence
aatatcacttttagttata

SEQ ID NO: 19837 - DNA, 19 bp, Artificial sequence
  SiRNA target sequence
atatcacttttagttatat

SEQ ID NO: 19838 - DNA, 19 bp, Artificial sequence
  SiRNA target sequence
tatcacttttagttatatt

SEQ ID NO: 19839 - DNA, 19 bp, Artificial sequence
  SiRNA target sequence
atcacttttagttatattg

SEQ ID NO: 19840 - DNA, 19 bp, Artificial sequence
  SiRNA target sequence
tcacttttagttatattgg

SEQ ID NO: 19841 - DNA, 19 bp, Artificial sequence
  SiRNA target sequence
cacttttagttatattggc

SEQ ID NO: 19842 - DNA, 19 bp, Artificial sequence
  SiRNA target sequence
acttttagttatattggca

SEQ ID NO: 19843 - DNA, 19 bp, Artificial sequence
  SiRNA target sequence
cttttagttatattggcat

SEQ ID NO: 19844 - DNA, 19 bp, Artificial sequence
  SiRNA target sequence
ttttagttatattggcatc

SEQ ID NO: 19845 - DNA, 19 bp, Artificial sequence
  SiRNA target sequence
tttagttatattggcatct

SEQ ID NO: 19846 - DNA, 19 bp, Artificial sequence
  SiRNA target sequence
ttagttatattggcatctc

SEQ ID NO: 19847 - DNA, 19 bp, Artificial sequence
  SiRNA target sequence
tagttatattggcatctct

SEQ ID NO: 19848 - DNA, 19 bp, Artificial sequence
  SiRNA target sequence
agttatattggcatctcta

SEQ ID NO: 19849 - DNA, 19 bp, Artificial sequence
  SiRNA target sequence
gttatattggcatctctaa

SEQ ID NO: 19850 - DNA, 19 bp, Artificial sequence
  SiRNA target sequence
ttatattggcatctctaat

SEQ ID NO: 19851 - DNA, 19 bp, Artificial sequence
  SiRNA target sequence
tatattggcatctctaata

SEQ ID NO: 19852 - DNA, 19 bp, Artificial sequence
  SiRNA target sequence
atattggcatctctaatag

SEQ ID NO: 19853 - DNA, 19 bp, Artificial sequence
  SiRNA target sequence
tattggcatctctaatagc

SEQ ID NO: 19854 - DNA, 19 bp, Artificial sequence
  SiRNA target sequence
attggcatctctaatagct

SEQ ID NO: 19855 - DNA, 19 bp, Artificial sequence
  SiRNA target sequence
ttggcatctctaatagctt

SEQ ID NO: 19856 - DNA, 19 bp, Artificial sequence
  SiRNA target sequence
tggcatctctaatagcttt

SEQ ID NO: 19857 - DNA, 19 bp, Artificial sequence
  SiRNA target sequence
ggcatctctaatagcttta

SEQ ID NO: 19858 - DNA, 19 bp, Artificial sequence
  SiRNA target sequence
gcatctctaatagctttaa

SEQ ID NO: 19859 - DNA, 19 bp, Artificial sequence
  SiRNA target sequence
catctctaatagctttaag

SEQ ID NO: 19860 - DNA, 19 bp, Artificial sequence
  SiRNA target sequence
atctctaatagctttaaga

SEQ ID NO: 19861 - DNA, 19 bp, Artificial sequence
  SiRNA target sequence
tctctaatagctttaagac

SEQ ID NO: 19862 - DNA, 19 bp, Artificial sequence
  SiRNA target sequence
ctctaatagctttaagaca

SEQ ID NO: 19863 - DNA, 19 bp, Artificial sequence
  SiRNA target sequence
tctaatagctttaagacag

SEQ ID NO: 19864 - DNA, 19 bp, Artificial sequence
  SiRNA target sequence
ctaatagctttaagacagg

SEQ ID NO: 19865 - DNA, 19 bp, Artificial sequence
  SiRNA target sequence
taatagctttaagacaggg

SEQ ID NO: 19866 - DNA, 19 bp, Artificial sequence
  SiRNA target sequence
aatagctttaagacagggg

SEQ ID NO: 19867 - DNA, 19 bp, Artificial sequence
  SiRNA target sequence
atagctttaagacaggggt

SEQ ID NO: 19868 - DNA, 19 bp, Artificial sequence
  SiRNA target sequence
tagctttaagacaggggtt

SEQ ID NO: 19869 - DNA, 19 bp, Artificial sequence
  SiRNA target sequence
agctttaagacaggggttt

SEQ ID NO: 19870 - DNA, 19 bp, Artificial sequence
  SiRNA target sequence
gctttaagacaggggttta

SEQ ID NO: 19871 - DNA, 19 bp, Artificial sequence
  SiRNA target sequence
ctttaagacaggggtttat

SEQ ID NO: 19872 - DNA, 19 bp, Artificial sequence
  SiRNA target sequence
tttaagacaggggtttatt

SEQ ID NO: 19873 - DNA, 19 bp, Artificial sequence
  SiRNA target sequence
ttaagacaggggtttattg

SEQ ID NO: 19874 - DNA, 19 bp, Artificial sequence
  SiRNA target sequence
taagacaggggtttattgt

SEQ ID NO: 19875 - DNA, 19 bp, Artificial sequence
  SiRNA target sequence
aagacaggggtttattgtt

SEQ ID NO: 19876 - DNA, 19 bp, Artificial sequence
  SiRNA target sequence
agacaggggtttattgttt

SEQ ID NO: 19877 - DNA, 19 bp, Artificial sequence
  SiRNA target sequence
gacaggggtttattgtttt

SEQ ID NO: 19878 - DNA, 19 bp, Artificial sequence
  SiRNA target sequence
acaggggtttattgttttg

SEQ ID NO: 19879 - DNA, 19 bp, Artificial sequence
  SiRNA target sequence
caggggtttattgttttgt

SEQ ID NO: 19880 - DNA, 19 bp, Artificial sequence
  SiRNA target sequence
aggggtttattgttttgtc

SEQ ID NO: 19881 - DNA, 19 bp, Artificial sequence
  SiRNA target sequence
ggggtttattgttttgtct

SEQ ID NO: 19882 - DNA, 19 bp, Artificial sequence
  SiRNA target sequence
gggtttattgttttgtcta

SEQ ID NO: 19883 - DNA, 19 bp, Artificial sequence
  SiRNA target sequence
ggtttattgttttgtctat

SEQ ID NO: 19884 - DNA, 19 bp, Artificial sequence
  SiRNA target sequence
gtttattgttttgtctatt

SEQ ID NO: 19885 - DNA, 19 bp, Artificial sequence
  SiRNA target sequence
tttattgttttgtctatta

SEQ ID NO: 19886 - DNA, 19 bp, Artificial sequence
  SiRNA target sequence
ttattgttttgtctattaa

SEQ ID NO: 19887 - DNA, 19 bp, Artificial sequence
  SiRNA target sequence
tattgttttgtctattaac

SEQ ID NO: 19888 - DNA, 19 bp, Artificial sequence
  SiRNA target sequence
attgttttgtctattaact

SEQ ID NO: 19889 - DNA, 19 bp, Artificial sequence
  SiRNA target sequence
ttgttttgtctattaactt

SEQ ID NO: 19890 - DNA, 19 bp, Artificial sequence
  SiRNA target sequence
tgttttgtctattaacttt

SEQ ID NO: 19891 - DNA, 19 bp, Artificial sequence
  SiRNA target sequence
gttttgtctattaactttt

SEQ ID NO: 19892 - DNA, 19 bp, Artificial sequence
  SiRNA target sequence
ttttgtctattaacttttt

SEQ ID NO: 19893 - DNA, 19 bp, Artificial sequence
  SiRNA target sequence
tttgtctattaactttttt

SEQ ID NO: 19894 - DNA, 19 bp, Artificial sequence
  SiRNA target sequence
ttgtctattaacttttttg

SEQ ID NO: 19895 - DNA, 19 bp, Artificial sequence
  SiRNA target sequence
tgtctattaacttttttgt

SEQ ID NO: 19896 - DNA, 19 bp, Artificial sequence
  SiRNA target sequence
gtctattaacttttttgta

SEQ ID NO: 19897 - DNA, 19 bp, Artificial sequence
  SiRNA target sequence
tctattaacttttttgtaa

SEQ ID NO: 19898 - DNA, 19 bp, Artificial sequence
  SiRNA target sequence
ctattaacttttttgtaat

SEQ ID NO: 19899 - DNA, 19 bp, Artificial sequence
  SiRNA target sequence
tattaacttttttgtaatt

SEQ ID NO: 19900 - DNA, 19 bp, Artificial sequence
  SiRNA target sequence
attaacttttttgtaattt

SEQ ID NO: 19901 - DNA, 19 bp, Artificial sequence
  SiRNA target sequence
ttaacttttttgtaatttt

SEQ ID NO: 19902 - DNA, 19 bp, Artificial sequence
  SiRNA target sequence
taacttttttgtaattttt

SEQ ID NO: 19903 - DNA, 19 bp, Artificial sequence
  SiRNA target sequence
aacttttttgtaatttttt

SEQ ID NO: 19904 - DNA, 19 bp, Artificial sequence
  SiRNA target sequence
acttttttgtaattttttc

SEQ ID NO: 19905 - DNA, 19 bp, Artificial sequence
  SiRNA target sequence
cttttttgtaattttttca

SEQ ID NO: 19906 - DNA, 19 bp, Artificial sequence
  SiRNA target sequence
ttttttgtaattttttcaa

SEQ ID NO: 19907 - DNA, 19 bp, Artificial sequence
  SiRNA target sequence
tttttgtaattttttcaaa

SEQ ID NO: 19908 - DNA, 19 bp, Artificial sequence
  SiRNA target sequence
ttttgtaattttttcaaat

SEQ ID NO: 19909 - DNA, 19 bp, Artificial sequence
  SiRNA target sequence
tttgtaattttttcaaatt

SEQ ID NO: 19910 - DNA, 19 bp, Artificial sequence
  SiRNA target sequence
ttgtaattttttcaaattc

SEQ ID NO: 19911 - DNA, 19 bp, Artificial sequence
  SiRNA target sequence
tgtaattttttcaaattcg

SEQ ID NO: 19912 - DNA, 19 bp, Artificial sequence
  SiRNA target sequence
gtaattttttcaaattcgt

SEQ ID NO: 19913 - DNA, 19 bp, Artificial sequence
  SiRNA target sequence
taattttttcaaattcgtc

SEQ ID NO: 19914 - DNA, 19 bp, Artificial sequence
  SiRNA target sequence
aattttttcaaattcgtcg

SEQ ID NO: 19915 - DNA, 19 bp, Artificial sequence
  SiRNA target sequence
attttttcaaattcgtcgc

SEQ ID NO: 19916 - DNA, 19 bp, Artificial sequence
  SiRNA target sequence
ttttttcaaattcgtcgcg

SEQ ID NO: 19917 - DNA, 19 bp, Artificial sequence
  SiRNA target sequence
tttttcaaattcgtcgcgt

SEQ ID NO: 19918 - DNA, 19 bp, Artificial sequence
  SiRNA target sequence
ttttcaaattcgtcgcgtg

SEQ ID NO: 19919 - DNA, 19 bp, Artificial sequence
  SiRNA target sequence
tttcaaattcgtcgcgtgt

SEQ ID NO: 19920 - DNA, 19 bp, Artificial sequence
  SiRNA target sequence
ttcaaattcgtcgcgtgta

SEQ ID NO: 19921 - DNA, 19 bp, Artificial sequence
  SiRNA target sequence
tcaaattcgtcgcgtgtaa

SEQ ID NO: 19922 - DNA, 19 bp, Artificial sequence
  SiRNA target sequence
caaattcgtcgcgtgtaat

SEQ ID NO: 19923 - DNA, 19 bp, Artificial sequence
  SiRNA target sequence
aaattcgtcgcgtgtaatt

SEQ ID NO: 19924 - DNA, 19 bp, Artificial sequence
  SiRNA target sequence
aattcgtcgcgtgtaatta

SEQ ID NO: 19925 - DNA, 19 bp, Artificial sequence
  SiRNA target sequence
attcgtcgcgtgtaattac

SEQ ID NO: 19926 - DNA, 19 bp, Artificial sequence
  SiRNA target sequence
ttcgtcgcgtgtaattacc

SEQ ID NO: 19927 - DNA, 19 bp, Artificial sequence
  SiRNA target sequence
tcgtcgcgtgtaattacct

SEQ ID NO: 19928 - DNA, 19 bp, Artificial sequence
  SiRNA target sequence
cgtcgcgtgtaattacctc

SEQ ID NO: 19929 - DNA, 19 bp, Artificial sequence
  SiRNA target sequence
gtcgcgtgtaattacctct

SEQ ID NO: 19930 - DNA, 19 bp, Artificial sequence
  SiRNA target sequence
tcgcgtgtaattacctctt

SEQ ID NO: 19931 - DNA, 19 bp, Artificial sequence
  SiRNA target sequence
cgcgtgtaattacctcttt

SEQ ID NO: 19932 - DNA, 19 bp, Artificial sequence
  SiRNA target sequence
gcgtgtaattacctctttt

SEQ ID NO: 19933 - DNA, 19 bp, Artificial sequence
  SiRNA target sequence
cgtgtaattacctctttta

SEQ ID NO: 19934 - DNA, 19 bp, Artificial sequence
  SiRNA target sequence
gtgtaattacctcttttaa

SEQ ID NO: 19935 - DNA, 19 bp, Artificial sequence
  SiRNA target sequence
tgtaattacctcttttaag

SEQ ID NO: 19936 - DNA, 19 bp, Artificial sequence
  SiRNA target sequence
gtaattacctcttttaagt

SEQ ID NO: 19937 - DNA, 19 bp, Artificial sequence
  SiRNA target sequence
taattacctcttttaagtg

SEQ ID NO: 19938 - DNA, 19 bp, Artificial sequence
  SiRNA target sequence
aattacctcttttaagtga

SEQ ID NO: 19939 - DNA, 19 bp, Artificial sequence
  SiRNA target sequence
attacctcttttaagtgat

SEQ ID NO: 19940 - DNA, 19 bp, Artificial sequence
  SiRNA target sequence
ttacctcttttaagtgata

SEQ ID NO: 19941 - DNA, 19 bp, Artificial sequence
  SiRNA target sequence
tacctcttttaagtgataa

SEQ ID NO: 19942 - DNA, 19 bp, Artificial sequence
  SiRNA target sequence
acctcttttaagtgataat

SEQ ID NO: 19943 - DNA, 19 bp, Artificial sequence
  SiRNA target sequence
cctcttttaagtgataatt

SEQ ID NO: 19944 - DNA, 19 bp, Artificial sequence
  SiRNA target sequence
ctcttttaagtgataattc

SEQ ID NO: 19945 - DNA, 19 bp, Artificial sequence
  SiRNA target sequence
tcttttaagtgataattct

SEQ ID NO: 19946 - DNA, 19 bp, Artificial sequence
  SiRNA target sequence
cttttaagtgataattctt

SEQ ID NO: 19947 - DNA, 19 bp, Artificial sequence
  SiRNA target sequence
ttttaagtgataattcttt

SEQ ID NO: 19948 - DNA, 19 bp, Artificial sequence
  SiRNA target sequence
tttaagtgataattctttt

SEQ ID NO: 19949 - DNA, 19 bp, Artificial sequence
  SiRNA target sequence
ttaagtgataattcttttt

SEQ ID NO: 19950 - DNA, 19 bp, Artificial sequence
  SiRNA target sequence
taagtgataattcttttta

SEQ ID NO: 19951 - DNA, 19 bp, Artificial sequence
  SiRNA target sequence
aagtgataattctttttac

SEQ ID NO: 19952 - DNA, 19 bp, Artificial sequence
  SiRNA target sequence
agtgataattctttttact

SEQ ID NO: 19953 - DNA, 19 bp, Artificial sequence
  SiRNA target sequence
gtgataattctttttacta

SEQ ID NO: 19954 - DNA, 19 bp, Artificial sequence
  SiRNA target sequence
tgataattctttttactat

SEQ ID NO: 19955 - DNA, 19 bp, Artificial sequence
  SiRNA target sequence
gataattctttttactatc

SEQ ID NO: 19956 - DNA, 19 bp, Artificial sequence
  SiRNA target sequence
ataattctttttactatcg

SEQ ID NO: 19957 - DNA, 19 bp, Artificial sequence
  SiRNA target sequence
taattctttttactatcgt

SEQ ID NO: 19958 - DNA, 19 bp, Artificial sequence
  SiRNA target sequence
aattctttttactatcgtt

SEQ ID NO: 19959 - DNA, 19 bp, Artificial sequence
  SiRNA target sequence
attctttttactatcgtta

SEQ ID NO: 19960 - DNA, 19 bp, Artificial sequence
  SiRNA target sequence
ttctttttactatcgttat

SEQ ID NO: 19961 - DNA, 19 bp, Artificial sequence
  SiRNA target sequence
tctttttactatcgttata

SEQ ID NO: 19962 - DNA, 19 bp, Artificial sequence
  SiRNA target sequence
ctttttactatcgttataa

SEQ ID NO: 19963 - DNA, 19 bp, Artificial sequence
  SiRNA target sequence
tttttactatcgttataaa

SEQ ID NO: 19964 - DNA, 19 bp, Artificial sequence
  SiRNA target sequence
ttttactatcgttataaat

SEQ ID NO: 19965 - DNA, 19 bp, Artificial sequence
  SiRNA target sequence
tttactatcgttataaata

SEQ ID NO: 19966 - DNA, 19 bp, Artificial sequence
  SiRNA target sequence
ttactatcgttataaatat

SEQ ID NO: 19967 - DNA, 19 bp, Artificial sequence
  SiRNA target sequence
tactatcgttataaatata

SEQ ID NO: 19968 - DNA, 19 bp, Artificial sequence
  SiRNA target sequence
actatcgttataaatatac

SEQ ID NO: 19969 - DNA, 19 bp, Artificial sequence
  SiRNA target sequence
ctatcgttataaatatacg

SEQ ID NO: 19970 - DNA, 19 bp, Artificial sequence
  SiRNA target sequence
tatcgttataaatatacgg

SEQ ID NO: 19971 - DNA, 19 bp, Artificial sequence
  SiRNA target sequence
atcgttataaatatacgga

SEQ ID NO: 19972 - DNA, 19 bp, Artificial sequence
  SiRNA target sequence
tcgttataaatatacggaa

SEQ ID NO: 19973 - DNA, 19 bp, Artificial sequence
  SiRNA target sequence
cgttataaatatacggaat

SEQ ID NO: 19974 - DNA, 19 bp, Artificial sequence
  SiRNA target sequence
gttataaatatacggaata

SEQ ID NO: 19975 - DNA, 19 bp, Artificial sequence
  SiRNA target sequence
ttataaatatacggaatat

SEQ ID NO: 19976 - DNA, 19 bp, Artificial sequence
  SiRNA target sequence
tataaatatacggaatatt

SEQ ID NO: 19977 - DNA, 19 bp, Artificial sequence
  SiRNA target sequence
ataaatatacggaatatta

SEQ ID NO: 19978 - DNA, 19 bp, Artificial sequence
  SiRNA target sequence
taaatatacggaatattaa

SEQ ID NO: 19979 - DNA, 19 bp, Artificial sequence
  SiRNA target sequence
aaatatacggaatattaat

SEQ ID NO: 19980 - DNA, 19 bp, Artificial sequence
  SiRNA target sequence
aatatacggaatattaatt

SEQ ID NO: 19981 - DNA, 19 bp, Artificial sequence
  SiRNA target sequence
atatacggaatattaattt

SEQ ID NO: 19982 - DNA, 19 bp, Artificial sequence
  SiRNA target sequence
tatacggaatattaatttc

SEQ ID NO: 19983 - DNA, 19 bp, Artificial sequence
  SiRNA target sequence
atacggaatattaatttca

SEQ ID NO: 19984 - DNA, 19 bp, Artificial sequence
  SiRNA target sequence
tacggaatattaatttcag

SEQ ID NO: 19985 - DNA, 19 bp, Artificial sequence
  SiRNA target sequence
acggaatattaatttcaga

SEQ ID NO: 19986 - DNA, 19 bp, Artificial sequence
  SiRNA target sequence
cggaatattaatttcagac

SEQ ID NO: 19987 - DNA, 19 bp, Artificial sequence
  SiRNA target sequence
ggaatattaatttcagacg

SEQ ID NO: 19988 - DNA, 19 bp, Artificial sequence
  SiRNA target sequence
gaatattaatttcagacga

SEQ ID NO: 19989 - DNA, 19 bp, Artificial sequence
  SiRNA target sequence
aatattaatttcagacgaa

SEQ ID NO: 19990 - DNA, 19 bp, Artificial sequence
  SiRNA target sequence
atattaatttcagacgaaa

SEQ ID NO: 19991 - DNA, 19 bp, Artificial sequence
  SiRNA target sequence
tattaatttcagacgaaag

SEQ ID NO: 19992 - DNA, 19 bp, Artificial sequence
  SiRNA target sequence
attaatttcagacgaaaga

SEQ ID NO: 19993 - DNA, 19 bp, Artificial sequence
  SiRNA target sequence
ttaatttcagacgaaagat

SEQ ID NO: 19994 - DNA, 19 bp, Artificial sequence
  SiRNA target sequence
taatttcagacgaaagatt

SEQ ID NO: 19995 - DNA, 19 bp, Artificial sequence
  SiRNA target sequence
aatttcagacgaaagatta

SEQ ID NO: 19996 - DNA, 19 bp, Artificial sequence
  SiRNA target sequence
atttcagacgaaagattag

SEQ ID NO: 19997 - DNA, 19 bp, Artificial sequence
  SiRNA target sequence
tttcagacgaaagattaga

SEQ ID NO: 19998 - DNA, 19 bp, Artificial sequence
  SiRNA target sequence
ttcagacgaaagattagac

SEQ ID NO: 19999 - DNA, 19 bp, Artificial sequence
  SiRNA target sequence
tcagacgaaagattagacg

SEQ ID NO: 20000 - DNA, 19 bp, Artificial sequence
  SiRNA target sequence
cagacgaaagattagacga

SEQ ID NO: 20001 - DNA, 19 bp, Artificial sequence
  SiRNA target sequence
agacgaaagattagacgac

SEQ ID NO: 20002 - DNA, 19 bp, Artificial sequence
  SiRNA target sequence
gacgaaagattagacgaca

SEQ ID NO: 20003 - DNA, 19 bp, Artificial sequence
  SiRNA target sequence
acgaaagattagacgacag

SEQ ID NO: 20004 - DNA, 19 bp, Artificial sequence
  SiRNA target sequence
cgaaagattagacgacagt

SEQ ID NO: 20005 - DNA, 19 bp, Artificial sequence
  SiRNA target sequence
gaaagattagacgacagtt

SEQ ID NO: 20006 - DNA, 19 bp, Artificial sequence
  SiRNA target sequence
aaagattagacgacagttc

SEQ ID NO: 20007 - DNA, 19 bp, Artificial sequence
  SiRNA target sequence
aagattagacgacagttct

SEQ ID NO: 20008 - DNA, 19 bp, Artificial sequence
  SiRNA target sequence
agattagacgacagttctt

SEQ ID NO: 20009 - DNA, 19 bp, Artificial sequence
  SiRNA target sequence
gattagacgacagttcttt

SEQ ID NO: 20010 - DNA, 19 bp, Artificial sequence
  SiRNA target sequence
attagacgacagttctttt

SEQ ID NO: 20011 - DNA, 19 bp, Artificial sequence
  SiRNA target sequence
ttagacgacagttcttttt

SEQ ID NO: 20012 - DNA, 19 bp, Artificial sequence
  SiRNA target sequence
tagacgacagttctttttt

SEQ ID NO: 20013 - DNA, 19 bp, Artificial sequence
  SiRNA target sequence
agacgacagttcttttttc

SEQ ID NO: 20014 - DNA, 19 bp, Artificial sequence
  SiRNA target sequence
gacgacagttcttttttca

SEQ ID NO: 20015 - DNA, 19 bp, Artificial sequence
  SiRNA target sequence
acgacagttcttttttcat

SEQ ID NO: 20016 - DNA, 19 bp, Artificial sequence
  SiRNA target sequence
cgacagttcttttttcatt

SEQ ID NO: 20017 - DNA, 19 bp, Artificial sequence
  SiRNA target sequence
gacagttcttttttcattt

SEQ ID NO: 20018 - DNA, 19 bp, Artificial sequence
  SiRNA target sequence
acagttcttttttcatttt

SEQ ID NO: 20019 - DNA, 19 bp, Artificial sequence
  SiRNA target sequence
cagttcttttttcattttt

SEQ ID NO: 20020 - DNA, 19 bp, Artificial sequence
  SiRNA target sequence
agttcttttttcatttttt

SEQ ID NO: 20021 - DNA, 19 bp, Artificial sequence
  SiRNA target sequence
gttcttttttcattttttc

SEQ ID NO: 20022 - DNA, 19 bp, Artificial sequence
  SiRNA target sequence
ttcttttttcattttttcc

SEQ ID NO: 20023 - DNA, 19 bp, Artificial sequence
  SiRNA target sequence
tcttttttcattttttccg

SEQ ID NO: 20024 - DNA, 19 bp, Artificial sequence
  SiRNA target sequence
cttttttcattttttccgc

SEQ ID NO: 20025 - DNA, 19 bp, Artificial sequence
  SiRNA target sequence
ttttttcattttttccgct

SEQ ID NO: 20026 - DNA, 19 bp, Artificial sequence
  SiRNA target sequence
tttttcattttttccgctg

SEQ ID NO: 20027 - DNA, 19 bp, Artificial sequence
  SiRNA target sequence
ttttcattttttccgctgc

SEQ ID NO: 20028 - DNA, 19 bp, Artificial sequence
  SiRNA target sequence
tttcattttttccgctgct

SEQ ID NO: 20029 - DNA, 19 bp, Artificial sequence
  SiRNA target sequence
ttcattttttccgctgctt

SEQ ID NO: 20030 - DNA, 19 bp, Artificial sequence
  SiRNA target sequence
tcattttttccgctgcttc

SEQ ID NO: 20031 - DNA, 19 bp, Artificial sequence
  SiRNA target sequence
cattttttccgctgcttct

SEQ ID NO: 20032 - DNA, 19 bp, Artificial sequence
  SiRNA target sequence
attttttccgctgcttctt

SEQ ID NO: 20033 - DNA, 19 bp, Artificial sequence
  SiRNA target sequence
ttttttccgctgcttcttt

SEQ ID NO: 20034 - DNA, 19 bp, Artificial sequence
  SiRNA target sequence
tttttccgctgcttcttta

SEQ ID NO: 20035 - DNA, 19 bp, Artificial sequence
  SiRNA target sequence
ttttccgctgcttctttaa

SEQ ID NO: 20036 - DNA, 19 bp, Artificial sequence
  SiRNA target sequence
tttccgctgcttctttaat

SEQ ID NO: 20037 - DNA, 19 bp, Artificial sequence
  SiRNA target sequence
ttccgctgcttctttaatt

SEQ ID NO: 20038 - DNA, 19 bp, Artificial sequence
  SiRNA target sequence
tccgctgcttctttaattc

SEQ ID NO: 20039 - DNA, 19 bp, Artificial sequence
  SiRNA target sequence
ccgctgcttctttaattct

SEQ ID NO: 20040 - DNA, 19 bp, Artificial sequence
  SiRNA target sequence
cgctgcttctttaattcta

SEQ ID NO: 20041 - DNA, 19 bp, Artificial sequence
  SiRNA target sequence
gctgcttctttaattctat

SEQ ID NO: 20042 - DNA, 19 bp, Artificial sequence
  SiRNA target sequence
ctgcttctttaattctatt

SEQ ID NO: 20043 - DNA, 19 bp, Artificial sequence
  SiRNA target sequence
tgcttctttaattctatta

SEQ ID NO: 20044 - DNA, 19 bp, Artificial sequence
  SiRNA target sequence
gcttctttaattctattat

SEQ ID NO: 20045 - DNA, 19 bp, Artificial sequence
  SiRNA target sequence
cttctttaattctattata

SEQ ID NO: 20046 - DNA, 19 bp, Artificial sequence
  SiRNA target sequence
ttctttaattctattataa

SEQ ID NO: 20047 - DNA, 19 bp, Artificial sequence
  SiRNA target sequence
tctttaattctattataac

SEQ ID NO: 20048 - DNA, 19 bp, Artificial sequence
  SiRNA target sequence
ctttaattctattataaca

SEQ ID NO: 20049 - DNA, 19 bp, Artificial sequence
  SiRNA target sequence
tttaattctattataacaa

SEQ ID NO: 20050 - DNA, 19 bp, Artificial sequence
  SiRNA target sequence
ttaattctattataacaag

SEQ ID NO: 20051 - DNA, 19 bp, Artificial sequence
  SiRNA target sequence
taattctattataacaaga

SEQ ID NO: 20052 - DNA, 19 bp, Artificial sequence
  SiRNA target sequence
aattctattataacaagaa

SEQ ID NO: 20053 - DNA, 19 bp, Artificial sequence
  SiRNA target sequence
attctattataacaagaat

SEQ ID NO: 20054 - DNA, 19 bp, Artificial sequence
  SiRNA target sequence
ttctattataacaagaatc

SEQ ID NO: 20055 - DNA, 19 bp, Artificial sequence
  SiRNA target sequence
tctattataacaagaatcg

SEQ ID NO: 20056 - DNA, 19 bp, Artificial sequence
  SiRNA target sequence
ctattataacaagaatcgt

SEQ ID NO: 20057 - DNA, 19 bp, Artificial sequence
  SiRNA target sequence
tattataacaagaatcgtg

SEQ ID NO: 20058 - DNA, 19 bp, Artificial sequence
  SiRNA target sequence
attataacaagaatcgtgt

SEQ ID NO: 20059 - DNA, 19 bp, Artificial sequence
  SiRNA target sequence
ttataacaagaatcgtgtt

SEQ ID NO: 20060 - DNA, 19 bp, Artificial sequence
  SiRNA target sequence
tataacaagaatcgtgttt

SEQ ID NO: 20061 - DNA, 19 bp, Artificial sequence
  SiRNA target sequence
ataacaagaatcgtgttta

SEQ ID NO: 20062 - DNA, 19 bp, Artificial sequence
  SiRNA target sequence
taacaagaatcgtgtttaa

SEQ ID NO: 20063 - DNA, 19 bp, Artificial sequence
  SiRNA target sequence
aacaagaatcgtgtttaag

SEQ ID NO: 20064 - DNA, 19 bp, Artificial sequence
  SiRNA target sequence
acaagaatcgtgtttaagt

SEQ ID NO: 20065 - DNA, 19 bp, Artificial sequence
  SiRNA target sequence
caagaatcgtgtttaagta

SEQ ID NO: 20066 - DNA, 19 bp, Artificial sequence
  SiRNA target sequence
aagaatcgtgtttaagtaa

SEQ ID NO: 20067 - DNA, 19 bp, Artificial sequence
  SiRNA target sequence
agaatcgtgtttaagtaaa

SEQ ID NO: 20068 - DNA, 19 bp, Artificial sequence
  SiRNA target sequence
gaatcgtgtttaagtaaat

SEQ ID NO: 20069 - DNA, 19 bp, Artificial sequence
  SiRNA target sequence
aatcgtgtttaagtaaatc

SEQ ID NO: 20070 - DNA, 19 bp, Artificial sequence
  SiRNA target sequence
atcgtgtttaagtaaatca

SEQ ID NO: 20071 - DNA, 19 bp, Artificial sequence
  SiRNA target sequence
tcgtgtttaagtaaatcaa

SEQ ID NO: 20072 - DNA, 19 bp, Artificial sequence
  SiRNA target sequence
cgtgtttaagtaaatcaat

SEQ ID NO: 20073 - DNA, 19 bp, Artificial sequence
  SiRNA target sequence
gtgtttaagtaaatcaatt

SEQ ID NO: 20074 - DNA, 19 bp, Artificial sequence
  SiRNA target sequence
tgtttaagtaaatcaattc

SEQ ID NO: 20075 - DNA, 19 bp, Artificial sequence
  SiRNA target sequence
gtttaagtaaatcaattcc

SEQ ID NO: 20076 - DNA, 19 bp, Artificial sequence
  SiRNA target sequence
tttaagtaaatcaattcct

SEQ ID NO: 20077 - DNA, 19 bp, Artificial sequence
  SiRNA target sequence
ttaagtaaatcaattcctg

SEQ ID NO: 20078 - DNA, 19 bp, Artificial sequence
  SiRNA target sequence
taagtaaatcaattcctgt

SEQ ID NO: 20079 - DNA, 19 bp, Artificial sequence
  SiRNA target sequence
aagtaaatcaattcctgtt

SEQ ID NO: 20080 - DNA, 19 bp, Artificial sequence
  SiRNA target sequence
agtaaatcaattcctgttc

SEQ ID NO: 20081 - DNA, 19 bp, Artificial sequence
  SiRNA target sequence
gtaaatcaattcctgttct

SEQ ID NO: 20082 - DNA, 19 bp, Artificial sequence
  SiRNA target sequence
taaatcaattcctgttcta

SEQ ID NO: 20083 - DNA, 19 bp, Artificial sequence
  SiRNA target sequence
aaatcaattcctgttctac

SEQ ID NO: 20084 - DNA, 19 bp, Artificial sequence
  SiRNA target sequence
aatcaattcctgttctact

SEQ ID NO: 20085 - DNA, 19 bp, Artificial sequence
  SiRNA target sequence
atcaattcctgttctactt

SEQ ID NO: 20086 - DNA, 19 bp, Artificial sequence
  SiRNA target sequence
tcaattcctgttctacttt

SEQ ID NO: 20087 - DNA, 19 bp, Artificial sequence
  SiRNA target sequence
caattcctgttctactttt

SEQ ID NO: 20088 - DNA, 19 bp, Artificial sequence
  SiRNA target sequence
aattcctgttctactttta

SEQ ID NO: 20089 - DNA, 19 bp, Artificial sequence
  SiRNA target sequence
attcctgttctacttttaa

SEQ ID NO: 20090 - DNA, 19 bp, Artificial sequence
  SiRNA target sequence
ttcctgttctacttttaaa

SEQ ID NO: 20091 - DNA, 19 bp, Artificial sequence
  SiRNA target sequence
tcctgttctacttttaaat

SEQ ID NO: 20092 - DNA, 19 bp, Artificial sequence
  SiRNA target sequence
cctgttctacttttaaatt

SEQ ID NO: 20093 - DNA, 19 bp, Artificial sequence
  SiRNA target sequence
ctgttctacttttaaattt

SEQ ID NO: 20094 - DNA, 19 bp, Artificial sequence
  SiRNA target sequence
tgttctacttttaaatttt

SEQ ID NO: 20095 - DNA, 19 bp, Artificial sequence
  SiRNA target sequence
gttctacttttaaattttt

SEQ ID NO: 20096 - DNA, 19 bp, Artificial sequence
  SiRNA target sequence
ttctacttttaaatttttc

SEQ ID NO: 20097 - DNA, 19 bp, Artificial sequence
  SiRNA target sequence
tctacttttaaatttttca

SEQ ID NO: 20098 - DNA, 19 bp, Artificial sequence
  SiRNA target sequence
ctacttttaaatttttcat

SEQ ID NO: 20099 - DNA, 19 bp, Artificial sequence
  SiRNA target sequence
tacttttaaatttttcatt

SEQ ID NO: 20100 - DNA, 19 bp, Artificial sequence
  SiRNA target sequence
acttttaaatttttcatta

SEQ ID NO: 20101 - DNA, 19 bp, Artificial sequence
  SiRNA target sequence
cttttaaatttttcattaa

SEQ ID NO: 20102 - DNA, 19 bp, Artificial sequence
  SiRNA target sequence
ttttaaatttttcattaat

SEQ ID NO: 20103 - DNA, 19 bp, Artificial sequence
  SiRNA target sequence
tttaaatttttcattaata

SEQ ID NO: 20104 - DNA, 19 bp, Artificial sequence
  SiRNA target sequence
ttaaatttttcattaatat

SEQ ID NO: 20105 - DNA, 19 bp, Artificial sequence
  SiRNA target sequence
taaatttttcattaatata

SEQ ID NO: 20106 - DNA, 19 bp, Artificial sequence
  SiRNA target sequence
aaatttttcattaatataa

SEQ ID NO: 20107 - DNA, 19 bp, Artificial sequence
  SiRNA target sequence
aatttttcattaatataat

SEQ ID NO: 20108 - DNA, 19 bp, Artificial sequence
  SiRNA target sequence
atttttcattaatataatc

SEQ ID NO: 20109 - DNA, 19 bp, Artificial sequence
  SiRNA target sequence
tttttcattaatataatct

SEQ ID NO: 20110 - DNA, 19 bp, Artificial sequence
  SiRNA target sequence
ttttcattaatataatcta

SEQ ID NO: 20111 - DNA, 19 bp, Artificial sequence
  SiRNA target sequence
tttcattaatataatctac

SEQ ID NO: 20112 - DNA, 19 bp, Artificial sequence
  SiRNA target sequence
ttcattaatataatctact

SEQ ID NO: 20113 - DNA, 19 bp, Artificial sequence
  SiRNA target sequence
tcattaatataatctacta

SEQ ID NO: 20114 - DNA, 19 bp, Artificial sequence
  SiRNA target sequence
cattaatataatctactaa

SEQ ID NO: 20115 - DNA, 19 bp, Artificial sequence
  SiRNA target sequence
attaatataatctactaaa

SEQ ID NO: 20116 - DNA, 19 bp, Artificial sequence
  SiRNA target sequence
ttaatataatctactaaag

SEQ ID NO: 20117 - DNA, 19 bp, Artificial sequence
  SiRNA target sequence
taatataatctactaaagt

SEQ ID NO: 20118 - DNA, 19 bp, Artificial sequence
  SiRNA target sequence
aatataatctactaaagta

SEQ ID NO: 20119 - DNA, 19 bp, Artificial sequence
  SiRNA target sequence
atataatctactaaagtat

SEQ ID NO: 20120 - DNA, 19 bp, Artificial sequence
  SiRNA target sequence
tataatctactaaagtatt

SEQ ID NO: 20121 - DNA, 19 bp, Artificial sequence
  SiRNA target sequence
ataatctactaaagtatta

SEQ ID NO: 20122 - DNA, 19 bp, Artificial sequence
  SiRNA target sequence
taatctactaaagtattat

SEQ ID NO: 20123 - DNA, 19 bp, Artificial sequence
  SiRNA target sequence
aatctactaaagtattatc

SEQ ID NO: 20124 - DNA, 19 bp, Artificial sequence
  SiRNA target sequence
atctactaaagtattatcc

SEQ ID NO: 20125 - DNA, 19 bp, Artificial sequence
  SiRNA target sequence
tctactaaagtattatcca

SEQ ID NO: 20126 - DNA, 19 bp, Artificial sequence
  SiRNA target sequence
ctactaaagtattatccaa

SEQ ID NO: 20127 - DNA, 19 bp, Artificial sequence
  SiRNA target sequence
tactaaagtattatccaaa

SEQ ID NO: 20128 - DNA, 19 bp, Artificial sequence
  SiRNA target sequence
actaaagtattatccaaat

SEQ ID NO: 20129 - DNA, 19 bp, Artificial sequence
  SiRNA target sequence
ctaaagtattatccaaatc

SEQ ID NO: 20130 - DNA, 19 bp, Artificial sequence
  SiRNA target sequence
taaagtattatccaaatct

SEQ ID NO: 20131 - DNA, 19 bp, Artificial sequence
  SiRNA target sequence
aaagtattatccaaatctt

SEQ ID NO: 20132 - DNA, 19 bp, Artificial sequence
  SiRNA target sequence
aagtattatccaaatcttc

SEQ ID NO: 20133 - DNA, 19 bp, Artificial sequence
  SiRNA target sequence
agtattatccaaatcttct

SEQ ID NO: 20134 - DNA, 19 bp, Artificial sequence
  SiRNA target sequence
gtattatccaaatcttctc

SEQ ID NO: 20135 - DNA, 19 bp, Artificial sequence
  SiRNA target sequence
tattatccaaatcttctcc

SEQ ID NO: 20136 - DNA, 19 bp, Artificial sequence
  SiRNA target sequence
attatccaaatcttctcct

SEQ ID NO: 20137 - DNA, 19 bp, Artificial sequence
  SiRNA target sequence
ttatccaaatcttctcctc

SEQ ID NO: 20138 - DNA, 19 bp, Artificial sequence
  SiRNA target sequence
tatccaaatcttctcctcc

SEQ ID NO: 20139 - DNA, 19 bp, Artificial sequence
  SiRNA target sequence
atccaaatcttctcctcct

SEQ ID NO: 20140 - DNA, 19 bp, Artificial sequence
  SiRNA target sequence
tccaaatcttctcctccta

SEQ ID NO: 20141 - DNA, 19 bp, Artificial sequence
  SiRNA target sequence
ccaaatcttctcctcctaa

SEQ ID NO: 20142 - DNA, 19 bp, Artificial sequence
  SiRNA target sequence
caaatcttctcctcctaaa

SEQ ID NO: 20143 - DNA, 19 bp, Artificial sequence
  SiRNA target sequence
aaatcttctcctcctaaaa

SEQ ID NO: 20144 - DNA, 19 bp, Artificial sequence
  SiRNA target sequence
aatcttctcctcctaaaaa

SEQ ID NO: 20145 - DNA, 19 bp, Artificial sequence
  SiRNA target sequence
atcttctcctcctaaaaaa

SEQ ID NO: 20146 - DNA, 19 bp, Artificial sequence
  SiRNA target sequence
tcttctcctcctaaaaaag

SEQ ID NO: 20147 - DNA, 19 bp, Artificial sequence
  SiRNA target sequence
cttctcctcctaaaaaagt

SEQ ID NO: 20148 - DNA, 19 bp, Artificial sequence
  SiRNA target sequence
ttctcctcctaaaaaagta

SEQ ID NO: 20149 - DNA, 19 bp, Artificial sequence
  SiRNA target sequence
tctcctcctaaaaaagtat

SEQ ID NO: 20150 - DNA, 19 bp, Artificial sequence
  SiRNA target sequence
ctcctcctaaaaaagtatt

SEQ ID NO: 20151 - DNA, 19 bp, Artificial sequence
  SiRNA target sequence
tcctcctaaaaaagtattt

SEQ ID NO: 20152 - DNA, 19 bp, Artificial sequence
  SiRNA target sequence
cctcctaaaaaagtatttc

SEQ ID NO: 20153 - DNA, 19 bp, Artificial sequence
  SiRNA target sequence
ctcctaaaaaagtatttcc

SEQ ID NO: 20154 - DNA, 19 bp, Artificial sequence
  SiRNA target sequence
tcctaaaaaagtatttccg

SEQ ID NO: 20155 - DNA, 19 bp, Artificial sequence
  SiRNA target sequence
cctaaaaaagtatttccgt

SEQ ID NO: 20156 - DNA, 19 bp, Artificial sequence
  SiRNA target sequence
ctaaaaaagtatttccgtt

SEQ ID NO: 20157 - DNA, 19 bp, Artificial sequence
  SiRNA target sequence
taaaaaagtatttccgtta

SEQ ID NO: 20158 - DNA, 19 bp, Artificial sequence
  SiRNA target sequence
aaaaaagtatttccgttag

SEQ ID NO: 20159 - DNA, 19 bp, Artificial sequence
  SiRNA target sequence
aaaaagtatttccgttagt

SEQ ID NO: 20160 - DNA, 19 bp, Artificial sequence
  SiRNA target sequence
aaaagtatttccgttagta

SEQ ID NO: 20161 - DNA, 19 bp, Artificial sequence
  SiRNA target sequence
aaagtatttccgttagtag

SEQ ID NO: 20162 - DNA, 19 bp, Artificial sequence
  SiRNA target sequence
aagtatttccgttagtaga

SEQ ID NO: 20163 - DNA, 19 bp, Artificial sequence
  SiRNA target sequence
agtatttccgttagtagat

SEQ ID NO: 20164 - DNA, 19 bp, Artificial sequence
  SiRNA target sequence
gtatttccgttagtagatt

SEQ ID NO: 20165 - DNA, 19 bp, Artificial sequence
  SiRNA target sequence
tatttccgttagtagattt

SEQ ID NO: 20166 - DNA, 19 bp, Artificial sequence
  SiRNA target sequence
atttccgttagtagatttt

SEQ ID NO: 20167 - DNA, 19 bp, Artificial sequence
  SiRNA target sequence
tttccgttagtagatttta

SEQ ID NO: 20168 - DNA, 19 bp, Artificial sequence
  SiRNA target sequence
ttccgttagtagattttac

SEQ ID NO: 20169 - DNA, 19 bp, Artificial sequence
  SiRNA target sequence
tccgttagtagattttaca

SEQ ID NO: 20170 - DNA, 19 bp, Artificial sequence
  SiRNA target sequence
ccgttagtagattttacat

SEQ ID NO: 20171 - DNA, 19 bp, Artificial sequence
  SiRNA target sequence
cgttagtagattttacatg

SEQ ID NO: 20172 - DNA, 19 bp, Artificial sequence
  SiRNA target sequence
gttagtagattttacatga

SEQ ID NO: 20173 - DNA, 19 bp, Artificial sequence
  SiRNA target sequence
ttagtagattttacatgaa

SEQ ID NO: 20174 - DNA, 19 bp, Artificial sequence
  SiRNA target sequence
tagtagattttacatgaaa

SEQ ID NO: 20175 - DNA, 19 bp, Artificial sequence
  SiRNA target sequence
agtagattttacatgaaaa

SEQ ID NO: 20176 - DNA, 19 bp, Artificial sequence
  SiRNA target sequence
gtagattttacatgaaaaa

SEQ ID NO: 20177 - DNA, 19 bp, Artificial sequence
  SiRNA target sequence
tagattttacatgaaaaat

SEQ ID NO: 20178 - DNA, 19 bp, Artificial sequence
  SiRNA target sequence
agattttacatgaaaaata

SEQ ID NO: 20179 - DNA, 19 bp, Artificial sequence
  SiRNA target sequence
gattttacatgaaaaatac

SEQ ID NO: 20180 - DNA, 19 bp, Artificial sequence
  SiRNA target sequence
attttacatgaaaaatacc

SEQ ID NO: 20181 - DNA, 19 bp, Artificial sequence
  SiRNA target sequence
ttttacatgaaaaatacca

SEQ ID NO: 20182 - DNA, 19 bp, Artificial sequence
  SiRNA target sequence
tttacatgaaaaataccat

SEQ ID NO: 20183 - DNA, 19 bp, Artificial sequence
  SiRNA target sequence
ttacatgaaaaataccatt

SEQ ID NO: 20184 - DNA, 19 bp, Artificial sequence
  SiRNA target sequence
tacatgaaaaataccatta

SEQ ID NO: 20185 - DNA, 19 bp, Artificial sequence
  SiRNA target sequence
acatgaaaaataccattat

SEQ ID NO: 20186 - DNA, 19 bp, Artificial sequence
  SiRNA target sequence
catgaaaaataccattatc

SEQ ID NO: 20187 - DNA, 19 bp, Artificial sequence
  SiRNA target sequence
atgaaaaataccattatct

SEQ ID NO: 20188 - DNA, 19 bp, Artificial sequence
  SiRNA target sequence
tgaaaaataccattatcta

SEQ ID NO: 20189 - DNA, 19 bp, Artificial sequence
  SiRNA target sequence
gaaaaataccattatctaa

SEQ ID NO: 20190 - DNA, 19 bp, Artificial sequence
  SiRNA target sequence
aaaaataccattatctaat

SEQ ID NO: 20191 - DNA, 19 bp, Artificial sequence
  SiRNA target sequence
aaaataccattatctaatt

SEQ ID NO: 20192 - DNA, 19 bp, Artificial sequence
  SiRNA target sequence
aaataccattatctaattc

SEQ ID NO: 20193 - DNA, 19 bp, Artificial sequence
  SiRNA target sequence
aataccattatctaattct

SEQ ID NO: 20194 - DNA, 19 bp, Artificial sequence
  SiRNA target sequence
ataccattatctaattcta

SEQ ID NO: 20195 - DNA, 19 bp, Artificial sequence
  SiRNA target sequence
taccattatctaattctaa

SEQ ID NO: 20196 - DNA, 19 bp, Artificial sequence
  SiRNA target sequence
accattatctaattctaat

SEQ ID NO: 20197 - DNA, 19 bp, Artificial sequence
  SiRNA target sequence
ccattatctaattctaata

SEQ ID NO: 20198 - DNA, 19 bp, Artificial sequence
  SiRNA target sequence
cattatctaattctaatat

SEQ ID NO: 20199 - DNA, 19 bp, Artificial sequence
  SiRNA target sequence
attatctaattctaatata

SEQ ID NO: 20200 - DNA, 19 bp, Artificial sequence
  SiRNA target sequence
ttatctaattctaatatac

SEQ ID NO: 20201 - DNA, 19 bp, Artificial sequence
  SiRNA target sequence
tatctaattctaatatact

SEQ ID NO: 20202 - DNA, 19 bp, Artificial sequence
  SiRNA target sequence
atctaattctaatatacta

SEQ ID NO: 20203 - DNA, 19 bp, Artificial sequence
  SiRNA target sequence
tctaattctaatatactaa

SEQ ID NO: 20204 - DNA, 19 bp, Artificial sequence
  SiRNA target sequence
ctaattctaatatactaat

SEQ ID NO: 20205 - DNA, 19 bp, Artificial sequence
  SiRNA target sequence
taattctaatatactaatg

SEQ ID NO: 20206 - DNA, 19 bp, Artificial sequence
  SiRNA target sequence
aattctaatatactaatgt

SEQ ID NO: 20207 - DNA, 19 bp, Artificial sequence
  SiRNA target sequence
attctaatatactaatgtc

SEQ ID NO: 20208 - DNA, 19 bp, Artificial sequence
  SiRNA target sequence
ttctaatatactaatgtca

SEQ ID NO: 20209 - DNA, 19 bp, Artificial sequence
  SiRNA target sequence
tctaatatactaatgtcaa

SEQ ID NO: 20210 - DNA, 19 bp, Artificial sequence
  SiRNA target sequence
ctaatatactaatgtcaaa

SEQ ID NO: 20211 - DNA, 19 bp, Artificial sequence
  SiRNA target sequence
taatatactaatgtcaaaa

SEQ ID NO: 20212 - DNA, 19 bp, Artificial sequence
  SiRNA target sequence
aatatactaatgtcaaaag

SEQ ID NO: 20213 - DNA, 19 bp, Artificial sequence
  SiRNA target sequence
atatactaatgtcaaaagt

SEQ ID NO: 20214 - DNA, 19 bp, Artificial sequence
  SiRNA target sequence
tatactaatgtcaaaagtt

SEQ ID NO: 20215 - DNA, 19 bp, Artificial sequence
  SiRNA target sequence
atactaatgtcaaaagttc

SEQ ID NO: 20216 - DNA, 19 bp, Artificial sequence
  SiRNA target sequence
tactaatgtcaaaagttcc

SEQ ID NO: 20217 - DNA, 19 bp, Artificial sequence
  SiRNA target sequence
actaatgtcaaaagttcct

SEQ ID NO: 20218 - DNA, 19 bp, Artificial sequence
  SiRNA target sequence
ctaatgtcaaaagttcctc

SEQ ID NO: 20219 - DNA, 19 bp, Artificial sequence
  SiRNA target sequence
taatgtcaaaagttcctcc

SEQ ID NO: 20220 - DNA, 19 bp, Artificial sequence
  SiRNA target sequence
aatgtcaaaagttcctcct

SEQ ID NO: 20221 - DNA, 19 bp, Artificial sequence
  SiRNA target sequence
atgtcaaaagttcctcctc

SEQ ID NO: 20222 - DNA, 19 bp, Artificial sequence
  SiRNA target sequence
tgtcaaaagttcctcctcc

SEQ ID NO: 20223 - DNA, 19 bp, Artificial sequence
  SiRNA target sequence
gtcaaaagttcctcctccc

SEQ ID NO: 20224 - DNA, 19 bp, Artificial sequence
  SiRNA target sequence
tcaaaagttcctcctccca

SEQ ID NO: 20225 - DNA, 19 bp, Artificial sequence
  SiRNA target sequence
caaaagttcctcctcccag

SEQ ID NO: 20226 - DNA, 19 bp, Artificial sequence
  SiRNA target sequence
aaaagttcctcctcccaga

SEQ ID NO: 20227 - DNA, 19 bp, Artificial sequence
  SiRNA target sequence
aaagttcctcctcccagat

SEQ ID NO: 20228 - DNA, 19 bp, Artificial sequence
  SiRNA target sequence
aagttcctcctcccagatc

SEQ ID NO: 20229 - DNA, 19 bp, Artificial sequence
  SiRNA target sequence
agttcctcctcccagatca

SEQ ID NO: 20230 - DNA, 19 bp, Artificial sequence
  SiRNA target sequence
gttcctcctcccagatcat

SEQ ID NO: 20231 - DNA, 19 bp, Artificial sequence
  SiRNA target sequence
ttcctcctcccagatcata

SEQ ID NO: 20232 - DNA, 19 bp, Artificial sequence
  SiRNA target sequence
tcctcctcccagatcataa

SEQ ID NO: 20233 - DNA, 19 bp, Artificial sequence
  SiRNA target sequence
cctcctcccagatcataaa

SEQ ID NO: 20234 - DNA, 19 bp, Artificial sequence
  SiRNA target sequence
ctcctcccagatcataaac

SEQ ID NO: 20235 - DNA, 19 bp, Artificial sequence
  SiRNA target sequence
tcctcccagatcataaaca

SEQ ID NO: 20236 - DNA, 19 bp, Artificial sequence
  SiRNA target sequence
cctcccagatcataaacag

SEQ ID NO: 20237 - DNA, 19 bp, Artificial sequence
  SiRNA target sequence
ctcccagatcataaacagc

SEQ ID NO: 20238 - DNA, 19 bp, Artificial sequence
  SiRNA target sequence
tcccagatcataaacagct

SEQ ID NO: 20239 - DNA, 19 bp, Artificial sequence
  SiRNA target sequence
cccagatcataaacagcta

SEQ ID NO: 20240 - DNA, 19 bp, Artificial sequence
  SiRNA target sequence
ccagatcataaacagctat

SEQ ID NO: 20241 - DNA, 19 bp, Artificial sequence
  SiRNA target sequence
cagatcataaacagctata

SEQ ID NO: 20242 - DNA, 19 bp, Artificial sequence
  SiRNA target sequence
agatcataaacagctataa

SEQ ID NO: 20243 - DNA, 19 bp, Artificial sequence
  SiRNA target sequence
gatcataaacagctataat

SEQ ID NO: 20244 - DNA, 19 bp, Artificial sequence
  SiRNA target sequence
atcataaacagctataata

SEQ ID NO: 20245 - DNA, 19 bp, Artificial sequence
  SiRNA target sequence
tcataaacagctataatac

SEQ ID NO: 20246 - DNA, 19 bp, Artificial sequence
  SiRNA target sequence
cataaacagctataatacc

SEQ ID NO: 20247 - DNA, 19 bp, Artificial sequence
  SiRNA target sequence
ataaacagctataataccc

SEQ ID NO: 20248 - DNA, 19 bp, Artificial sequence
  SiRNA target sequence
taaacagctataataccct

SEQ ID NO: 20249 - DNA, 19 bp, Artificial sequence
  SiRNA target sequence
aaacagctataataccctg

SEQ ID NO: 20250 - DNA, 19 bp, Artificial sequence
  SiRNA target sequence
aacagctataataccctgt

SEQ ID NO: 20251 - DNA, 19 bp, Artificial sequence
  SiRNA target sequence
acagctataataccctgtg

SEQ ID NO: 20252 - DNA, 19 bp, Artificial sequence
  SiRNA target sequence
cagctataataccctgtgc

SEQ ID NO: 20253 - DNA, 19 bp, Artificial sequence
  SiRNA target sequence
agctataataccctgtgca

SEQ ID NO: 20254 - DNA, 19 bp, Artificial sequence
  SiRNA target sequence
gctataataccctgtgcag

SEQ ID NO: 20255 - DNA, 19 bp, Artificial sequence
  SiRNA target sequence
ctataataccctgtgcaga

SEQ ID NO: 20256 - DNA, 19 bp, Artificial sequence
  SiRNA target sequence
tataataccctgtgcagac

SEQ ID NO: 20257 - DNA, 19 bp, Artificial sequence
  SiRNA target sequence
ataataccctgtgcagact

SEQ ID NO: 20258 - DNA, 19 bp, Artificial sequence
  SiRNA target sequence
taataccctgtgcagactt

SEQ ID NO: 20259 - DNA, 19 bp, Artificial sequence
  SiRNA target sequence
aataccctgtgcagacttg

SEQ ID NO: 20260 - DNA, 19 bp, Artificial sequence
  SiRNA target sequence
ataccctgtgcagacttgt

SEQ ID NO: 20261 - DNA, 19 bp, Artificial sequence
  SiRNA target sequence
taccctgtgcagacttgtc

SEQ ID NO: 20262 - DNA, 19 bp, Artificial sequence
  SiRNA target sequence
accctgtgcagacttgtca

SEQ ID NO: 20263 - DNA, 19 bp, Artificial sequence
  SiRNA target sequence
ccctgtgcagacttgtcaa

SEQ ID NO: 20264 - DNA, 19 bp, Artificial sequence
  SiRNA target sequence
cctgtgcagacttgtcaag

SEQ ID NO: 20265 - DNA, 19 bp, Artificial sequence
  SiRNA target sequence
ctgtgcagacttgtcaagc

SEQ ID NO: 20266 - DNA, 19 bp, Artificial sequence
  SiRNA target sequence
tgtgcagacttgtcaagcc

SEQ ID NO: 20267 - DNA, 19 bp, Artificial sequence
  SiRNA target sequence
gtgcagacttgtcaagccc

SEQ ID NO: 20268 - DNA, 19 bp, Artificial sequence
  SiRNA target sequence
tgcagacttgtcaagccca

SEQ ID NO: 20269 - DNA, 19 bp, Artificial sequence
  SiRNA target sequence
gcagacttgtcaagcccat

SEQ ID NO: 20270 - DNA, 19 bp, Artificial sequence
  SiRNA target sequence
cagacttgtcaagcccata

SEQ ID NO: 20271 - DNA, 19 bp, Artificial sequence
  SiRNA target sequence
agacttgtcaagcccataa

SEQ ID NO: 20272 - DNA, 19 bp, Artificial sequence
  SiRNA target sequence
gacttgtcaagcccataag

SEQ ID NO: 20273 - DNA, 19 bp, Artificial sequence
  SiRNA target sequence
acttgtcaagcccataagc

SEQ ID NO: 20274 - DNA, 19 bp, Artificial sequence
  SiRNA target sequence
cttgtcaagcccataagca

SEQ ID NO: 20275 - DNA, 19 bp, Artificial sequence
  SiRNA target sequence
ttgtcaagcccataagcaa

SEQ ID NO: 20276 - DNA, 19 bp, Artificial sequence
  SiRNA target sequence
tgtcaagcccataagcaag

SEQ ID NO: 20277 - DNA, 19 bp, Artificial sequence
  SiRNA target sequence
gtcaagcccataagcaagt

SEQ ID NO: 20278 - DNA, 19 bp, Artificial sequence
  SiRNA target sequence
tcaagcccataagcaagtg

SEQ ID NO: 20279 - DNA, 19 bp, Artificial sequence
  SiRNA target sequence
caagcccataagcaagtgc

SEQ ID NO: 20280 - DNA, 19 bp, Artificial sequence
  SiRNA target sequence
aagcccataagcaagtgct

SEQ ID NO: 20281 - DNA, 19 bp, Artificial sequence
  SiRNA target sequence
agcccataagcaagtgctg

SEQ ID NO: 20282 - DNA, 19 bp, Artificial sequence
  SiRNA target sequence
gcccataagcaagtgctgc

SEQ ID NO: 20283 - DNA, 19 bp, Artificial sequence
  SiRNA target sequence
cccataagcaagtgctgcc

SEQ ID NO: 20284 - DNA, 19 bp, Artificial sequence
  SiRNA target sequence
ccataagcaagtgctgccg

SEQ ID NO: 20285 - DNA, 19 bp, Artificial sequence
  SiRNA target sequence
cataagcaagtgctgccgc

SEQ ID NO: 20286 - DNA, 19 bp, Artificial sequence
  SiRNA target sequence
ataagcaagtgctgccgca

SEQ ID NO: 20287 - DNA, 19 bp, Artificial sequence
  SiRNA target sequence
taagcaagtgctgccgcag

SEQ ID NO: 20288 - DNA, 19 bp, Artificial sequence
  SiRNA target sequence
aagcaagtgctgccgcagt

SEQ ID NO: 20289 - DNA, 19 bp, Artificial sequence
  SiRNA target sequence
agcaagtgctgccgcagta

SEQ ID NO: 20290 - DNA, 19 bp, Artificial sequence
  SiRNA target sequence
gcaagtgctgccgcagtag

SEQ ID NO: 20291 - DNA, 19 bp, Artificial sequence
  SiRNA target sequence
caagtgctgccgcagtagg

SEQ ID NO: 20292 - DNA, 19 bp, Artificial sequence
  SiRNA target sequence
aagtgctgccgcagtaggc

SEQ ID NO: 20293 - DNA, 19 bp, Artificial sequence
  SiRNA target sequence
agtgctgccgcagtaggct

SEQ ID NO: 20294 - DNA, 19 bp, Artificial sequence
  SiRNA target sequence
gtgctgccgcagtaggctc

SEQ ID NO: 20295 - DNA, 19 bp, Artificial sequence
  SiRNA target sequence
tgctgccgcagtaggctca

SEQ ID NO: 20296 - DNA, 19 bp, Artificial sequence
  SiRNA target sequence
gctgccgcagtaggctcat

SEQ ID NO: 20297 - DNA, 19 bp, Artificial sequence
  SiRNA target sequence
ctgccgcagtaggctcatt

SEQ ID NO: 20298 - DNA, 19 bp, Artificial sequence
  SiRNA target sequence
tgccgcagtaggctcatta

SEQ ID NO: 20299 - DNA, 19 bp, Artificial sequence
  SiRNA target sequence
gccgcagtaggctcattaa

SEQ ID NO: 20300 - DNA, 19 bp, Artificial sequence
  SiRNA target sequence
ccgcagtaggctcattaat

SEQ ID NO: 20301 - DNA, 19 bp, Artificial sequence
  SiRNA target sequence
cgcagtaggctcattaatc

SEQ ID NO: 20302 - DNA, 19 bp, Artificial sequence
  SiRNA target sequence
gcagtaggctcattaatca

SEQ ID NO: 20303 - DNA, 19 bp, Artificial sequence
  SiRNA target sequence
cagtaggctcattaatcac

SEQ ID NO: 20304 - DNA, 19 bp, Artificial sequence
  SiRNA target sequence
agtaggctcattaatcact

SEQ ID NO: 20305 - DNA, 19 bp, Artificial sequence
  SiRNA target sequence
gtaggctcattaatcactc

SEQ ID NO: 20306 - DNA, 19 bp, Artificial sequence
  SiRNA target sequence
taggctcattaatcactct

SEQ ID NO: 20307 - DNA, 19 bp, Artificial sequence
  SiRNA target sequence
aggctcattaatcactcta

SEQ ID NO: 20308 - DNA, 19 bp, Artificial sequence
  SiRNA target sequence
ggctcattaatcactctaa

SEQ ID NO: 20309 - DNA, 19 bp, Artificial sequence
  SiRNA target sequence
gctcattaatcactctaag

SEQ ID NO: 20310 - DNA, 19 bp, Artificial sequence
  SiRNA target sequence
ctcattaatcactctaagc

SEQ ID NO: 20311 - DNA, 19 bp, Artificial sequence
  SiRNA target sequence
tcattaatcactctaagca

SEQ ID NO: 20312 - DNA, 19 bp, Artificial sequence
  SiRNA target sequence
cattaatcactctaagcac

SEQ ID NO: 20313 - DNA, 19 bp, Artificial sequence
  SiRNA target sequence
attaatcactctaagcact

SEQ ID NO: 20314 - DNA, 19 bp, Artificial sequence
  SiRNA target sequence
ttaatcactctaagcactt

SEQ ID NO: 20315 - DNA, 19 bp, Artificial sequence
  SiRNA target sequence
taatcactctaagcacttg

SEQ ID NO: 20316 - DNA, 19 bp, Artificial sequence
  SiRNA target sequence
aatcactctaagcacttgt

SEQ ID NO: 20317 - DNA, 19 bp, Artificial sequence
  SiRNA target sequence
atcactctaagcacttgta

SEQ ID NO: 20318 - DNA, 19 bp, Artificial sequence
  SiRNA target sequence
tcactctaagcacttgtaa

SEQ ID NO: 20319 - DNA, 19 bp, Artificial sequence
  SiRNA target sequence
cactctaagcacttgtaat

SEQ ID NO: 20320 - DNA, 19 bp, Artificial sequence
  SiRNA target sequence
actctaagcacttgtaatc

SEQ ID NO: 20321 - DNA, 19 bp, Artificial sequence
  SiRNA target sequence
ctctaagcacttgtaatcc

SEQ ID NO: 20322 - DNA, 19 bp, Artificial sequence
  SiRNA target sequence
tctaagcacttgtaatccc

SEQ ID NO: 20323 - DNA, 19 bp, Artificial sequence
  SiRNA target sequence
ctaagcacttgtaatcccg

SEQ ID NO: 20324 - DNA, 19 bp, Artificial sequence
  SiRNA target sequence
taagcacttgtaatcccgc

SEQ ID NO: 20325 - DNA, 19 bp, Artificial sequence
  SiRNA target sequence
aagcacttgtaatcccgca

SEQ ID NO: 20326 - DNA, 19 bp, Artificial sequence
  SiRNA target sequence
agcacttgtaatcccgcaa

SEQ ID NO: 20327 - DNA, 19 bp, Artificial sequence
  SiRNA target sequence
gcacttgtaatcccgcaat

SEQ ID NO: 20328 - DNA, 19 bp, Artificial sequence
  SiRNA target sequence
cacttgtaatcccgcaatc

SEQ ID NO: 20329 - DNA, 19 bp, Artificial sequence
  SiRNA target sequence
acttgtaatcccgcaatcc

SEQ ID NO: 20330 - DNA, 19 bp, Artificial sequence
  SiRNA target sequence
cttgtaatcccgcaatcct

SEQ ID NO: 20331 - DNA, 19 bp, Artificial sequence
  SiRNA target sequence
ttgtaatcccgcaatcctt

SEQ ID NO: 20332 - DNA, 19 bp, Artificial sequence
  SiRNA target sequence
tgtaatcccgcaatccttc

SEQ ID NO: 20333 - DNA, 19 bp, Artificial sequence
  SiRNA target sequence
gtaatcccgcaatccttcc

SEQ ID NO: 20334 - DNA, 19 bp, Artificial sequence
  SiRNA target sequence
taatcccgcaatccttccc

SEQ ID NO: 20335 - DNA, 19 bp, Artificial sequence
  SiRNA target sequence
aatcccgcaatccttcccg

SEQ ID NO: 20336 - DNA, 19 bp, Artificial sequence
  SiRNA target sequence
atcccgcaatccttcccgc

SEQ ID NO: 20337 - DNA, 19 bp, Artificial sequence
  SiRNA target sequence
tcccgcaatccttcccgca

SEQ ID NO: 20338 - DNA, 19 bp, Artificial sequence
  SiRNA target sequence
cccgcaatccttcccgcat

SEQ ID NO: 20339 - DNA, 19 bp, Artificial sequence
  SiRNA target sequence
ccgcaatccttcccgcatc

SEQ ID NO: 20340 - DNA, 19 bp, Artificial sequence
  SiRNA target sequence
cgcaatccttcccgcatct

SEQ ID NO: 20341 - DNA, 19 bp, Artificial sequence
  SiRNA target sequence
gcaatccttcccgcatctt

SEQ ID NO: 20342 - DNA, 19 bp, Artificial sequence
  SiRNA target sequence
caatccttcccgcatcttt

SEQ ID NO: 20343 - DNA, 19 bp, Artificial sequence
  SiRNA target sequence
aatccttcccgcatcttta

SEQ ID NO: 20344 - DNA, 19 bp, Artificial sequence
  SiRNA target sequence
atccttcccgcatctttag

SEQ ID NO: 20345 - DNA, 19 bp, Artificial sequence
  SiRNA target sequence
tccttcccgcatctttagt

SEQ ID NO: 20346 - DNA, 19 bp, Artificial sequence
  SiRNA target sequence
ccttcccgcatctttagta

SEQ ID NO: 20347 - DNA, 19 bp, Artificial sequence
  SiRNA target sequence
cttcccgcatctttagtag

SEQ ID NO: 20348 - DNA, 19 bp, Artificial sequence
  SiRNA target sequence
ttcccgcatctttagtagc

SEQ ID NO: 20349 - DNA, 19 bp, Artificial sequence
  SiRNA target sequence
tcccgcatctttagtagct

SEQ ID NO: 20350 - DNA, 19 bp, Artificial sequence
  SiRNA target sequence
cccgcatctttagtagctt

SEQ ID NO: 20351 - DNA, 19 bp, Artificial sequence
  SiRNA target sequence
ccgcatctttagtagcttg

SEQ ID NO: 20352 - DNA, 19 bp, Artificial sequence
  SiRNA target sequence
cgcatctttagtagcttgc

SEQ ID NO: 20353 - DNA, 19 bp, Artificial sequence
  SiRNA target sequence
gcatctttagtagcttgcc

SEQ ID NO: 20354 - DNA, 19 bp, Artificial sequence
  SiRNA target sequence
catctttagtagcttgcct

SEQ ID NO: 20355 - DNA, 19 bp, Artificial sequence
  SiRNA target sequence
atctttagtagcttgcctt

SEQ ID NO: 20356 - DNA, 19 bp, Artificial sequence
  SiRNA target sequence
tctttagtagcttgccttt

SEQ ID NO: 20357 - DNA, 19 bp, Artificial sequence
  SiRNA target sequence
ctttagtagcttgcctttg

SEQ ID NO: 20358 - DNA, 19 bp, Artificial sequence
  SiRNA target sequence
tttagtagcttgcctttgc

SEQ ID NO: 20359 - DNA, 19 bp, Artificial sequence
  SiRNA target sequence
ttagtagcttgcctttgca

SEQ ID NO: 20360 - DNA, 19 bp, Artificial sequence
  SiRNA target sequence
tagtagcttgcctttgcat

SEQ ID NO: 20361 - DNA, 19 bp, Artificial sequence
  SiRNA target sequence
agtagcttgcctttgcatg

SEQ ID NO: 20362 - DNA, 19 bp, Artificial sequence
  SiRNA target sequence
gtagcttgcctttgcatgt

SEQ ID NO: 20363 - DNA, 19 bp, Artificial sequence
  SiRNA target sequence
tagcttgcctttgcatgtc

SEQ ID NO: 20364 - DNA, 19 bp, Artificial sequence
  SiRNA target sequence
agcttgcctttgcatgtca

SEQ ID NO: 20365 - DNA, 19 bp, Artificial sequence
  SiRNA target sequence
gcttgcctttgcatgtcat

SEQ ID NO: 20366 - DNA, 19 bp, Artificial sequence
  SiRNA target sequence
cttgcctttgcatgtcatc

SEQ ID NO: 20367 - DNA, 19 bp, Artificial sequence
  SiRNA target sequence
ttgcctttgcatgtcatca

SEQ ID NO: 20368 - DNA, 19 bp, Artificial sequence
  SiRNA target sequence
tgcctttgcatgtcatcaa

SEQ ID NO: 20369 - DNA, 19 bp, Artificial sequence
  SiRNA target sequence
gcctttgcatgtcatcaaa

SEQ ID NO: 20370 - DNA, 19 bp, Artificial sequence
  SiRNA target sequence
cctttgcatgtcatcaaaa

SEQ ID NO: 20371 - DNA, 19 bp, Artificial sequence
  SiRNA target sequence
ctttgcatgtcatcaaaat

SEQ ID NO: 20372 - DNA, 19 bp, Artificial sequence
  SiRNA target sequence
tttgcatgtcatcaaaata

SEQ ID NO: 20373 - DNA, 19 bp, Artificial sequence
  SiRNA target sequence
ttgcatgtcatcaaaatat

SEQ ID NO: 20374 - DNA, 19 bp, Artificial sequence
  SiRNA target sequence
tgcatgtcatcaaaatatg

SEQ ID NO: 20375 - DNA, 19 bp, Artificial sequence
  SiRNA target sequence
gcatgtcatcaaaatatgc

SEQ ID NO: 20376 - DNA, 19 bp, Artificial sequence
  SiRNA target sequence
catgtcatcaaaatatgcg

SEQ ID NO: 20377 - DNA, 19 bp, Artificial sequence
  SiRNA target sequence
atgtcatcaaaatatgcgg

SEQ ID NO: 20378 - DNA, 19 bp, Artificial sequence
  SiRNA target sequence
tgtcatcaaaatatgcggg

SEQ ID NO: 20379 - DNA, 19 bp, Artificial sequence
  SiRNA target sequence
gtcatcaaaatatgcgggc

SEQ ID NO: 20380 - DNA, 19 bp, Artificial sequence
  SiRNA target sequence
tcatcaaaatatgcgggca

SEQ ID NO: 20381 - DNA, 19 bp, Artificial sequence
  SiRNA target sequence
catcaaaatatgcgggcac

SEQ ID NO: 20382 - DNA, 19 bp, Artificial sequence
  SiRNA target sequence
atcaaaatatgcgggcact

SEQ ID NO: 20383 - DNA, 19 bp, Artificial sequence
  SiRNA target sequence
tcaaaatatgcgggcactg

SEQ ID NO: 20384 - DNA, 19 bp, Artificial sequence
  SiRNA target sequence
caaaatatgcgggcactgt

SEQ ID NO: 20385 - DNA, 19 bp, Artificial sequence
  SiRNA target sequence
aaaatatgcgggcactgtt

SEQ ID NO: 20386 - DNA, 19 bp, Artificial sequence
  SiRNA target sequence
aaatatgcgggcactgtta

SEQ ID NO: 20387 - DNA, 19 bp, Artificial sequence
  SiRNA target sequence
aatatgcgggcactgttat

SEQ ID NO: 20388 - DNA, 19 bp, Artificial sequence
  SiRNA target sequence
atatgcgggcactgttata

SEQ ID NO: 20389 - DNA, 19 bp, Artificial sequence
  SiRNA target sequence
tatgcgggcactgttataa

SEQ ID NO: 20390 - DNA, 19 bp, Artificial sequence
  SiRNA target sequence
atgcgggcactgttataac

SEQ ID NO: 20391 - DNA, 19 bp, Artificial sequence
  SiRNA target sequence
tgcgggcactgttataaca

SEQ ID NO: 20392 - DNA, 19 bp, Artificial sequence
  SiRNA target sequence
gcgggcactgttataacag

SEQ ID NO: 20393 - DNA, 19 bp, Artificial sequence
  SiRNA target sequence
cgggcactgttataacaga

SEQ ID NO: 20394 - DNA, 19 bp, Artificial sequence
  SiRNA target sequence
gggcactgttataacagat

SEQ ID NO: 20395 - DNA, 19 bp, Artificial sequence
  SiRNA target sequence
ggcactgttataacagatc

SEQ ID NO: 20396 - DNA, 19 bp, Artificial sequence
  SiRNA target sequence
gcactgttataacagatct

SEQ ID NO: 20397 - DNA, 19 bp, Artificial sequence
  SiRNA target sequence
cactgttataacagatctt

SEQ ID NO: 20398 - DNA, 19 bp, Artificial sequence
  SiRNA target sequence
actgttataacagatctta

SEQ ID NO: 20399 - DNA, 19 bp, Artificial sequence
  SiRNA target sequence
ctgttataacagatcttaa

SEQ ID NO: 20400 - DNA, 19 bp, Artificial sequence
  SiRNA target sequence
tgttataacagatcttaat

SEQ ID NO: 20401 - DNA, 19 bp, Artificial sequence
  SiRNA target sequence
gttataacagatcttaata

SEQ ID NO: 20402 - DNA, 19 bp, Artificial sequence
  SiRNA target sequence
ttataacagatcttaatac

SEQ ID NO: 20403 - DNA, 19 bp, Artificial sequence
  SiRNA target sequence
tataacagatcttaatact

SEQ ID NO: 20404 - DNA, 19 bp, Artificial sequence
  SiRNA target sequence
ataacagatcttaatactt

SEQ ID NO: 20405 - DNA, 19 bp, Artificial sequence
  SiRNA target sequence
taacagatcttaatacttt

SEQ ID NO: 20406 - DNA, 19 bp, Artificial sequence
  SiRNA target sequence
aacagatcttaatacttta

SEQ ID NO: 20407 - DNA, 19 bp, Artificial sequence
  SiRNA target sequence
acagatcttaatactttag

SEQ ID NO: 20408 - DNA, 19 bp, Artificial sequence
  SiRNA target sequence
cagatcttaatactttaga

SEQ ID NO: 20409 - DNA, 19 bp, Artificial sequence
  SiRNA target sequence
agatcttaatactttagaa

SEQ ID NO: 20410 - DNA, 19 bp, Artificial sequence
  SiRNA target sequence
gatcttaatactttagaat

SEQ ID NO: 20411 - DNA, 19 bp, Artificial sequence
  SiRNA target sequence
atcttaatactttagaatt

SEQ ID NO: 20412 - DNA, 19 bp, Artificial sequence
  SiRNA target sequence
tcttaatactttagaattt

SEQ ID NO: 20413 - DNA, 19 bp, Artificial sequence
  SiRNA target sequence
cttaatactttagaattta

SEQ ID NO: 20414 - DNA, 19 bp, Artificial sequence
  SiRNA target sequence
ttaatactttagaatttaa

SEQ ID NO: 20415 - DNA, 19 bp, Artificial sequence
  SiRNA target sequence
taatactttagaatttaaa

SEQ ID NO: 20416 - DNA, 19 bp, Artificial sequence
  SiRNA target sequence
aatactttagaatttaaaa

SEQ ID NO: 20417 - DNA, 19 bp, Artificial sequence
  SiRNA target sequence
atactttagaatttaaaaa

SEQ ID NO: 20418 - DNA, 19 bp, Artificial sequence
  SiRNA target sequence
tactttagaatttaaaaaa

SEQ ID NO: 20419 - DNA, 19 bp, Artificial sequence
  SiRNA target sequence
actttagaatttaaaaaat

SEQ ID NO: 20420 - DNA, 19 bp, Artificial sequence
  SiRNA target sequence
ctttagaatttaaaaaatt

SEQ ID NO: 20421 - DNA, 19 bp, Artificial sequence
  SiRNA target sequence
tttagaatttaaaaaattc

SEQ ID NO: 20422 - DNA, 19 bp, Artificial sequence
  SiRNA target sequence
ttagaatttaaaaaattct

SEQ ID NO: 20423 - DNA, 19 bp, Artificial sequence
  SiRNA target sequence
tagaatttaaaaaattctc

SEQ ID NO: 20424 - DNA, 19 bp, Artificial sequence
  SiRNA target sequence
agaatttaaaaaattctct

SEQ ID NO: 20425 - DNA, 19 bp, Artificial sequence
  SiRNA target sequence
gaatttaaaaaattctctg

SEQ ID NO: 20426 - DNA, 19 bp, Artificial sequence
  SiRNA target sequence
aatttaaaaaattctctgc

SEQ ID NO: 20427 - DNA, 19 bp, Artificial sequence
  SiRNA target sequence
atttaaaaaattctctgcg

SEQ ID NO: 20428 - DNA, 19 bp, Artificial sequence
  SiRNA target sequence
tttaaaaaattctctgcgg

SEQ ID NO: 20429 - DNA, 19 bp, Artificial sequence
  SiRNA target sequence
ttaaaaaattctctgcggc

SEQ ID NO: 20430 - DNA, 19 bp, Artificial sequence
  SiRNA target sequence
taaaaaattctctgcggca

SEQ ID NO: 20431 - DNA, 19 bp, Artificial sequence
  SiRNA target sequence
aaaaaattctctgcggcat

SEQ ID NO: 20432 - DNA, 19 bp, Artificial sequence
  SiRNA target sequence
aaaaattctctgcggcatt

SEQ ID NO: 20433 - DNA, 19 bp, Artificial sequence
  SiRNA target sequence
aaaattctctgcggcattt

SEQ ID NO: 20434 - DNA, 19 bp, Artificial sequence
  SiRNA target sequence
aaattctctgcggcatttt

SEQ ID NO: 20435 - DNA, 19 bp, Artificial sequence
  SiRNA target sequence
aattctctgcggcattttt

SEQ ID NO: 20436 - DNA, 19 bp, Artificial sequence
  SiRNA target sequence
attctctgcggcatttttc

SEQ ID NO: 20437 - DNA, 19 bp, Artificial sequence
  SiRNA target sequence
ttctctgcggcatttttca

SEQ ID NO: 20438 - DNA, 19 bp, Artificial sequence
  SiRNA target sequence
tctctgcggcatttttcat

SEQ ID NO: 20439 - DNA, 19 bp, Artificial sequence
  SiRNA target sequence
ctctgcggcatttttcatt

SEQ ID NO: 20440 - DNA, 19 bp, Artificial sequence
  SiRNA target sequence
tctgcggcatttttcattt

SEQ ID NO: 20441 - DNA, 19 bp, Artificial sequence
  SiRNA target sequence
ctgcggcatttttcatttt

SEQ ID NO: 20442 - DNA, 19 bp, Artificial sequence
  SiRNA target sequence
tgcggcatttttcattttt

SEQ ID NO: 20443 - DNA, 19 bp, Artificial sequence
  SiRNA target sequence
gcggcatttttcatttttg

SEQ ID NO: 20444 - DNA, 19 bp, Artificial sequence
  SiRNA target sequence
cggcatttttcatttttga

SEQ ID NO: 20445 - DNA, 19 bp, Artificial sequence
  SiRNA target sequence
ggcatttttcatttttgac

SEQ ID NO: 20446 - DNA, 19 bp, Artificial sequence
  SiRNA target sequence
gcatttttcatttttgaca

SEQ ID NO: 20447 - DNA, 19 bp, Artificial sequence
  SiRNA target sequence
catttttcatttttgacaa

SEQ ID NO: 20448 - DNA, 19 bp, Artificial sequence
  SiRNA target sequence
atttttcatttttgacaaa

SEQ ID NO: 20449 - DNA, 19 bp, Artificial sequence
  SiRNA target sequence
tttttcatttttgacaaaa

SEQ ID NO: 20450 - DNA, 19 bp, Artificial sequence
  SiRNA target sequence
ttttcatttttgacaaaat

SEQ ID NO: 20451 - DNA, 19 bp, Artificial sequence
  SiRNA target sequence
tttcatttttgacaaaata

SEQ ID NO: 20452 - DNA, 19 bp, Artificial sequence
  SiRNA target sequence
ttcatttttgacaaaataa

SEQ ID NO: 20453 - DNA, 19 bp, Artificial sequence
  SiRNA target sequence
tcatttttgacaaaataaa

SEQ ID NO: 20454 - DNA, 19 bp, Artificial sequence
  SiRNA target sequence
catttttgacaaaataaat

SEQ ID NO: 20455 - DNA, 19 bp, Artificial sequence
  SiRNA target sequence
atttttgacaaaataaatg

SEQ ID NO: 20456 - DNA, 19 bp, Artificial sequence
  SiRNA target sequence
tttttgacaaaataaatgc

SEQ ID NO: 20457 - DNA, 19 bp, Artificial sequence
  SiRNA target sequence
ttttgacaaaataaatgca

SEQ ID NO: 20458 - DNA, 19 bp, Artificial sequence
  SiRNA target sequence
tttgacaaaataaatgcac

SEQ ID NO: 20459 - DNA, 19 bp, Artificial sequence
  SiRNA target sequence
ttgacaaaataaatgcacc

SEQ ID NO: 20460 - DNA, 19 bp, Artificial sequence
  SiRNA target sequence
tgacaaaataaatgcacca

SEQ ID NO: 20461 - DNA, 19 bp, Artificial sequence
  SiRNA target sequence
gacaaaataaatgcaccaa

SEQ ID NO: 20462 - DNA, 19 bp, Artificial sequence
  SiRNA target sequence
acaaaataaatgcaccaat

SEQ ID NO: 20463 - DNA, 19 bp, Artificial sequence
  SiRNA target sequence
caaaataaatgcaccaatt

SEQ ID NO: 20464 - DNA, 19 bp, Artificial sequence
  SiRNA target sequence
aaaataaatgcaccaattt

SEQ ID NO: 20465 - DNA, 19 bp, Artificial sequence
  SiRNA target sequence
aaataaatgcaccaatttg

SEQ ID NO: 20466 - DNA, 19 bp, Artificial sequence
  SiRNA target sequence
aataaatgcaccaatttgt

SEQ ID NO: 20467 - DNA, 19 bp, Artificial sequence
  SiRNA target sequence
ataaatgcaccaatttgtg

SEQ ID NO: 20468 - DNA, 19 bp, Artificial sequence
  SiRNA target sequence
taaatgcaccaatttgtgc

SEQ ID NO: 20469 - DNA, 19 bp, Artificial sequence
  SiRNA target sequence
aaatgcaccaatttgtgca

SEQ ID NO: 20470 - DNA, 19 bp, Artificial sequence
  SiRNA target sequence
aatgcaccaatttgtgcag

SEQ ID NO: 20471 - DNA, 19 bp, Artificial sequence
  SiRNA target sequence
atgcaccaatttgtgcagg

SEQ ID NO: 20472 - DNA, 19 bp, Artificial sequence
  SiRNA target sequence
tgcaccaatttgtgcagga

SEQ ID NO: 20473 - DNA, 19 bp, Artificial sequence
  SiRNA target sequence
gcaccaatttgtgcaggag

SEQ ID NO: 20474 - DNA, 19 bp, Artificial sequence
  SiRNA target sequence
caccaatttgtgcaggaga

SEQ ID NO: 20475 - DNA, 19 bp, Artificial sequence
  SiRNA target sequence
accaatttgtgcaggagaa

SEQ ID NO: 20476 - DNA, 19 bp, Artificial sequence
  SiRNA target sequence
ccaatttgtgcaggagaat

SEQ ID NO: 20477 - DNA, 19 bp, Artificial sequence
  SiRNA target sequence
caatttgtgcaggagaata

SEQ ID NO: 20478 - DNA, 19 bp, Artificial sequence
  SiRNA target sequence
aatttgtgcaggagaatat

SEQ ID NO: 20479 - DNA, 19 bp, Artificial sequence
  SiRNA target sequence
atttgtgcaggagaatatt

SEQ ID NO: 20480 - DNA, 19 bp, Artificial sequence
  SiRNA target sequence
tttgtgcaggagaatattt

SEQ ID NO: 20481 - DNA, 19 bp, Artificial sequence
  SiRNA target sequence
ttgtgcaggagaatatttc

SEQ ID NO: 20482 - DNA, 19 bp, Artificial sequence
  SiRNA target sequence
tgtgcaggagaatatttct

SEQ ID NO: 20483 - DNA, 19 bp, Artificial sequence
  SiRNA target sequence
gtgcaggagaatatttctt

SEQ ID NO: 20484 - DNA, 19 bp, Artificial sequence
  SiRNA target sequence
tgcaggagaatatttctta

SEQ ID NO: 20485 - DNA, 19 bp, Artificial sequence
  SiRNA target sequence
gcaggagaatatttcttat

SEQ ID NO: 20486 - DNA, 19 bp, Artificial sequence
  SiRNA target sequence
caggagaatatttcttatt

SEQ ID NO: 20487 - DNA, 19 bp, Artificial sequence
  SiRNA target sequence
aggagaatatttcttattg

SEQ ID NO: 20488 - DNA, 19 bp, Artificial sequence
  SiRNA target sequence
ggagaatatttcttattgt

SEQ ID NO: 20489 - DNA, 19 bp, Artificial sequence
  SiRNA target sequence
gagaatatttcttattgtc

SEQ ID NO: 20490 - DNA, 19 bp, Artificial sequence
  SiRNA target sequence
agaatatttcttattgtca

SEQ ID NO: 20491 - DNA, 19 bp, Artificial sequence
  SiRNA target sequence
gaatatttcttattgtcaa

SEQ ID NO: 20492 - DNA, 19 bp, Artificial sequence
  SiRNA target sequence
aatatttcttattgtcaat

SEQ ID NO: 20493 - DNA, 19 bp, Artificial sequence
  SiRNA target sequence
atatttcttattgtcaatt

SEQ ID NO: 20494 - DNA, 19 bp, Artificial sequence
  SiRNA target sequence
tatttcttattgtcaattt

SEQ ID NO: 20495 - DNA, 19 bp, Artificial sequence
  SiRNA target sequence
atttcttattgtcaatttt

SEQ ID NO: 20496 - DNA, 19 bp, Artificial sequence
  SiRNA target sequence
tttcttattgtcaattttt

SEQ ID NO: 20497 - DNA, 19 bp, Artificial sequence
  SiRNA target sequence
ttcttattgtcaattttta

SEQ ID NO: 20498 - DNA, 19 bp, Artificial sequence
  SiRNA target sequence
tcttattgtcaatttttat

SEQ ID NO: 20499 - DNA, 19 bp, Artificial sequence
  SiRNA target sequence
cttattgtcaatttttatc

SEQ ID NO: 20500 - DNA, 19 bp, Artificial sequence
  SiRNA target sequence
ttattgtcaatttttatcc

SEQ ID NO: 20501 - DNA, 19 bp, Artificial sequence
  SiRNA target sequence
tattgtcaatttttatcca

SEQ ID NO: 20502 - DNA, 19 bp, Artificial sequence
  SiRNA target sequence
attgtcaatttttatccaa

SEQ ID NO: 20503 - DNA, 19 bp, Artificial sequence
  SiRNA target sequence
ttgtcaatttttatccaaa

SEQ ID NO: 20504 - DNA, 19 bp, Artificial sequence
  SiRNA target sequence
tgtcaatttttatccaaat

SEQ ID NO: 20505 - DNA, 19 bp, Artificial sequence
  SiRNA target sequence
gtcaatttttatccaaata

SEQ ID NO: 20506 - DNA, 19 bp, Artificial sequence
  SiRNA target sequence
tcaatttttatccaaatat

SEQ ID NO: 20507 - DNA, 19 bp, Artificial sequence
  SiRNA target sequence
caatttttatccaaatatc

SEQ ID NO: 20508 - DNA, 19 bp, Artificial sequence
  SiRNA target sequence
aatttttatccaaatatcg

SEQ ID NO: 20509 - DNA, 19 bp, Artificial sequence
  SiRNA target sequence
atttttatccaaatatcgc

SEQ ID NO: 20510 - DNA, 19 bp, Artificial sequence
  SiRNA target sequence
tttttatccaaatatcgcc

SEQ ID NO: 20511 - DNA, 19 bp, Artificial sequence
  SiRNA target sequence
ttttatccaaatatcgccg

SEQ ID NO: 20512 - DNA, 19 bp, Artificial sequence
  SiRNA target sequence
tttatccaaatatcgccgt

SEQ ID NO: 20513 - DNA, 19 bp, Artificial sequence
  SiRNA target sequence
ttatccaaatatcgccgtt

SEQ ID NO: 20514 - DNA, 19 bp, Artificial sequence
  SiRNA target sequence
tatccaaatatcgccgtta

SEQ ID NO: 20515 - DNA, 19 bp, Artificial sequence
  SiRNA target sequence
atccaaatatcgccgttac

SEQ ID NO: 20516 - DNA, 19 bp, Artificial sequence
  SiRNA target sequence
tccaaatatcgccgttaca

SEQ ID NO: 20517 - DNA, 19 bp, Artificial sequence
  SiRNA target sequence
ccaaatatcgccgttacaa

SEQ ID NO: 20518 - DNA, 19 bp, Artificial sequence
  SiRNA target sequence
caaatatcgccgttacaat

SEQ ID NO: 20519 - DNA, 19 bp, Artificial sequence
  SiRNA target sequence
aaatatcgccgttacaatg

SEQ ID NO: 20520 - DNA, 19 bp, Artificial sequence
  SiRNA target sequence
aatatcgccgttacaatgc

SEQ ID NO: 20521 - DNA, 19 bp, Artificial sequence
  SiRNA target sequence
atatcgccgttacaatgct

SEQ ID NO: 20522 - DNA, 19 bp, Artificial sequence
  SiRNA target sequence
tatcgccgttacaatgctt

SEQ ID NO: 20523 - DNA, 19 bp, Artificial sequence
  SiRNA target sequence
atcgccgttacaatgctta

SEQ ID NO: 20524 - DNA, 19 bp, Artificial sequence
  SiRNA target sequence
tcgccgttacaatgcttag

SEQ ID NO: 20525 - DNA, 19 bp, Artificial sequence
  SiRNA target sequence
cgccgttacaatgcttagt

SEQ ID NO: 20526 - DNA, 19 bp, Artificial sequence
  SiRNA target sequence
gccgttacaatgcttagta

SEQ ID NO: 20527 - DNA, 19 bp, Artificial sequence
  SiRNA target sequence
ccgttacaatgcttagtag

SEQ ID NO: 20528 - DNA, 19 bp, Artificial sequence
  SiRNA target sequence
cgttacaatgcttagtagt

SEQ ID NO: 20529 - DNA, 19 bp, Artificial sequence
  SiRNA target sequence
gttacaatgcttagtagtg

SEQ ID NO: 20530 - DNA, 19 bp, Artificial sequence
  SiRNA target sequence
ttacaatgcttagtagtgt

SEQ ID NO: 20531 - DNA, 19 bp, Artificial sequence
  SiRNA target sequence
tacaatgcttagtagtgtc

SEQ ID NO: 20532 - DNA, 19 bp, Artificial sequence
  SiRNA target sequence
acaatgcttagtagtgtca

SEQ ID NO: 20533 - DNA, 19 bp, Artificial sequence
  SiRNA target sequence
caatgcttagtagtgtcat

SEQ ID NO: 20534 - DNA, 19 bp, Artificial sequence
  SiRNA target sequence
aatgcttagtagtgtcata

SEQ ID NO: 20535 - DNA, 19 bp, Artificial sequence
  SiRNA target sequence
atgcttagtagtgtcatat

SEQ ID NO: 20536 - DNA, 19 bp, Artificial sequence
  SiRNA target sequence
tgcttagtagtgtcatatg

SEQ ID NO: 20537 - DNA, 19 bp, Artificial sequence
  SiRNA target sequence
gcttagtagtgtcatatgg

SEQ ID NO: 20538 - DNA, 19 bp, Artificial sequence
  SiRNA target sequence
cttagtagtgtcatatggt

SEQ ID NO: 20539 - DNA, 19 bp, Artificial sequence
  SiRNA target sequence
ttagtagtgtcatatggta

SEQ ID NO: 20540 - DNA, 19 bp, Artificial sequence
  SiRNA target sequence
tagtagtgtcatatggtaa

SEQ ID NO: 20541 - DNA, 19 bp, Artificial sequence
  SiRNA target sequence
agtagtgtcatatggtaag

SEQ ID NO: 20542 - DNA, 19 bp, Artificial sequence
  SiRNA target sequence
gtagtgtcatatggtaagc

SEQ ID NO: 20543 - DNA, 19 bp, Artificial sequence
  SiRNA target sequence
tagtgtcatatggtaagct

SEQ ID NO: 20544 - DNA, 19 bp, Artificial sequence
  SiRNA target sequence
agtgtcatatggtaagctt

SEQ ID NO: 20545 - DNA, 19 bp, Artificial sequence
  SiRNA target sequence
gtgtcatatggtaagcttt

SEQ ID NO: 20546 - DNA, 19 bp, Artificial sequence
  SiRNA target sequence
tgtcatatggtaagctttt

SEQ ID NO: 20547 - DNA, 19 bp, Artificial sequence
  SiRNA target sequence
gtcatatggtaagcttttt

SEQ ID NO: 20548 - DNA, 19 bp, Artificial sequence
  SiRNA target sequence
tcatatggtaagcttttta

SEQ ID NO: 20549 - DNA, 19 bp, Artificial sequence
  SiRNA target sequence
catatggtaagctttttaa

SEQ ID NO: 20550 - DNA, 19 bp, Artificial sequence
  SiRNA target sequence
atatggtaagctttttaaa

SEQ ID NO: 20551 - DNA, 19 bp, Artificial sequence
  SiRNA target sequence
tatggtaagctttttaaat

SEQ ID NO: 20552 - DNA, 19 bp, Artificial sequence
  SiRNA target sequence
atggtaagctttttaaata

SEQ ID NO: 20553 - DNA, 19 bp, Artificial sequence
  SiRNA target sequence
tggtaagctttttaaataa

SEQ ID NO: 20554 - DNA, 19 bp, Artificial sequence
  SiRNA target sequence
ggtaagctttttaaataat

SEQ ID NO: 20555 - DNA, 19 bp, Artificial sequence
  SiRNA target sequence
gtaagctttttaaataatc

SEQ ID NO: 20556 - DNA, 19 bp, Artificial sequence
  SiRNA target sequence
taagctttttaaataatct

SEQ ID NO: 20557 - DNA, 19 bp, Artificial sequence
  SiRNA target sequence
aagctttttaaataatctt

SEQ ID NO: 20558 - DNA, 19 bp, Artificial sequence
  SiRNA target sequence
agctttttaaataatcttt

SEQ ID NO: 20559 - DNA, 19 bp, Artificial sequence
  SiRNA target sequence
gctttttaaataatctttt

SEQ ID NO: 20560 - DNA, 19 bp, Artificial sequence
  SiRNA target sequence
ctttttaaataatctttta

SEQ ID NO: 20561 - DNA, 19 bp, Artificial sequence
  SiRNA target sequence
tttttaaataatcttttaa

SEQ ID NO: 20562 - DNA, 19 bp, Artificial sequence
  SiRNA target sequence
ttttaaataatcttttaat

SEQ ID NO: 20563 - DNA, 19 bp, Artificial sequence
  SiRNA target sequence
tttaaataatcttttaatt

SEQ ID NO: 20564 - DNA, 19 bp, Artificial sequence
  SiRNA target sequence
ttaaataatcttttaattc

SEQ ID NO: 20565 - DNA, 19 bp, Artificial sequence
  SiRNA target sequence
taaataatcttttaattct

SEQ ID NO: 20566 - DNA, 19 bp, Artificial sequence
  SiRNA target sequence
aaataatcttttaattcta

SEQ ID NO: 20567 - DNA, 19 bp, Artificial sequence
  SiRNA target sequence
aataatcttttaattctac

SEQ ID NO: 20568 - DNA, 19 bp, Artificial sequence
  SiRNA target sequence
ataatcttttaattctaca

SEQ ID NO: 20569 - DNA, 19 bp, Artificial sequence
  SiRNA target sequence
taatcttttaattctacat

SEQ ID NO: 20570 - DNA, 19 bp, Artificial sequence
  SiRNA target sequence
aatcttttaattctacatc

SEQ ID NO: 20571 - DNA, 19 bp, Artificial sequence
  SiRNA target sequence
atcttttaattctacatca

SEQ ID NO: 20572 - DNA, 19 bp, Artificial sequence
  SiRNA target sequence
tcttttaattctacatcat

SEQ ID NO: 20573 - DNA, 19 bp, Artificial sequence
  SiRNA target sequence
cttttaattctacatcatc

SEQ ID NO: 20574 - DNA, 19 bp, Artificial sequence
  SiRNA target sequence
ttttaattctacatcatca

SEQ ID NO: 20575 - DNA, 19 bp, Artificial sequence
  SiRNA target sequence
tttaattctacatcatcaa

SEQ ID NO: 20576 - DNA, 19 bp, Artificial sequence
  SiRNA target sequence
ttaattctacatcatcaaa

SEQ ID NO: 20577 - DNA, 19 bp, Artificial sequence
  SiRNA target sequence
taattctacatcatcaaat

SEQ ID NO: 20578 - DNA, 19 bp, Artificial sequence
  SiRNA target sequence
aattctacatcatcaaatt

SEQ ID NO: 20579 - DNA, 19 bp, Artificial sequence
  SiRNA target sequence
attctacatcatcaaattt

SEQ ID NO: 20580 - DNA, 19 bp, Artificial sequence
  SiRNA target sequence
ttctacatcatcaaatttt

SEQ ID NO: 20581 - DNA, 19 bp, Artificial sequence
  SiRNA target sequence
tctacatcatcaaattttc

SEQ ID NO: 20582 - DNA, 19 bp, Artificial sequence
  SiRNA target sequence
ctacatcatcaaattttcg

SEQ ID NO: 20583 - DNA, 19 bp, Artificial sequence
  SiRNA target sequence
tacatcatcaaattttcgt

SEQ ID NO: 20584 - DNA, 19 bp, Artificial sequence
  SiRNA target sequence
acatcatcaaattttcgtc

SEQ ID NO: 20585 - DNA, 19 bp, Artificial sequence
  SiRNA target sequence
catcatcaaattttcgtcc

SEQ ID NO: 20586 - DNA, 19 bp, Artificial sequence
  SiRNA target sequence
atcatcaaattttcgtccc

SEQ ID NO: 20587 - DNA, 19 bp, Artificial sequence
  SiRNA target sequence
tcatcaaattttcgtccca

SEQ ID NO: 20588 - DNA, 19 bp, Artificial sequence
  SiRNA target sequence
catcaaattttcgtcccag

SEQ ID NO: 20589 - DNA, 19 bp, Artificial sequence
  SiRNA target sequence
atcaaattttcgtcccagc

SEQ ID NO: 20590 - DNA, 19 bp, Artificial sequence
  SiRNA target sequence
tcaaattttcgtcccagca

SEQ ID NO: 20591 - DNA, 19 bp, Artificial sequence
  SiRNA target sequence
caaattttcgtcccagcaa

SEQ ID NO: 20592 - DNA, 19 bp, Artificial sequence
  SiRNA target sequence
aaattttcgtcccagcaat

SEQ ID NO: 20593 - DNA, 19 bp, Artificial sequence
  SiRNA target sequence
aattttcgtcccagcaatc

SEQ ID NO: 20594 - DNA, 19 bp, Artificial sequence
  SiRNA target sequence
attttcgtcccagcaatct

SEQ ID NO: 20595 - DNA, 19 bp, Artificial sequence
  SiRNA target sequence
ttttcgtcccagcaatctc

SEQ ID NO: 20596 - DNA, 19 bp, Artificial sequence
  SiRNA target sequence
tttcgtcccagcaatctct

SEQ ID NO: 20597 - DNA, 19 bp, Artificial sequence
  SiRNA target sequence
ttcgtcccagcaatctctt

SEQ ID NO: 20598 - DNA, 19 bp, Artificial sequence
  SiRNA target sequence
tcgtcccagcaatctctta

SEQ ID NO: 20599 - DNA, 19 bp, Artificial sequence
  SiRNA target sequence
cgtcccagcaatctcttag

SEQ ID NO: 20600 - DNA, 19 bp, Artificial sequence
  SiRNA target sequence
gtcccagcaatctcttaga

SEQ ID NO: 20601 - DNA, 19 bp, Artificial sequence
  SiRNA target sequence
tcccagcaatctcttagac

SEQ ID NO: 20602 - DNA, 19 bp, Artificial sequence
  SiRNA target sequence
cccagcaatctcttagacg

SEQ ID NO: 20603 - DNA, 19 bp, Artificial sequence
  SiRNA target sequence
ccagcaatctcttagacgc

SEQ ID NO: 20604 - DNA, 19 bp, Artificial sequence
  SiRNA target sequence
cagcaatctcttagacgca

SEQ ID NO: 20605 - DNA, 19 bp, Artificial sequence
  SiRNA target sequence
agcaatctcttagacgcaa

SEQ ID NO: 20606 - DNA, 19 bp, Artificial sequence
  SiRNA target sequence
gcaatctcttagacgcaaa

SEQ ID NO: 20607 - DNA, 19 bp, Artificial sequence
  SiRNA target sequence
caatctcttagacgcaaaa

SEQ ID NO: 20608 - DNA, 19 bp, Artificial sequence
  SiRNA target sequence
aatctcttagacgcaaaaa

SEQ ID NO: 20609 - DNA, 19 bp, Artificial sequence
  SiRNA target sequence
atctcttagacgcaaaaat

SEQ ID NO: 20610 - DNA, 19 bp, Artificial sequence
  SiRNA target sequence
tctcttagacgcaaaaatc

SEQ ID NO: 20611 - DNA, 19 bp, Artificial sequence
  SiRNA target sequence
ctcttagacgcaaaaatcg

SEQ ID NO: 20612 - DNA, 19 bp, Artificial sequence
  SiRNA target sequence
tcttagacgcaaaaatcgt

SEQ ID NO: 20613 - DNA, 19 bp, Artificial sequence
  SiRNA target sequence
cttagacgcaaaaatcgta

SEQ ID NO: 20614 - DNA, 19 bp, Artificial sequence
  SiRNA target sequence
ttagacgcaaaaatcgtat

SEQ ID NO: 20615 - DNA, 19 bp, Artificial sequence
  SiRNA target sequence
tagacgcaaaaatcgtatt

SEQ ID NO: 20616 - DNA, 19 bp, Artificial sequence
  SiRNA target sequence
agacgcaaaaatcgtattc

SEQ ID NO: 20617 - DNA, 19 bp, Artificial sequence
  SiRNA target sequence
gacgcaaaaatcgtattct

SEQ ID NO: 20618 - DNA, 19 bp, Artificial sequence
  SiRNA target sequence
acgcaaaaatcgtattctt

SEQ ID NO: 20619 - DNA, 19 bp, Artificial sequence
  SiRNA target sequence
cgcaaaaatcgtattcttg

SEQ ID NO: 20620 - DNA, 19 bp, Artificial sequence
  SiRNA target sequence
gcaaaaatcgtattcttgg

SEQ ID NO: 20621 - DNA, 19 bp, Artificial sequence
  SiRNA target sequence
caaaaatcgtattcttggg

SEQ ID NO: 20622 - DNA, 19 bp, Artificial sequence
  SiRNA target sequence
aaaaatcgtattcttggga

SEQ ID NO: 20623 - DNA, 19 bp, Artificial sequence
  SiRNA target sequence
aaaatcgtattcttgggat

SEQ ID NO: 20624 - DNA, 19 bp, Artificial sequence
  SiRNA target sequence
aaatcgtattcttgggatg

SEQ ID NO: 20625 - DNA, 19 bp, Artificial sequence
  SiRNA target sequence
aatcgtattcttgggatgt

SEQ ID NO: 20626 - DNA, 19 bp, Artificial sequence
  SiRNA target sequence
atcgtattcttgggatgta

SEQ ID NO: 20627 - DNA, 19 bp, Artificial sequence
  SiRNA target sequence
tcgtattcttgggatgtaa

SEQ ID NO: 20628 - DNA, 19 bp, Artificial sequence
  SiRNA target sequence
cgtattcttgggatgtaat

SEQ ID NO: 20629 - DNA, 19 bp, Artificial sequence
  SiRNA target sequence
gtattcttgggatgtaata

SEQ ID NO: 20630 - DNA, 19 bp, Artificial sequence
  SiRNA target sequence
tattcttgggatgtaataa

SEQ ID NO: 20631 - DNA, 19 bp, Artificial sequence
  SiRNA target sequence
attcttgggatgtaataac

SEQ ID NO: 20632 - DNA, 19 bp, Artificial sequence
  SiRNA target sequence
ttcttgggatgtaataaca

SEQ ID NO: 20633 - DNA, 19 bp, Artificial sequence
  SiRNA target sequence
tcttgggatgtaataacaa

SEQ ID NO: 20634 - DNA, 19 bp, Artificial sequence
  SiRNA target sequence
cttgggatgtaataacaag

SEQ ID NO: 20635 - DNA, 19 bp, Artificial sequence
  SiRNA target sequence
ttgggatgtaataacaagt

SEQ ID NO: 20636 - DNA, 19 bp, Artificial sequence
  SiRNA target sequence
tgggatgtaataacaagtt

SEQ ID NO: 20637 - DNA, 19 bp, Artificial sequence
  SiRNA target sequence
gggatgtaataacaagtta

SEQ ID NO: 20638 - DNA, 19 bp, Artificial sequence
  SiRNA target sequence
ggatgtaataacaagttag

SEQ ID NO: 20639 - DNA, 19 bp, Artificial sequence
  SiRNA target sequence
gatgtaataacaagttaga

SEQ ID NO: 20640 - DNA, 19 bp, Artificial sequence
  SiRNA target sequence
atgtaataacaagttagac

SEQ ID NO: 20641 - DNA, 19 bp, Artificial sequence
  SiRNA target sequence
tgtaataacaagttagact

SEQ ID NO: 20642 - DNA, 19 bp, Artificial sequence
  SiRNA target sequence
gtaataacaagttagactt

SEQ ID NO: 20643 - DNA, 19 bp, Artificial sequence
  SiRNA target sequence
taataacaagttagactta

SEQ ID NO: 20644 - DNA, 19 bp, Artificial sequence
  SiRNA target sequence
aataacaagttagacttag

SEQ ID NO: 20645 - DNA, 19 bp, Artificial sequence
  SiRNA target sequence
ataacaagttagacttagc

SEQ ID NO: 20646 - DNA, 19 bp, Artificial sequence
  SiRNA target sequence
taacaagttagacttagct

SEQ ID NO: 20647 - DNA, 19 bp, Artificial sequence
  SiRNA target sequence
aacaagttagacttagctt

SEQ ID NO: 20648 - DNA, 19 bp, Artificial sequence
  SiRNA target sequence
acaagttagacttagcttg

SEQ ID NO: 20649 - DNA, 19 bp, Artificial sequence
  SiRNA target sequence
caagttagacttagcttgc

SEQ ID NO: 20650 - DNA, 19 bp, Artificial sequence
  SiRNA target sequence
aagttagacttagcttgct

SEQ ID NO: 20651 - DNA, 19 bp, Artificial sequence
  SiRNA target sequence
agttagacttagcttgctc

SEQ ID NO: 20652 - DNA, 19 bp, Artificial sequence
  SiRNA target sequence
gttagacttagcttgctca

SEQ ID NO: 20653 - DNA, 19 bp, Artificial sequence
  SiRNA target sequence
ttagacttagcttgctcac

SEQ ID NO: 20654 - DNA, 19 bp, Artificial sequence
  SiRNA target sequence
tagacttagcttgctcacc

SEQ ID NO: 20655 - DNA, 19 bp, Artificial sequence
  SiRNA target sequence
agacttagcttgctcacct

SEQ ID NO: 20656 - DNA, 19 bp, Artificial sequence
  SiRNA target sequence
gacttagcttgctcacctg

SEQ ID NO: 20657 - DNA, 19 bp, Artificial sequence
  SiRNA target sequence
acttagcttgctcacctgt

SEQ ID NO: 20658 - DNA, 19 bp, Artificial sequence
  SiRNA target sequence
cttagcttgctcacctgtt

SEQ ID NO: 20659 - DNA, 19 bp, Artificial sequence
  SiRNA target sequence
ttagcttgctcacctgtta

SEQ ID NO: 20660 - DNA, 19 bp, Artificial sequence
  SiRNA target sequence
tagcttgctcacctgttaa

SEQ ID NO: 20661 - DNA, 19 bp, Artificial sequence
  SiRNA target sequence
agcttgctcacctgttaaa

SEQ ID NO: 20662 - DNA, 19 bp, Artificial sequence
  SiRNA target sequence
gcttgctcacctgttaaaa

SEQ ID NO: 20663 - DNA, 19 bp, Artificial sequence
  SiRNA target sequence
cttgctcacctgttaaaat

SEQ ID NO: 20664 - DNA, 19 bp, Artificial sequence
  SiRNA target sequence
ttgctcacctgttaaaatt

SEQ ID NO: 20665 - DNA, 19 bp, Artificial sequence
  SiRNA target sequence
tgctcacctgttaaaattt

SEQ ID NO: 20666 - DNA, 19 bp, Artificial sequence
  SiRNA target sequence
gctcacctgttaaaatttt

SEQ ID NO: 20667 - DNA, 19 bp, Artificial sequence
  SiRNA target sequence
ctcacctgttaaaatttta

SEQ ID NO: 20668 - DNA, 19 bp, Artificial sequence
  SiRNA target sequence
tcacctgttaaaattttat

SEQ ID NO: 20669 - DNA, 19 bp, Artificial sequence
  SiRNA target sequence
cacctgttaaaattttatc

SEQ ID NO: 20670 - DNA, 19 bp, Artificial sequence
  SiRNA target sequence
acctgttaaaattttatct

SEQ ID NO: 20671 - DNA, 19 bp, Artificial sequence
  SiRNA target sequence
cctgttaaaattttatctt

SEQ ID NO: 20672 - DNA, 19 bp, Artificial sequence
  SiRNA target sequence
ctgttaaaattttatcttt

SEQ ID NO: 20673 - DNA, 19 bp, Artificial sequence
  SiRNA target sequence
tgttaaaattttatcttta

SEQ ID NO: 20674 - DNA, 19 bp, Artificial sequence
  SiRNA target sequence
gttaaaattttatctttaa

SEQ ID NO: 20675 - DNA, 19 bp, Artificial sequence
  SiRNA target sequence
ttaaaattttatctttaaa

SEQ ID NO: 20676 - DNA, 19 bp, Artificial sequence
  SiRNA target sequence
taaaattttatctttaaaa

SEQ ID NO: 20677 - DNA, 19 bp, Artificial sequence
  SiRNA target sequence
aaaattttatctttaaaaa

SEQ ID NO: 20678 - DNA, 19 bp, Artificial sequence
  SiRNA target sequence
aaattttatctttaaaaat

SEQ ID NO: 20679 - DNA, 19 bp, Artificial sequence
  SiRNA target sequence
aattttatctttaaaaatt

SEQ ID NO: 20680 - DNA, 19 bp, Artificial sequence
  SiRNA target sequence
attttatctttaaaaattg

SEQ ID NO: 20681 - DNA, 19 bp, Artificial sequence
  SiRNA target sequence
ttttatctttaaaaattga

SEQ ID NO: 20682 - DNA, 19 bp, Artificial sequence
  SiRNA target sequence
tttatctttaaaaattgat

SEQ ID NO: 20683 - DNA, 19 bp, Artificial sequence
  SiRNA target sequence
ttatctttaaaaattgata

SEQ ID NO: 20684 - DNA, 19 bp, Artificial sequence
  SiRNA target sequence
tatctttaaaaattgatac

SEQ ID NO: 20685 - DNA, 19 bp, Artificial sequence
  SiRNA target sequence
atctttaaaaattgatacc

SEQ ID NO: 20686 - DNA, 19 bp, Artificial sequence
  SiRNA target sequence
tctttaaaaattgatacca

SEQ ID NO: 20687 - DNA, 19 bp, Artificial sequence
  SiRNA target sequence
ctttaaaaattgataccac

SEQ ID NO: 20688 - DNA, 19 bp, Artificial sequence
  SiRNA target sequence
tttaaaaattgataccacc

SEQ ID NO: 20689 - DNA, 19 bp, Artificial sequence
  SiRNA target sequence
ttaaaaattgataccaccg

SEQ ID NO: 20690 - DNA, 19 bp, Artificial sequence
  SiRNA target sequence
taaaaattgataccaccga

SEQ ID NO: 20691 - DNA, 19 bp, Artificial sequence
  SiRNA target sequence
aaaaattgataccaccgat

SEQ ID NO: 20692 - DNA, 19 bp, Artificial sequence
  SiRNA target sequence
aaaattgataccaccgatg

SEQ ID NO: 20693 - DNA, 19 bp, Artificial sequence
  SiRNA target sequence
aaattgataccaccgatgg

SEQ ID NO: 20694 - DNA, 19 bp, Artificial sequence
  SiRNA target sequence
aattgataccaccgatggt

SEQ ID NO: 20695 - DNA, 19 bp, Artificial sequence
  SiRNA target sequence
attgataccaccgatggtg

SEQ ID NO: 20696 - DNA, 19 bp, Artificial sequence
  SiRNA target sequence
ttgataccaccgatggtgt

SEQ ID NO: 20697 - DNA, 19 bp, Artificial sequence
  SiRNA target sequence
tgataccaccgatggtgta

SEQ ID NO: 20698 - DNA, 19 bp, Artificial sequence
  SiRNA target sequence
gataccaccgatggtgtag

SEQ ID NO: 20699 - DNA, 19 bp, Artificial sequence
  SiRNA target sequence
ataccaccgatggtgtagt

SEQ ID NO: 20700 - DNA, 19 bp, Artificial sequence
  SiRNA target sequence
taccaccgatggtgtagtt

SEQ ID NO: 20701 - DNA, 19 bp, Artificial sequence
  SiRNA target sequence
accaccgatggtgtagttc

SEQ ID NO: 20702 - DNA, 19 bp, Artificial sequence
  SiRNA target sequence
ccaccgatggtgtagttct

SEQ ID NO: 20703 - DNA, 19 bp, Artificial sequence
  SiRNA target sequence
caccgatggtgtagttcta

SEQ ID NO: 20704 - DNA, 19 bp, Artificial sequence
  SiRNA target sequence
accgatggtgtagttctac

SEQ ID NO: 20705 - DNA, 19 bp, Artificial sequence
  SiRNA target sequence
ccgatggtgtagttctacc

SEQ ID NO: 20706 - DNA, 19 bp, Artificial sequence
  SiRNA target sequence
cgatggtgtagttctacca

SEQ ID NO: 20707 - DNA, 19 bp, Artificial sequence
  SiRNA target sequence
gatggtgtagttctaccac

SEQ ID NO: 20708 - DNA, 19 bp, Artificial sequence
  SiRNA target sequence
atggtgtagttctaccacc

SEQ ID NO: 20709 - DNA, 19 bp, Artificial sequence
  SiRNA target sequence
tggtgtagttctaccacct

SEQ ID NO: 20710 - DNA, 19 bp, Artificial sequence
  SiRNA target sequence
ggtgtagttctaccacctt

SEQ ID NO: 20711 - DNA, 19 bp, Artificial sequence
  SiRNA target sequence
gtgtagttctaccaccttc

SEQ ID NO: 20712 - DNA, 19 bp, Artificial sequence
  SiRNA target sequence
tgtagttctaccaccttct

SEQ ID NO: 20713 - DNA, 19 bp, Artificial sequence
  SiRNA target sequence
gtagttctaccaccttctt

SEQ ID NO: 20714 - DNA, 19 bp, Artificial sequence
  SiRNA target sequence
tagttctaccaccttcttc

SEQ ID NO: 20715 - DNA, 19 bp, Artificial sequence
  SiRNA target sequence
agttctaccaccttcttcg

SEQ ID NO: 20716 - DNA, 19 bp, Artificial sequence
  SiRNA target sequence
gttctaccaccttcttcgt

SEQ ID NO: 20717 - DNA, 19 bp, Artificial sequence
  SiRNA target sequence
ttctaccaccttcttcgtt

SEQ ID NO: 20718 - DNA, 19 bp, Artificial sequence
  SiRNA target sequence
tctaccaccttcttcgttt

SEQ ID NO: 20719 - DNA, 19 bp, Artificial sequence
  SiRNA target sequence
ctaccaccttcttcgtttt

SEQ ID NO: 20720 - DNA, 19 bp, Artificial sequence
  SiRNA target sequence
taccaccttcttcgttttc

SEQ ID NO: 20721 - DNA, 19 bp, Artificial sequence
  SiRNA target sequence
accaccttcttcgttttca

SEQ ID NO: 20722 - DNA, 19 bp, Artificial sequence
  SiRNA target sequence
ccaccttcttcgttttcaa

SEQ ID NO: 20723 - DNA, 19 bp, Artificial sequence
  SiRNA target sequence
caccttcttcgttttcaat

SEQ ID NO: 20724 - DNA, 19 bp, Artificial sequence
  SiRNA target sequence
accttcttcgttttcaata

SEQ ID NO: 20725 - DNA, 19 bp, Artificial sequence
  SiRNA target sequence
ccttcttcgttttcaataa

SEQ ID NO: 20726 - DNA, 19 bp, Artificial sequence
  SiRNA target sequence
cttcttcgttttcaataat

SEQ ID NO: 20727 - DNA, 19 bp, Artificial sequence
  SiRNA target sequence
ttcttcgttttcaataatt

SEQ ID NO: 20728 - DNA, 19 bp, Artificial sequence
  SiRNA target sequence
tcttcgttttcaataattt

SEQ ID NO: 20729 - DNA, 19 bp, Artificial sequence
  SiRNA target sequence
cttcgttttcaataatttg

SEQ ID NO: 20730 - DNA, 19 bp, Artificial sequence
  SiRNA target sequence
ttcgttttcaataatttgt

SEQ ID NO: 20731 - DNA, 19 bp, Artificial sequence
  SiRNA target sequence
tcgttttcaataatttgtg

SEQ ID NO: 20732 - DNA, 19 bp, Artificial sequence
  SiRNA target sequence
cgttttcaataatttgtgg

SEQ ID NO: 20733 - DNA, 19 bp, Artificial sequence
  SiRNA target sequence
gttttcaataatttgtggg

SEQ ID NO: 20734 - DNA, 19 bp, Artificial sequence
  SiRNA target sequence
ttttcaataatttgtggga

SEQ ID NO: 20735 - DNA, 19 bp, Artificial sequence
  SiRNA target sequence
tttcaataatttgtgggat

SEQ ID NO: 20736 - DNA, 19 bp, Artificial sequence
  SiRNA target sequence
ttcaataatttgtgggata

SEQ ID NO: 20737 - DNA, 19 bp, Artificial sequence
  SiRNA target sequence
tcaataatttgtgggatat

SEQ ID NO: 20738 - DNA, 19 bp, Artificial sequence
  SiRNA target sequence
caataatttgtgggatatt

SEQ ID NO: 20739 - DNA, 19 bp, Artificial sequence
  SiRNA target sequence
aataatttgtgggatattg

SEQ ID NO: 20740 - DNA, 19 bp, Artificial sequence
  SiRNA target sequence
ataatttgtgggatattgt

SEQ ID NO: 20741 - DNA, 19 bp, Artificial sequence
  SiRNA target sequence
taatttgtgggatattgtt

SEQ ID NO: 20742 - DNA, 19 bp, Artificial sequence
  SiRNA target sequence
aatttgtgggatattgtta

SEQ ID NO: 20743 - DNA, 19 bp, Artificial sequence
  SiRNA target sequence
atttgtgggatattgttat

SEQ ID NO: 20744 - DNA, 19 bp, Artificial sequence
  SiRNA target sequence
tttgtgggatattgttatg

SEQ ID NO: 20745 - DNA, 19 bp, Artificial sequence
  SiRNA target sequence
ttgtgggatattgttatgt

SEQ ID NO: 20746 - DNA, 19 bp, Artificial sequence
  SiRNA target sequence
tgtgggatattgttatgta

SEQ ID NO: 20747 - DNA, 19 bp, Artificial sequence
  SiRNA target sequence
gtgggatattgttatgtat

SEQ ID NO: 20748 - DNA, 19 bp, Artificial sequence
  SiRNA target sequence
tgggatattgttatgtata

SEQ ID NO: 20749 - DNA, 19 bp, Artificial sequence
  SiRNA target sequence
gggatattgttatgtataa

SEQ ID NO: 20750 - DNA, 19 bp, Artificial sequence
  SiRNA target sequence
ggatattgttatgtataag

SEQ ID NO: 20751 - DNA, 19 bp, Artificial sequence
  SiRNA target sequence
gatattgttatgtataaga

SEQ ID NO: 20752 - DNA, 19 bp, Artificial sequence
  SiRNA target sequence
atattgttatgtataagag

SEQ ID NO: 20753 - DNA, 19 bp, Artificial sequence
  SiRNA target sequence
tattgttatgtataagaga

SEQ ID NO: 20754 - DNA, 19 bp, Artificial sequence
  SiRNA target sequence
attgttatgtataagagac

SEQ ID NO: 20755 - DNA, 19 bp, Artificial sequence
  SiRNA target sequence
ttgttatgtataagagaca

SEQ ID NO: 20756 - DNA, 19 bp, Artificial sequence
  SiRNA target sequence
tgttatgtataagagacac

SEQ ID NO: 20757 - DNA, 19 bp, Artificial sequence
  SiRNA target sequence
gttatgtataagagacaca

SEQ ID NO: 20758 - DNA, 19 bp, Artificial sequence
  SiRNA target sequence
ttatgtataagagacacac

SEQ ID NO: 20759 - DNA, 19 bp, Artificial sequence
  SiRNA target sequence
tatgtataagagacacaca

SEQ ID NO: 20760 - DNA, 19 bp, Artificial sequence
  SiRNA target sequence
atgtataagagacacacaa

SEQ ID NO: 20761 - DNA, 19 bp, Artificial sequence
  SiRNA target sequence
tgtataagagacacacaag

SEQ ID NO: 20762 - DNA, 19 bp, Artificial sequence
  SiRNA target sequence
gtataagagacacacaaga

SEQ ID NO: 20763 - DNA, 19 bp, Artificial sequence
  SiRNA target sequence
tataagagacacacaagaa

SEQ ID NO: 20764 - DNA, 19 bp, Artificial sequence
  SiRNA target sequence
ataagagacacacaagaat

SEQ ID NO: 20765 - DNA, 19 bp, Artificial sequence
  SiRNA target sequence
taagagacacacaagaatt

SEQ ID NO: 20766 - DNA, 19 bp, Artificial sequence
  SiRNA target sequence
aagagacacacaagaattg

SEQ ID NO: 20767 - DNA, 19 bp, Artificial sequence
  SiRNA target sequence
agagacacacaagaattgg

SEQ ID NO: 20768 - DNA, 19 bp, Artificial sequence
  SiRNA target sequence
gagacacacaagaattggt

SEQ ID NO: 20769 - DNA, 19 bp, Artificial sequence
  SiRNA target sequence
agacacacaagaattggtt

SEQ ID NO: 20770 - DNA, 19 bp, Artificial sequence
  SiRNA target sequence
gacacacaagaattggttg

SEQ ID NO: 20771 - DNA, 19 bp, Artificial sequence
  SiRNA target sequence
acacacaagaattggttgt

SEQ ID NO: 20772 - DNA, 19 bp, Artificial sequence
  SiRNA target sequence
cacacaagaattggttgtt

SEQ ID NO: 20773 - DNA, 19 bp, Artificial sequence
  SiRNA target sequence
acacaagaattggttgttc

SEQ ID NO: 20774 - DNA, 19 bp, Artificial sequence
  SiRNA target sequence
cacaagaattggttgttcc

SEQ ID NO: 20775 - DNA, 19 bp, Artificial sequence
  SiRNA target sequence
acaagaattggttgttcct

SEQ ID NO: 20776 - DNA, 19 bp, Artificial sequence
  SiRNA target sequence
caagaattggttgttccta

SEQ ID NO: 20777 - DNA, 19 bp, Artificial sequence
  SiRNA target sequence
aagaattggttgttcctag

SEQ ID NO: 20778 - DNA, 19 bp, Artificial sequence
  SiRNA target sequence
agaattggttgttcctaga

SEQ ID NO: 20779 - DNA, 19 bp, Artificial sequence
  SiRNA target sequence
gaattggttgttcctagat

SEQ ID NO: 20780 - DNA, 19 bp, Artificial sequence
  SiRNA target sequence
aattggttgttcctagatc

SEQ ID NO: 20781 - DNA, 19 bp, Artificial sequence
  SiRNA target sequence
attggttgttcctagatca

SEQ ID NO: 20782 - DNA, 19 bp, Artificial sequence
  SiRNA target sequence
ttggttgttcctagatcaa

SEQ ID NO: 20783 - DNA, 19 bp, Artificial sequence
  SiRNA target sequence
tggttgttcctagatcaat

SEQ ID NO: 20784 - DNA, 19 bp, Artificial sequence
  SiRNA target sequence
ggttgttcctagatcaatt

SEQ ID NO: 20785 - DNA, 19 bp, Artificial sequence
  SiRNA target sequence
gttgttcctagatcaattc

SEQ ID NO: 20786 - DNA, 19 bp, Artificial sequence
  SiRNA target sequence
ttgttcctagatcaattcc

SEQ ID NO: 20787 - DNA, 19 bp, Artificial sequence
  SiRNA target sequence
tgttcctagatcaattcct

SEQ ID NO: 20788 - DNA, 19 bp, Artificial sequence
  SiRNA target sequence
gttcctagatcaattccta

SEQ ID NO: 20789 - DNA, 19 bp, Artificial sequence
  SiRNA target sequence
ttcctagatcaattcctat

SEQ ID NO: 20790 - DNA, 19 bp, Artificial sequence
  SiRNA target sequence
tcctagatcaattcctatt

SEQ ID NO: 20791 - DNA, 19 bp, Artificial sequence
  SiRNA target sequence
cctagatcaattcctatta

SEQ ID NO: 20792 - DNA, 19 bp, Artificial sequence
  SiRNA target sequence
ctagatcaattcctattat

SEQ ID NO: 20793 - DNA, 19 bp, Artificial sequence
  SiRNA target sequence
tagatcaattcctattatt

SEQ ID NO: 20794 - DNA, 19 bp, Artificial sequence
  SiRNA target sequence
agatcaattcctattattt

SEQ ID NO: 20795 - DNA, 19 bp, Artificial sequence
  SiRNA target sequence
gatcaattcctattatttt

SEQ ID NO: 20796 - DNA, 19 bp, Artificial sequence
  SiRNA target sequence
atcaattcctattatttta

SEQ ID NO: 20797 - DNA, 19 bp, Artificial sequence
  SiRNA target sequence
tcaattcctattattttag

SEQ ID NO: 20798 - DNA, 19 bp, Artificial sequence
  SiRNA target sequence
caattcctattattttaga

SEQ ID NO: 20799 - DNA, 19 bp, Artificial sequence
  SiRNA target sequence
aattcctattattttagag

SEQ ID NO: 20800 - DNA, 19 bp, Artificial sequence
  SiRNA target sequence
attcctattattttagagc

SEQ ID NO: 20801 - DNA, 19 bp, Artificial sequence
  SiRNA target sequence
ttcctattattttagagct

SEQ ID NO: 20802 - DNA, 19 bp, Artificial sequence
  SiRNA target sequence
tcctattattttagagcta

SEQ ID NO: 20803 - DNA, 19 bp, Artificial sequence
  SiRNA target sequence
cctattattttagagctaa

SEQ ID NO: 20804 - DNA, 19 bp, Artificial sequence
  SiRNA target sequence
ctattattttagagctaat

SEQ ID NO: 20805 - DNA, 19 bp, Artificial sequence
  SiRNA target sequence
tattattttagagctaatt

SEQ ID NO: 20806 - DNA, 19 bp, Artificial sequence
  SiRNA target sequence
attattttagagctaattt

SEQ ID NO: 20807 - DNA, 19 bp, Artificial sequence
  SiRNA target sequence
ttattttagagctaatttc

SEQ ID NO: 20808 - DNA, 19 bp, Artificial sequence
  SiRNA target sequence
tattttagagctaatttct

SEQ ID NO: 20809 - DNA, 19 bp, Artificial sequence
  SiRNA target sequence
attttagagctaatttctt

SEQ ID NO: 20810 - DNA, 19 bp, Artificial sequence
  SiRNA target sequence
ttttagagctaatttcttc

SEQ ID NO: 20811 - DNA, 19 bp, Artificial sequence
  SiRNA target sequence
tttagagctaatttcttct

SEQ ID NO: 20812 - DNA, 19 bp, Artificial sequence
  SiRNA target sequence
ttagagctaatttcttctt

SEQ ID NO: 20813 - DNA, 19 bp, Artificial sequence
  SiRNA target sequence
tagagctaatttcttcttt

SEQ ID NO: 20814 - DNA, 19 bp, Artificial sequence
  SiRNA target sequence
agagctaatttcttcttta

SEQ ID NO: 20815 - DNA, 19 bp, Artificial sequence
  SiRNA target sequence
gagctaatttcttctttag

SEQ ID NO: 20816 - DNA, 19 bp, Artificial sequence
  SiRNA target sequence
agctaatttcttctttaga

SEQ ID NO: 20817 - DNA, 19 bp, Artificial sequence
  SiRNA target sequence
gctaatttcttctttagac

SEQ ID NO: 20818 - DNA, 19 bp, Artificial sequence
  SiRNA target sequence
ctaatttcttctttagaca

SEQ ID NO: 20819 - DNA, 19 bp, Artificial sequence
  SiRNA target sequence
taatttcttctttagacat

SEQ ID NO: 20820 - DNA, 20 bp, Artificial sequence
  SiRNA target sequence
ttaagaatttttcaatattt

SEQ ID NO: 20821 - DNA, 20 bp, Artificial sequence
  SiRNA target sequence
taagaatttttcaatatttt

SEQ ID NO: 20822 - DNA, 20 bp, Artificial sequence
  SiRNA target sequence
aagaatttttcaatattttt

SEQ ID NO: 20823 - DNA, 20 bp, Artificial sequence
  SiRNA target sequence
agaatttttcaatatttttt

SEQ ID NO: 20824 - DNA, 20 bp, Artificial sequence
  SiRNA target sequence
gaatttttcaatattttttt

SEQ ID NO: 20825 - DNA, 20 bp, Artificial sequence
  SiRNA target sequence
aatttttcaatatttttttt

SEQ ID NO: 20826 - DNA, 20 bp, Artificial sequence
  SiRNA target sequence
atttttcaatattttttttg

SEQ ID NO: 20827 - DNA, 20 bp, Artificial sequence
  SiRNA target sequence
tttttcaatattttttttgc

SEQ ID NO: 20828 - DNA, 20 bp, Artificial sequence
  SiRNA target sequence
ttttcaatattttttttgct

SEQ ID NO: 20829 - DNA, 20 bp, Artificial sequence
  SiRNA target sequence
tttcaatattttttttgctt

SEQ ID NO: 20830 - DNA, 20 bp, Artificial sequence
  SiRNA target sequence
ttcaatattttttttgcttg

SEQ ID NO: 20831 - DNA, 20 bp, Artificial sequence
  SiRNA target sequence
tcaatattttttttgcttgt

SEQ ID NO: 20832 - DNA, 20 bp, Artificial sequence
  SiRNA target sequence
caatattttttttgcttgtt

SEQ ID NO: 20833 - DNA, 20 bp, Artificial sequence
  SiRNA target sequence
aatattttttttgcttgttc

SEQ ID NO: 20834 - DNA, 20 bp, Artificial sequence
  SiRNA target sequence
atattttttttgcttgttct

SEQ ID NO: 20835 - DNA, 20 bp, Artificial sequence
  SiRNA target sequence
tattttttttgcttgttcta

SEQ ID NO: 20836 - DNA, 20 bp, Artificial sequence
  SiRNA target sequence
attttttttgcttgttctaa

SEQ ID NO: 20837 - DNA, 20 bp, Artificial sequence
  SiRNA target sequence
ttttttttgcttgttctaag

SEQ ID NO: 20838 - DNA, 20 bp, Artificial sequence
  SiRNA target sequence
tttttttgcttgttctaagt

SEQ ID NO: 20839 - DNA, 20 bp, Artificial sequence
  SiRNA target sequence
ttttttgcttgttctaagtc

SEQ ID NO: 20840 - DNA, 20 bp, Artificial sequence
  SiRNA target sequence
tttttgcttgttctaagtca

SEQ ID NO: 20841 - DNA, 20 bp, Artificial sequence
  SiRNA target sequence
ttttgcttgttctaagtcat

SEQ ID NO: 20842 - DNA, 20 bp, Artificial sequence
  SiRNA target sequence
tttgcttgttctaagtcata

SEQ ID NO: 20843 - DNA, 20 bp, Artificial sequence
  SiRNA target sequence
ttgcttgttctaagtcataa

SEQ ID NO: 20844 - DNA, 20 bp, Artificial sequence
  SiRNA target sequence
tgcttgttctaagtcataaa

SEQ ID NO: 20845 - DNA, 20 bp, Artificial sequence
  SiRNA target sequence
gcttgttctaagtcataaat

SEQ ID NO: 20846 - DNA, 20 bp, Artificial sequence
  SiRNA target sequence
cttgttctaagtcataaatt

SEQ ID NO: 20847 - DNA, 20 bp, Artificial sequence
  SiRNA target sequence
ttgttctaagtcataaattt

SEQ ID NO: 20848 - DNA, 20 bp, Artificial sequence
  SiRNA target sequence
tgttctaagtcataaatttt

SEQ ID NO: 20849 - DNA, 20 bp, Artificial sequence
  SiRNA target sequence
gttctaagtcataaattttt

SEQ ID NO: 20850 - DNA, 20 bp, Artificial sequence
  SiRNA target sequence
ttctaagtcataaatttttt

SEQ ID NO: 20851 - DNA, 20 bp, Artificial sequence
  SiRNA target sequence
tctaagtcataaattttttt

SEQ ID NO: 20852 - DNA, 20 bp, Artificial sequence
  SiRNA target sequence
ctaagtcataaattttttta

SEQ ID NO: 20853 - DNA, 20 bp, Artificial sequence
  SiRNA target sequence
taagtcataaatttttttag

SEQ ID NO: 20854 - DNA, 20 bp, Artificial sequence
  SiRNA target sequence
aagtcataaatttttttagt

SEQ ID NO: 20855 - DNA, 20 bp, Artificial sequence
  SiRNA target sequence
agtcataaatttttttagtc

SEQ ID NO: 20856 - DNA, 20 bp, Artificial sequence
  SiRNA target sequence
gtcataaatttttttagtca

SEQ ID NO: 20857 - DNA, 20 bp, Artificial sequence
  SiRNA target sequence
tcataaatttttttagtcaa

SEQ ID NO: 20858 - DNA, 20 bp, Artificial sequence
  SiRNA target sequence
cataaatttttttagtcaaa

SEQ ID NO: 20859 - DNA, 20 bp, Artificial sequence
  SiRNA target sequence
ataaatttttttagtcaaat

SEQ ID NO: 20860 - DNA, 20 bp, Artificial sequence
  SiRNA target sequence
taaatttttttagtcaaata

SEQ ID NO: 20861 - DNA, 20 bp, Artificial sequence
  SiRNA target sequence
aaatttttttagtcaaatat

SEQ ID NO: 20862 - DNA, 20 bp, Artificial sequence
  SiRNA target sequence
aatttttttagtcaaatatg

SEQ ID NO: 20863 - DNA, 20 bp, Artificial sequence
  SiRNA target sequence
atttttttagtcaaatatga

SEQ ID NO: 20864 - DNA, 20 bp, Artificial sequence
  SiRNA target sequence
tttttttagtcaaatatgac

SEQ ID NO: 20865 - DNA, 20 bp, Artificial sequence
  SiRNA target sequence
ttttttagtcaaatatgact

SEQ ID NO: 20866 - DNA, 20 bp, Artificial sequence
  SiRNA target sequence
tttttagtcaaatatgactt

SEQ ID NO: 20867 - DNA, 20 bp, Artificial sequence
  SiRNA target sequence
ttttagtcaaatatgacttt

SEQ ID NO: 20868 - DNA, 20 bp, Artificial sequence
  SiRNA target sequence
tttagtcaaatatgacttta

SEQ ID NO: 20869 - DNA, 20 bp, Artificial sequence
  SiRNA target sequence
ttagtcaaatatgactttaa

SEQ ID NO: 20870 - DNA, 20 bp, Artificial sequence
  SiRNA target sequence
tagtcaaatatgactttaaa

SEQ ID NO: 20871 - DNA, 20 bp, Artificial sequence
  SiRNA target sequence
agtcaaatatgactttaaaa

SEQ ID NO: 20872 - DNA, 20 bp, Artificial sequence
  SiRNA target sequence
gtcaaatatgactttaaaat

SEQ ID NO: 20873 - DNA, 20 bp, Artificial sequence
  SiRNA target sequence
tcaaatatgactttaaaatc

SEQ ID NO: 20874 - DNA, 20 bp, Artificial sequence
  SiRNA target sequence
caaatatgactttaaaatct

SEQ ID NO: 20875 - DNA, 20 bp, Artificial sequence
  SiRNA target sequence
aaatatgactttaaaatctc

SEQ ID NO: 20876 - DNA, 20 bp, Artificial sequence
  SiRNA target sequence
aatatgactttaaaatctct

SEQ ID NO: 20877 - DNA, 20 bp, Artificial sequence
  SiRNA target sequence
atatgactttaaaatctctt

SEQ ID NO: 20878 - DNA, 20 bp, Artificial sequence
  SiRNA target sequence
tatgactttaaaatctcttt

SEQ ID NO: 20879 - DNA, 20 bp, Artificial sequence
  SiRNA target sequence
atgactttaaaatctctttt

SEQ ID NO: 20880 - DNA, 20 bp, Artificial sequence
  SiRNA target sequence
tgactttaaaatctcttttg

SEQ ID NO: 20881 - DNA, 20 bp, Artificial sequence
  SiRNA target sequence
gactttaaaatctcttttgt

SEQ ID NO: 20882 - DNA, 20 bp, Artificial sequence
  SiRNA target sequence
actttaaaatctcttttgtt

SEQ ID NO: 20883 - DNA, 20 bp, Artificial sequence
  SiRNA target sequence
ctttaaaatctcttttgttt

SEQ ID NO: 20884 - DNA, 20 bp, Artificial sequence
  SiRNA target sequence
tttaaaatctcttttgtttc

SEQ ID NO: 20885 - DNA, 20 bp, Artificial sequence
  SiRNA target sequence
ttaaaatctcttttgtttca

SEQ ID NO: 20886 - DNA, 20 bp, Artificial sequence
  SiRNA target sequence
taaaatctcttttgtttcat

SEQ ID NO: 20887 - DNA, 20 bp, Artificial sequence
  SiRNA target sequence
aaaatctcttttgtttcatc

SEQ ID NO: 20888 - DNA, 20 bp, Artificial sequence
  SiRNA target sequence
aaatctcttttgtttcatct

SEQ ID NO: 20889 - DNA, 20 bp, Artificial sequence
  SiRNA target sequence
aatctcttttgtttcatctg

SEQ ID NO: 20890 - DNA, 20 bp, Artificial sequence
  SiRNA target sequence
atctcttttgtttcatctgt

SEQ ID NO: 20891 - DNA, 20 bp, Artificial sequence
  SiRNA target sequence
tctcttttgtttcatctgtt

SEQ ID NO: 20892 - DNA, 20 bp, Artificial sequence
  SiRNA target sequence
ctcttttgtttcatctgtta

SEQ ID NO: 20893 - DNA, 20 bp, Artificial sequence
  SiRNA target sequence
tcttttgtttcatctgttac

SEQ ID NO: 20894 - DNA, 20 bp, Artificial sequence
  SiRNA target sequence
cttttgtttcatctgttact

SEQ ID NO: 20895 - DNA, 20 bp, Artificial sequence
  SiRNA target sequence
ttttgtttcatctgttactt

SEQ ID NO: 20896 - DNA, 20 bp, Artificial sequence
  SiRNA target sequence
tttgtttcatctgttacttg

SEQ ID NO: 20897 - DNA, 20 bp, Artificial sequence
  SiRNA target sequence
ttgtttcatctgttacttgt

SEQ ID NO: 20898 - DNA, 20 bp, Artificial sequence
  SiRNA target sequence
tgtttcatctgttacttgtt

SEQ ID NO: 20899 - DNA, 20 bp, Artificial sequence
  SiRNA target sequence
gtttcatctgttacttgttt

SEQ ID NO: 20900 - DNA, 20 bp, Artificial sequence
  SiRNA target sequence
tttcatctgttacttgtttg

SEQ ID NO: 20901 - DNA, 20 bp, Artificial sequence
  SiRNA target sequence
ttcatctgttacttgtttgt

SEQ ID NO: 20902 - DNA, 20 bp, Artificial sequence
  SiRNA target sequence
tcatctgttacttgtttgta

SEQ ID NO: 20903 - DNA, 20 bp, Artificial sequence
  SiRNA target sequence
catctgttacttgtttgtac

SEQ ID NO: 20904 - DNA, 20 bp, Artificial sequence
  SiRNA target sequence
atctgttacttgtttgtact

SEQ ID NO: 20905 - DNA, 20 bp, Artificial sequence
  SiRNA target sequence
tctgttacttgtttgtactt

SEQ ID NO: 20906 - DNA, 20 bp, Artificial sequence
  SiRNA target sequence
ctgttacttgtttgtacttt

SEQ ID NO: 20907 - DNA, 20 bp, Artificial sequence
  SiRNA target sequence
tgttacttgtttgtacttta

SEQ ID NO: 20908 - DNA, 20 bp, Artificial sequence
  SiRNA target sequence
gttacttgtttgtactttaa

SEQ ID NO: 20909 - DNA, 20 bp, Artificial sequence
  SiRNA target sequence
ttacttgtttgtactttaaa

SEQ ID NO: 20910 - DNA, 20 bp, Artificial sequence
  SiRNA target sequence
tacttgtttgtactttaaaa

SEQ ID NO: 20911 - DNA, 20 bp, Artificial sequence
  SiRNA target sequence
acttgtttgtactttaaaaa

SEQ ID NO: 20912 - DNA, 20 bp, Artificial sequence
  SiRNA target sequence
cttgtttgtactttaaaaat

SEQ ID NO: 20913 - DNA, 20 bp, Artificial sequence
  SiRNA target sequence
ttgtttgtactttaaaaatt

SEQ ID NO: 20914 - DNA, 20 bp, Artificial sequence
  SiRNA target sequence
tgtttgtactttaaaaattg

SEQ ID NO: 20915 - DNA, 20 bp, Artificial sequence
  SiRNA target sequence
gtttgtactttaaaaattgt

SEQ ID NO: 20916 - DNA, 20 bp, Artificial sequence
  SiRNA target sequence
tttgtactttaaaaattgtt

SEQ ID NO: 20917 - DNA, 20 bp, Artificial sequence
  SiRNA target sequence
ttgtactttaaaaattgttg

SEQ ID NO: 20918 - DNA, 20 bp, Artificial sequence
  SiRNA target sequence
tgtactttaaaaattgttga

SEQ ID NO: 20919 - DNA, 20 bp, Artificial sequence
  SiRNA target sequence
gtactttaaaaattgttgaa

SEQ ID NO: 20920 - DNA, 20 bp, Artificial sequence
  SiRNA target sequence
tactttaaaaattgttgaat

SEQ ID NO: 20921 - DNA, 20 bp, Artificial sequence
  SiRNA target sequence
actttaaaaattgttgaatt

SEQ ID NO: 20922 - DNA, 20 bp, Artificial sequence
  SiRNA target sequence
ctttaaaaattgttgaattt

SEQ ID NO: 20923 - DNA, 20 bp, Artificial sequence
  SiRNA target sequence
tttaaaaattgttgaatttc

SEQ ID NO: 20924 - DNA, 20 bp, Artificial sequence
  SiRNA target sequence
ttaaaaattgttgaatttca

SEQ ID NO: 20925 - DNA, 20 bp, Artificial sequence
  SiRNA target sequence
taaaaattgttgaatttcaa

SEQ ID NO: 20926 - DNA, 20 bp, Artificial sequence
  SiRNA target sequence
aaaaattgttgaatttcaat

SEQ ID NO: 20927 - DNA, 20 bp, Artificial sequence
  SiRNA target sequence
aaaattgttgaatttcaatt

SEQ ID NO: 20928 - DNA, 20 bp, Artificial sequence
  SiRNA target sequence
aaattgttgaatttcaattt

SEQ ID NO: 20929 - DNA, 20 bp, Artificial sequence
  SiRNA target sequence
aattgttgaatttcaatttt

SEQ ID NO: 20930 - DNA, 20 bp, Artificial sequence
  SiRNA target sequence
attgttgaatttcaatttta

SEQ ID NO: 20931 - DNA, 20 bp, Artificial sequence
  SiRNA target sequence
ttgttgaatttcaattttaa

SEQ ID NO: 20932 - DNA, 20 bp, Artificial sequence
  SiRNA target sequence
tgttgaatttcaattttaaa

SEQ ID NO: 20933 - DNA, 20 bp, Artificial sequence
  SiRNA target sequence
gttgaatttcaattttaaat

SEQ ID NO: 20934 - DNA, 20 bp, Artificial sequence
  SiRNA target sequence
ttgaatttcaattttaaatt

SEQ ID NO: 20935 - DNA, 20 bp, Artificial sequence
  SiRNA target sequence
tgaatttcaattttaaattc

SEQ ID NO: 20936 - DNA, 20 bp, Artificial sequence
  SiRNA target sequence
gaatttcaattttaaattcg

SEQ ID NO: 20937 - DNA, 20 bp, Artificial sequence
  SiRNA target sequence
aatttcaattttaaattcgg

SEQ ID NO: 20938 - DNA, 20 bp, Artificial sequence
  SiRNA target sequence
atttcaattttaaattcggc

SEQ ID NO: 20939 - DNA, 20 bp, Artificial sequence
  SiRNA target sequence
tttcaattttaaattcggca

SEQ ID NO: 20940 - DNA, 20 bp, Artificial sequence
  SiRNA target sequence
ttcaattttaaattcggcac

SEQ ID NO: 20941 - DNA, 20 bp, Artificial sequence
  SiRNA target sequence
tcaattttaaattcggcaca

SEQ ID NO: 20942 - DNA, 20 bp, Artificial sequence
  SiRNA target sequence
caattttaaattcggcacaa

SEQ ID NO: 20943 - DNA, 20 bp, Artificial sequence
  SiRNA target sequence
aattttaaattcggcacaat

SEQ ID NO: 20944 - DNA, 20 bp, Artificial sequence
  SiRNA target sequence
attttaaattcggcacaatt

SEQ ID NO: 20945 - DNA, 20 bp, Artificial sequence
  SiRNA target sequence
ttttaaattcggcacaattt

SEQ ID NO: 20946 - DNA, 20 bp, Artificial sequence
  SiRNA target sequence
tttaaattcggcacaatttt

SEQ ID NO: 20947 - DNA, 20 bp, Artificial sequence
  SiRNA target sequence
ttaaattcggcacaattttt

SEQ ID NO: 20948 - DNA, 20 bp, Artificial sequence
  SiRNA target sequence
taaattcggcacaatttttt

SEQ ID NO: 20949 - DNA, 20 bp, Artificial sequence
  SiRNA target sequence
aaattcggcacaattttttt

SEQ ID NO: 20950 - DNA, 20 bp, Artificial sequence
  SiRNA target sequence
aattcggcacaatttttttc

SEQ ID NO: 20951 - DNA, 20 bp, Artificial sequence
  SiRNA target sequence
attcggcacaatttttttca

SEQ ID NO: 20952 - DNA, 20 bp, Artificial sequence
  SiRNA target sequence
ttcggcacaatttttttcaa

SEQ ID NO: 20953 - DNA, 20 bp, Artificial sequence
  SiRNA target sequence
tcggcacaatttttttcaat

SEQ ID NO: 20954 - DNA, 20 bp, Artificial sequence
  SiRNA target sequence
cggcacaatttttttcaatt

SEQ ID NO: 20955 - DNA, 20 bp, Artificial sequence
  SiRNA target sequence
ggcacaatttttttcaattt

SEQ ID NO: 20956 - DNA, 20 bp, Artificial sequence
  SiRNA target sequence
gcacaatttttttcaatttc

SEQ ID NO: 20957 - DNA, 20 bp, Artificial sequence
  SiRNA target sequence
cacaatttttttcaatttca

SEQ ID NO: 20958 - DNA, 20 bp, Artificial sequence
  SiRNA target sequence
acaatttttttcaatttcat

SEQ ID NO: 20959 - DNA, 20 bp, Artificial sequence
  SiRNA target sequence
caatttttttcaatttcatc

SEQ ID NO: 20960 - DNA, 20 bp, Artificial sequence
  SiRNA target sequence
aatttttttcaatttcatct

SEQ ID NO: 20961 - DNA, 20 bp, Artificial sequence
  SiRNA target sequence
atttttttcaatttcatctt

SEQ ID NO: 20962 - DNA, 20 bp, Artificial sequence
  SiRNA target sequence
tttttttcaatttcatcttt

SEQ ID NO: 20963 - DNA, 20 bp, Artificial sequence
  SiRNA target sequence
ttttttcaatttcatctttt

SEQ ID NO: 20964 - DNA, 20 bp, Artificial sequence
  SiRNA target sequence
tttttcaatttcatcttttt

SEQ ID NO: 20965 - DNA, 20 bp, Artificial sequence
  SiRNA target sequence
ttttcaatttcatctttttt

SEQ ID NO: 20966 - DNA, 20 bp, Artificial sequence
  SiRNA target sequence
tttcaatttcatcttttttc

SEQ ID NO: 20967 - DNA, 20 bp, Artificial sequence
  SiRNA target sequence
ttcaatttcatcttttttcg

SEQ ID NO: 20968 - DNA, 20 bp, Artificial sequence
  SiRNA target sequence
tcaatttcatcttttttcga

SEQ ID NO: 20969 - DNA, 20 bp, Artificial sequence
  SiRNA target sequence
caatttcatcttttttcgaa

SEQ ID NO: 20970 - DNA, 20 bp, Artificial sequence
  SiRNA target sequence
aatttcatcttttttcgaat

SEQ ID NO: 20971 - DNA, 20 bp, Artificial sequence
  SiRNA target sequence
atttcatcttttttcgaatt

SEQ ID NO: 20972 - DNA, 20 bp, Artificial sequence
  SiRNA target sequence
tttcatcttttttcgaattt

SEQ ID NO: 20973 - DNA, 20 bp, Artificial sequence
  SiRNA target sequence
ttcatcttttttcgaatttt

SEQ ID NO: 20974 - DNA, 20 bp, Artificial sequence
  SiRNA target sequence
tcatcttttttcgaattttc

SEQ ID NO: 20975 - DNA, 20 bp, Artificial sequence
  SiRNA target sequence
catcttttttcgaattttct

SEQ ID NO: 20976 - DNA, 20 bp, Artificial sequence
  SiRNA target sequence
atcttttttcgaattttctt

SEQ ID NO: 20977 - DNA, 20 bp, Artificial sequence
  SiRNA target sequence
tcttttttcgaattttcttc

SEQ ID NO: 20978 - DNA, 20 bp, Artificial sequence
  SiRNA target sequence
cttttttcgaattttcttcg

SEQ ID NO: 20979 - DNA, 20 bp, Artificial sequence
  SiRNA target sequence
ttttttcgaattttcttcgg

SEQ ID NO: 20980 - DNA, 20 bp, Artificial sequence
  SiRNA target sequence
tttttcgaattttcttcggc

SEQ ID NO: 20981 - DNA, 20 bp, Artificial sequence
  SiRNA target sequence
ttttcgaattttcttcggct

SEQ ID NO: 20982 - DNA, 20 bp, Artificial sequence
  SiRNA target sequence
tttcgaattttcttcggctt

SEQ ID NO: 20983 - DNA, 20 bp, Artificial sequence
  SiRNA target sequence
ttcgaattttcttcggcttc

SEQ ID NO: 20984 - DNA, 20 bp, Artificial sequence
  SiRNA target sequence
tcgaattttcttcggcttct

SEQ ID NO: 20985 - DNA, 20 bp, Artificial sequence
  SiRNA target sequence
cgaattttcttcggcttctc

SEQ ID NO: 20986 - DNA, 20 bp, Artificial sequence
  SiRNA target sequence
gaattttcttcggcttctcg

SEQ ID NO: 20987 - DNA, 20 bp, Artificial sequence
  SiRNA target sequence
aattttcttcggcttctcgt

SEQ ID NO: 20988 - DNA, 20 bp, Artificial sequence
  SiRNA target sequence
attttcttcggcttctcgta

SEQ ID NO: 20989 - DNA, 20 bp, Artificial sequence
  SiRNA target sequence
ttttcttcggcttctcgtat

SEQ ID NO: 20990 - DNA, 20 bp, Artificial sequence
  SiRNA target sequence
tttcttcggcttctcgtatc

SEQ ID NO: 20991 - DNA, 20 bp, Artificial sequence
  SiRNA target sequence
ttcttcggcttctcgtatca

SEQ ID NO: 20992 - DNA, 20 bp, Artificial sequence
  SiRNA target sequence
tcttcggcttctcgtatcat

SEQ ID NO: 20993 - DNA, 20 bp, Artificial sequence
  SiRNA target sequence
cttcggcttctcgtatcatt

SEQ ID NO: 20994 - DNA, 20 bp, Artificial sequence
  SiRNA target sequence
ttcggcttctcgtatcattt

SEQ ID NO: 20995 - DNA, 20 bp, Artificial sequence
  SiRNA target sequence
tcggcttctcgtatcatttg

SEQ ID NO: 20996 - DNA, 20 bp, Artificial sequence
  SiRNA target sequence
cggcttctcgtatcatttgc

SEQ ID NO: 20997 - DNA, 20 bp, Artificial sequence
  SiRNA target sequence
ggcttctcgtatcatttgcg

SEQ ID NO: 20998 - DNA, 20 bp, Artificial sequence
  SiRNA target sequence
gcttctcgtatcatttgcga

SEQ ID NO: 20999 - DNA, 20 bp, Artificial sequence
  SiRNA target sequence
cttctcgtatcatttgcgaa

SEQ ID NO: 21000 - DNA, 20 bp, Artificial sequence
  SiRNA target sequence
ttctcgtatcatttgcgaaa

SEQ ID NO: 21001 - DNA, 20 bp, Artificial sequence
  SiRNA target sequence
tctcgtatcatttgcgaaat

SEQ ID NO: 21002 - DNA, 20 bp, Artificial sequence
  SiRNA target sequence
ctcgtatcatttgcgaaatt

SEQ ID NO: 21003 - DNA, 20 bp, Artificial sequence
  SiRNA target sequence
tcgtatcatttgcgaaattt

SEQ ID NO: 21004 - DNA, 20 bp, Artificial sequence
  SiRNA target sequence
cgtatcatttgcgaaatttc

SEQ ID NO: 21005 - DNA, 20 bp, Artificial sequence
  SiRNA target sequence
gtatcatttgcgaaatttca

SEQ ID NO: 21006 - DNA, 20 bp, Artificial sequence
  SiRNA target sequence
tatcatttgcgaaatttcac

SEQ ID NO: 21007 - DNA, 20 bp, Artificial sequence
  SiRNA target sequence
atcatttgcgaaatttcacc

SEQ ID NO: 21008 - DNA, 20 bp, Artificial sequence
  SiRNA target sequence
tcatttgcgaaatttcacct

SEQ ID NO: 21009 - DNA, 20 bp, Artificial sequence
  SiRNA target sequence
catttgcgaaatttcacctt

SEQ ID NO: 21010 - DNA, 20 bp, Artificial sequence
  SiRNA target sequence
atttgcgaaatttcaccttc

SEQ ID NO: 21011 - DNA, 20 bp, Artificial sequence
  SiRNA target sequence
tttgcgaaatttcaccttca

SEQ ID NO: 21012 - DNA, 20 bp, Artificial sequence
  SiRNA target sequence
ttgcgaaatttcaccttcat

SEQ ID NO: 21013 - DNA, 20 bp, Artificial sequence
  SiRNA target sequence
tgcgaaatttcaccttcatt

SEQ ID NO: 21014 - DNA, 20 bp, Artificial sequence
  SiRNA target sequence
gcgaaatttcaccttcattt

SEQ ID NO: 21015 - DNA, 20 bp, Artificial sequence
  SiRNA target sequence
cgaaatttcaccttcattta

SEQ ID NO: 21016 - DNA, 20 bp, Artificial sequence
  SiRNA target sequence
gaaatttcaccttcatttaa

SEQ ID NO: 21017 - DNA, 20 bp, Artificial sequence
  SiRNA target sequence
aaatttcaccttcatttaat

SEQ ID NO: 21018 - DNA, 20 bp, Artificial sequence
  SiRNA target sequence
aatttcaccttcatttaatc

SEQ ID NO: 21019 - DNA, 20 bp, Artificial sequence
  SiRNA target sequence
atttcaccttcatttaatcc

SEQ ID NO: 21020 - DNA, 20 bp, Artificial sequence
  SiRNA target sequence
tttcaccttcatttaatcca

SEQ ID NO: 21021 - DNA, 20 bp, Artificial sequence
  SiRNA target sequence
ttcaccttcatttaatccac

SEQ ID NO: 21022 - DNA, 20 bp, Artificial sequence
  SiRNA target sequence
tcaccttcatttaatccact

SEQ ID NO: 21023 - DNA, 20 bp, Artificial sequence
  SiRNA target sequence
caccttcatttaatccactt

SEQ ID NO: 21024 - DNA, 20 bp, Artificial sequence
  SiRNA target sequence
accttcatttaatccacttg

SEQ ID NO: 21025 - DNA, 20 bp, Artificial sequence
  SiRNA target sequence
ccttcatttaatccacttga

SEQ ID NO: 21026 - DNA, 20 bp, Artificial sequence
  SiRNA target sequence
cttcatttaatccacttgaa

SEQ ID NO: 21027 - DNA, 20 bp, Artificial sequence
  SiRNA target sequence
ttcatttaatccacttgaag

SEQ ID NO: 21028 - DNA, 20 bp, Artificial sequence
  SiRNA target sequence
tcatttaatccacttgaagg

SEQ ID NO: 21029 - DNA, 20 bp, Artificial sequence
  SiRNA target sequence
catttaatccacttgaaggc

SEQ ID NO: 21030 - DNA, 20 bp, Artificial sequence
  SiRNA target sequence
atttaatccacttgaaggca

SEQ ID NO: 21031 - DNA, 20 bp, Artificial sequence
  SiRNA target sequence
tttaatccacttgaaggcac

SEQ ID NO: 21032 - DNA, 20 bp, Artificial sequence
  SiRNA target sequence
ttaatccacttgaaggcaca

SEQ ID NO: 21033 - DNA, 20 bp, Artificial sequence
  SiRNA target sequence
taatccacttgaaggcacaa

SEQ ID NO: 21034 - DNA, 20 bp, Artificial sequence
  SiRNA target sequence
aatccacttgaaggcacaat

SEQ ID NO: 21035 - DNA, 20 bp, Artificial sequence
  SiRNA target sequence
atccacttgaaggcacaatt

SEQ ID NO: 21036 - DNA, 20 bp, Artificial sequence
  SiRNA target sequence
tccacttgaaggcacaattt

SEQ ID NO: 21037 - DNA, 20 bp, Artificial sequence
  SiRNA target sequence
ccacttgaaggcacaatttc

SEQ ID NO: 21038 - DNA, 20 bp, Artificial sequence
  SiRNA target sequence
cacttgaaggcacaatttcg

SEQ ID NO: 21039 - DNA, 20 bp, Artificial sequence
  SiRNA target sequence
acttgaaggcacaatttcga

SEQ ID NO: 21040 - DNA, 20 bp, Artificial sequence
  SiRNA target sequence
cttgaaggcacaatttcgat

SEQ ID NO: 21041 - DNA, 20 bp, Artificial sequence
  SiRNA target sequence
ttgaaggcacaatttcgatt

SEQ ID NO: 21042 - DNA, 20 bp, Artificial sequence
  SiRNA target sequence
tgaaggcacaatttcgattt

SEQ ID NO: 21043 - DNA, 20 bp, Artificial sequence
  SiRNA target sequence
gaaggcacaatttcgatttc

SEQ ID NO: 21044 - DNA, 20 bp, Artificial sequence
  SiRNA target sequence
aaggcacaatttcgatttct

SEQ ID NO: 21045 - DNA, 20 bp, Artificial sequence
  SiRNA target sequence
aggcacaatttcgatttctt

SEQ ID NO: 21046 - DNA, 20 bp, Artificial sequence
  SiRNA target sequence
ggcacaatttcgatttcttg

SEQ ID NO: 21047 - DNA, 20 bp, Artificial sequence
  SiRNA target sequence
gcacaatttcgatttcttgc

SEQ ID NO: 21048 - DNA, 20 bp, Artificial sequence
  SiRNA target sequence
cacaatttcgatttcttgct

SEQ ID NO: 21049 - DNA, 20 bp, Artificial sequence
  SiRNA target sequence
acaatttcgatttcttgctt

SEQ ID NO: 21050 - DNA, 20 bp, Artificial sequence
  SiRNA target sequence
caatttcgatttcttgcttt

SEQ ID NO: 21051 - DNA, 20 bp, Artificial sequence
  SiRNA target sequence
aatttcgatttcttgctttt

SEQ ID NO: 21052 - DNA, 20 bp, Artificial sequence
  SiRNA target sequence
atttcgatttcttgcttttt

SEQ ID NO: 21053 - DNA, 20 bp, Artificial sequence
  SiRNA target sequence
tttcgatttcttgctttttt

SEQ ID NO: 21054 - DNA, 20 bp, Artificial sequence
  SiRNA target sequence
ttcgatttcttgcttttttt

SEQ ID NO: 21055 - DNA, 20 bp, Artificial sequence
  SiRNA target sequence
tcgatttcttgctttttttt

SEQ ID NO: 21056 - DNA, 20 bp, Artificial sequence
  SiRNA target sequence
cgatttcttgcttttttttc

SEQ ID NO: 21057 - DNA, 20 bp, Artificial sequence
  SiRNA target sequence
gatttcttgcttttttttcg

SEQ ID NO: 21058 - DNA, 20 bp, Artificial sequence
  SiRNA target sequence
atttcttgcttttttttcgt

SEQ ID NO: 21059 - DNA, 20 bp, Artificial sequence
  SiRNA target sequence
tttcttgcttttttttcgtt

SEQ ID NO: 21060 - DNA, 20 bp, Artificial sequence
  SiRNA target sequence
ttcttgcttttttttcgtta

SEQ ID NO: 21061 - DNA, 20 bp, Artificial sequence
  SiRNA target sequence
tcttgcttttttttcgttat

SEQ ID NO: 21062 - DNA, 20 bp, Artificial sequence
  SiRNA target sequence
cttgcttttttttcgttatc

SEQ ID NO: 21063 - DNA, 20 bp, Artificial sequence
  SiRNA target sequence
ttgcttttttttcgttatcc

SEQ ID NO: 21064 - DNA, 20 bp, Artificial sequence
  SiRNA target sequence
tgcttttttttcgttatccc

SEQ ID NO: 21065 - DNA, 20 bp, Artificial sequence
  SiRNA target sequence
gcttttttttcgttatcccg

SEQ ID NO: 21066 - DNA, 20 bp, Artificial sequence
  SiRNA target sequence
cttttttttcgttatcccgt

SEQ ID NO: 21067 - DNA, 20 bp, Artificial sequence
  SiRNA target sequence
ttttttttcgttatcccgtc

SEQ ID NO: 21068 - DNA, 20 bp, Artificial sequence
  SiRNA target sequence
tttttttcgttatcccgtct

SEQ ID NO: 21069 - DNA, 20 bp, Artificial sequence
  SiRNA target sequence
ttttttcgttatcccgtctt

SEQ ID NO: 21070 - DNA, 20 bp, Artificial sequence
  SiRNA target sequence
tttttcgttatcccgtcttg

SEQ ID NO: 21071 - DNA, 20 bp, Artificial sequence
  SiRNA target sequence
ttttcgttatcccgtcttgc

SEQ ID NO: 21072 - DNA, 20 bp, Artificial sequence
  SiRNA target sequence
tttcgttatcccgtcttgcg

SEQ ID NO: 21073 - DNA, 20 bp, Artificial sequence
  SiRNA target sequence
ttcgttatcccgtcttgcgc

SEQ ID NO: 21074 - DNA, 20 bp, Artificial sequence
  SiRNA target sequence
tcgttatcccgtcttgcgca

SEQ ID NO: 21075 - DNA, 20 bp, Artificial sequence
  SiRNA target sequence
cgttatcccgtcttgcgcag

SEQ ID NO: 21076 - DNA, 20 bp, Artificial sequence
  SiRNA target sequence
gttatcccgtcttgcgcaga

SEQ ID NO: 21077 - DNA, 20 bp, Artificial sequence
  SiRNA target sequence
ttatcccgtcttgcgcagat

SEQ ID NO: 21078 - DNA, 20 bp, Artificial sequence
  SiRNA target sequence
tatcccgtcttgcgcagata

SEQ ID NO: 21079 - DNA, 20 bp, Artificial sequence
  SiRNA target sequence
atcccgtcttgcgcagatac

SEQ ID NO: 21080 - DNA, 20 bp, Artificial sequence
  SiRNA target sequence
tcccgtcttgcgcagatact

SEQ ID NO: 21081 - DNA, 20 bp, Artificial sequence
  SiRNA target sequence
cccgtcttgcgcagatactt

SEQ ID NO: 21082 - DNA, 20 bp, Artificial sequence
  SiRNA target sequence
ccgtcttgcgcagatacttt

SEQ ID NO: 21083 - DNA, 20 bp, Artificial sequence
  SiRNA target sequence
cgtcttgcgcagatactttg

SEQ ID NO: 21084 - DNA, 20 bp, Artificial sequence
  SiRNA target sequence
gtcttgcgcagatactttgt

SEQ ID NO: 21085 - DNA, 20 bp, Artificial sequence
  SiRNA target sequence
tcttgcgcagatactttgta

SEQ ID NO: 21086 - DNA, 20 bp, Artificial sequence
  SiRNA target sequence
cttgcgcagatactttgtat

SEQ ID NO: 21087 - DNA, 20 bp, Artificial sequence
  SiRNA target sequence
ttgcgcagatactttgtata

SEQ ID NO: 21088 - DNA, 20 bp, Artificial sequence
  SiRNA target sequence
tgcgcagatactttgtatat

SEQ ID NO: 21089 - DNA, 20 bp, Artificial sequence
  SiRNA target sequence
gcgcagatactttgtatatt

SEQ ID NO: 21090 - DNA, 20 bp, Artificial sequence
  SiRNA target sequence
cgcagatactttgtatattc

SEQ ID NO: 21091 - DNA, 20 bp, Artificial sequence
  SiRNA target sequence
gcagatactttgtatattcc

SEQ ID NO: 21092 - DNA, 20 bp, Artificial sequence
  SiRNA target sequence
cagatactttgtatattccg

SEQ ID NO: 21093 - DNA, 20 bp, Artificial sequence
  SiRNA target sequence
agatactttgtatattccgt

SEQ ID NO: 21094 - DNA, 20 bp, Artificial sequence
  SiRNA target sequence
gatactttgtatattccgtt

SEQ ID NO: 21095 - DNA, 20 bp, Artificial sequence
  SiRNA target sequence
atactttgtatattccgtta

SEQ ID NO: 21096 - DNA, 20 bp, Artificial sequence
  SiRNA target sequence
tactttgtatattccgttag

SEQ ID NO: 21097 - DNA, 20 bp, Artificial sequence
  SiRNA target sequence
actttgtatattccgttagc

SEQ ID NO: 21098 - DNA, 20 bp, Artificial sequence
  SiRNA target sequence
ctttgtatattccgttagca

SEQ ID NO: 21099 - DNA, 20 bp, Artificial sequence
  SiRNA target sequence
tttgtatattccgttagcat

SEQ ID NO: 21100 - DNA, 20 bp, Artificial sequence
  SiRNA target sequence
ttgtatattccgttagcatc

SEQ ID NO: 21101 - DNA, 20 bp, Artificial sequence
  SiRNA target sequence
tgtatattccgttagcatcg

SEQ ID NO: 21102 - DNA, 20 bp, Artificial sequence
  SiRNA target sequence
gtatattccgttagcatcgg

SEQ ID NO: 21103 - DNA, 20 bp, Artificial sequence
  SiRNA target sequence
tatattccgttagcatcggc

SEQ ID NO: 21104 - DNA, 20 bp, Artificial sequence
  SiRNA target sequence
atattccgttagcatcggct

SEQ ID NO: 21105 - DNA, 20 bp, Artificial sequence
  SiRNA target sequence
tattccgttagcatcggctt

SEQ ID NO: 21106 - DNA, 20 bp, Artificial sequence
  SiRNA target sequence
attccgttagcatcggcttc

SEQ ID NO: 21107 - DNA, 20 bp, Artificial sequence
  SiRNA target sequence
ttccgttagcatcggcttca

SEQ ID NO: 21108 - DNA, 20 bp, Artificial sequence
  SiRNA target sequence
tccgttagcatcggcttcaa

SEQ ID NO: 21109 - DNA, 20 bp, Artificial sequence
  SiRNA target sequence
ccgttagcatcggcttcaaa

SEQ ID NO: 21110 - DNA, 20 bp, Artificial sequence
  SiRNA target sequence
cgttagcatcggcttcaaat

SEQ ID NO: 21111 - DNA, 20 bp, Artificial sequence
  SiRNA target sequence
gttagcatcggcttcaaatg

SEQ ID NO: 21112 - DNA, 20 bp, Artificial sequence
  SiRNA target sequence
ttagcatcggcttcaaatgt

SEQ ID NO: 21113 - DNA, 20 bp, Artificial sequence
  SiRNA target sequence
tagcatcggcttcaaatgta

SEQ ID NO: 21114 - DNA, 20 bp, Artificial sequence
  SiRNA target sequence
agcatcggcttcaaatgtaa

SEQ ID NO: 21115 - DNA, 20 bp, Artificial sequence
  SiRNA target sequence
gcatcggcttcaaatgtaac

SEQ ID NO: 21116 - DNA, 20 bp, Artificial sequence
  SiRNA target sequence
catcggcttcaaatgtaaca

SEQ ID NO: 21117 - DNA, 20 bp, Artificial sequence
  SiRNA target sequence
atcggcttcaaatgtaacat

SEQ ID NO: 21118 - DNA, 20 bp, Artificial sequence
  SiRNA target sequence
tcggcttcaaatgtaacatc

SEQ ID NO: 21119 - DNA, 20 bp, Artificial sequence
  SiRNA target sequence
cggcttcaaatgtaacatct

SEQ ID NO: 21120 - DNA, 20 bp, Artificial sequence
  SiRNA target sequence
ggcttcaaatgtaacatcta

SEQ ID NO: 21121 - DNA, 20 bp, Artificial sequence
  SiRNA target sequence
gcttcaaatgtaacatctat

SEQ ID NO: 21122 - DNA, 20 bp, Artificial sequence
  SiRNA target sequence
cttcaaatgtaacatctatc

SEQ ID NO: 21123 - DNA, 20 bp, Artificial sequence
  SiRNA target sequence
ttcaaatgtaacatctatct

SEQ ID NO: 21124 - DNA, 20 bp, Artificial sequence
  SiRNA target sequence
tcaaatgtaacatctatctt

SEQ ID NO: 21125 - DNA, 20 bp, Artificial sequence
  SiRNA target sequence
caaatgtaacatctatcttt

SEQ ID NO: 21126 - DNA, 20 bp, Artificial sequence
  SiRNA target sequence
aaatgtaacatctatctttg

SEQ ID NO: 21127 - DNA, 20 bp, Artificial sequence
  SiRNA target sequence
aatgtaacatctatctttgg

SEQ ID NO: 21128 - DNA, 20 bp, Artificial sequence
  SiRNA target sequence
atgtaacatctatctttgga

SEQ ID NO: 21129 - DNA, 20 bp, Artificial sequence
  SiRNA target sequence
tgtaacatctatctttggaa

SEQ ID NO: 21130 - DNA, 20 bp, Artificial sequence
  SiRNA target sequence
gtaacatctatctttggaat

SEQ ID NO: 21131 - DNA, 20 bp, Artificial sequence
  SiRNA target sequence
taacatctatctttggaata

SEQ ID NO: 21132 - DNA, 20 bp, Artificial sequence
  SiRNA target sequence
aacatctatctttggaatac

SEQ ID NO: 21133 - DNA, 20 bp, Artificial sequence
  SiRNA target sequence
acatctatctttggaatacc

SEQ ID NO: 21134 - DNA, 20 bp, Artificial sequence
  SiRNA target sequence
catctatctttggaatacct

SEQ ID NO: 21135 - DNA, 20 bp, Artificial sequence
  SiRNA target sequence
atctatctttggaatacctg

SEQ ID NO: 21136 - DNA, 20 bp, Artificial sequence
  SiRNA target sequence
tctatctttggaatacctgc

SEQ ID NO: 21137 - DNA, 20 bp, Artificial sequence
  SiRNA target sequence
ctatctttggaatacctgca

SEQ ID NO: 21138 - DNA, 20 bp, Artificial sequence
  SiRNA target sequence
tatctttggaatacctgcag

SEQ ID NO: 21139 - DNA, 20 bp, Artificial sequence
  SiRNA target sequence
atctttggaatacctgcagg

SEQ ID NO: 21140 - DNA, 20 bp, Artificial sequence
  SiRNA target sequence
tctttggaatacctgcaggt

SEQ ID NO: 21141 - DNA, 20 bp, Artificial sequence
  SiRNA target sequence
ctttggaatacctgcaggtg

SEQ ID NO: 21142 - DNA, 20 bp, Artificial sequence
  SiRNA target sequence
tttggaatacctgcaggtgc

SEQ ID NO: 21143 - DNA, 20 bp, Artificial sequence
  SiRNA target sequence
ttggaatacctgcaggtgct

SEQ ID NO: 21144 - DNA, 20 bp, Artificial sequence
  SiRNA target sequence
tggaatacctgcaggtgctt

SEQ ID NO: 21145 - DNA, 20 bp, Artificial sequence
  SiRNA target sequence
ggaatacctgcaggtgcttt

SEQ ID NO: 21146 - DNA, 20 bp, Artificial sequence
  SiRNA target sequence
gaatacctgcaggtgcttta

SEQ ID NO: 21147 - DNA, 20 bp, Artificial sequence
  SiRNA target sequence
aatacctgcaggtgctttag

SEQ ID NO: 21148 - DNA, 20 bp, Artificial sequence
  SiRNA target sequence
atacctgcaggtgctttagg

SEQ ID NO: 21149 - DNA, 20 bp, Artificial sequence
  SiRNA target sequence
tacctgcaggtgctttagga

SEQ ID NO: 21150 - DNA, 20 bp, Artificial sequence
  SiRNA target sequence
acctgcaggtgctttaggaa

SEQ ID NO: 21151 - DNA, 20 bp, Artificial sequence
  SiRNA target sequence
cctgcaggtgctttaggaat

SEQ ID NO: 21152 - DNA, 20 bp, Artificial sequence
  SiRNA target sequence
ctgcaggtgctttaggaatg

SEQ ID NO: 21153 - DNA, 20 bp, Artificial sequence
  SiRNA target sequence
tgcaggtgctttaggaatgt

SEQ ID NO: 21154 - DNA, 20 bp, Artificial sequence
  SiRNA target sequence
gcaggtgctttaggaatgtt

SEQ ID NO: 21155 - DNA, 20 bp, Artificial sequence
  SiRNA target sequence
caggtgctttaggaatgttt

SEQ ID NO: 21156 - DNA, 20 bp, Artificial sequence
  SiRNA target sequence
aggtgctttaggaatgtttt

SEQ ID NO: 21157 - DNA, 20 bp, Artificial sequence
  SiRNA target sequence
ggtgctttaggaatgttttt

SEQ ID NO: 21158 - DNA, 20 bp, Artificial sequence
  SiRNA target sequence
gtgctttaggaatgtttttg

SEQ ID NO: 21159 - DNA, 20 bp, Artificial sequence
  SiRNA target sequence
tgctttaggaatgtttttga

SEQ ID NO: 21160 - DNA, 20 bp, Artificial sequence
  SiRNA target sequence
gctttaggaatgtttttgag

SEQ ID NO: 21161 - DNA, 20 bp, Artificial sequence
  SiRNA target sequence
ctttaggaatgtttttgagc

SEQ ID NO: 21162 - DNA, 20 bp, Artificial sequence
  SiRNA target sequence
tttaggaatgtttttgagct

SEQ ID NO: 21163 - DNA, 20 bp, Artificial sequence
  SiRNA target sequence
ttaggaatgtttttgagctt

SEQ ID NO: 21164 - DNA, 20 bp, Artificial sequence
  SiRNA target sequence
taggaatgtttttgagcttt

SEQ ID NO: 21165 - DNA, 20 bp, Artificial sequence
  SiRNA target sequence
aggaatgtttttgagcttta

SEQ ID NO: 21166 - DNA, 20 bp, Artificial sequence
  SiRNA target sequence
ggaatgtttttgagctttat

SEQ ID NO: 21167 - DNA, 20 bp, Artificial sequence
  SiRNA target sequence
gaatgtttttgagctttata

SEQ ID NO: 21168 - DNA, 20 bp, Artificial sequence
  SiRNA target sequence
aatgtttttgagctttatag

SEQ ID NO: 21169 - DNA, 20 bp, Artificial sequence
  SiRNA target sequence
atgtttttgagctttatagc

SEQ ID NO: 21170 - DNA, 20 bp, Artificial sequence
  SiRNA target sequence
tgtttttgagctttatagct

SEQ ID NO: 21171 - DNA, 20 bp, Artificial sequence
  SiRNA target sequence
gtttttgagctttatagctc

SEQ ID NO: 21172 - DNA, 20 bp, Artificial sequence
  SiRNA target sequence
tttttgagctttatagctcc

SEQ ID NO: 21173 - DNA, 20 bp, Artificial sequence
  SiRNA target sequence
ttttgagctttatagctcct

SEQ ID NO: 21174 - DNA, 20 bp, Artificial sequence
  SiRNA target sequence
tttgagctttatagctccta

SEQ ID NO: 21175 - DNA, 20 bp, Artificial sequence
  SiRNA target sequence
ttgagctttatagctcctaa

SEQ ID NO: 21176 - DNA, 20 bp, Artificial sequence
  SiRNA target sequence
tgagctttatagctcctaaa

SEQ ID NO: 21177 - DNA, 20 bp, Artificial sequence
  SiRNA target sequence
gagctttatagctcctaaat

SEQ ID NO: 21178 - DNA, 20 bp, Artificial sequence
  SiRNA target sequence
agctttatagctcctaaata

SEQ ID NO: 21179 - DNA, 20 bp, Artificial sequence
  SiRNA target sequence
gctttatagctcctaaatat

SEQ ID NO: 21180 - DNA, 20 bp, Artificial sequence
  SiRNA target sequence
ctttatagctcctaaatatt

SEQ ID NO: 21181 - DNA, 20 bp, Artificial sequence
  SiRNA target sequence
tttatagctcctaaatattt

SEQ ID NO: 21182 - DNA, 20 bp, Artificial sequence
  SiRNA target sequence
ttatagctcctaaatattta

SEQ ID NO: 21183 - DNA, 20 bp, Artificial sequence
  SiRNA target sequence
tatagctcctaaatatttat

SEQ ID NO: 21184 - DNA, 20 bp, Artificial sequence
  SiRNA target sequence
atagctcctaaatatttatt

SEQ ID NO: 21185 - DNA, 20 bp, Artificial sequence
  SiRNA target sequence
tagctcctaaatatttattg

SEQ ID NO: 21186 - DNA, 20 bp, Artificial sequence
  SiRNA target sequence
agctcctaaatatttattgt

SEQ ID NO: 21187 - DNA, 20 bp, Artificial sequence
  SiRNA target sequence
gctcctaaatatttattgtc

SEQ ID NO: 21188 - DNA, 20 bp, Artificial sequence
  SiRNA target sequence
ctcctaaatatttattgtct

SEQ ID NO: 21189 - DNA, 20 bp, Artificial sequence
  SiRNA target sequence
tcctaaatatttattgtctt

SEQ ID NO: 21190 - DNA, 20 bp, Artificial sequence
  SiRNA target sequence
cctaaatatttattgtcttt

SEQ ID NO: 21191 - DNA, 20 bp, Artificial sequence
  SiRNA target sequence
ctaaatatttattgtctttt

SEQ ID NO: 21192 - DNA, 20 bp, Artificial sequence
  SiRNA target sequence
taaatatttattgtctttta

SEQ ID NO: 21193 - DNA, 20 bp, Artificial sequence
  SiRNA target sequence
aaatatttattgtcttttac

SEQ ID NO: 21194 - DNA, 20 bp, Artificial sequence
  SiRNA target sequence
aatatttattgtcttttacc

SEQ ID NO: 21195 - DNA, 20 bp, Artificial sequence
  SiRNA target sequence
atatttattgtcttttacca

SEQ ID NO: 21196 - DNA, 20 bp, Artificial sequence
  SiRNA target sequence
tatttattgtcttttaccat

SEQ ID NO: 21197 - DNA, 20 bp, Artificial sequence
  SiRNA target sequence
atttattgtcttttaccatc

SEQ ID NO: 21198 - DNA, 20 bp, Artificial sequence
  SiRNA target sequence
tttattgtcttttaccatct

SEQ ID NO: 21199 - DNA, 20 bp, Artificial sequence
  SiRNA target sequence
ttattgtcttttaccatctt

SEQ ID NO: 21200 - DNA, 20 bp, Artificial sequence
  SiRNA target sequence
tattgtcttttaccatcttt

SEQ ID NO: 21201 - DNA, 20 bp, Artificial sequence
  SiRNA target sequence
attgtcttttaccatctttc

SEQ ID NO: 21202 - DNA, 20 bp, Artificial sequence
  SiRNA target sequence
ttgtcttttaccatctttct

SEQ ID NO: 21203 - DNA, 20 bp, Artificial sequence
  SiRNA target sequence
tgtcttttaccatctttctt

SEQ ID NO: 21204 - DNA, 20 bp, Artificial sequence
  SiRNA target sequence
gtcttttaccatctttcttt

SEQ ID NO: 21205 - DNA, 20 bp, Artificial sequence
  SiRNA target sequence
tcttttaccatctttctttc

SEQ ID NO: 21206 - DNA, 20 bp, Artificial sequence
  SiRNA target sequence
cttttaccatctttctttct

SEQ ID NO: 21207 - DNA, 20 bp, Artificial sequence
  SiRNA target sequence
ttttaccatctttctttctc

SEQ ID NO: 21208 - DNA, 20 bp, Artificial sequence
  SiRNA target sequence
tttaccatctttctttctcc

SEQ ID NO: 21209 - DNA, 20 bp, Artificial sequence
  SiRNA target sequence
ttaccatctttctttctcct

SEQ ID NO: 21210 - DNA, 20 bp, Artificial sequence
  SiRNA target sequence
taccatctttctttctcctt

SEQ ID NO: 21211 - DNA, 20 bp, Artificial sequence
  SiRNA target sequence
accatctttctttctccttg

SEQ ID NO: 21212 - DNA, 20 bp, Artificial sequence
  SiRNA target sequence
ccatctttctttctccttga

SEQ ID NO: 21213 - DNA, 20 bp, Artificial sequence
  SiRNA target sequence
catctttctttctccttgat

SEQ ID NO: 21214 - DNA, 20 bp, Artificial sequence
  SiRNA target sequence
atctttctttctccttgata

SEQ ID NO: 21215 - DNA, 20 bp, Artificial sequence
  SiRNA target sequence
tctttctttctccttgatat

SEQ ID NO: 21216 - DNA, 20 bp, Artificial sequence
  SiRNA target sequence
ctttctttctccttgatata

SEQ ID NO: 21217 - DNA, 20 bp, Artificial sequence
  SiRNA target sequence
tttctttctccttgatatat

SEQ ID NO: 21218 - DNA, 20 bp, Artificial sequence
  SiRNA target sequence
ttctttctccttgatatatt

SEQ ID NO: 21219 - DNA, 20 bp, Artificial sequence
  SiRNA target sequence
tctttctccttgatatattc

SEQ ID NO: 21220 - DNA, 20 bp, Artificial sequence
  SiRNA target sequence
ctttctccttgatatattct

SEQ ID NO: 21221 - DNA, 20 bp, Artificial sequence
  SiRNA target sequence
tttctccttgatatattcta

SEQ ID NO: 21222 - DNA, 20 bp, Artificial sequence
  SiRNA target sequence
ttctccttgatatattctaa

SEQ ID NO: 21223 - DNA, 20 bp, Artificial sequence
  SiRNA target sequence
tctccttgatatattctaat

SEQ ID NO: 21224 - DNA, 20 bp, Artificial sequence
  SiRNA target sequence
ctccttgatatattctaata

SEQ ID NO: 21225 - DNA, 20 bp, Artificial sequence
  SiRNA target sequence
tccttgatatattctaatat

SEQ ID NO: 21226 - DNA, 20 bp, Artificial sequence
  SiRNA target sequence
ccttgatatattctaatatc

SEQ ID NO: 21227 - DNA, 20 bp, Artificial sequence
  SiRNA target sequence
cttgatatattctaatatct

SEQ ID NO: 21228 - DNA, 20 bp, Artificial sequence
  SiRNA target sequence
ttgatatattctaatatcta

SEQ ID NO: 21229 - DNA, 20 bp, Artificial sequence
  SiRNA target sequence
tgatatattctaatatctac

SEQ ID NO: 21230 - DNA, 20 bp, Artificial sequence
  SiRNA target sequence
gatatattctaatatctact

SEQ ID NO: 21231 - DNA, 20 bp, Artificial sequence
  SiRNA target sequence
atatattctaatatctactt

SEQ ID NO: 21232 - DNA, 20 bp, Artificial sequence
  SiRNA target sequence
tatattctaatatctacttc

SEQ ID NO: 21233 - DNA, 20 bp, Artificial sequence
  SiRNA target sequence
atattctaatatctacttcg

SEQ ID NO: 21234 - DNA, 20 bp, Artificial sequence
  SiRNA target sequence
tattctaatatctacttcgg

SEQ ID NO: 21235 - DNA, 20 bp, Artificial sequence
  SiRNA target sequence
attctaatatctacttcgga

SEQ ID NO: 21236 - DNA, 20 bp, Artificial sequence
  SiRNA target sequence
ttctaatatctacttcggat

SEQ ID NO: 21237 - DNA, 20 bp, Artificial sequence
  SiRNA target sequence
tctaatatctacttcggatt

SEQ ID NO: 21238 - DNA, 20 bp, Artificial sequence
  SiRNA target sequence
ctaatatctacttcggattg

SEQ ID NO: 21239 - DNA, 20 bp, Artificial sequence
  SiRNA target sequence
taatatctacttcggattga

SEQ ID NO: 21240 - DNA, 20 bp, Artificial sequence
  SiRNA target sequence
aatatctacttcggattgat

SEQ ID NO: 21241 - DNA, 20 bp, Artificial sequence
  SiRNA target sequence
atatctacttcggattgatt

SEQ ID NO: 21242 - DNA, 20 bp, Artificial sequence
  SiRNA target sequence
tatctacttcggattgatta

SEQ ID NO: 21243 - DNA, 20 bp, Artificial sequence
  SiRNA target sequence
atctacttcggattgattat

SEQ ID NO: 21244 - DNA, 20 bp, Artificial sequence
  SiRNA target sequence
tctacttcggattgattatc

SEQ ID NO: 21245 - DNA, 20 bp, Artificial sequence
  SiRNA target sequence
ctacttcggattgattatct

SEQ ID NO: 21246 - DNA, 20 bp, Artificial sequence
  SiRNA target sequence
tacttcggattgattatctt

SEQ ID NO: 21247 - DNA, 20 bp, Artificial sequence
  SiRNA target sequence
acttcggattgattatcttc

SEQ ID NO: 21248 - DNA, 20 bp, Artificial sequence
  SiRNA target sequence
cttcggattgattatcttca

SEQ ID NO: 21249 - DNA, 20 bp, Artificial sequence
  SiRNA target sequence
ttcggattgattatcttcag

SEQ ID NO: 21250 - DNA, 20 bp, Artificial sequence
  SiRNA target sequence
tcggattgattatcttcaga

SEQ ID NO: 21251 - DNA, 20 bp, Artificial sequence
  SiRNA target sequence
cggattgattatcttcagag

SEQ ID NO: 21252 - DNA, 20 bp, Artificial sequence
  SiRNA target sequence
ggattgattatcttcagagg

SEQ ID NO: 21253 - DNA, 20 bp, Artificial sequence
  SiRNA target sequence
gattgattatcttcagaggt

SEQ ID NO: 21254 - DNA, 20 bp, Artificial sequence
  SiRNA target sequence
attgattatcttcagaggta

SEQ ID NO: 21255 - DNA, 20 bp, Artificial sequence
  SiRNA target sequence
ttgattatcttcagaggtag

SEQ ID NO: 21256 - DNA, 20 bp, Artificial sequence
  SiRNA target sequence
tgattatcttcagaggtaga

SEQ ID NO: 21257 - DNA, 20 bp, Artificial sequence
  SiRNA target sequence
gattatcttcagaggtagaa

SEQ ID NO: 21258 - DNA, 20 bp, Artificial sequence
  SiRNA target sequence
attatcttcagaggtagaaa

SEQ ID NO: 21259 - DNA, 20 bp, Artificial sequence
  SiRNA target sequence
ttatcttcagaggtagaaaa

SEQ ID NO: 21260 - DNA, 20 bp, Artificial sequence
  SiRNA target sequence
tatcttcagaggtagaaaaa

SEQ ID NO: 21261 - DNA, 20 bp, Artificial sequence
  SiRNA target sequence
atcttcagaggtagaaaaac

SEQ ID NO: 21262 - DNA, 20 bp, Artificial sequence
  SiRNA target sequence
tcttcagaggtagaaaaact

SEQ ID NO: 21263 - DNA, 20 bp, Artificial sequence
  SiRNA target sequence
cttcagaggtagaaaaactg

SEQ ID NO: 21264 - DNA, 20 bp, Artificial sequence
  SiRNA target sequence
ttcagaggtagaaaaactgt

SEQ ID NO: 21265 - DNA, 20 bp, Artificial sequence
  SiRNA target sequence
tcagaggtagaaaaactgtg

SEQ ID NO: 21266 - DNA, 20 bp, Artificial sequence
  SiRNA target sequence
cagaggtagaaaaactgtgt

SEQ ID NO: 21267 - DNA, 20 bp, Artificial sequence
  SiRNA target sequence
agaggtagaaaaactgtgtg

SEQ ID NO: 21268 - DNA, 20 bp, Artificial sequence
  SiRNA target sequence
gaggtagaaaaactgtgtgt

SEQ ID NO: 21269 - DNA, 20 bp, Artificial sequence
  SiRNA target sequence
aggtagaaaaactgtgtgtt

SEQ ID NO: 21270 - DNA, 20 bp, Artificial sequence
  SiRNA target sequence
ggtagaaaaactgtgtgttt

SEQ ID NO: 21271 - DNA, 20 bp, Artificial sequence
  SiRNA target sequence
gtagaaaaactgtgtgtttc

SEQ ID NO: 21272 - DNA, 20 bp, Artificial sequence
  SiRNA target sequence
tagaaaaactgtgtgtttcc

SEQ ID NO: 21273 - DNA, 20 bp, Artificial sequence
  SiRNA target sequence
agaaaaactgtgtgtttcct

SEQ ID NO: 21274 - DNA, 20 bp, Artificial sequence
  SiRNA target sequence
gaaaaactgtgtgtttcctt

SEQ ID NO: 21275 - DNA, 20 bp, Artificial sequence
  SiRNA target sequence
aaaaactgtgtgtttcctta

SEQ ID NO: 21276 - DNA, 20 bp, Artificial sequence
  SiRNA target sequence
aaaactgtgtgtttccttaa

SEQ ID NO: 21277 - DNA, 20 bp, Artificial sequence
  SiRNA target sequence
aaactgtgtgtttccttaaa

SEQ ID NO: 21278 - DNA, 20 bp, Artificial sequence
  SiRNA target sequence
aactgtgtgtttccttaaat

SEQ ID NO: 21279 - DNA, 20 bp, Artificial sequence
  SiRNA target sequence
actgtgtgtttccttaaatg

SEQ ID NO: 21280 - DNA, 20 bp, Artificial sequence
  SiRNA target sequence
ctgtgtgtttccttaaatgg

SEQ ID NO: 21281 - DNA, 20 bp, Artificial sequence
  SiRNA target sequence
tgtgtgtttccttaaatgga

SEQ ID NO: 21282 - DNA, 20 bp, Artificial sequence
  SiRNA target sequence
gtgtgtttccttaaatggaa

SEQ ID NO: 21283 - DNA, 20 bp, Artificial sequence
  SiRNA target sequence
tgtgtttccttaaatggaat

SEQ ID NO: 21284 - DNA, 20 bp, Artificial sequence
  SiRNA target sequence
gtgtttccttaaatggaata

SEQ ID NO: 21285 - DNA, 20 bp, Artificial sequence
  SiRNA target sequence
tgtttccttaaatggaatag

SEQ ID NO: 21286 - DNA, 20 bp, Artificial sequence
  SiRNA target sequence
gtttccttaaatggaatagt

SEQ ID NO: 21287 - DNA, 20 bp, Artificial sequence
  SiRNA target sequence
tttccttaaatggaatagta

SEQ ID NO: 21288 - DNA, 20 bp, Artificial sequence
  SiRNA target sequence
ttccttaaatggaatagtag

SEQ ID NO: 21289 - DNA, 20 bp, Artificial sequence
  SiRNA target sequence
tccttaaatggaatagtaga

SEQ ID NO: 21290 - DNA, 20 bp, Artificial sequence
  SiRNA target sequence
ccttaaatggaatagtagaa

SEQ ID NO: 21291 - DNA, 20 bp, Artificial sequence
  SiRNA target sequence
cttaaatggaatagtagaat

SEQ ID NO: 21292 - DNA, 20 bp, Artificial sequence
  SiRNA target sequence
ttaaatggaatagtagaatt

SEQ ID NO: 21293 - DNA, 20 bp, Artificial sequence
  SiRNA target sequence
taaatggaatagtagaattt

SEQ ID NO: 21294 - DNA, 20 bp, Artificial sequence
  SiRNA target sequence
aaatggaatagtagaatttc

SEQ ID NO: 21295 - DNA, 20 bp, Artificial sequence
  SiRNA target sequence
aatggaatagtagaatttct

SEQ ID NO: 21296 - DNA, 20 bp, Artificial sequence
  SiRNA target sequence
atggaatagtagaatttcta

SEQ ID NO: 21297 - DNA, 20 bp, Artificial sequence
  SiRNA target sequence
tggaatagtagaatttctat

SEQ ID NO: 21298 - DNA, 20 bp, Artificial sequence
  SiRNA target sequence
ggaatagtagaatttctatg

SEQ ID NO: 21299 - DNA, 20 bp, Artificial sequence
  SiRNA target sequence
gaatagtagaatttctatga

SEQ ID NO: 21300 - DNA, 20 bp, Artificial sequence
  SiRNA target sequence
aatagtagaatttctatgaa

SEQ ID NO: 21301 - DNA, 20 bp, Artificial sequence
  SiRNA target sequence
atagtagaatttctatgaat

SEQ ID NO: 21302 - DNA, 20 bp, Artificial sequence
  SiRNA target sequence
tagtagaatttctatgaatt

SEQ ID NO: 21303 - DNA, 20 bp, Artificial sequence
  SiRNA target sequence
agtagaatttctatgaatta

SEQ ID NO: 21304 - DNA, 20 bp, Artificial sequence
  SiRNA target sequence
gtagaatttctatgaattat

SEQ ID NO: 21305 - DNA, 20 bp, Artificial sequence
  SiRNA target sequence
tagaatttctatgaattatc

SEQ ID NO: 21306 - DNA, 20 bp, Artificial sequence
  SiRNA target sequence
agaatttctatgaattatct

SEQ ID NO: 21307 - DNA, 20 bp, Artificial sequence
  SiRNA target sequence
gaatttctatgaattatctt

SEQ ID NO: 21308 - DNA, 20 bp, Artificial sequence
  SiRNA target sequence
aatttctatgaattatctta

SEQ ID NO: 21309 - DNA, 20 bp, Artificial sequence
  SiRNA target sequence
atttctatgaattatcttat

SEQ ID NO: 21310 - DNA, 20 bp, Artificial sequence
  SiRNA target sequence
tttctatgaattatcttatt

SEQ ID NO: 21311 - DNA, 20 bp, Artificial sequence
  SiRNA target sequence
ttctatgaattatcttatta

SEQ ID NO: 21312 - DNA, 20 bp, Artificial sequence
  SiRNA target sequence
tctatgaattatcttattaa

SEQ ID NO: 21313 - DNA, 20 bp, Artificial sequence
  SiRNA target sequence
ctatgaattatcttattaaa

SEQ ID NO: 21314 - DNA, 20 bp, Artificial sequence
  SiRNA target sequence
tatgaattatcttattaaaa

SEQ ID NO: 21315 - DNA, 20 bp, Artificial sequence
  SiRNA target sequence
atgaattatcttattaaaaa

SEQ ID NO: 21316 - DNA, 20 bp, Artificial sequence
  SiRNA target sequence
tgaattatcttattaaaaat

SEQ ID NO: 21317 - DNA, 20 bp, Artificial sequence
  SiRNA target sequence
gaattatcttattaaaaatc

SEQ ID NO: 21318 - DNA, 20 bp, Artificial sequence
  SiRNA target sequence
aattatcttattaaaaatcc

SEQ ID NO: 21319 - DNA, 20 bp, Artificial sequence
  SiRNA target sequence
attatcttattaaaaatccc

SEQ ID NO: 21320 - DNA, 20 bp, Artificial sequence
  SiRNA target sequence
ttatcttattaaaaatcccg

SEQ ID NO: 21321 - DNA, 20 bp, Artificial sequence
  SiRNA target sequence
tatcttattaaaaatcccgc

SEQ ID NO: 21322 - DNA, 20 bp, Artificial sequence
  SiRNA target sequence
atcttattaaaaatcccgcc

SEQ ID NO: 21323 - DNA, 20 bp, Artificial sequence
  SiRNA target sequence
tcttattaaaaatcccgccc

SEQ ID NO: 21324 - DNA, 20 bp, Artificial sequence
  SiRNA target sequence
cttattaaaaatcccgccca

SEQ ID NO: 21325 - DNA, 20 bp, Artificial sequence
  SiRNA target sequence
ttattaaaaatcccgcccaa

SEQ ID NO: 21326 - DNA, 20 bp, Artificial sequence
  SiRNA target sequence
tattaaaaatcccgcccaaa

SEQ ID NO: 21327 - DNA, 20 bp, Artificial sequence
  SiRNA target sequence
attaaaaatcccgcccaaaa

SEQ ID NO: 21328 - DNA, 20 bp, Artificial sequence
  SiRNA target sequence
ttaaaaatcccgcccaaaag

SEQ ID NO: 21329 - DNA, 20 bp, Artificial sequence
  SiRNA target sequence
taaaaatcccgcccaaaagc

SEQ ID NO: 21330 - DNA, 20 bp, Artificial sequence
  SiRNA target sequence
aaaaatcccgcccaaaagct

SEQ ID NO: 21331 - DNA, 20 bp, Artificial sequence
  SiRNA target sequence
aaaatcccgcccaaaagctc

SEQ ID NO: 21332 - DNA, 20 bp, Artificial sequence
  SiRNA target sequence
aaatcccgcccaaaagctct

SEQ ID NO: 21333 - DNA, 20 bp, Artificial sequence
  SiRNA target sequence
aatcccgcccaaaagctcta

SEQ ID NO: 21334 - DNA, 20 bp, Artificial sequence
  SiRNA target sequence
atcccgcccaaaagctctat

SEQ ID NO: 21335 - DNA, 20 bp, Artificial sequence
  SiRNA target sequence
tcccgcccaaaagctctata

SEQ ID NO: 21336 - DNA, 20 bp, Artificial sequence
  SiRNA target sequence
cccgcccaaaagctctatac

SEQ ID NO: 21337 - DNA, 20 bp, Artificial sequence
  SiRNA target sequence
ccgcccaaaagctctatacc

SEQ ID NO: 21338 - DNA, 20 bp, Artificial sequence
  SiRNA target sequence
cgcccaaaagctctatacct

SEQ ID NO: 21339 - DNA, 20 bp, Artificial sequence
  SiRNA target sequence
gcccaaaagctctataccta

SEQ ID NO: 21340 - DNA, 20 bp, Artificial sequence
  SiRNA target sequence
cccaaaagctctatacctaa

SEQ ID NO: 21341 - DNA, 20 bp, Artificial sequence
  SiRNA target sequence
ccaaaagctctatacctaaa

SEQ ID NO: 21342 - DNA, 20 bp, Artificial sequence
  SiRNA target sequence
caaaagctctatacctaaac

SEQ ID NO: 21343 - DNA, 20 bp, Artificial sequence
  SiRNA target sequence
aaaagctctatacctaaact

SEQ ID NO: 21344 - DNA, 20 bp, Artificial sequence
  SiRNA target sequence
aaagctctatacctaaactc

SEQ ID NO: 21345 - DNA, 20 bp, Artificial sequence
  SiRNA target sequence
aagctctatacctaaactca

SEQ ID NO: 21346 - DNA, 20 bp, Artificial sequence
  SiRNA target sequence
agctctatacctaaactcaa

SEQ ID NO: 21347 - DNA, 20 bp, Artificial sequence
  SiRNA target sequence
gctctatacctaaactcaat

SEQ ID NO: 21348 - DNA, 20 bp, Artificial sequence
  SiRNA target sequence
ctctatacctaaactcaatg

SEQ ID NO: 21349 - DNA, 20 bp, Artificial sequence
  SiRNA target sequence
tctatacctaaactcaatgg

SEQ ID NO: 21350 - DNA, 20 bp, Artificial sequence
  SiRNA target sequence
ctatacctaaactcaatggt

SEQ ID NO: 21351 - DNA, 20 bp, Artificial sequence
  SiRNA target sequence
tatacctaaactcaatggta

SEQ ID NO: 21352 - DNA, 20 bp, Artificial sequence
  SiRNA target sequence
atacctaaactcaatggtac

SEQ ID NO: 21353 - DNA, 20 bp, Artificial sequence
  SiRNA target sequence
tacctaaactcaatggtact

SEQ ID NO: 21354 - DNA, 20 bp, Artificial sequence
  SiRNA target sequence
acctaaactcaatggtacta

SEQ ID NO: 21355 - DNA, 20 bp, Artificial sequence
  SiRNA target sequence
cctaaactcaatggtactac

SEQ ID NO: 21356 - DNA, 20 bp, Artificial sequence
  SiRNA target sequence
ctaaactcaatggtactaca

SEQ ID NO: 21357 - DNA, 20 bp, Artificial sequence
  SiRNA target sequence
taaactcaatggtactacat

SEQ ID NO: 21358 - DNA, 20 bp, Artificial sequence
  SiRNA target sequence
aaactcaatggtactacatc

SEQ ID NO: 21359 - DNA, 20 bp, Artificial sequence
  SiRNA target sequence
aactcaatggtactacatcc

SEQ ID NO: 21360 - DNA, 20 bp, Artificial sequence
  SiRNA target sequence
actcaatggtactacatcca

SEQ ID NO: 21361 - DNA, 20 bp, Artificial sequence
  SiRNA target sequence
ctcaatggtactacatccaa

SEQ ID NO: 21362 - DNA, 20 bp, Artificial sequence
  SiRNA target sequence
tcaatggtactacatccaat

SEQ ID NO: 21363 - DNA, 20 bp, Artificial sequence
  SiRNA target sequence
caatggtactacatccaata

SEQ ID NO: 21364 - DNA, 20 bp, Artificial sequence
  SiRNA target sequence
aatggtactacatccaataa

SEQ ID NO: 21365 - DNA, 20 bp, Artificial sequence
  SiRNA target sequence
atggtactacatccaataat

SEQ ID NO: 21366 - DNA, 20 bp, Artificial sequence
  SiRNA target sequence
tggtactacatccaataata

SEQ ID NO: 21367 - DNA, 20 bp, Artificial sequence
  SiRNA target sequence
ggtactacatccaataatag

SEQ ID NO: 21368 - DNA, 20 bp, Artificial sequence
  SiRNA target sequence
gtactacatccaataatagg

SEQ ID NO: 21369 - DNA, 20 bp, Artificial sequence
  SiRNA target sequence
tactacatccaataatagga

SEQ ID NO: 21370 - DNA, 20 bp, Artificial sequence
  SiRNA target sequence
actacatccaataataggac

SEQ ID NO: 21371 - DNA, 20 bp, Artificial sequence
  SiRNA target sequence
ctacatccaataataggaca

SEQ ID NO: 21372 - DNA, 20 bp, Artificial sequence
  SiRNA target sequence
tacatccaataataggacat

SEQ ID NO: 21373 - DNA, 20 bp, Artificial sequence
  SiRNA target sequence
acatccaataataggacatc

SEQ ID NO: 21374 - DNA, 20 bp, Artificial sequence
  SiRNA target sequence
catccaataataggacatct

SEQ ID NO: 21375 - DNA, 20 bp, Artificial sequence
  SiRNA target sequence
atccaataataggacatctt

SEQ ID NO: 21376 - DNA, 20 bp, Artificial sequence
  SiRNA target sequence
tccaataataggacatcttt

SEQ ID NO: 21377 - DNA, 20 bp, Artificial sequence
  SiRNA target sequence
ccaataataggacatctttt

SEQ ID NO: 21378 - DNA, 20 bp, Artificial sequence
  SiRNA target sequence
caataataggacatctttta

SEQ ID NO: 21379 - DNA, 20 bp, Artificial sequence
  SiRNA target sequence
aataataggacatcttttat

SEQ ID NO: 21380 - DNA, 20 bp, Artificial sequence
  SiRNA target sequence
ataataggacatcttttatt

SEQ ID NO: 21381 - DNA, 20 bp, Artificial sequence
  SiRNA target sequence
taataggacatcttttattt

SEQ ID NO: 21382 - DNA, 20 bp, Artificial sequence
  SiRNA target sequence
aataggacatcttttatttt

SEQ ID NO: 21383 - DNA, 20 bp, Artificial sequence
  SiRNA target sequence
ataggacatcttttattttt

SEQ ID NO: 21384 - DNA, 20 bp, Artificial sequence
  SiRNA target sequence
taggacatcttttatttttc

SEQ ID NO: 21385 - DNA, 20 bp, Artificial sequence
  SiRNA target sequence
aggacatcttttatttttcc

SEQ ID NO: 21386 - DNA, 20 bp, Artificial sequence
  SiRNA target sequence
ggacatcttttatttttcct

SEQ ID NO: 21387 - DNA, 20 bp, Artificial sequence
  SiRNA target sequence
gacatcttttatttttcctt

SEQ ID NO: 21388 - DNA, 20 bp, Artificial sequence
  SiRNA target sequence
acatcttttatttttccttc

SEQ ID NO: 21389 - DNA, 20 bp, Artificial sequence
  SiRNA target sequence
catcttttatttttccttct

SEQ ID NO: 21390 - DNA, 20 bp, Artificial sequence
  SiRNA target sequence
atcttttatttttccttcta

SEQ ID NO: 21391 - DNA, 20 bp, Artificial sequence
  SiRNA target sequence
tcttttatttttccttctaa

SEQ ID NO: 21392 - DNA, 20 bp, Artificial sequence
  SiRNA target sequence
cttttatttttccttctaac

SEQ ID NO: 21393 - DNA, 20 bp, Artificial sequence
  SiRNA target sequence
ttttatttttccttctaaca

SEQ ID NO: 21394 - DNA, 20 bp, Artificial sequence
  SiRNA target sequence
tttatttttccttctaacac

SEQ ID NO: 21395 - DNA, 20 bp, Artificial sequence
  SiRNA target sequence
ttatttttccttctaacacg

SEQ ID NO: 21396 - DNA, 20 bp, Artificial sequence
  SiRNA target sequence
tatttttccttctaacacgc

SEQ ID NO: 21397 - DNA, 20 bp, Artificial sequence
  SiRNA target sequence
atttttccttctaacacgcc

SEQ ID NO: 21398 - DNA, 20 bp, Artificial sequence
  SiRNA target sequence
tttttccttctaacacgcct

SEQ ID NO: 21399 - DNA, 20 bp, Artificial sequence
  SiRNA target sequence
ttttccttctaacacgcctg

SEQ ID NO: 21400 - DNA, 20 bp, Artificial sequence
  SiRNA target sequence
tttccttctaacacgcctgc

SEQ ID NO: 21401 - DNA, 20 bp, Artificial sequence
  SiRNA target sequence
ttccttctaacacgcctgct

SEQ ID NO: 21402 - DNA, 20 bp, Artificial sequence
  SiRNA target sequence
tccttctaacacgcctgctt

SEQ ID NO: 21403 - DNA, 20 bp, Artificial sequence
  SiRNA target sequence
ccttctaacacgcctgcttg

SEQ ID NO: 21404 - DNA, 20 bp, Artificial sequence
  SiRNA target sequence
cttctaacacgcctgcttgt

SEQ ID NO: 21405 - DNA, 20 bp, Artificial sequence
  SiRNA target sequence
ttctaacacgcctgcttgta

SEQ ID NO: 21406 - DNA, 20 bp, Artificial sequence
  SiRNA target sequence
tctaacacgcctgcttgtag

SEQ ID NO: 21407 - DNA, 20 bp, Artificial sequence
  SiRNA target sequence
ctaacacgcctgcttgtaga

SEQ ID NO: 21408 - DNA, 20 bp, Artificial sequence
  SiRNA target sequence
taacacgcctgcttgtagag

SEQ ID NO: 21409 - DNA, 20 bp, Artificial sequence
  SiRNA target sequence
aacacgcctgcttgtagagc

SEQ ID NO: 21410 - DNA, 20 bp, Artificial sequence
  SiRNA target sequence
acacgcctgcttgtagagcg

SEQ ID NO: 21411 - DNA, 20 bp, Artificial sequence
  SiRNA target sequence
cacgcctgcttgtagagcgg

SEQ ID NO: 21412 - DNA, 20 bp, Artificial sequence
  SiRNA target sequence
acgcctgcttgtagagcggc

SEQ ID NO: 21413 - DNA, 20 bp, Artificial sequence
  SiRNA target sequence
cgcctgcttgtagagcggcc

SEQ ID NO: 21414 - DNA, 20 bp, Artificial sequence
  SiRNA target sequence
gcctgcttgtagagcggccc

SEQ ID NO: 21415 - DNA, 20 bp, Artificial sequence
  SiRNA target sequence
cctgcttgtagagcggcccc

SEQ ID NO: 21416 - DNA, 20 bp, Artificial sequence
  SiRNA target sequence
ctgcttgtagagcggcccct

SEQ ID NO: 21417 - DNA, 20 bp, Artificial sequence
  SiRNA target sequence
tgcttgtagagcggcccctt

SEQ ID NO: 21418 - DNA, 20 bp, Artificial sequence
  SiRNA target sequence
gcttgtagagcggccccttt

SEQ ID NO: 21419 - DNA, 20 bp, Artificial sequence
  SiRNA target sequence
cttgtagagcggccccttta

SEQ ID NO: 21420 - DNA, 20 bp, Artificial sequence
  SiRNA target sequence
ttgtagagcggcccctttag

SEQ ID NO: 21421 - DNA, 20 bp, Artificial sequence
  SiRNA target sequence
tgtagagcggcccctttagc

SEQ ID NO: 21422 - DNA, 20 bp, Artificial sequence
  SiRNA target sequence
gtagagcggcccctttagca

SEQ ID NO: 21423 - DNA, 20 bp, Artificial sequence
  SiRNA target sequence
tagagcggcccctttagcaa

SEQ ID NO: 21424 - DNA, 20 bp, Artificial sequence
  SiRNA target sequence
agagcggcccctttagcaac

SEQ ID NO: 21425 - DNA, 20 bp, Artificial sequence
  SiRNA target sequence
gagcggcccctttagcaaca

SEQ ID NO: 21426 - DNA, 20 bp, Artificial sequence
  SiRNA target sequence
agcggcccctttagcaacag

SEQ ID NO: 21427 - DNA, 20 bp, Artificial sequence
  SiRNA target sequence
gcggcccctttagcaacagc

SEQ ID NO: 21428 - DNA, 20 bp, Artificial sequence
  SiRNA target sequence
cggcccctttagcaacagct

SEQ ID NO: 21429 - DNA, 20 bp, Artificial sequence
  SiRNA target sequence
ggcccctttagcaacagctt

SEQ ID NO: 21430 - DNA, 20 bp, Artificial sequence
  SiRNA target sequence
gcccctttagcaacagcttc

SEQ ID NO: 21431 - DNA, 20 bp, Artificial sequence
  SiRNA target sequence
cccctttagcaacagcttca

SEQ ID NO: 21432 - DNA, 20 bp, Artificial sequence
  SiRNA target sequence
ccctttagcaacagcttcat

SEQ ID NO: 21433 - DNA, 20 bp, Artificial sequence
  SiRNA target sequence
cctttagcaacagcttcatc

SEQ ID NO: 21434 - DNA, 20 bp, Artificial sequence
  SiRNA target sequence
ctttagcaacagcttcatct

SEQ ID NO: 21435 - DNA, 20 bp, Artificial sequence
  SiRNA target sequence
tttagcaacagcttcatctg

SEQ ID NO: 21436 - DNA, 20 bp, Artificial sequence
  SiRNA target sequence
ttagcaacagcttcatctgg

SEQ ID NO: 21437 - DNA, 20 bp, Artificial sequence
  SiRNA target sequence
tagcaacagcttcatctgga

SEQ ID NO: 21438 - DNA, 20 bp, Artificial sequence
  SiRNA target sequence
agcaacagcttcatctggat

SEQ ID NO: 21439 - DNA, 20 bp, Artificial sequence
  SiRNA target sequence
gcaacagcttcatctggatt

SEQ ID NO: 21440 - DNA, 20 bp, Artificial sequence
  SiRNA target sequence
caacagcttcatctggatta

SEQ ID NO: 21441 - DNA, 20 bp, Artificial sequence
  SiRNA target sequence
aacagcttcatctggattaa

SEQ ID NO: 21442 - DNA, 20 bp, Artificial sequence
  SiRNA target sequence
acagcttcatctggattaat

SEQ ID NO: 21443 - DNA, 20 bp, Artificial sequence
  SiRNA target sequence
cagcttcatctggattaata

SEQ ID NO: 21444 - DNA, 20 bp, Artificial sequence
  SiRNA target sequence
agcttcatctggattaatat

SEQ ID NO: 21445 - DNA, 20 bp, Artificial sequence
  SiRNA target sequence
gcttcatctggattaatatt

SEQ ID NO: 21446 - DNA, 20 bp, Artificial sequence
  SiRNA target sequence
cttcatctggattaatattt

SEQ ID NO: 21447 - DNA, 20 bp, Artificial sequence
  SiRNA target sequence
ttcatctggattaatatttg

SEQ ID NO: 21448 - DNA, 20 bp, Artificial sequence
  SiRNA target sequence
tcatctggattaatatttgt

SEQ ID NO: 21449 - DNA, 20 bp, Artificial sequence
  SiRNA target sequence
catctggattaatatttgta

SEQ ID NO: 21450 - DNA, 20 bp, Artificial sequence
  SiRNA target sequence
atctggattaatatttgtag

SEQ ID NO: 21451 - DNA, 20 bp, Artificial sequence
  SiRNA target sequence
tctggattaatatttgtaga

SEQ ID NO: 21452 - DNA, 20 bp, Artificial sequence
  SiRNA target sequence
ctggattaatatttgtagaa

SEQ ID NO: 21453 - DNA, 20 bp, Artificial sequence
  SiRNA target sequence
tggattaatatttgtagaag

SEQ ID NO: 21454 - DNA, 20 bp, Artificial sequence
  SiRNA target sequence
ggattaatatttgtagaagg

SEQ ID NO: 21455 - DNA, 20 bp, Artificial sequence
  SiRNA target sequence
gattaatatttgtagaaggc

SEQ ID NO: 21456 - DNA, 20 bp, Artificial sequence
  SiRNA target sequence
attaatatttgtagaaggct

SEQ ID NO: 21457 - DNA, 20 bp, Artificial sequence
  SiRNA target sequence
ttaatatttgtagaaggctc

SEQ ID NO: 21458 - DNA, 20 bp, Artificial sequence
  SiRNA target sequence
taatatttgtagaaggctcg

SEQ ID NO: 21459 - DNA, 20 bp, Artificial sequence
  SiRNA target sequence
aatatttgtagaaggctcga

SEQ ID NO: 21460 - DNA, 20 bp, Artificial sequence
  SiRNA target sequence
atatttgtagaaggctcgat

SEQ ID NO: 21461 - DNA, 20 bp, Artificial sequence
  SiRNA target sequence
tatttgtagaaggctcgata

SEQ ID NO: 21462 - DNA, 20 bp, Artificial sequence
  SiRNA target sequence
atttgtagaaggctcgatac

SEQ ID NO: 21463 - DNA, 20 bp, Artificial sequence
  SiRNA target sequence
tttgtagaaggctcgatacc

SEQ ID NO: 21464 - DNA, 20 bp, Artificial sequence
  SiRNA target sequence
ttgtagaaggctcgatacca

SEQ ID NO: 21465 - DNA, 20 bp, Artificial sequence
  SiRNA target sequence
tgtagaaggctcgataccaa

SEQ ID NO: 21466 - DNA, 20 bp, Artificial sequence
  SiRNA target sequence
gtagaaggctcgataccaaa

SEQ ID NO: 21467 - DNA, 20 bp, Artificial sequence
  SiRNA target sequence
tagaaggctcgataccaaaa

SEQ ID NO: 21468 - DNA, 20 bp, Artificial sequence
  SiRNA target sequence
agaaggctcgataccaaaaa

SEQ ID NO: 21469 - DNA, 20 bp, Artificial sequence
  SiRNA target sequence
gaaggctcgataccaaaaat

SEQ ID NO: 21470 - DNA, 20 bp, Artificial sequence
  SiRNA target sequence
aaggctcgataccaaaaatc

SEQ ID NO: 21471 - DNA, 20 bp, Artificial sequence
  SiRNA target sequence
aggctcgataccaaaaatct

SEQ ID NO: 21472 - DNA, 20 bp, Artificial sequence
  SiRNA target sequence
ggctcgataccaaaaatctt

SEQ ID NO: 21473 - DNA, 20 bp, Artificial sequence
  SiRNA target sequence
gctcgataccaaaaatcttc

SEQ ID NO: 21474 - DNA, 20 bp, Artificial sequence
  SiRNA target sequence
ctcgataccaaaaatcttct

SEQ ID NO: 21475 - DNA, 20 bp, Artificial sequence
  SiRNA target sequence
tcgataccaaaaatcttctt

SEQ ID NO: 21476 - DNA, 20 bp, Artificial sequence
  SiRNA target sequence
cgataccaaaaatcttctta

SEQ ID NO: 21477 - DNA, 20 bp, Artificial sequence
  SiRNA target sequence
gataccaaaaatcttcttaa

SEQ ID NO: 21478 - DNA, 20 bp, Artificial sequence
  SiRNA target sequence
ataccaaaaatcttcttaac

SEQ ID NO: 21479 - DNA, 20 bp, Artificial sequence
  SiRNA target sequence
taccaaaaatcttcttaaca

SEQ ID NO: 21480 - DNA, 20 bp, Artificial sequence
  SiRNA target sequence
accaaaaatcttcttaacaa

SEQ ID NO: 21481 - DNA, 20 bp, Artificial sequence
  SiRNA target sequence
ccaaaaatcttcttaacaag

SEQ ID NO: 21482 - DNA, 20 bp, Artificial sequence
  SiRNA target sequence
caaaaatcttcttaacaagt

SEQ ID NO: 21483 - DNA, 20 bp, Artificial sequence
  SiRNA target sequence
aaaaatcttcttaacaagtt

SEQ ID NO: 21484 - DNA, 20 bp, Artificial sequence
  SiRNA target sequence
aaaatcttcttaacaagttt

SEQ ID NO: 21485 - DNA, 20 bp, Artificial sequence
  SiRNA target sequence
aaatcttcttaacaagtttt

SEQ ID NO: 21486 - DNA, 20 bp, Artificial sequence
  SiRNA target sequence
aatcttcttaacaagttttc

SEQ ID NO: 21487 - DNA, 20 bp, Artificial sequence
  SiRNA target sequence
atcttcttaacaagttttct

SEQ ID NO: 21488 - DNA, 20 bp, Artificial sequence
  SiRNA target sequence
tcttcttaacaagttttcta

SEQ ID NO: 21489 - DNA, 20 bp, Artificial sequence
  SiRNA target sequence
cttcttaacaagttttctaa

SEQ ID NO: 21490 - DNA, 20 bp, Artificial sequence
  SiRNA target sequence
ttcttaacaagttttctaac

SEQ ID NO: 21491 - DNA, 20 bp, Artificial sequence
  SiRNA target sequence
tcttaacaagttttctaaca

SEQ ID NO: 21492 - DNA, 20 bp, Artificial sequence
  SiRNA target sequence
cttaacaagttttctaacat

SEQ ID NO: 21493 - DNA, 20 bp, Artificial sequence
  SiRNA target sequence
ttaacaagttttctaacata

SEQ ID NO: 21494 - DNA, 20 bp, Artificial sequence
  SiRNA target sequence
taacaagttttctaacatac

SEQ ID NO: 21495 - DNA, 20 bp, Artificial sequence
  SiRNA target sequence
aacaagttttctaacatacg

SEQ ID NO: 21496 - DNA, 20 bp, Artificial sequence
  SiRNA target sequence
acaagttttctaacatacgg

SEQ ID NO: 21497 - DNA, 20 bp, Artificial sequence
  SiRNA target sequence
caagttttctaacatacggc

SEQ ID NO: 21498 - DNA, 20 bp, Artificial sequence
  SiRNA target sequence
aagttttctaacatacggca

SEQ ID NO: 21499 - DNA, 20 bp, Artificial sequence
  SiRNA target sequence
agttttctaacatacggcat

SEQ ID NO: 21500 - DNA, 20 bp, Artificial sequence
  SiRNA target sequence
gttttctaacatacggcatt

SEQ ID NO: 21501 - DNA, 20 bp, Artificial sequence
  SiRNA target sequence
ttttctaacatacggcattc

SEQ ID NO: 21502 - DNA, 20 bp, Artificial sequence
  SiRNA target sequence
tttctaacatacggcattcg

SEQ ID NO: 21503 - DNA, 20 bp, Artificial sequence
  SiRNA target sequence
ttctaacatacggcattcgt

SEQ ID NO: 21504 - DNA, 20 bp, Artificial sequence
  SiRNA target sequence
tctaacatacggcattcgtg

SEQ ID NO: 21505 - DNA, 20 bp, Artificial sequence
  SiRNA target sequence
ctaacatacggcattcgtgt

SEQ ID NO: 21506 - DNA, 20 bp, Artificial sequence
  SiRNA target sequence
taacatacggcattcgtgtc

SEQ ID NO: 21507 - DNA, 20 bp, Artificial sequence
  SiRNA target sequence
aacatacggcattcgtgtca

SEQ ID NO: 21508 - DNA, 20 bp, Artificial sequence
  SiRNA target sequence
acatacggcattcgtgtcat

SEQ ID NO: 21509 - DNA, 20 bp, Artificial sequence
  SiRNA target sequence
catacggcattcgtgtcatt

SEQ ID NO: 21510 - DNA, 20 bp, Artificial sequence
  SiRNA target sequence
atacggcattcgtgtcattc

SEQ ID NO: 21511 - DNA, 20 bp, Artificial sequence
  SiRNA target sequence
tacggcattcgtgtcattcc

SEQ ID NO: 21512 - DNA, 20 bp, Artificial sequence
  SiRNA target sequence
acggcattcgtgtcattcca

SEQ ID NO: 21513 - DNA, 20 bp, Artificial sequence
  SiRNA target sequence
cggcattcgtgtcattccac

SEQ ID NO: 21514 - DNA, 20 bp, Artificial sequence
  SiRNA target sequence
ggcattcgtgtcattccacc

SEQ ID NO: 21515 - DNA, 20 bp, Artificial sequence
  SiRNA target sequence
gcattcgtgtcattccaccc

SEQ ID NO: 21516 - DNA, 20 bp, Artificial sequence
  SiRNA target sequence
cattcgtgtcattccaccca

SEQ ID NO: 21517 - DNA, 20 bp, Artificial sequence
  SiRNA target sequence
attcgtgtcattccacccac

SEQ ID NO: 21518 - DNA, 20 bp, Artificial sequence
  SiRNA target sequence
ttcgtgtcattccacccaca

SEQ ID NO: 21519 - DNA, 20 bp, Artificial sequence
  SiRNA target sequence
tcgtgtcattccacccacaa

SEQ ID NO: 21520 - DNA, 20 bp, Artificial sequence
  SiRNA target sequence
cgtgtcattccacccacaag

SEQ ID NO: 21521 - DNA, 20 bp, Artificial sequence
  SiRNA target sequence
gtgtcattccacccacaagt

SEQ ID NO: 21522 - DNA, 20 bp, Artificial sequence
  SiRNA target sequence
tgtcattccacccacaagta

SEQ ID NO: 21523 - DNA, 20 bp, Artificial sequence
  SiRNA target sequence
gtcattccacccacaagtat

SEQ ID NO: 21524 - DNA, 20 bp, Artificial sequence
  SiRNA target sequence
tcattccacccacaagtata

SEQ ID NO: 21525 - DNA, 20 bp, Artificial sequence
  SiRNA target sequence
cattccacccacaagtataa

SEQ ID NO: 21526 - DNA, 20 bp, Artificial sequence
  SiRNA target sequence
attccacccacaagtataac

SEQ ID NO: 21527 - DNA, 20 bp, Artificial sequence
  SiRNA target sequence
ttccacccacaagtataacg

SEQ ID NO: 21528 - DNA, 20 bp, Artificial sequence
  SiRNA target sequence
tccacccacaagtataacgt

SEQ ID NO: 21529 - DNA, 20 bp, Artificial sequence
  SiRNA target sequence
ccacccacaagtataacgtg

SEQ ID NO: 21530 - DNA, 20 bp, Artificial sequence
  SiRNA target sequence
cacccacaagtataacgtgt

SEQ ID NO: 21531 - DNA, 20 bp, Artificial sequence
  SiRNA target sequence
acccacaagtataacgtgtt

SEQ ID NO: 21532 - DNA, 20 bp, Artificial sequence
  SiRNA target sequence
cccacaagtataacgtgttt

SEQ ID NO: 21533 - DNA, 20 bp, Artificial sequence
  SiRNA target sequence
ccacaagtataacgtgttta

SEQ ID NO: 21534 - DNA, 20 bp, Artificial sequence
  SiRNA target sequence
cacaagtataacgtgtttaa

SEQ ID NO: 21535 - DNA, 20 bp, Artificial sequence
  SiRNA target sequence
acaagtataacgtgtttaat

SEQ ID NO: 21536 - DNA, 20 bp, Artificial sequence
  SiRNA target sequence
caagtataacgtgtttaata

SEQ ID NO: 21537 - DNA, 20 bp, Artificial sequence
  SiRNA target sequence
aagtataacgtgtttaatat

SEQ ID NO: 21538 - DNA, 20 bp, Artificial sequence
  SiRNA target sequence
agtataacgtgtttaatatc

SEQ ID NO: 21539 - DNA, 20 bp, Artificial sequence
  SiRNA target sequence
gtataacgtgtttaatatca

SEQ ID NO: 21540 - DNA, 20 bp, Artificial sequence
  SiRNA target sequence
tataacgtgtttaatatcac

SEQ ID NO: 21541 - DNA, 20 bp, Artificial sequence
  SiRNA target sequence
ataacgtgtttaatatcact

SEQ ID NO: 21542 - DNA, 20 bp, Artificial sequence
  SiRNA target sequence
taacgtgtttaatatcactt

SEQ ID NO: 21543 - DNA, 20 bp, Artificial sequence
  SiRNA target sequence
aacgtgtttaatatcacttt

SEQ ID NO: 21544 - DNA, 20 bp, Artificial sequence
  SiRNA target sequence
acgtgtttaatatcactttt

SEQ ID NO: 21545 - DNA, 20 bp, Artificial sequence
  SiRNA target sequence
cgtgtttaatatcactttta

SEQ ID NO: 21546 - DNA, 20 bp, Artificial sequence
  SiRNA target sequence
gtgtttaatatcacttttag

SEQ ID NO: 21547 - DNA, 20 bp, Artificial sequence
  SiRNA target sequence
tgtttaatatcacttttagt

SEQ ID NO: 21548 - DNA, 20 bp, Artificial sequence
  SiRNA target sequence
gtttaatatcacttttagtt

SEQ ID NO: 21549 - DNA, 20 bp, Artificial sequence
  SiRNA target sequence
tttaatatcacttttagtta

SEQ ID NO: 21550 - DNA, 20 bp, Artificial sequence
  SiRNA target sequence
ttaatatcacttttagttat

SEQ ID NO: 21551 - DNA, 20 bp, Artificial sequence
  SiRNA target sequence
taatatcacttttagttata

SEQ ID NO: 21552 - DNA, 20 bp, Artificial sequence
  SiRNA target sequence
aatatcacttttagttatat

SEQ ID NO: 21553 - DNA, 20 bp, Artificial sequence
  SiRNA target sequence
atatcacttttagttatatt

SEQ ID NO: 21554 - DNA, 20 bp, Artificial sequence
  SiRNA target sequence
tatcacttttagttatattg

SEQ ID NO: 21555 - DNA, 20 bp, Artificial sequence
  SiRNA target sequence
atcacttttagttatattgg

SEQ ID NO: 21556 - DNA, 20 bp, Artificial sequence
  SiRNA target sequence
tcacttttagttatattggc

SEQ ID NO: 21557 - DNA, 20 bp, Artificial sequence
  SiRNA target sequence
cacttttagttatattggca

SEQ ID NO: 21558 - DNA, 20 bp, Artificial sequence
  SiRNA target sequence
acttttagttatattggcat

SEQ ID NO: 21559 - DNA, 20 bp, Artificial sequence
  SiRNA target sequence
cttttagttatattggcatc

SEQ ID NO: 21560 - DNA, 20 bp, Artificial sequence
  SiRNA target sequence
ttttagttatattggcatct

SEQ ID NO: 21561 - DNA, 20 bp, Artificial sequence
  SiRNA target sequence
tttagttatattggcatctc

SEQ ID NO: 21562 - DNA, 20 bp, Artificial sequence
  SiRNA target sequence
ttagttatattggcatctct

SEQ ID NO: 21563 - DNA, 20 bp, Artificial sequence
  SiRNA target sequence
tagttatattggcatctcta

SEQ ID NO: 21564 - DNA, 20 bp, Artificial sequence
  SiRNA target sequence
agttatattggcatctctaa

SEQ ID NO: 21565 - DNA, 20 bp, Artificial sequence
  SiRNA target sequence
gttatattggcatctctaat

SEQ ID NO: 21566 - DNA, 20 bp, Artificial sequence
  SiRNA target sequence
ttatattggcatctctaata

SEQ ID NO: 21567 - DNA, 20 bp, Artificial sequence
  SiRNA target sequence
tatattggcatctctaatag

SEQ ID NO: 21568 - DNA, 20 bp, Artificial sequence
  SiRNA target sequence
atattggcatctctaatagc

SEQ ID NO: 21569 - DNA, 20 bp, Artificial sequence
  SiRNA target sequence
tattggcatctctaatagct

SEQ ID NO: 21570 - DNA, 20 bp, Artificial sequence
  SiRNA target sequence
attggcatctctaatagctt

SEQ ID NO: 21571 - DNA, 20 bp, Artificial sequence
  SiRNA target sequence
ttggcatctctaatagcttt

SEQ ID NO: 21572 - DNA, 20 bp, Artificial sequence
  SiRNA target sequence
tggcatctctaatagcttta

SEQ ID NO: 21573 - DNA, 20 bp, Artificial sequence
  SiRNA target sequence
ggcatctctaatagctttaa

SEQ ID NO: 21574 - DNA, 20 bp, Artificial sequence
  SiRNA target sequence
gcatctctaatagctttaag

SEQ ID NO: 21575 - DNA, 20 bp, Artificial sequence
  SiRNA target sequence
catctctaatagctttaaga

SEQ ID NO: 21576 - DNA, 20 bp, Artificial sequence
  SiRNA target sequence
atctctaatagctttaagac

SEQ ID NO: 21577 - DNA, 20 bp, Artificial sequence
  SiRNA target sequence
tctctaatagctttaagaca

SEQ ID NO: 21578 - DNA, 20 bp, Artificial sequence
  SiRNA target sequence
ctctaatagctttaagacag

SEQ ID NO: 21579 - DNA, 20 bp, Artificial sequence
  SiRNA target sequence
tctaatagctttaagacagg

SEQ ID NO: 21580 - DNA, 20 bp, Artificial sequence
  SiRNA target sequence
ctaatagctttaagacaggg

SEQ ID NO: 21581 - DNA, 20 bp, Artificial sequence
  SiRNA target sequence
taatagctttaagacagggg

SEQ ID NO: 21582 - DNA, 20 bp, Artificial sequence
  SiRNA target sequence
aatagctttaagacaggggt

SEQ ID NO: 21583 - DNA, 20 bp, Artificial sequence
  SiRNA target sequence
atagctttaagacaggggtt

SEQ ID NO: 21584 - DNA, 20 bp, Artificial sequence
  SiRNA target sequence
tagctttaagacaggggttt

SEQ ID NO: 21585 - DNA, 20 bp, Artificial sequence
  SiRNA target sequence
agctttaagacaggggttta

SEQ ID NO: 21586 - DNA, 20 bp, Artificial sequence
  SiRNA target sequence
gctttaagacaggggtttat

SEQ ID NO: 21587 - DNA, 20 bp, Artificial sequence
  SiRNA target sequence
ctttaagacaggggtttatt

SEQ ID NO: 21588 - DNA, 20 bp, Artificial sequence
  SiRNA target sequence
tttaagacaggggtttattg

SEQ ID NO: 21589 - DNA, 20 bp, Artificial sequence
  SiRNA target sequence
ttaagacaggggtttattgt

SEQ ID NO: 21590 - DNA, 20 bp, Artificial sequence
  SiRNA target sequence
taagacaggggtttattgtt

SEQ ID NO: 21591 - DNA, 20 bp, Artificial sequence
  SiRNA target sequence
aagacaggggtttattgttt

SEQ ID NO: 21592 - DNA, 20 bp, Artificial sequence
  SiRNA target sequence
agacaggggtttattgtttt

SEQ ID NO: 21593 - DNA, 20 bp, Artificial sequence
  SiRNA target sequence
gacaggggtttattgttttg

SEQ ID NO: 21594 - DNA, 20 bp, Artificial sequence
  SiRNA target sequence
acaggggtttattgttttgt

SEQ ID NO: 21595 - DNA, 20 bp, Artificial sequence
  SiRNA target sequence
caggggtttattgttttgtc

SEQ ID NO: 21596 - DNA, 20 bp, Artificial sequence
  SiRNA target sequence
aggggtttattgttttgtct

SEQ ID NO: 21597 - DNA, 20 bp, Artificial sequence
  SiRNA target sequence
ggggtttattgttttgtcta

SEQ ID NO: 21598 - DNA, 20 bp, Artificial sequence
  SiRNA target sequence
gggtttattgttttgtctat

SEQ ID NO: 21599 - DNA, 20 bp, Artificial sequence
  SiRNA target sequence
ggtttattgttttgtctatt

SEQ ID NO: 21600 - DNA, 20 bp, Artificial sequence
  SiRNA target sequence
gtttattgttttgtctatta

SEQ ID NO: 21601 - DNA, 20 bp, Artificial sequence
  SiRNA target sequence
tttattgttttgtctattaa

SEQ ID NO: 21602 - DNA, 20 bp, Artificial sequence
  SiRNA target sequence
ttattgttttgtctattaac

SEQ ID NO: 21603 - DNA, 20 bp, Artificial sequence
  SiRNA target sequence
tattgttttgtctattaact

SEQ ID NO: 21604 - DNA, 20 bp, Artificial sequence
  SiRNA target sequence
attgttttgtctattaactt

SEQ ID NO: 21605 - DNA, 20 bp, Artificial sequence
  SiRNA target sequence
ttgttttgtctattaacttt

SEQ ID NO: 21606 - DNA, 20 bp, Artificial sequence
  SiRNA target sequence
tgttttgtctattaactttt

SEQ ID NO: 21607 - DNA, 20 bp, Artificial sequence
  SiRNA target sequence
gttttgtctattaacttttt

SEQ ID NO: 21608 - DNA, 20 bp, Artificial sequence
  SiRNA target sequence
ttttgtctattaactttttt

SEQ ID NO: 21609 - DNA, 20 bp, Artificial sequence
  SiRNA target sequence
tttgtctattaacttttttg

SEQ ID NO: 21610 - DNA, 20 bp, Artificial sequence
  SiRNA target sequence
ttgtctattaacttttttgt

SEQ ID NO: 21611 - DNA, 20 bp, Artificial sequence
  SiRNA target sequence
tgtctattaacttttttgta

SEQ ID NO: 21612 - DNA, 20 bp, Artificial sequence
  SiRNA target sequence
gtctattaacttttttgtaa

SEQ ID NO: 21613 - DNA, 20 bp, Artificial sequence
  SiRNA target sequence
tctattaacttttttgtaat

SEQ ID NO: 21614 - DNA, 20 bp, Artificial sequence
  SiRNA target sequence
ctattaacttttttgtaatt

SEQ ID NO: 21615 - DNA, 20 bp, Artificial sequence
  SiRNA target sequence
tattaacttttttgtaattt

SEQ ID NO: 21616 - DNA, 20 bp, Artificial sequence
  SiRNA target sequence
attaacttttttgtaatttt

SEQ ID NO: 21617 - DNA, 20 bp, Artificial sequence
  SiRNA target sequence
ttaacttttttgtaattttt

SEQ ID NO: 21618 - DNA, 20 bp, Artificial sequence
  SiRNA target sequence
taacttttttgtaatttttt

SEQ ID NO: 21619 - DNA, 20 bp, Artificial sequence
  SiRNA target sequence
aacttttttgtaattttttc

SEQ ID NO: 21620 - DNA, 20 bp, Artificial sequence
  SiRNA target sequence
acttttttgtaattttttca

SEQ ID NO: 21621 - DNA, 20 bp, Artificial sequence
  SiRNA target sequence
cttttttgtaattttttcaa

SEQ ID NO: 21622 - DNA, 20 bp, Artificial sequence
  SiRNA target sequence
ttttttgtaattttttcaaa

SEQ ID NO: 21623 - DNA, 20 bp, Artificial sequence
  SiRNA target sequence
tttttgtaattttttcaaat

SEQ ID NO: 21624 - DNA, 20 bp, Artificial sequence
  SiRNA target sequence
ttttgtaattttttcaaatt

SEQ ID NO: 21625 - DNA, 20 bp, Artificial sequence
  SiRNA target sequence
tttgtaattttttcaaattc

SEQ ID NO: 21626 - DNA, 20 bp, Artificial sequence
  SiRNA target sequence
ttgtaattttttcaaattcg

SEQ ID NO: 21627 - DNA, 20 bp, Artificial sequence
  SiRNA target sequence
tgtaattttttcaaattcgt

SEQ ID NO: 21628 - DNA, 20 bp, Artificial sequence
  SiRNA target sequence
gtaattttttcaaattcgtc

SEQ ID NO: 21629 - DNA, 20 bp, Artificial sequence
  SiRNA target sequence
taattttttcaaattcgtcg

SEQ ID NO: 21630 - DNA, 20 bp, Artificial sequence
  SiRNA target sequence
aattttttcaaattcgtcgc

SEQ ID NO: 21631 - DNA, 20 bp, Artificial sequence
  SiRNA target sequence
attttttcaaattcgtcgcg

SEQ ID NO: 21632 - DNA, 20 bp, Artificial sequence
  SiRNA target sequence
ttttttcaaattcgtcgcgt

SEQ ID NO: 21633 - DNA, 20 bp, Artificial sequence
  SiRNA target sequence
tttttcaaattcgtcgcgtg

SEQ ID NO: 21634 - DNA, 20 bp, Artificial sequence
  SiRNA target sequence
ttttcaaattcgtcgcgtgt

SEQ ID NO: 21635 - DNA, 20 bp, Artificial sequence
  SiRNA target sequence
tttcaaattcgtcgcgtgta

SEQ ID NO: 21636 - DNA, 20 bp, Artificial sequence
  SiRNA target sequence
ttcaaattcgtcgcgtgtaa

SEQ ID NO: 21637 - DNA, 20 bp, Artificial sequence
  SiRNA target sequence
tcaaattcgtcgcgtgtaat

SEQ ID NO: 21638 - DNA, 20 bp, Artificial sequence
  SiRNA target sequence
caaattcgtcgcgtgtaatt

SEQ ID NO: 21639 - DNA, 20 bp, Artificial sequence
  SiRNA target sequence
aaattcgtcgcgtgtaatta

SEQ ID NO: 21640 - DNA, 20 bp, Artificial sequence
  SiRNA target sequence
aattcgtcgcgtgtaattac

SEQ ID NO: 21641 - DNA, 20 bp, Artificial sequence
  SiRNA target sequence
attcgtcgcgtgtaattacc

SEQ ID NO: 21642 - DNA, 20 bp, Artificial sequence
  SiRNA target sequence
ttcgtcgcgtgtaattacct

SEQ ID NO: 21643 - DNA, 20 bp, Artificial sequence
  SiRNA target sequence
tcgtcgcgtgtaattacctc

SEQ ID NO: 21644 - DNA, 20 bp, Artificial sequence
  SiRNA target sequence
cgtcgcgtgtaattacctct

SEQ ID NO: 21645 - DNA, 20 bp, Artificial sequence
  SiRNA target sequence
gtcgcgtgtaattacctctt

SEQ ID NO: 21646 - DNA, 20 bp, Artificial sequence
  SiRNA target sequence
tcgcgtgtaattacctcttt

SEQ ID NO: 21647 - DNA, 20 bp, Artificial sequence
  SiRNA target sequence
cgcgtgtaattacctctttt

SEQ ID NO: 21648 - DNA, 20 bp, Artificial sequence
  SiRNA target sequence
gcgtgtaattacctctttta

SEQ ID NO: 21649 - DNA, 20 bp, Artificial sequence
  SiRNA target sequence
cgtgtaattacctcttttaa

SEQ ID NO: 21650 - DNA, 20 bp, Artificial sequence
  SiRNA target sequence
gtgtaattacctcttttaag

SEQ ID NO: 21651 - DNA, 20 bp, Artificial sequence
  SiRNA target sequence
tgtaattacctcttttaagt

SEQ ID NO: 21652 - DNA, 20 bp, Artificial sequence
  SiRNA target sequence
gtaattacctcttttaagtg

SEQ ID NO: 21653 - DNA, 20 bp, Artificial sequence
  SiRNA target sequence
taattacctcttttaagtga

SEQ ID NO: 21654 - DNA, 20 bp, Artificial sequence
  SiRNA target sequence
aattacctcttttaagtgat

SEQ ID NO: 21655 - DNA, 20 bp, Artificial sequence
  SiRNA target sequence
attacctcttttaagtgata

SEQ ID NO: 21656 - DNA, 20 bp, Artificial sequence
  SiRNA target sequence
ttacctcttttaagtgataa

SEQ ID NO: 21657 - DNA, 20 bp, Artificial sequence
  SiRNA target sequence
tacctcttttaagtgataat

SEQ ID NO: 21658 - DNA, 20 bp, Artificial sequence
  SiRNA target sequence
acctcttttaagtgataatt

SEQ ID NO: 21659 - DNA, 20 bp, Artificial sequence
  SiRNA target sequence
cctcttttaagtgataattc

SEQ ID NO: 21660 - DNA, 20 bp, Artificial sequence
  SiRNA target sequence
ctcttttaagtgataattct

SEQ ID NO: 21661 - DNA, 20 bp, Artificial sequence
  SiRNA target sequence
tcttttaagtgataattctt

SEQ ID NO: 21662 - DNA, 20 bp, Artificial sequence
  SiRNA target sequence
cttttaagtgataattcttt

SEQ ID NO: 21663 - DNA, 20 bp, Artificial sequence
  SiRNA target sequence
ttttaagtgataattctttt

SEQ ID NO: 21664 - DNA, 20 bp, Artificial sequence
  SiRNA target sequence
tttaagtgataattcttttt

SEQ ID NO: 21665 - DNA, 20 bp, Artificial sequence
  SiRNA target sequence
ttaagtgataattcttttta

SEQ ID NO: 21666 - DNA, 20 bp, Artificial sequence
  SiRNA target sequence
taagtgataattctttttac

SEQ ID NO: 21667 - DNA, 20 bp, Artificial sequence
  SiRNA target sequence
aagtgataattctttttact

SEQ ID NO: 21668 - DNA, 20 bp, Artificial sequence
  SiRNA target sequence
agtgataattctttttacta

SEQ ID NO: 21669 - DNA, 20 bp, Artificial sequence
  SiRNA target sequence
gtgataattctttttactat

SEQ ID NO: 21670 - DNA, 20 bp, Artificial sequence
  SiRNA target sequence
tgataattctttttactatc

SEQ ID NO: 21671 - DNA, 20 bp, Artificial sequence
  SiRNA target sequence
gataattctttttactatcg

SEQ ID NO: 21672 - DNA, 20 bp, Artificial sequence
  SiRNA target sequence
ataattctttttactatcgt

SEQ ID NO: 21673 - DNA, 20 bp, Artificial sequence
  SiRNA target sequence
taattctttttactatcgtt

SEQ ID NO: 21674 - DNA, 20 bp, Artificial sequence
  SiRNA target sequence
aattctttttactatcgtta

SEQ ID NO: 21675 - DNA, 20 bp, Artificial sequence
  SiRNA target sequence
attctttttactatcgttat

SEQ ID NO: 21676 - DNA, 20 bp, Artificial sequence
  SiRNA target sequence
ttctttttactatcgttata

SEQ ID NO: 21677 - DNA, 20 bp, Artificial sequence
  SiRNA target sequence
tctttttactatcgttataa

SEQ ID NO: 21678 - DNA, 20 bp, Artificial sequence
  SiRNA target sequence
ctttttactatcgttataaa

SEQ ID NO: 21679 - DNA, 20 bp, Artificial sequence
  SiRNA target sequence
tttttactatcgttataaat

SEQ ID NO: 21680 - DNA, 20 bp, Artificial sequence
  SiRNA target sequence
ttttactatcgttataaata

SEQ ID NO: 21681 - DNA, 20 bp, Artificial sequence
  SiRNA target sequence
tttactatcgttataaatat

SEQ ID NO: 21682 - DNA, 20 bp, Artificial sequence
  SiRNA target sequence
ttactatcgttataaatata

SEQ ID NO: 21683 - DNA, 20 bp, Artificial sequence
  SiRNA target sequence
tactatcgttataaatatac

SEQ ID NO: 21684 - DNA, 20 bp, Artificial sequence
  SiRNA target sequence
actatcgttataaatatacg

SEQ ID NO: 21685 - DNA, 20 bp, Artificial sequence
  SiRNA target sequence
ctatcgttataaatatacgg

SEQ ID NO: 21686 - DNA, 20 bp, Artificial sequence
  SiRNA target sequence
tatcgttataaatatacgga

SEQ ID NO: 21687 - DNA, 20 bp, Artificial sequence
  SiRNA target sequence
atcgttataaatatacggaa

SEQ ID NO: 21688 - DNA, 20 bp, Artificial sequence
  SiRNA target sequence
tcgttataaatatacggaat

SEQ ID NO: 21689 - DNA, 20 bp, Artificial sequence
  SiRNA target sequence
cgttataaatatacggaata

SEQ ID NO: 21690 - DNA, 20 bp, Artificial sequence
  SiRNA target sequence
gttataaatatacggaatat

SEQ ID NO: 21691 - DNA, 20 bp, Artificial sequence
  SiRNA target sequence
ttataaatatacggaatatt

SEQ ID NO: 21692 - DNA, 20 bp, Artificial sequence
  SiRNA target sequence
tataaatatacggaatatta

SEQ ID NO: 21693 - DNA, 20 bp, Artificial sequence
  SiRNA target sequence
ataaatatacggaatattaa

SEQ ID NO: 21694 - DNA, 20 bp, Artificial sequence
  SiRNA target sequence
taaatatacggaatattaat

SEQ ID NO: 21695 - DNA, 20 bp, Artificial sequence
  SiRNA target sequence
aaatatacggaatattaatt

SEQ ID NO: 21696 - DNA, 20 bp, Artificial sequence
  SiRNA target sequence
aatatacggaatattaattt

SEQ ID NO: 21697 - DNA, 20 bp, Artificial sequence
  SiRNA target sequence
atatacggaatattaatttc

SEQ ID NO: 21698 - DNA, 20 bp, Artificial sequence
  SiRNA target sequence
tatacggaatattaatttca

SEQ ID NO: 21699 - DNA, 20 bp, Artificial sequence
  SiRNA target sequence
atacggaatattaatttcag

SEQ ID NO: 21700 - DNA, 20 bp, Artificial sequence
  SiRNA target sequence
tacggaatattaatttcaga

SEQ ID NO: 21701 - DNA, 20 bp, Artificial sequence
  SiRNA target sequence
acggaatattaatttcagac

SEQ ID NO: 21702 - DNA, 20 bp, Artificial sequence
  SiRNA target sequence
cggaatattaatttcagacg

SEQ ID NO: 21703 - DNA, 20 bp, Artificial sequence
  SiRNA target sequence
ggaatattaatttcagacga

SEQ ID NO: 21704 - DNA, 20 bp, Artificial sequence
  SiRNA target sequence
gaatattaatttcagacgaa

SEQ ID NO: 21705 - DNA, 20 bp, Artificial sequence
  SiRNA target sequence
aatattaatttcagacgaaa

SEQ ID NO: 21706 - DNA, 20 bp, Artificial sequence
  SiRNA target sequence
atattaatttcagacgaaag

SEQ ID NO: 21707 - DNA, 20 bp, Artificial sequence
  SiRNA target sequence
tattaatttcagacgaaaga

SEQ ID NO: 21708 - DNA, 20 bp, Artificial sequence
  SiRNA target sequence
attaatttcagacgaaagat

SEQ ID NO: 21709 - DNA, 20 bp, Artificial sequence
  SiRNA target sequence
ttaatttcagacgaaagatt

SEQ ID NO: 21710 - DNA, 20 bp, Artificial sequence
  SiRNA target sequence
taatttcagacgaaagatta

SEQ ID NO: 21711 - DNA, 20 bp, Artificial sequence
  SiRNA target sequence
aatttcagacgaaagattag

SEQ ID NO: 21712 - DNA, 20 bp, Artificial sequence
  SiRNA target sequence
atttcagacgaaagattaga

SEQ ID NO: 21713 - DNA, 20 bp, Artificial sequence
  SiRNA target sequence
tttcagacgaaagattagac

SEQ ID NO: 21714 - DNA, 20 bp, Artificial sequence
  SiRNA target sequence
ttcagacgaaagattagacg

SEQ ID NO: 21715 - DNA, 20 bp, Artificial sequence
  SiRNA target sequence
tcagacgaaagattagacga

SEQ ID NO: 21716 - DNA, 20 bp, Artificial sequence
  SiRNA target sequence
cagacgaaagattagacgac

SEQ ID NO: 21717 - DNA, 20 bp, Artificial sequence
  SiRNA target sequence
agacgaaagattagacgaca

SEQ ID NO: 21718 - DNA, 20 bp, Artificial sequence
  SiRNA target sequence
gacgaaagattagacgacag

SEQ ID NO: 21719 - DNA, 20 bp, Artificial sequence
  SiRNA target sequence
acgaaagattagacgacagt

SEQ ID NO: 21720 - DNA, 20 bp, Artificial sequence
  SiRNA target sequence
cgaaagattagacgacagtt

SEQ ID NO: 21721 - DNA, 20 bp, Artificial sequence
  SiRNA target sequence
gaaagattagacgacagttc

SEQ ID NO: 21722 - DNA, 20 bp, Artificial sequence
  SiRNA target sequence
aaagattagacgacagttct

SEQ ID NO: 21723 - DNA, 20 bp, Artificial sequence
  SiRNA target sequence
aagattagacgacagttctt

SEQ ID NO: 21724 - DNA, 20 bp, Artificial sequence
  SiRNA target sequence
agattagacgacagttcttt

SEQ ID NO: 21725 - DNA, 20 bp, Artificial sequence
  SiRNA target sequence
gattagacgacagttctttt

SEQ ID NO: 21726 - DNA, 20 bp, Artificial sequence
  SiRNA target sequence
attagacgacagttcttttt

SEQ ID NO: 21727 - DNA, 20 bp, Artificial sequence
  SiRNA target sequence
ttagacgacagttctttttt

SEQ ID NO: 21728 - DNA, 20 bp, Artificial sequence
  SiRNA target sequence
tagacgacagttcttttttc

SEQ ID NO: 21729 - DNA, 20 bp, Artificial sequence
  SiRNA target sequence
agacgacagttcttttttca

SEQ ID NO: 21730 - DNA, 20 bp, Artificial sequence
  SiRNA target sequence
gacgacagttcttttttcat

SEQ ID NO: 21731 - DNA, 20 bp, Artificial sequence
  SiRNA target sequence
acgacagttcttttttcatt

SEQ ID NO: 21732 - DNA, 20 bp, Artificial sequence
  SiRNA target sequence
cgacagttcttttttcattt

SEQ ID NO: 21733 - DNA, 20 bp, Artificial sequence
  SiRNA target sequence
gacagttcttttttcatttt

SEQ ID NO: 21734 - DNA, 20 bp, Artificial sequence
  SiRNA target sequence
acagttcttttttcattttt

SEQ ID NO: 21735 - DNA, 20 bp, Artificial sequence
  SiRNA target sequence
cagttcttttttcatttttt

SEQ ID NO: 21736 - DNA, 20 bp, Artificial sequence
  SiRNA target sequence
agttcttttttcattttttc

SEQ ID NO: 21737 - DNA, 20 bp, Artificial sequence
  SiRNA target sequence
gttcttttttcattttttcc

SEQ ID NO: 21738 - DNA, 20 bp, Artificial sequence
  SiRNA target sequence
ttcttttttcattttttccg

SEQ ID NO: 21739 - DNA, 20 bp, Artificial sequence
  SiRNA target sequence
tcttttttcattttttccgc

SEQ ID NO: 21740 - DNA, 20 bp, Artificial sequence
  SiRNA target sequence
cttttttcattttttccgct

SEQ ID NO: 21741 - DNA, 20 bp, Artificial sequence
  SiRNA target sequence
ttttttcattttttccgctg

SEQ ID NO: 21742 - DNA, 20 bp, Artificial sequence
  SiRNA target sequence
tttttcattttttccgctgc

SEQ ID NO: 21743 - DNA, 20 bp, Artificial sequence
  SiRNA target sequence
ttttcattttttccgctgct

SEQ ID NO: 21744 - DNA, 20 bp, Artificial sequence
  SiRNA target sequence
tttcattttttccgctgctt

SEQ ID NO: 21745 - DNA, 20 bp, Artificial sequence
  SiRNA target sequence
ttcattttttccgctgcttc

SEQ ID NO: 21746 - DNA, 20 bp, Artificial sequence
  SiRNA target sequence
tcattttttccgctgcttct

SEQ ID NO: 21747 - DNA, 20 bp, Artificial sequence
  SiRNA target sequence
cattttttccgctgcttctt

SEQ ID NO: 21748 - DNA, 20 bp, Artificial sequence
  SiRNA target sequence
attttttccgctgcttcttt

SEQ ID NO: 21749 - DNA, 20 bp, Artificial sequence
  SiRNA target sequence
ttttttccgctgcttcttta

SEQ ID NO: 21750 - DNA, 20 bp, Artificial sequence
  SiRNA target sequence
tttttccgctgcttctttaa

SEQ ID NO: 21751 - DNA, 20 bp, Artificial sequence
  SiRNA target sequence
ttttccgctgcttctttaat

SEQ ID NO: 21752 - DNA, 20 bp, Artificial sequence
  SiRNA target sequence
tttccgctgcttctttaatt

SEQ ID NO: 21753 - DNA, 20 bp, Artificial sequence
  SiRNA target sequence
ttccgctgcttctttaattc

SEQ ID NO: 21754 - DNA, 20 bp, Artificial sequence
  SiRNA target sequence
tccgctgcttctttaattct

SEQ ID NO: 21755 - DNA, 20 bp, Artificial sequence
  SiRNA target sequence
ccgctgcttctttaattcta

SEQ ID NO: 21756 - DNA, 20 bp, Artificial sequence
  SiRNA target sequence
cgctgcttctttaattctat

SEQ ID NO: 21757 - DNA, 20 bp, Artificial sequence
  SiRNA target sequence
gctgcttctttaattctatt

SEQ ID NO: 21758 - DNA, 20 bp, Artificial sequence
  SiRNA target sequence
ctgcttctttaattctatta

SEQ ID NO: 21759 - DNA, 20 bp, Artificial sequence
  SiRNA target sequence
tgcttctttaattctattat

SEQ ID NO: 21760 - DNA, 20 bp, Artificial sequence
  SiRNA target sequence
gcttctttaattctattata

SEQ ID NO: 21761 - DNA, 20 bp, Artificial sequence
  SiRNA target sequence
cttctttaattctattataa

SEQ ID NO: 21762 - DNA, 20 bp, Artificial sequence
  SiRNA target sequence
ttctttaattctattataac

SEQ ID NO: 21763 - DNA, 20 bp, Artificial sequence
  SiRNA target sequence
tctttaattctattataaca

SEQ ID NO: 21764 - DNA, 20 bp, Artificial sequence
  SiRNA target sequence
ctttaattctattataacaa

SEQ ID NO: 21765 - DNA, 20 bp, Artificial sequence
  SiRNA target sequence
tttaattctattataacaag

SEQ ID NO: 21766 - DNA, 20 bp, Artificial sequence
  SiRNA target sequence
ttaattctattataacaaga

SEQ ID NO: 21767 - DNA, 20 bp, Artificial sequence
  SiRNA target sequence
taattctattataacaagaa

SEQ ID NO: 21768 - DNA, 20 bp, Artificial sequence
  SiRNA target sequence
aattctattataacaagaat

SEQ ID NO: 21769 - DNA, 20 bp, Artificial sequence
  SiRNA target sequence
attctattataacaagaatc

SEQ ID NO: 21770 - DNA, 20 bp, Artificial sequence
  SiRNA target sequence
ttctattataacaagaatcg

SEQ ID NO: 21771 - DNA, 20 bp, Artificial sequence
  SiRNA target sequence
tctattataacaagaatcgt

SEQ ID NO: 21772 - DNA, 20 bp, Artificial sequence
  SiRNA target sequence
ctattataacaagaatcgtg

SEQ ID NO: 21773 - DNA, 20 bp, Artificial sequence
  SiRNA target sequence
tattataacaagaatcgtgt

SEQ ID NO: 21774 - DNA, 20 bp, Artificial sequence
  SiRNA target sequence
attataacaagaatcgtgtt

SEQ ID NO: 21775 - DNA, 20 bp, Artificial sequence
  SiRNA target sequence
ttataacaagaatcgtgttt

SEQ ID NO: 21776 - DNA, 20 bp, Artificial sequence
  SiRNA target sequence
tataacaagaatcgtgttta

SEQ ID NO: 21777 - DNA, 20 bp, Artificial sequence
  SiRNA target sequence
ataacaagaatcgtgtttaa

SEQ ID NO: 21778 - DNA, 20 bp, Artificial sequence
  SiRNA target sequence
taacaagaatcgtgtttaag

SEQ ID NO: 21779 - DNA, 20 bp, Artificial sequence
  SiRNA target sequence
aacaagaatcgtgtttaagt

SEQ ID NO: 21780 - DNA, 20 bp, Artificial sequence
  SiRNA target sequence
acaagaatcgtgtttaagta

SEQ ID NO: 21781 - DNA, 20 bp, Artificial sequence
  SiRNA target sequence
caagaatcgtgtttaagtaa

SEQ ID NO: 21782 - DNA, 20 bp, Artificial sequence
  SiRNA target sequence
aagaatcgtgtttaagtaaa

SEQ ID NO: 21783 - DNA, 20 bp, Artificial sequence
  SiRNA target sequence
agaatcgtgtttaagtaaat

SEQ ID NO: 21784 - DNA, 20 bp, Artificial sequence
  SiRNA target sequence
gaatcgtgtttaagtaaatc

SEQ ID NO: 21785 - DNA, 20 bp, Artificial sequence
  SiRNA target sequence
aatcgtgtttaagtaaatca

SEQ ID NO: 21786 - DNA, 20 bp, Artificial sequence
  SiRNA target sequence
atcgtgtttaagtaaatcaa

SEQ ID NO: 21787 - DNA, 20 bp, Artificial sequence
  SiRNA target sequence
tcgtgtttaagtaaatcaat

SEQ ID NO: 21788 - DNA, 20 bp, Artificial sequence
  SiRNA target sequence
cgtgtttaagtaaatcaatt

SEQ ID NO: 21789 - DNA, 20 bp, Artificial sequence
  SiRNA target sequence
gtgtttaagtaaatcaattc

SEQ ID NO: 21790 - DNA, 20 bp, Artificial sequence
  SiRNA target sequence
tgtttaagtaaatcaattcc

SEQ ID NO: 21791 - DNA, 20 bp, Artificial sequence
  SiRNA target sequence
gtttaagtaaatcaattcct

SEQ ID NO: 21792 - DNA, 20 bp, Artificial sequence
  SiRNA target sequence
tttaagtaaatcaattcctg

SEQ ID NO: 21793 - DNA, 20 bp, Artificial sequence
  SiRNA target sequence
ttaagtaaatcaattcctgt

SEQ ID NO: 21794 - DNA, 20 bp, Artificial sequence
  SiRNA target sequence
taagtaaatcaattcctgtt

SEQ ID NO: 21795 - DNA, 20 bp, Artificial sequence
  SiRNA target sequence
aagtaaatcaattcctgttc

SEQ ID NO: 21796 - DNA, 20 bp, Artificial sequence
  SiRNA target sequence
agtaaatcaattcctgttct

SEQ ID NO: 21797 - DNA, 20 bp, Artificial sequence
  SiRNA target sequence
gtaaatcaattcctgttcta

SEQ ID NO: 21798 - DNA, 20 bp, Artificial sequence
  SiRNA target sequence
taaatcaattcctgttctac

SEQ ID NO: 21799 - DNA, 20 bp, Artificial sequence
  SiRNA target sequence
aaatcaattcctgttctact

SEQ ID NO: 21800 - DNA, 20 bp, Artificial sequence
  SiRNA target sequence
aatcaattcctgttctactt

SEQ ID NO: 21801 - DNA, 20 bp, Artificial sequence
  SiRNA target sequence
atcaattcctgttctacttt

SEQ ID NO: 21802 - DNA, 20 bp, Artificial sequence
  SiRNA target sequence
tcaattcctgttctactttt

SEQ ID NO: 21803 - DNA, 20 bp, Artificial sequence
  SiRNA target sequence
caattcctgttctactttta

SEQ ID NO: 21804 - DNA, 20 bp, Artificial sequence
  SiRNA target sequence
aattcctgttctacttttaa

SEQ ID NO: 21805 - DNA, 20 bp, Artificial sequence
  SiRNA target sequence
attcctgttctacttttaaa

SEQ ID NO: 21806 - DNA, 20 bp, Artificial sequence
  SiRNA target sequence
ttcctgttctacttttaaat

SEQ ID NO: 21807 - DNA, 20 bp, Artificial sequence
  SiRNA target sequence
tcctgttctacttttaaatt

SEQ ID NO: 21808 - DNA, 20 bp, Artificial sequence
  SiRNA target sequence
cctgttctacttttaaattt

SEQ ID NO: 21809 - DNA, 20 bp, Artificial sequence
  SiRNA target sequence
ctgttctacttttaaatttt

SEQ ID NO: 21810 - DNA, 20 bp, Artificial sequence
  SiRNA target sequence
tgttctacttttaaattttt

SEQ ID NO: 21811 - DNA, 20 bp, Artificial sequence
  SiRNA target sequence
gttctacttttaaatttttc

SEQ ID NO: 21812 - DNA, 20 bp, Artificial sequence
  SiRNA target sequence
ttctacttttaaatttttca

SEQ ID NO: 21813 - DNA, 20 bp, Artificial sequence
  SiRNA target sequence
tctacttttaaatttttcat

SEQ ID NO: 21814 - DNA, 20 bp, Artificial sequence
  SiRNA target sequence
ctacttttaaatttttcatt

SEQ ID NO: 21815 - DNA, 20 bp, Artificial sequence
  SiRNA target sequence
tacttttaaatttttcatta

SEQ ID NO: 21816 - DNA, 20 bp, Artificial sequence
  SiRNA target sequence
acttttaaatttttcattaa

SEQ ID NO: 21817 - DNA, 20 bp, Artificial sequence
  SiRNA target sequence
cttttaaatttttcattaat

SEQ ID NO: 21818 - DNA, 20 bp, Artificial sequence
  SiRNA target sequence
ttttaaatttttcattaata

SEQ ID NO: 21819 - DNA, 20 bp, Artificial sequence
  SiRNA target sequence
tttaaatttttcattaatat

SEQ ID NO: 21820 - DNA, 20 bp, Artificial sequence
  SiRNA target sequence
ttaaatttttcattaatata

SEQ ID NO: 21821 - DNA, 20 bp, Artificial sequence
  SiRNA target sequence
taaatttttcattaatataa

SEQ ID NO: 21822 - DNA, 20 bp, Artificial sequence
  SiRNA target sequence
aaatttttcattaatataat

SEQ ID NO: 21823 - DNA, 20 bp, Artificial sequence
  SiRNA target sequence
aatttttcattaatataatc

SEQ ID NO: 21824 - DNA, 20 bp, Artificial sequence
  SiRNA target sequence
atttttcattaatataatct

SEQ ID NO: 21825 - DNA, 20 bp, Artificial sequence
  SiRNA target sequence
tttttcattaatataatcta

SEQ ID NO: 21826 - DNA, 20 bp, Artificial sequence
  SiRNA target sequence
ttttcattaatataatctac

SEQ ID NO: 21827 - DNA, 20 bp, Artificial sequence
  SiRNA target sequence
tttcattaatataatctact

SEQ ID NO: 21828 - DNA, 20 bp, Artificial sequence
  SiRNA target sequence
ttcattaatataatctacta

SEQ ID NO: 21829 - DNA, 20 bp, Artificial sequence
  SiRNA target sequence
tcattaatataatctactaa

SEQ ID NO: 21830 - DNA, 20 bp, Artificial sequence
  SiRNA target sequence
cattaatataatctactaaa

SEQ ID NO: 21831 - DNA, 20 bp, Artificial sequence
  SiRNA target sequence
attaatataatctactaaag

SEQ ID NO: 21832 - DNA, 20 bp, Artificial sequence
  SiRNA target sequence
ttaatataatctactaaagt

SEQ ID NO: 21833 - DNA, 20 bp, Artificial sequence
  SiRNA target sequence
taatataatctactaaagta

SEQ ID NO: 21834 - DNA, 20 bp, Artificial sequence
  SiRNA target sequence
aatataatctactaaagtat

SEQ ID NO: 21835 - DNA, 20 bp, Artificial sequence
  SiRNA target sequence
atataatctactaaagtatt

SEQ ID NO: 21836 - DNA, 20 bp, Artificial sequence
  SiRNA target sequence
tataatctactaaagtatta

SEQ ID NO: 21837 - DNA, 20 bp, Artificial sequence
  SiRNA target sequence
ataatctactaaagtattat

SEQ ID NO: 21838 - DNA, 20 bp, Artificial sequence
  SiRNA target sequence
taatctactaaagtattatc

SEQ ID NO: 21839 - DNA, 20 bp, Artificial sequence
  SiRNA target sequence
aatctactaaagtattatcc

SEQ ID NO: 21840 - DNA, 20 bp, Artificial sequence
  SiRNA target sequence
atctactaaagtattatcca

SEQ ID NO: 21841 - DNA, 20 bp, Artificial sequence
  SiRNA target sequence
tctactaaagtattatccaa

SEQ ID NO: 21842 - DNA, 20 bp, Artificial sequence
  SiRNA target sequence
ctactaaagtattatccaaa

SEQ ID NO: 21843 - DNA, 20 bp, Artificial sequence
  SiRNA target sequence
tactaaagtattatccaaat

SEQ ID NO: 21844 - DNA, 20 bp, Artificial sequence
  SiRNA target sequence
actaaagtattatccaaatc

SEQ ID NO: 21845 - DNA, 20 bp, Artificial sequence
  SiRNA target sequence
ctaaagtattatccaaatct

SEQ ID NO: 21846 - DNA, 20 bp, Artificial sequence
  SiRNA target sequence
taaagtattatccaaatctt

SEQ ID NO: 21847 - DNA, 20 bp, Artificial sequence
  SiRNA target sequence
aaagtattatccaaatcttc

SEQ ID NO: 21848 - DNA, 20 bp, Artificial sequence
  SiRNA target sequence
aagtattatccaaatcttct

SEQ ID NO: 21849 - DNA, 20 bp, Artificial sequence
  SiRNA target sequence
agtattatccaaatcttctc

SEQ ID NO: 21850 - DNA, 20 bp, Artificial sequence
  SiRNA target sequence
gtattatccaaatcttctcc

SEQ ID NO: 21851 - DNA, 20 bp, Artificial sequence
  SiRNA target sequence
tattatccaaatcttctcct

SEQ ID NO: 21852 - DNA, 20 bp, Artificial sequence
  SiRNA target sequence
attatccaaatcttctcctc

SEQ ID NO: 21853 - DNA, 20 bp, Artificial sequence
  SiRNA target sequence
ttatccaaatcttctcctcc

SEQ ID NO: 21854 - DNA, 20 bp, Artificial sequence
  SiRNA target sequence
tatccaaatcttctcctcct

SEQ ID NO: 21855 - DNA, 20 bp, Artificial sequence
  SiRNA target sequence
atccaaatcttctcctccta

SEQ ID NO: 21856 - DNA, 20 bp, Artificial sequence
  SiRNA target sequence
tccaaatcttctcctcctaa

SEQ ID NO: 21857 - DNA, 20 bp, Artificial sequence
  SiRNA target sequence
ccaaatcttctcctcctaaa

SEQ ID NO: 21858 - DNA, 20 bp, Artificial sequence
  SiRNA target sequence
caaatcttctcctcctaaaa

SEQ ID NO: 21859 - DNA, 20 bp, Artificial sequence
  SiRNA target sequence
aaatcttctcctcctaaaaa

SEQ ID NO: 21860 - DNA, 20 bp, Artificial sequence
  SiRNA target sequence
aatcttctcctcctaaaaaa

SEQ ID NO: 21861 - DNA, 20 bp, Artificial sequence
  SiRNA target sequence
atcttctcctcctaaaaaag

SEQ ID NO: 21862 - DNA, 20 bp, Artificial sequence
  SiRNA target sequence
tcttctcctcctaaaaaagt

SEQ ID NO: 21863 - DNA, 20 bp, Artificial sequence
  SiRNA target sequence
cttctcctcctaaaaaagta

SEQ ID NO: 21864 - DNA, 20 bp, Artificial sequence
  SiRNA target sequence
ttctcctcctaaaaaagtat

SEQ ID NO: 21865 - DNA, 20 bp, Artificial sequence
  SiRNA target sequence
tctcctcctaaaaaagtatt

SEQ ID NO: 21866 - DNA, 20 bp, Artificial sequence
  SiRNA target sequence
ctcctcctaaaaaagtattt

SEQ ID NO: 21867 - DNA, 20 bp, Artificial sequence
  SiRNA target sequence
tcctcctaaaaaagtatttc

SEQ ID NO: 21868 - DNA, 20 bp, Artificial sequence
  SiRNA target sequence
cctcctaaaaaagtatttcc

SEQ ID NO: 21869 - DNA, 20 bp, Artificial sequence
  SiRNA target sequence
ctcctaaaaaagtatttccg

SEQ ID NO: 21870 - DNA, 20 bp, Artificial sequence
  SiRNA target sequence
tcctaaaaaagtatttccgt

SEQ ID NO: 21871 - DNA, 20 bp, Artificial sequence
  SiRNA target sequence
cctaaaaaagtatttccgtt

SEQ ID NO: 21872 - DNA, 20 bp, Artificial sequence
  SiRNA target sequence
ctaaaaaagtatttccgtta

SEQ ID NO: 21873 - DNA, 20 bp, Artificial sequence
  SiRNA target sequence
taaaaaagtatttccgttag

SEQ ID NO: 21874 - DNA, 20 bp, Artificial sequence
  SiRNA target sequence
aaaaaagtatttccgttagt

SEQ ID NO: 21875 - DNA, 20 bp, Artificial sequence
  SiRNA target sequence
aaaaagtatttccgttagta

SEQ ID NO: 21876 - DNA, 20 bp, Artificial sequence
  SiRNA target sequence
aaaagtatttccgttagtag

SEQ ID NO: 21877 - DNA, 20 bp, Artificial sequence
  SiRNA target sequence
aaagtatttccgttagtaga

SEQ ID NO: 21878 - DNA, 20 bp, Artificial sequence
  SiRNA target sequence
aagtatttccgttagtagat

SEQ ID NO: 21879 - DNA, 20 bp, Artificial sequence
  SiRNA target sequence
agtatttccgttagtagatt

SEQ ID NO: 21880 - DNA, 20 bp, Artificial sequence
  SiRNA target sequence
gtatttccgttagtagattt

SEQ ID NO: 21881 - DNA, 20 bp, Artificial sequence
  SiRNA target sequence
tatttccgttagtagatttt

SEQ ID NO: 21882 - DNA, 20 bp, Artificial sequence
  SiRNA target sequence
atttccgttagtagatttta

SEQ ID NO: 21883 - DNA, 20 bp, Artificial sequence
  SiRNA target sequence
tttccgttagtagattttac

SEQ ID NO: 21884 - DNA, 20 bp, Artificial sequence
  SiRNA target sequence
ttccgttagtagattttaca

SEQ ID NO: 21885 - DNA, 20 bp, Artificial sequence
  SiRNA target sequence
tccgttagtagattttacat

SEQ ID NO: 21886 - DNA, 20 bp, Artificial sequence
  SiRNA target sequence
ccgttagtagattttacatg

SEQ ID NO: 21887 - DNA, 20 bp, Artificial sequence
  SiRNA target sequence
cgttagtagattttacatga

SEQ ID NO: 21888 - DNA, 20 bp, Artificial sequence
  SiRNA target sequence
gttagtagattttacatgaa

SEQ ID NO: 21889 - DNA, 20 bp, Artificial sequence
  SiRNA target sequence
ttagtagattttacatgaaa

SEQ ID NO: 21890 - DNA, 20 bp, Artificial sequence
  SiRNA target sequence
tagtagattttacatgaaaa

SEQ ID NO: 21891 - DNA, 20 bp, Artificial sequence
  SiRNA target sequence
agtagattttacatgaaaaa

SEQ ID NO: 21892 - DNA, 20 bp, Artificial sequence
  SiRNA target sequence
gtagattttacatgaaaaat

SEQ ID NO: 21893 - DNA, 20 bp, Artificial sequence
  SiRNA target sequence
tagattttacatgaaaaata

SEQ ID NO: 21894 - DNA, 20 bp, Artificial sequence
  SiRNA target sequence
agattttacatgaaaaatac

SEQ ID NO: 21895 - DNA, 20 bp, Artificial sequence
  SiRNA target sequence
gattttacatgaaaaatacc

SEQ ID NO: 21896 - DNA, 20 bp, Artificial sequence
  SiRNA target sequence
attttacatgaaaaatacca

SEQ ID NO: 21897 - DNA, 20 bp, Artificial sequence
  SiRNA target sequence
ttttacatgaaaaataccat

SEQ ID NO: 21898 - DNA, 20 bp, Artificial sequence
  SiRNA target sequence
tttacatgaaaaataccatt

SEQ ID NO: 21899 - DNA, 20 bp, Artificial sequence
  SiRNA target sequence
ttacatgaaaaataccatta

SEQ ID NO: 21900 - DNA, 20 bp, Artificial sequence
  SiRNA target sequence
tacatgaaaaataccattat

SEQ ID NO: 21901 - DNA, 20 bp, Artificial sequence
  SiRNA target sequence
acatgaaaaataccattatc

SEQ ID NO: 21902 - DNA, 20 bp, Artificial sequence
  SiRNA target sequence
catgaaaaataccattatct

SEQ ID NO: 21903 - DNA, 20 bp, Artificial sequence
  SiRNA target sequence
atgaaaaataccattatcta

SEQ ID NO: 21904 - DNA, 20 bp, Artificial sequence
  SiRNA target sequence
tgaaaaataccattatctaa

SEQ ID NO: 21905 - DNA, 20 bp, Artificial sequence
  SiRNA target sequence
gaaaaataccattatctaat

SEQ ID NO: 21906 - DNA, 20 bp, Artificial sequence
  SiRNA target sequence
aaaaataccattatctaatt

SEQ ID NO: 21907 - DNA, 20 bp, Artificial sequence
  SiRNA target sequence
aaaataccattatctaattc

SEQ ID NO: 21908 - DNA, 20 bp, Artificial sequence
  SiRNA target sequence
aaataccattatctaattct

SEQ ID NO: 21909 - DNA, 20 bp, Artificial sequence
  SiRNA target sequence
aataccattatctaattcta

SEQ ID NO: 21910 - DNA, 20 bp, Artificial sequence
  SiRNA target sequence
ataccattatctaattctaa

SEQ ID NO: 21911 - DNA, 20 bp, Artificial sequence
  SiRNA target sequence
taccattatctaattctaat

SEQ ID NO: 21912 - DNA, 20 bp, Artificial sequence
  SiRNA target sequence
accattatctaattctaata

SEQ ID NO: 21913 - DNA, 20 bp, Artificial sequence
  SiRNA target sequence
ccattatctaattctaatat

SEQ ID NO: 21914 - DNA, 20 bp, Artificial sequence
  SiRNA target sequence
cattatctaattctaatata

SEQ ID NO: 21915 - DNA, 20 bp, Artificial sequence
  SiRNA target sequence
attatctaattctaatatac

SEQ ID NO: 21916 - DNA, 20 bp, Artificial sequence
  SiRNA target sequence
ttatctaattctaatatact

SEQ ID NO: 21917 - DNA, 20 bp, Artificial sequence
  SiRNA target sequence
tatctaattctaatatacta

SEQ ID NO: 21918 - DNA, 20 bp, Artificial sequence
  SiRNA target sequence
atctaattctaatatactaa

SEQ ID NO: 21919 - DNA, 20 bp, Artificial sequence
  SiRNA target sequence
tctaattctaatatactaat

SEQ ID NO: 21920 - DNA, 20 bp, Artificial sequence
  SiRNA target sequence
ctaattctaatatactaatg

SEQ ID NO: 21921 - DNA, 20 bp, Artificial sequence
  SiRNA target sequence
taattctaatatactaatgt

SEQ ID NO: 21922 - DNA, 20 bp, Artificial sequence
  SiRNA target sequence
aattctaatatactaatgtc

SEQ ID NO: 21923 - DNA, 20 bp, Artificial sequence
  SiRNA target sequence
attctaatatactaatgtca

SEQ ID NO: 21924 - DNA, 20 bp, Artificial sequence
  SiRNA target sequence
ttctaatatactaatgtcaa

SEQ ID NO: 21925 - DNA, 20 bp, Artificial sequence
  SiRNA target sequence
tctaatatactaatgtcaaa

SEQ ID NO: 21926 - DNA, 20 bp, Artificial sequence
  SiRNA target sequence
ctaatatactaatgtcaaaa

SEQ ID NO: 21927 - DNA, 20 bp, Artificial sequence
  SiRNA target sequence
taatatactaatgtcaaaag

SEQ ID NO: 21928 - DNA, 20 bp, Artificial sequence
  SiRNA target sequence
aatatactaatgtcaaaagt

SEQ ID NO: 21929 - DNA, 20 bp, Artificial sequence
  SiRNA target sequence
atatactaatgtcaaaagtt

SEQ ID NO: 21930 - DNA, 20 bp, Artificial sequence
  SiRNA target sequence
tatactaatgtcaaaagttc

SEQ ID NO: 21931 - DNA, 20 bp, Artificial sequence
  SiRNA target sequence
atactaatgtcaaaagttcc

SEQ ID NO: 21932 - DNA, 20 bp, Artificial sequence
  SiRNA target sequence
tactaatgtcaaaagttcct

SEQ ID NO: 21933 - DNA, 20 bp, Artificial sequence
  SiRNA target sequence
actaatgtcaaaagttcctc

SEQ ID NO: 21934 - DNA, 20 bp, Artificial sequence
  SiRNA target sequence
ctaatgtcaaaagttcctcc

SEQ ID NO: 21935 - DNA, 20 bp, Artificial sequence
  SiRNA target sequence
taatgtcaaaagttcctcct

SEQ ID NO: 21936 - DNA, 20 bp, Artificial sequence
  SiRNA target sequence
aatgtcaaaagttcctcctc

SEQ ID NO: 21937 - DNA, 20 bp, Artificial sequence
  SiRNA target sequence
atgtcaaaagttcctcctcc

SEQ ID NO: 21938 - DNA, 20 bp, Artificial sequence
  SiRNA target sequence
tgtcaaaagttcctcctccc

SEQ ID NO: 21939 - DNA, 20 bp, Artificial sequence
  SiRNA target sequence
gtcaaaagttcctcctccca

SEQ ID NO: 21940 - DNA, 20 bp, Artificial sequence
  SiRNA target sequence
tcaaaagttcctcctcccag

SEQ ID NO: 21941 - DNA, 20 bp, Artificial sequence
  SiRNA target sequence
caaaagttcctcctcccaga

SEQ ID NO: 21942 - DNA, 20 bp, Artificial sequence
  SiRNA target sequence
aaaagttcctcctcccagat

SEQ ID NO: 21943 - DNA, 20 bp, Artificial sequence
  SiRNA target sequence
aaagttcctcctcccagatc

SEQ ID NO: 21944 - DNA, 20 bp, Artificial sequence
  SiRNA target sequence
aagttcctcctcccagatca

SEQ ID NO: 21945 - DNA, 20 bp, Artificial sequence
  SiRNA target sequence
agttcctcctcccagatcat

SEQ ID NO: 21946 - DNA, 20 bp, Artificial sequence
  SiRNA target sequence
gttcctcctcccagatcata

SEQ ID NO: 21947 - DNA, 20 bp, Artificial sequence
  SiRNA target sequence
ttcctcctcccagatcataa

SEQ ID NO: 21948 - DNA, 20 bp, Artificial sequence
  SiRNA target sequence
tcctcctcccagatcataaa

SEQ ID NO: 21949 - DNA, 20 bp, Artificial sequence
  SiRNA target sequence
cctcctcccagatcataaac

SEQ ID NO: 21950 - DNA, 20 bp, Artificial sequence
  SiRNA target sequence
ctcctcccagatcataaaca

SEQ ID NO: 21951 - DNA, 20 bp, Artificial sequence
  SiRNA target sequence
tcctcccagatcataaacag

SEQ ID NO: 21952 - DNA, 20 bp, Artificial sequence
  SiRNA target sequence
cctcccagatcataaacagc

SEQ ID NO: 21953 - DNA, 20 bp, Artificial sequence
  SiRNA target sequence
ctcccagatcataaacagct

SEQ ID NO: 21954 - DNA, 20 bp, Artificial sequence
  SiRNA target sequence
tcccagatcataaacagcta

SEQ ID NO: 21955 - DNA, 20 bp, Artificial sequence
  SiRNA target sequence
cccagatcataaacagctat

SEQ ID NO: 21956 - DNA, 20 bp, Artificial sequence
  SiRNA target sequence
ccagatcataaacagctata

SEQ ID NO: 21957 - DNA, 20 bp, Artificial sequence
  SiRNA target sequence
cagatcataaacagctataa

SEQ ID NO: 21958 - DNA, 20 bp, Artificial sequence
  SiRNA target sequence
agatcataaacagctataat

SEQ ID NO: 21959 - DNA, 20 bp, Artificial sequence
  SiRNA target sequence
gatcataaacagctataata

SEQ ID NO: 21960 - DNA, 20 bp, Artificial sequence
  SiRNA target sequence
atcataaacagctataatac

SEQ ID NO: 21961 - DNA, 20 bp, Artificial sequence
  SiRNA target sequence
tcataaacagctataatacc

SEQ ID NO: 21962 - DNA, 20 bp, Artificial sequence
  SiRNA target sequence
cataaacagctataataccc

SEQ ID NO: 21963 - DNA, 20 bp, Artificial sequence
  SiRNA target sequence
ataaacagctataataccct

SEQ ID NO: 21964 - DNA, 20 bp, Artificial sequence
  SiRNA target sequence
taaacagctataataccctg

SEQ ID NO: 21965 - DNA, 20 bp, Artificial sequence
  SiRNA target sequence
aaacagctataataccctgt

SEQ ID NO: 21966 - DNA, 20 bp, Artificial sequence
  SiRNA target sequence
aacagctataataccctgtg

SEQ ID NO: 21967 - DNA, 20 bp, Artificial sequence
  SiRNA target sequence
acagctataataccctgtgc

SEQ ID NO: 21968 - DNA, 20 bp, Artificial sequence
  SiRNA target sequence
cagctataataccctgtgca

SEQ ID NO: 21969 - DNA, 20 bp, Artificial sequence
  SiRNA target sequence
agctataataccctgtgcag

SEQ ID NO: 21970 - DNA, 20 bp, Artificial sequence
  SiRNA target sequence
gctataataccctgtgcaga

SEQ ID NO: 21971 - DNA, 20 bp, Artificial sequence
  SiRNA target sequence
ctataataccctgtgcagac

SEQ ID NO: 21972 - DNA, 20 bp, Artificial sequence
  SiRNA target sequence
tataataccctgtgcagact

SEQ ID NO: 21973 - DNA, 20 bp, Artificial sequence
  SiRNA target sequence
ataataccctgtgcagactt

SEQ ID NO: 21974 - DNA, 20 bp, Artificial sequence
  SiRNA target sequence
taataccctgtgcagacttg

SEQ ID NO: 21975 - DNA, 20 bp, Artificial sequence
  SiRNA target sequence
aataccctgtgcagacttgt

SEQ ID NO: 21976 - DNA, 20 bp, Artificial sequence
  SiRNA target sequence
ataccctgtgcagacttgtc

SEQ ID NO: 21977 - DNA, 20 bp, Artificial sequence
  SiRNA target sequence
taccctgtgcagacttgtca

SEQ ID NO: 21978 - DNA, 20 bp, Artificial sequence
  SiRNA target sequence
accctgtgcagacttgtcaa

SEQ ID NO: 21979 - DNA, 20 bp, Artificial sequence
  SiRNA target sequence
ccctgtgcagacttgtcaag

SEQ ID NO: 21980 - DNA, 20 bp, Artificial sequence
  SiRNA target sequence
cctgtgcagacttgtcaagc

SEQ ID NO: 21981 - DNA, 20 bp, Artificial sequence
  SiRNA target sequence
ctgtgcagacttgtcaagcc

SEQ ID NO: 21982 - DNA, 20 bp, Artificial sequence
  SiRNA target sequence
tgtgcagacttgtcaagccc

SEQ ID NO: 21983 - DNA, 20 bp, Artificial sequence
  SiRNA target sequence
gtgcagacttgtcaagccca

SEQ ID NO: 21984 - DNA, 20 bp, Artificial sequence
  SiRNA target sequence
tgcagacttgtcaagcccat

SEQ ID NO: 21985 - DNA, 20 bp, Artificial sequence
  SiRNA target sequence
gcagacttgtcaagcccata

SEQ ID NO: 21986 - DNA, 20 bp, Artificial sequence
  SiRNA target sequence
cagacttgtcaagcccataa

SEQ ID NO: 21987 - DNA, 20 bp, Artificial sequence
  SiRNA target sequence
agacttgtcaagcccataag

SEQ ID NO: 21988 - DNA, 20 bp, Artificial sequence
  SiRNA target sequence
gacttgtcaagcccataagc

SEQ ID NO: 21989 - DNA, 20 bp, Artificial sequence
  SiRNA target sequence
acttgtcaagcccataagca

SEQ ID NO: 21990 - DNA, 20 bp, Artificial sequence
  SiRNA target sequence
cttgtcaagcccataagcaa

SEQ ID NO: 21991 - DNA, 20 bp, Artificial sequence
  SiRNA target sequence
ttgtcaagcccataagcaag

SEQ ID NO: 21992 - DNA, 20 bp, Artificial sequence
  SiRNA target sequence
tgtcaagcccataagcaagt

SEQ ID NO: 21993 - DNA, 20 bp, Artificial sequence
  SiRNA target sequence
gtcaagcccataagcaagtg

SEQ ID NO: 21994 - DNA, 20 bp, Artificial sequence
  SiRNA target sequence
tcaagcccataagcaagtgc

SEQ ID NO: 21995 - DNA, 20 bp, Artificial sequence
  SiRNA target sequence
caagcccataagcaagtgct

SEQ ID NO: 21996 - DNA, 20 bp, Artificial sequence
  SiRNA target sequence
aagcccataagcaagtgctg

SEQ ID NO: 21997 - DNA, 20 bp, Artificial sequence
  SiRNA target sequence
agcccataagcaagtgctgc

SEQ ID NO: 21998 - DNA, 20 bp, Artificial sequence
  SiRNA target sequence
gcccataagcaagtgctgcc

SEQ ID NO: 21999 - DNA, 20 bp, Artificial sequence
  SiRNA target sequence
cccataagcaagtgctgccg

SEQ ID NO: 22000 - DNA, 20 bp, Artificial sequence
  SiRNA target sequence
ccataagcaagtgctgccgc

SEQ ID NO: 22001 - DNA, 20 bp, Artificial sequence
  SiRNA target sequence
cataagcaagtgctgccgca

SEQ ID NO: 22002 - DNA, 20 bp, Artificial sequence
  SiRNA target sequence
ataagcaagtgctgccgcag

SEQ ID NO: 22003 - DNA, 20 bp, Artificial sequence
  SiRNA target sequence
taagcaagtgctgccgcagt

SEQ ID NO: 22004 - DNA, 20 bp, Artificial sequence
  SiRNA target sequence
aagcaagtgctgccgcagta

SEQ ID NO: 22005 - DNA, 20 bp, Artificial sequence
  SiRNA target sequence
agcaagtgctgccgcagtag

SEQ ID NO: 22006 - DNA, 20 bp, Artificial sequence
  SiRNA target sequence
gcaagtgctgccgcagtagg

SEQ ID NO: 22007 - DNA, 20 bp, Artificial sequence
  SiRNA target sequence
caagtgctgccgcagtaggc

SEQ ID NO: 22008 - DNA, 20 bp, Artificial sequence
  SiRNA target sequence
aagtgctgccgcagtaggct

SEQ ID NO: 22009 - DNA, 20 bp, Artificial sequence
  SiRNA target sequence
agtgctgccgcagtaggctc

SEQ ID NO: 22010 - DNA, 20 bp, Artificial sequence
  SiRNA target sequence
gtgctgccgcagtaggctca

SEQ ID NO: 22011 - DNA, 20 bp, Artificial sequence
  SiRNA target sequence
tgctgccgcagtaggctcat

SEQ ID NO: 22012 - DNA, 20 bp, Artificial sequence
  SiRNA target sequence
gctgccgcagtaggctcatt

SEQ ID NO: 22013 - DNA, 20 bp, Artificial sequence
  SiRNA target sequence
ctgccgcagtaggctcatta

SEQ ID NO: 22014 - DNA, 20 bp, Artificial sequence
  SiRNA target sequence
tgccgcagtaggctcattaa

SEQ ID NO: 22015 - DNA, 20 bp, Artificial sequence
  SiRNA target sequence
gccgcagtaggctcattaat

SEQ ID NO: 22016 - DNA, 20 bp, Artificial sequence
  SiRNA target sequence
ccgcagtaggctcattaatc

SEQ ID NO: 22017 - DNA, 20 bp, Artificial sequence
  SiRNA target sequence
cgcagtaggctcattaatca

SEQ ID NO: 22018 - DNA, 20 bp, Artificial sequence
  SiRNA target sequence
gcagtaggctcattaatcac

SEQ ID NO: 22019 - DNA, 20 bp, Artificial sequence
  SiRNA target sequence
cagtaggctcattaatcact

SEQ ID NO: 22020 - DNA, 20 bp, Artificial sequence
  SiRNA target sequence
agtaggctcattaatcactc

SEQ ID NO: 22021 - DNA, 20 bp, Artificial sequence
  SiRNA target sequence
gtaggctcattaatcactct

SEQ ID NO: 22022 - DNA, 20 bp, Artificial sequence
  SiRNA target sequence
taggctcattaatcactcta

SEQ ID NO: 22023 - DNA, 20 bp, Artificial sequence
  SiRNA target sequence
aggctcattaatcactctaa

SEQ ID NO: 22024 - DNA, 20 bp, Artificial sequence
  SiRNA target sequence
ggctcattaatcactctaag

SEQ ID NO: 22025 - DNA, 20 bp, Artificial sequence
  SiRNA target sequence
gctcattaatcactctaagc

SEQ ID NO: 22026 - DNA, 20 bp, Artificial sequence
  SiRNA target sequence
ctcattaatcactctaagca

SEQ ID NO: 22027 - DNA, 20 bp, Artificial sequence
  SiRNA target sequence
tcattaatcactctaagcac

SEQ ID NO: 22028 - DNA, 20 bp, Artificial sequence
  SiRNA target sequence
cattaatcactctaagcact

SEQ ID NO: 22029 - DNA, 20 bp, Artificial sequence
  SiRNA target sequence
attaatcactctaagcactt

SEQ ID NO: 22030 - DNA, 20 bp, Artificial sequence
  SiRNA target sequence
ttaatcactctaagcacttg

SEQ ID NO: 22031 - DNA, 20 bp, Artificial sequence
  SiRNA target sequence
taatcactctaagcacttgt

SEQ ID NO: 22032 - DNA, 20 bp, Artificial sequence
  SiRNA target sequence
aatcactctaagcacttgta

SEQ ID NO: 22033 - DNA, 20 bp, Artificial sequence
  SiRNA target sequence
atcactctaagcacttgtaa

SEQ ID NO: 22034 - DNA, 20 bp, Artificial sequence
  SiRNA target sequence
tcactctaagcacttgtaat

SEQ ID NO: 22035 - DNA, 20 bp, Artificial sequence
  SiRNA target sequence
cactctaagcacttgtaatc

SEQ ID NO: 22036 - DNA, 20 bp, Artificial sequence
  SiRNA target sequence
actctaagcacttgtaatcc

SEQ ID NO: 22037 - DNA, 20 bp, Artificial sequence
  SiRNA target sequence
ctctaagcacttgtaatccc

SEQ ID NO: 22038 - DNA, 20 bp, Artificial sequence
  SiRNA target sequence
tctaagcacttgtaatcccg

SEQ ID NO: 22039 - DNA, 20 bp, Artificial sequence
  SiRNA target sequence
ctaagcacttgtaatcccgc

SEQ ID NO: 22040 - DNA, 20 bp, Artificial sequence
  SiRNA target sequence
taagcacttgtaatcccgca

SEQ ID NO: 22041 - DNA, 20 bp, Artificial sequence
  SiRNA target sequence
aagcacttgtaatcccgcaa

SEQ ID NO: 22042 - DNA, 20 bp, Artificial sequence
  SiRNA target sequence
agcacttgtaatcccgcaat

SEQ ID NO: 22043 - DNA, 20 bp, Artificial sequence
  SiRNA target sequence
gcacttgtaatcccgcaatc

SEQ ID NO: 22044 - DNA, 20 bp, Artificial sequence
  SiRNA target sequence
cacttgtaatcccgcaatcc

SEQ ID NO: 22045 - DNA, 20 bp, Artificial sequence
  SiRNA target sequence
acttgtaatcccgcaatcct

SEQ ID NO: 22046 - DNA, 20 bp, Artificial sequence
  SiRNA target sequence
cttgtaatcccgcaatcctt

SEQ ID NO: 22047 - DNA, 20 bp, Artificial sequence
  SiRNA target sequence
ttgtaatcccgcaatccttc

SEQ ID NO: 22048 - DNA, 20 bp, Artificial sequence
  SiRNA target sequence
tgtaatcccgcaatccttcc

SEQ ID NO: 22049 - DNA, 20 bp, Artificial sequence
  SiRNA target sequence
gtaatcccgcaatccttccc

SEQ ID NO: 22050 - DNA, 20 bp, Artificial sequence
  SiRNA target sequence
taatcccgcaatccttcccg

SEQ ID NO: 22051 - DNA, 20 bp, Artificial sequence
  SiRNA target sequence
aatcccgcaatccttcccgc

SEQ ID NO: 22052 - DNA, 20 bp, Artificial sequence
  SiRNA target sequence
atcccgcaatccttcccgca

SEQ ID NO: 22053 - DNA, 20 bp, Artificial sequence
  SiRNA target sequence
tcccgcaatccttcccgcat

SEQ ID NO: 22054 - DNA, 20 bp, Artificial sequence
  SiRNA target sequence
cccgcaatccttcccgcatc

SEQ ID NO: 22055 - DNA, 20 bp, Artificial sequence
  SiRNA target sequence
ccgcaatccttcccgcatct

SEQ ID NO: 22056 - DNA, 20 bp, Artificial sequence
  SiRNA target sequence
cgcaatccttcccgcatctt

SEQ ID NO: 22057 - DNA, 20 bp, Artificial sequence
  SiRNA target sequence
gcaatccttcccgcatcttt

SEQ ID NO: 22058 - DNA, 20 bp, Artificial sequence
  SiRNA target sequence
caatccttcccgcatcttta

SEQ ID NO: 22059 - DNA, 20 bp, Artificial sequence
  SiRNA target sequence
aatccttcccgcatctttag

SEQ ID NO: 22060 - DNA, 20 bp, Artificial sequence
  SiRNA target sequence
atccttcccgcatctttagt

SEQ ID NO: 22061 - DNA, 20 bp, Artificial sequence
  SiRNA target sequence
tccttcccgcatctttagta

SEQ ID NO: 22062 - DNA, 20 bp, Artificial sequence
  SiRNA target sequence
ccttcccgcatctttagtag

SEQ ID NO: 22063 - DNA, 20 bp, Artificial sequence
  SiRNA target sequence
cttcccgcatctttagtagc

SEQ ID NO: 22064 - DNA, 20 bp, Artificial sequence
  SiRNA target sequence
ttcccgcatctttagtagct

SEQ ID NO: 22065 - DNA, 20 bp, Artificial sequence
  SiRNA target sequence
tcccgcatctttagtagctt

SEQ ID NO: 22066 - DNA, 20 bp, Artificial sequence
  SiRNA target sequence
cccgcatctttagtagcttg

SEQ ID NO: 22067 - DNA, 20 bp, Artificial sequence
  SiRNA target sequence
ccgcatctttagtagcttgc

SEQ ID NO: 22068 - DNA, 20 bp, Artificial sequence
  SiRNA target sequence
cgcatctttagtagcttgcc

SEQ ID NO: 22069 - DNA, 20 bp, Artificial sequence
  SiRNA target sequence
gcatctttagtagcttgcct

SEQ ID NO: 22070 - DNA, 20 bp, Artificial sequence
  SiRNA target sequence
catctttagtagcttgcctt

SEQ ID NO: 22071 - DNA, 20 bp, Artificial sequence
  SiRNA target sequence
atctttagtagcttgccttt

SEQ ID NO: 22072 - DNA, 20 bp, Artificial sequence
  SiRNA target sequence
tctttagtagcttgcctttg

SEQ ID NO: 22073 - DNA, 20 bp, Artificial sequence
  SiRNA target sequence
ctttagtagcttgcctttgc

SEQ ID NO: 22074 - DNA, 20 bp, Artificial sequence
  SiRNA target sequence
tttagtagcttgcctttgca

SEQ ID NO: 22075 - DNA, 20 bp, Artificial sequence
  SiRNA target sequence
ttagtagcttgcctttgcat

SEQ ID NO: 22076 - DNA, 20 bp, Artificial sequence
  SiRNA target sequence
tagtagcttgcctttgcatg

SEQ ID NO: 22077 - DNA, 20 bp, Artificial sequence
  SiRNA target sequence
agtagcttgcctttgcatgt

SEQ ID NO: 22078 - DNA, 20 bp, Artificial sequence
  SiRNA target sequence
gtagcttgcctttgcatgtc

SEQ ID NO: 22079 - DNA, 20 bp, Artificial sequence
  SiRNA target sequence
tagcttgcctttgcatgtca

SEQ ID NO: 22080 - DNA, 20 bp, Artificial sequence
  SiRNA target sequence
agcttgcctttgcatgtcat

SEQ ID NO: 22081 - DNA, 20 bp, Artificial sequence
  SiRNA target sequence
gcttgcctttgcatgtcatc

SEQ ID NO: 22082 - DNA, 20 bp, Artificial sequence
  SiRNA target sequence
cttgcctttgcatgtcatca

SEQ ID NO: 22083 - DNA, 20 bp, Artificial sequence
  SiRNA target sequence
ttgcctttgcatgtcatcaa

SEQ ID NO: 22084 - DNA, 20 bp, Artificial sequence
  SiRNA target sequence
tgcctttgcatgtcatcaaa

SEQ ID NO: 22085 - DNA, 20 bp, Artificial sequence
  SiRNA target sequence
gcctttgcatgtcatcaaaa

SEQ ID NO: 22086 - DNA, 20 bp, Artificial sequence
  SiRNA target sequence
cctttgcatgtcatcaaaat

SEQ ID NO: 22087 - DNA, 20 bp, Artificial sequence
  SiRNA target sequence
ctttgcatgtcatcaaaata

SEQ ID NO: 22088 - DNA, 20 bp, Artificial sequence
  SiRNA target sequence
tttgcatgtcatcaaaatat

SEQ ID NO: 22089 - DNA, 20 bp, Artificial sequence
  SiRNA target sequence
ttgcatgtcatcaaaatatg

SEQ ID NO: 22090 - DNA, 20 bp, Artificial sequence
  SiRNA target sequence
tgcatgtcatcaaaatatgc

SEQ ID NO: 22091 - DNA, 20 bp, Artificial sequence
  SiRNA target sequence
gcatgtcatcaaaatatgcg

SEQ ID NO: 22092 - DNA, 20 bp, Artificial sequence
  SiRNA target sequence
catgtcatcaaaatatgcgg

SEQ ID NO: 22093 - DNA, 20 bp, Artificial sequence
  SiRNA target sequence
atgtcatcaaaatatgcggg

SEQ ID NO: 22094 - DNA, 20 bp, Artificial sequence
  SiRNA target sequence
tgtcatcaaaatatgcgggc

SEQ ID NO: 22095 - DNA, 20 bp, Artificial sequence
  SiRNA target sequence
gtcatcaaaatatgcgggca

SEQ ID NO: 22096 - DNA, 20 bp, Artificial sequence
  SiRNA target sequence
tcatcaaaatatgcgggcac

SEQ ID NO: 22097 - DNA, 20 bp, Artificial sequence
  SiRNA target sequence
catcaaaatatgcgggcact

SEQ ID NO: 22098 - DNA, 20 bp, Artificial sequence
  SiRNA target sequence
atcaaaatatgcgggcactg

SEQ ID NO: 22099 - DNA, 20 bp, Artificial sequence
  SiRNA target sequence
tcaaaatatgcgggcactgt

SEQ ID NO: 22100 - DNA, 20 bp, Artificial sequence
  SiRNA target sequence
caaaatatgcgggcactgtt

SEQ ID NO: 22101 - DNA, 20 bp, Artificial sequence
  SiRNA target sequence
aaaatatgcgggcactgtta

SEQ ID NO: 22102 - DNA, 20 bp, Artificial sequence
  SiRNA target sequence
aaatatgcgggcactgttat

SEQ ID NO: 22103 - DNA, 20 bp, Artificial sequence
  SiRNA target sequence
aatatgcgggcactgttata

SEQ ID NO: 22104 - DNA, 20 bp, Artificial sequence
  SiRNA target sequence
atatgcgggcactgttataa

SEQ ID NO: 22105 - DNA, 20 bp, Artificial sequence
  SiRNA target sequence
tatgcgggcactgttataac

SEQ ID NO: 22106 - DNA, 20 bp, Artificial sequence
  SiRNA target sequence
atgcgggcactgttataaca

SEQ ID NO: 22107 - DNA, 20 bp, Artificial sequence
  SiRNA target sequence
tgcgggcactgttataacag

SEQ ID NO: 22108 - DNA, 20 bp, Artificial sequence
  SiRNA target sequence
gcgggcactgttataacaga

SEQ ID NO: 22109 - DNA, 20 bp, Artificial sequence
  SiRNA target sequence
cgggcactgttataacagat

SEQ ID NO: 22110 - DNA, 20 bp, Artificial sequence
  SiRNA target sequence
gggcactgttataacagatc

SEQ ID NO: 22111 - DNA, 20 bp, Artificial sequence
  SiRNA target sequence
ggcactgttataacagatct

SEQ ID NO: 22112 - DNA, 20 bp, Artificial sequence
  SiRNA target sequence
gcactgttataacagatctt

SEQ ID NO: 22113 - DNA, 20 bp, Artificial sequence
  SiRNA target sequence
cactgttataacagatctta

SEQ ID NO: 22114 - DNA, 20 bp, Artificial sequence
  SiRNA target sequence
actgttataacagatcttaa

SEQ ID NO: 22115 - DNA, 20 bp, Artificial sequence
  SiRNA target sequence
ctgttataacagatcttaat

SEQ ID NO: 22116 - DNA, 20 bp, Artificial sequence
  SiRNA target sequence
tgttataacagatcttaata

SEQ ID NO: 22117 - DNA, 20 bp, Artificial sequence
  SiRNA target sequence
gttataacagatcttaatac

SEQ ID NO: 22118 - DNA, 20 bp, Artificial sequence
  SiRNA target sequence
ttataacagatcttaatact

SEQ ID NO: 22119 - DNA, 20 bp, Artificial sequence
  SiRNA target sequence
tataacagatcttaatactt

SEQ ID NO: 22120 - DNA, 20 bp, Artificial sequence
  SiRNA target sequence
ataacagatcttaatacttt

SEQ ID NO: 22121 - DNA, 20 bp, Artificial sequence
  SiRNA target sequence
taacagatcttaatacttta

SEQ ID NO: 22122 - DNA, 20 bp, Artificial sequence
  SiRNA target sequence
aacagatcttaatactttag

SEQ ID NO: 22123 - DNA, 20 bp, Artificial sequence
  SiRNA target sequence
acagatcttaatactttaga

SEQ ID NO: 22124 - DNA, 20 bp, Artificial sequence
  SiRNA target sequence
cagatcttaatactttagaa

SEQ ID NO: 22125 - DNA, 20 bp, Artificial sequence
  SiRNA target sequence
agatcttaatactttagaat

SEQ ID NO: 22126 - DNA, 20 bp, Artificial sequence
  SiRNA target sequence
gatcttaatactttagaatt

SEQ ID NO: 22127 - DNA, 20 bp, Artificial sequence
  SiRNA target sequence
atcttaatactttagaattt

SEQ ID NO: 22128 - DNA, 20 bp, Artificial sequence
  SiRNA target sequence
tcttaatactttagaattta

SEQ ID NO: 22129 - DNA, 20 bp, Artificial sequence
  SiRNA target sequence
cttaatactttagaatttaa

SEQ ID NO: 22130 - DNA, 20 bp, Artificial sequence
  SiRNA target sequence
ttaatactttagaatttaaa

SEQ ID NO: 22131 - DNA, 20 bp, Artificial sequence
  SiRNA target sequence
taatactttagaatttaaaa

SEQ ID NO: 22132 - DNA, 20 bp, Artificial sequence
  SiRNA target sequence
aatactttagaatttaaaaa

SEQ ID NO: 22133 - DNA, 20 bp, Artificial sequence
  SiRNA target sequence
atactttagaatttaaaaaa

SEQ ID NO: 22134 - DNA, 20 bp, Artificial sequence
  SiRNA target sequence
tactttagaatttaaaaaat

SEQ ID NO: 22135 - DNA, 20 bp, Artificial sequence
  SiRNA target sequence
actttagaatttaaaaaatt

SEQ ID NO: 22136 - DNA, 20 bp, Artificial sequence
  SiRNA target sequence
ctttagaatttaaaaaattc

SEQ ID NO: 22137 - DNA, 20 bp, Artificial sequence
  SiRNA target sequence
tttagaatttaaaaaattct

SEQ ID NO: 22138 - DNA, 20 bp, Artificial sequence
  SiRNA target sequence
ttagaatttaaaaaattctc

SEQ ID NO: 22139 - DNA, 20 bp, Artificial sequence
  SiRNA target sequence
tagaatttaaaaaattctct

SEQ ID NO: 22140 - DNA, 20 bp, Artificial sequence
  SiRNA target sequence
agaatttaaaaaattctctg

SEQ ID NO: 22141 - DNA, 20 bp, Artificial sequence
  SiRNA target sequence
gaatttaaaaaattctctgc

SEQ ID NO: 22142 - DNA, 20 bp, Artificial sequence
  SiRNA target sequence
aatttaaaaaattctctgcg

SEQ ID NO: 22143 - DNA, 20 bp, Artificial sequence
  SiRNA target sequence
atttaaaaaattctctgcgg

SEQ ID NO: 22144 - DNA, 20 bp, Artificial sequence
  SiRNA target sequence
tttaaaaaattctctgcggc

SEQ ID NO: 22145 - DNA, 20 bp, Artificial sequence
  SiRNA target sequence
ttaaaaaattctctgcggca

SEQ ID NO: 22146 - DNA, 20 bp, Artificial sequence
  SiRNA target sequence
taaaaaattctctgcggcat

SEQ ID NO: 22147 - DNA, 20 bp, Artificial sequence
  SiRNA target sequence
aaaaaattctctgcggcatt

SEQ ID NO: 22148 - DNA, 20 bp, Artificial sequence
  SiRNA target sequence
aaaaattctctgcggcattt

SEQ ID NO: 22149 - DNA, 20 bp, Artificial sequence
  SiRNA target sequence
aaaattctctgcggcatttt

SEQ ID NO: 22150 - DNA, 20 bp, Artificial sequence
  SiRNA target sequence
aaattctctgcggcattttt

SEQ ID NO: 22151 - DNA, 20 bp, Artificial sequence
  SiRNA target sequence
aattctctgcggcatttttc

SEQ ID NO: 22152 - DNA, 20 bp, Artificial sequence
  SiRNA target sequence
attctctgcggcatttttca

SEQ ID NO: 22153 - DNA, 20 bp, Artificial sequence
  SiRNA target sequence
ttctctgcggcatttttcat

SEQ ID NO: 22154 - DNA, 20 bp, Artificial sequence
  SiRNA target sequence
tctctgcggcatttttcatt

SEQ ID NO: 22155 - DNA, 20 bp, Artificial sequence
  SiRNA target sequence
ctctgcggcatttttcattt

SEQ ID NO: 22156 - DNA, 20 bp, Artificial sequence
  SiRNA target sequence
tctgcggcatttttcatttt

SEQ ID NO: 22157 - DNA, 20 bp, Artificial sequence
  SiRNA target sequence
ctgcggcatttttcattttt

SEQ ID NO: 22158 - DNA, 20 bp, Artificial sequence
  SiRNA target sequence
tgcggcatttttcatttttg

SEQ ID NO: 22159 - DNA, 20 bp, Artificial sequence
  SiRNA target sequence
gcggcatttttcatttttga

SEQ ID NO: 22160 - DNA, 20 bp, Artificial sequence
  SiRNA target sequence
cggcatttttcatttttgac

SEQ ID NO: 22161 - DNA, 20 bp, Artificial sequence
  SiRNA target sequence
ggcatttttcatttttgaca

SEQ ID NO: 22162 - DNA, 20 bp, Artificial sequence
  SiRNA target sequence
gcatttttcatttttgacaa

SEQ ID NO: 22163 - DNA, 20 bp, Artificial sequence
  SiRNA target sequence
catttttcatttttgacaaa

SEQ ID NO: 22164 - DNA, 20 bp, Artificial sequence
  SiRNA target sequence
atttttcatttttgacaaaa

SEQ ID NO: 22165 - DNA, 20 bp, Artificial sequence
  SiRNA target sequence
tttttcatttttgacaaaat

SEQ ID NO: 22166 - DNA, 20 bp, Artificial sequence
  SiRNA target sequence
ttttcatttttgacaaaata

SEQ ID NO: 22167 - DNA, 20 bp, Artificial sequence
  SiRNA target sequence
tttcatttttgacaaaataa

SEQ ID NO: 22168 - DNA, 20 bp, Artificial sequence
  SiRNA target sequence
ttcatttttgacaaaataaa

SEQ ID NO: 22169 - DNA, 20 bp, Artificial sequence
  SiRNA target sequence
tcatttttgacaaaataaat

SEQ ID NO: 22170 - DNA, 20 bp, Artificial sequence
  SiRNA target sequence
catttttgacaaaataaatg

SEQ ID NO: 22171 - DNA, 20 bp, Artificial sequence
  SiRNA target sequence
atttttgacaaaataaatgc

SEQ ID NO: 22172 - DNA, 20 bp, Artificial sequence
  SiRNA target sequence
tttttgacaaaataaatgca

SEQ ID NO: 22173 - DNA, 20 bp, Artificial sequence
  SiRNA target sequence
ttttgacaaaataaatgcac

SEQ ID NO: 22174 - DNA, 20 bp, Artificial sequence
  SiRNA target sequence
tttgacaaaataaatgcacc

SEQ ID NO: 22175 - DNA, 20 bp, Artificial sequence
  SiRNA target sequence
ttgacaaaataaatgcacca

SEQ ID NO: 22176 - DNA, 20 bp, Artificial sequence
  SiRNA target sequence
tgacaaaataaatgcaccaa

SEQ ID NO: 22177 - DNA, 20 bp, Artificial sequence
  SiRNA target sequence
gacaaaataaatgcaccaat

SEQ ID NO: 22178 - DNA, 20 bp, Artificial sequence
  SiRNA target sequence
acaaaataaatgcaccaatt

SEQ ID NO: 22179 - DNA, 20 bp, Artificial sequence
  SiRNA target sequence
caaaataaatgcaccaattt

SEQ ID NO: 22180 - DNA, 20 bp, Artificial sequence
  SiRNA target sequence
aaaataaatgcaccaatttg

SEQ ID NO: 22181 - DNA, 20 bp, Artificial sequence
  SiRNA target sequence
aaataaatgcaccaatttgt

SEQ ID NO: 22182 - DNA, 20 bp, Artificial sequence
  SiRNA target sequence
aataaatgcaccaatttgtg

SEQ ID NO: 22183 - DNA, 20 bp, Artificial sequence
  SiRNA target sequence
ataaatgcaccaatttgtgc

SEQ ID NO: 22184 - DNA, 20 bp, Artificial sequence
  SiRNA target sequence
taaatgcaccaatttgtgca

SEQ ID NO: 22185 - DNA, 20 bp, Artificial sequence
  SiRNA target sequence
aaatgcaccaatttgtgcag

SEQ ID NO: 22186 - DNA, 20 bp, Artificial sequence
  SiRNA target sequence
aatgcaccaatttgtgcagg

SEQ ID NO: 22187 - DNA, 20 bp, Artificial sequence
  SiRNA target sequence
atgcaccaatttgtgcagga

SEQ ID NO: 22188 - DNA, 20 bp, Artificial sequence
  SiRNA target sequence
tgcaccaatttgtgcaggag

SEQ ID NO: 22189 - DNA, 20 bp, Artificial sequence
  SiRNA target sequence
gcaccaatttgtgcaggaga

SEQ ID NO: 22190 - DNA, 20 bp, Artificial sequence
  SiRNA target sequence
caccaatttgtgcaggagaa

SEQ ID NO: 22191 - DNA, 20 bp, Artificial sequence
  SiRNA target sequence
accaatttgtgcaggagaat

SEQ ID NO: 22192 - DNA, 20 bp, Artificial sequence
  SiRNA target sequence
ccaatttgtgcaggagaata

SEQ ID NO: 22193 - DNA, 20 bp, Artificial sequence
  SiRNA target sequence
caatttgtgcaggagaatat

SEQ ID NO: 22194 - DNA, 20 bp, Artificial sequence
  SiRNA target sequence
aatttgtgcaggagaatatt

SEQ ID NO: 22195 - DNA, 20 bp, Artificial sequence
  SiRNA target sequence
atttgtgcaggagaatattt

SEQ ID NO: 22196 - DNA, 20 bp, Artificial sequence
  SiRNA target sequence
tttgtgcaggagaatatttc

SEQ ID NO: 22197 - DNA, 20 bp, Artificial sequence
  SiRNA target sequence
ttgtgcaggagaatatttct

SEQ ID NO: 22198 - DNA, 20 bp, Artificial sequence
  SiRNA target sequence
tgtgcaggagaatatttctt

SEQ ID NO: 22199 - DNA, 20 bp, Artificial sequence
  SiRNA target sequence
gtgcaggagaatatttctta

SEQ ID NO: 22200 - DNA, 20 bp, Artificial sequence
  SiRNA target sequence
tgcaggagaatatttcttat

SEQ ID NO: 22201 - DNA, 20 bp, Artificial sequence
  SiRNA target sequence
gcaggagaatatttcttatt

SEQ ID NO: 22202 - DNA, 20 bp, Artificial sequence
  SiRNA target sequence
caggagaatatttcttattg

SEQ ID NO: 22203 - DNA, 20 bp, Artificial sequence
  SiRNA target sequence
aggagaatatttcttattgt

SEQ ID NO: 22204 - DNA, 20 bp, Artificial sequence
  SiRNA target sequence
ggagaatatttcttattgtc

SEQ ID NO: 22205 - DNA, 20 bp, Artificial sequence
  SiRNA target sequence
gagaatatttcttattgtca

SEQ ID NO: 22206 - DNA, 20 bp, Artificial sequence
  SiRNA target sequence
agaatatttcttattgtcaa

SEQ ID NO: 22207 - DNA, 20 bp, Artificial sequence
  SiRNA target sequence
gaatatttcttattgtcaat

SEQ ID NO: 22208 - DNA, 20 bp, Artificial sequence
  SiRNA target sequence
aatatttcttattgtcaatt

SEQ ID NO: 22209 - DNA, 20 bp, Artificial sequence
  SiRNA target sequence
atatttcttattgtcaattt

SEQ ID NO: 22210 - DNA, 20 bp, Artificial sequence
  SiRNA target sequence
tatttcttattgtcaatttt

SEQ ID NO: 22211 - DNA, 20 bp, Artificial sequence
  SiRNA target sequence
atttcttattgtcaattttt

SEQ ID NO: 22212 - DNA, 20 bp, Artificial sequence
  SiRNA target sequence
tttcttattgtcaattttta

SEQ ID NO: 22213 - DNA, 20 bp, Artificial sequence
  SiRNA target sequence
ttcttattgtcaatttttat

SEQ ID NO: 22214 - DNA, 20 bp, Artificial sequence
  SiRNA target sequence
tcttattgtcaatttttatc

SEQ ID NO: 22215 - DNA, 20 bp, Artificial sequence
  SiRNA target sequence
cttattgtcaatttttatcc

SEQ ID NO: 22216 - DNA, 20 bp, Artificial sequence
  SiRNA target sequence
ttattgtcaatttttatcca

SEQ ID NO: 22217 - DNA, 20 bp, Artificial sequence
  SiRNA target sequence
tattgtcaatttttatccaa

SEQ ID NO: 22218 - DNA, 20 bp, Artificial sequence
  SiRNA target sequence
attgtcaatttttatccaaa

SEQ ID NO: 22219 - DNA, 20 bp, Artificial sequence
  SiRNA target sequence
ttgtcaatttttatccaaat

SEQ ID NO: 22220 - DNA, 20 bp, Artificial sequence
  SiRNA target sequence
tgtcaatttttatccaaata

SEQ ID NO: 22221 - DNA, 20 bp, Artificial sequence
  SiRNA target sequence
gtcaatttttatccaaatat

SEQ ID NO: 22222 - DNA, 20 bp, Artificial sequence
  SiRNA target sequence
tcaatttttatccaaatatc

SEQ ID NO: 22223 - DNA, 20 bp, Artificial sequence
  SiRNA target sequence
caatttttatccaaatatcg

SEQ ID NO: 22224 - DNA, 20 bp, Artificial sequence
  SiRNA target sequence
aatttttatccaaatatcgc

SEQ ID NO: 22225 - DNA, 20 bp, Artificial sequence
  SiRNA target sequence
atttttatccaaatatcgcc

SEQ ID NO: 22226 - DNA, 20 bp, Artificial sequence
  SiRNA target sequence
tttttatccaaatatcgccg

SEQ ID NO: 22227 - DNA, 20 bp, Artificial sequence
  SiRNA target sequence
ttttatccaaatatcgccgt

SEQ ID NO: 22228 - DNA, 20 bp, Artificial sequence
  SiRNA target sequence
tttatccaaatatcgccgtt

SEQ ID NO: 22229 - DNA, 20 bp, Artificial sequence
  SiRNA target sequence
ttatccaaatatcgccgtta

SEQ ID NO: 22230 - DNA, 20 bp, Artificial sequence
  SiRNA target sequence
tatccaaatatcgccgttac

SEQ ID NO: 22231 - DNA, 20 bp, Artificial sequence
  SiRNA target sequence
atccaaatatcgccgttaca

SEQ ID NO: 22232 - DNA, 20 bp, Artificial sequence
  SiRNA target sequence
tccaaatatcgccgttacaa

SEQ ID NO: 22233 - DNA, 20 bp, Artificial sequence
  SiRNA target sequence
ccaaatatcgccgttacaat

SEQ ID NO: 22234 - DNA, 20 bp, Artificial sequence
  SiRNA target sequence
caaatatcgccgttacaatg

SEQ ID NO: 22235 - DNA, 20 bp, Artificial sequence
  SiRNA target sequence
aaatatcgccgttacaatgc

SEQ ID NO: 22236 - DNA, 20 bp, Artificial sequence
  SiRNA target sequence
aatatcgccgttacaatgct

SEQ ID NO: 22237 - DNA, 20 bp, Artificial sequence
  SiRNA target sequence
atatcgccgttacaatgctt

SEQ ID NO: 22238 - DNA, 20 bp, Artificial sequence
  SiRNA target sequence
tatcgccgttacaatgctta

SEQ ID NO: 22239 - DNA, 20 bp, Artificial sequence
  SiRNA target sequence
atcgccgttacaatgcttag

SEQ ID NO: 22240 - DNA, 20 bp, Artificial sequence
  SiRNA target sequence
tcgccgttacaatgcttagt

SEQ ID NO: 22241 - DNA, 20 bp, Artificial sequence
  SiRNA target sequence
cgccgttacaatgcttagta

SEQ ID NO: 22242 - DNA, 20 bp, Artificial sequence
  SiRNA target sequence
gccgttacaatgcttagtag

SEQ ID NO: 22243 - DNA, 20 bp, Artificial sequence
  SiRNA target sequence
ccgttacaatgcttagtagt

SEQ ID NO: 22244 - DNA, 20 bp, Artificial sequence
  SiRNA target sequence
cgttacaatgcttagtagtg

SEQ ID NO: 22245 - DNA, 20 bp, Artificial sequence
  SiRNA target sequence
gttacaatgcttagtagtgt

SEQ ID NO: 22246 - DNA, 20 bp, Artificial sequence
  SiRNA target sequence
ttacaatgcttagtagtgtc

SEQ ID NO: 22247 - DNA, 20 bp, Artificial sequence
  SiRNA target sequence
tacaatgcttagtagtgtca

SEQ ID NO: 22248 - DNA, 20 bp, Artificial sequence
  SiRNA target sequence
acaatgcttagtagtgtcat

SEQ ID NO: 22249 - DNA, 20 bp, Artificial sequence
  SiRNA target sequence
caatgcttagtagtgtcata

SEQ ID NO: 22250 - DNA, 20 bp, Artificial sequence
  SiRNA target sequence
aatgcttagtagtgtcatat

SEQ ID NO: 22251 - DNA, 20 bp, Artificial sequence
  SiRNA target sequence
atgcttagtagtgtcatatg

SEQ ID NO: 22252 - DNA, 20 bp, Artificial sequence
  SiRNA target sequence
tgcttagtagtgtcatatgg

SEQ ID NO: 22253 - DNA, 20 bp, Artificial sequence
  SiRNA target sequence
gcttagtagtgtcatatggt

SEQ ID NO: 22254 - DNA, 20 bp, Artificial sequence
  SiRNA target sequence
cttagtagtgtcatatggta

SEQ ID NO: 22255 - DNA, 20 bp, Artificial sequence
  SiRNA target sequence
ttagtagtgtcatatggtaa

SEQ ID NO: 22256 - DNA, 20 bp, Artificial sequence
  SiRNA target sequence
tagtagtgtcatatggtaag

SEQ ID NO: 22257 - DNA, 20 bp, Artificial sequence
  SiRNA target sequence
agtagtgtcatatggtaagc

SEQ ID NO: 22258 - DNA, 20 bp, Artificial sequence
  SiRNA target sequence
gtagtgtcatatggtaagct

SEQ ID NO: 22259 - DNA, 20 bp, Artificial sequence
  SiRNA target sequence
tagtgtcatatggtaagctt

SEQ ID NO: 22260 - DNA, 20 bp, Artificial sequence
  SiRNA target sequence
agtgtcatatggtaagcttt

SEQ ID NO: 22261 - DNA, 20 bp, Artificial sequence
  SiRNA target sequence
gtgtcatatggtaagctttt

SEQ ID NO: 22262 - DNA, 20 bp, Artificial sequence
  SiRNA target sequence
tgtcatatggtaagcttttt

SEQ ID NO: 22263 - DNA, 20 bp, Artificial sequence
  SiRNA target sequence
gtcatatggtaagcttttta

SEQ ID NO: 22264 - DNA, 20 bp, Artificial sequence
  SiRNA target sequence
tcatatggtaagctttttaa

SEQ ID NO: 22265 - DNA, 20 bp, Artificial sequence
  SiRNA target sequence
catatggtaagctttttaaa

SEQ ID NO: 22266 - DNA, 20 bp, Artificial sequence
  SiRNA target sequence
atatggtaagctttttaaat

SEQ ID NO: 22267 - DNA, 20 bp, Artificial sequence
  SiRNA target sequence
tatggtaagctttttaaata

SEQ ID NO: 22268 - DNA, 20 bp, Artificial sequence
  SiRNA target sequence
atggtaagctttttaaataa

SEQ ID NO: 22269 - DNA, 20 bp, Artificial sequence
  SiRNA target sequence
tggtaagctttttaaataat

SEQ ID NO: 22270 - DNA, 20 bp, Artificial sequence
  SiRNA target sequence
ggtaagctttttaaataatc

SEQ ID NO: 22271 - DNA, 20 bp, Artificial sequence
  SiRNA target sequence
gtaagctttttaaataatct

SEQ ID NO: 22272 - DNA, 20 bp, Artificial sequence
  SiRNA target sequence
taagctttttaaataatctt

SEQ ID NO: 22273 - DNA, 20 bp, Artificial sequence
  SiRNA target sequence
aagctttttaaataatcttt

SEQ ID NO: 22274 - DNA, 20 bp, Artificial sequence
  SiRNA target sequence
agctttttaaataatctttt

SEQ ID NO: 22275 - DNA, 20 bp, Artificial sequence
  SiRNA target sequence
gctttttaaataatctttta

SEQ ID NO: 22276 - DNA, 20 bp, Artificial sequence
  SiRNA target sequence
ctttttaaataatcttttaa

SEQ ID NO: 22277 - DNA, 20 bp, Artificial sequence
  SiRNA target sequence
tttttaaataatcttttaat

SEQ ID NO: 22278 - DNA, 20 bp, Artificial sequence
  SiRNA target sequence
ttttaaataatcttttaatt

SEQ ID NO: 22279 - DNA, 20 bp, Artificial sequence
  SiRNA target sequence
tttaaataatcttttaattc

SEQ ID NO: 22280 - DNA, 20 bp, Artificial sequence
  SiRNA target sequence
ttaaataatcttttaattct

SEQ ID NO: 22281 - DNA, 20 bp, Artificial sequence
  SiRNA target sequence
taaataatcttttaattcta

SEQ ID NO: 22282 - DNA, 20 bp, Artificial sequence
  SiRNA target sequence
aaataatcttttaattctac

SEQ ID NO: 22283 - DNA, 20 bp, Artificial sequence
  SiRNA target sequence
aataatcttttaattctaca

SEQ ID NO: 22284 - DNA, 20 bp, Artificial sequence
  SiRNA target sequence
ataatcttttaattctacat

SEQ ID NO: 22285 - DNA, 20 bp, Artificial sequence
  SiRNA target sequence
taatcttttaattctacatc

SEQ ID NO: 22286 - DNA, 20 bp, Artificial sequence
  SiRNA target sequence
aatcttttaattctacatca

SEQ ID NO: 22287 - DNA, 20 bp, Artificial sequence
  SiRNA target sequence
atcttttaattctacatcat

SEQ ID NO: 22288 - DNA, 20 bp, Artificial sequence
  SiRNA target sequence
tcttttaattctacatcatc

SEQ ID NO: 22289 - DNA, 20 bp, Artificial sequence
  SiRNA target sequence
cttttaattctacatcatca

SEQ ID NO: 22290 - DNA, 20 bp, Artificial sequence
  SiRNA target sequence
ttttaattctacatcatcaa

SEQ ID NO: 22291 - DNA, 20 bp, Artificial sequence
  SiRNA target sequence
tttaattctacatcatcaaa

SEQ ID NO: 22292 - DNA, 20 bp, Artificial sequence
  SiRNA target sequence
ttaattctacatcatcaaat

SEQ ID NO: 22293 - DNA, 20 bp, Artificial sequence
  SiRNA target sequence
taattctacatcatcaaatt

SEQ ID NO: 22294 - DNA, 20 bp, Artificial sequence
  SiRNA target sequence
aattctacatcatcaaattt

SEQ ID NO: 22295 - DNA, 20 bp, Artificial sequence
  SiRNA target sequence
attctacatcatcaaatttt

SEQ ID NO: 22296 - DNA, 20 bp, Artificial sequence
  SiRNA target sequence
ttctacatcatcaaattttc

SEQ ID NO: 22297 - DNA, 20 bp, Artificial sequence
  SiRNA target sequence
tctacatcatcaaattttcg

SEQ ID NO: 22298 - DNA, 20 bp, Artificial sequence
  SiRNA target sequence
ctacatcatcaaattttcgt

SEQ ID NO: 22299 - DNA, 20 bp, Artificial sequence
  SiRNA target sequence
tacatcatcaaattttcgtc

SEQ ID NO: 22300 - DNA, 20 bp, Artificial sequence
  SiRNA target sequence
acatcatcaaattttcgtcc

SEQ ID NO: 22301 - DNA, 20 bp, Artificial sequence
  SiRNA target sequence
catcatcaaattttcgtccc

SEQ ID NO: 22302 - DNA, 20 bp, Artificial sequence
  SiRNA target sequence
atcatcaaattttcgtccca

SEQ ID NO: 22303 - DNA, 20 bp, Artificial sequence
  SiRNA target sequence
tcatcaaattttcgtcccag

SEQ ID NO: 22304 - DNA, 20 bp, Artificial sequence
  SiRNA target sequence
catcaaattttcgtcccagc

SEQ ID NO: 22305 - DNA, 20 bp, Artificial sequence
  SiRNA target sequence
atcaaattttcgtcccagca

SEQ ID NO: 22306 - DNA, 20 bp, Artificial sequence
  SiRNA target sequence
tcaaattttcgtcccagcaa

SEQ ID NO: 22307 - DNA, 20 bp, Artificial sequence
  SiRNA target sequence
caaattttcgtcccagcaat

SEQ ID NO: 22308 - DNA, 20 bp, Artificial sequence
  SiRNA target sequence
aaattttcgtcccagcaatc

SEQ ID NO: 22309 - DNA, 20 bp, Artificial sequence
  SiRNA target sequence
aattttcgtcccagcaatct

SEQ ID NO: 22310 - DNA, 20 bp, Artificial sequence
  SiRNA target sequence
attttcgtcccagcaatctc

SEQ ID NO: 22311 - DNA, 20 bp, Artificial sequence
  SiRNA target sequence
ttttcgtcccagcaatctct

SEQ ID NO: 22312 - DNA, 20 bp, Artificial sequence
  SiRNA target sequence
tttcgtcccagcaatctctt

SEQ ID NO: 22313 - DNA, 20 bp, Artificial sequence
  SiRNA target sequence
ttcgtcccagcaatctctta

SEQ ID NO: 22314 - DNA, 20 bp, Artificial sequence
  SiRNA target sequence
tcgtcccagcaatctcttag

SEQ ID NO: 22315 - DNA, 20 bp, Artificial sequence
  SiRNA target sequence
cgtcccagcaatctcttaga

SEQ ID NO: 22316 - DNA, 20 bp, Artificial sequence
  SiRNA target sequence
gtcccagcaatctcttagac

SEQ ID NO: 22317 - DNA, 20 bp, Artificial sequence
  SiRNA target sequence
tcccagcaatctcttagacg

SEQ ID NO: 22318 - DNA, 20 bp, Artificial sequence
  SiRNA target sequence
cccagcaatctcttagacgc

SEQ ID NO: 22319 - DNA, 20 bp, Artificial sequence
  SiRNA target sequence
ccagcaatctcttagacgca

SEQ ID NO: 22320 - DNA, 20 bp, Artificial sequence
  SiRNA target sequence
cagcaatctcttagacgcaa

SEQ ID NO: 22321 - DNA, 20 bp, Artificial sequence
  SiRNA target sequence
agcaatctcttagacgcaaa

SEQ ID NO: 22322 - DNA, 20 bp, Artificial sequence
  SiRNA target sequence
gcaatctcttagacgcaaaa

SEQ ID NO: 22323 - DNA, 20 bp, Artificial sequence
  SiRNA target sequence
caatctcttagacgcaaaaa

SEQ ID NO: 22324 - DNA, 20 bp, Artificial sequence
  SiRNA target sequence
aatctcttagacgcaaaaat

SEQ ID NO: 22325 - DNA, 20 bp, Artificial sequence
  SiRNA target sequence
atctcttagacgcaaaaatc

SEQ ID NO: 22326 - DNA, 20 bp, Artificial sequence
  SiRNA target sequence
tctcttagacgcaaaaatcg

SEQ ID NO: 22327 - DNA, 20 bp, Artificial sequence
  SiRNA target sequence
ctcttagacgcaaaaatcgt

SEQ ID NO: 22328 - DNA, 20 bp, Artificial sequence
  SiRNA target sequence
tcttagacgcaaaaatcgta

SEQ ID NO: 22329 - DNA, 20 bp, Artificial sequence
  SiRNA target sequence
cttagacgcaaaaatcgtat

SEQ ID NO: 22330 - DNA, 20 bp, Artificial sequence
  SiRNA target sequence
ttagacgcaaaaatcgtatt

SEQ ID NO: 22331 - DNA, 20 bp, Artificial sequence
  SiRNA target sequence
tagacgcaaaaatcgtattc

SEQ ID NO: 22332 - DNA, 20 bp, Artificial sequence
  SiRNA target sequence
agacgcaaaaatcgtattct

SEQ ID NO: 22333 - DNA, 20 bp, Artificial sequence
  SiRNA target sequence
gacgcaaaaatcgtattctt

SEQ ID NO: 22334 - DNA, 20 bp, Artificial sequence
  SiRNA target sequence
acgcaaaaatcgtattcttg

SEQ ID NO: 22335 - DNA, 20 bp, Artificial sequence
  SiRNA target sequence
cgcaaaaatcgtattcttgg

SEQ ID NO: 22336 - DNA, 20 bp, Artificial sequence
  SiRNA target sequence
gcaaaaatcgtattcttggg

SEQ ID NO: 22337 - DNA, 20 bp, Artificial sequence
  SiRNA target sequence
caaaaatcgtattcttggga

SEQ ID NO: 22338 - DNA, 20 bp, Artificial sequence
  SiRNA target sequence
aaaaatcgtattcttgggat

SEQ ID NO: 22339 - DNA, 20 bp, Artificial sequence
  SiRNA target sequence
aaaatcgtattcttgggatg

SEQ ID NO: 22340 - DNA, 20 bp, Artificial sequence
  SiRNA target sequence
aaatcgtattcttgggatgt

SEQ ID NO: 22341 - DNA, 20 bp, Artificial sequence
  SiRNA target sequence
aatcgtattcttgggatgta

SEQ ID NO: 22342 - DNA, 20 bp, Artificial sequence
  SiRNA target sequence
atcgtattcttgggatgtaa

SEQ ID NO: 22343 - DNA, 20 bp, Artificial sequence
  SiRNA target sequence
tcgtattcttgggatgtaat

SEQ ID NO: 22344 - DNA, 20 bp, Artificial sequence
  SiRNA target sequence
cgtattcttgggatgtaata

SEQ ID NO: 22345 - DNA, 20 bp, Artificial sequence
  SiRNA target sequence
gtattcttgggatgtaataa

SEQ ID NO: 22346 - DNA, 20 bp, Artificial sequence
  SiRNA target sequence
tattcttgggatgtaataac

SEQ ID NO: 22347 - DNA, 20 bp, Artificial sequence
  SiRNA target sequence
attcttgggatgtaataaca

SEQ ID NO: 22348 - DNA, 20 bp, Artificial sequence
  SiRNA target sequence
ttcttgggatgtaataacaa

SEQ ID NO: 22349 - DNA, 20 bp, Artificial sequence
  SiRNA target sequence
tcttgggatgtaataacaag

SEQ ID NO: 22350 - DNA, 20 bp, Artificial sequence
  SiRNA target sequence
cttgggatgtaataacaagt

SEQ ID NO: 22351 - DNA, 20 bp, Artificial sequence
  SiRNA target sequence
ttgggatgtaataacaagtt

SEQ ID NO: 22352 - DNA, 20 bp, Artificial sequence
  SiRNA target sequence
tgggatgtaataacaagtta

SEQ ID NO: 22353 - DNA, 20 bp, Artificial sequence
  SiRNA target sequence
gggatgtaataacaagttag

SEQ ID NO: 22354 - DNA, 20 bp, Artificial sequence
  SiRNA target sequence
ggatgtaataacaagttaga

SEQ ID NO: 22355 - DNA, 20 bp, Artificial sequence
  SiRNA target sequence
gatgtaataacaagttagac

SEQ ID NO: 22356 - DNA, 20 bp, Artificial sequence
  SiRNA target sequence
atgtaataacaagttagact

SEQ ID NO: 22357 - DNA, 20 bp, Artificial sequence
  SiRNA target sequence
tgtaataacaagttagactt

SEQ ID NO: 22358 - DNA, 20 bp, Artificial sequence
  SiRNA target sequence
gtaataacaagttagactta

SEQ ID NO: 22359 - DNA, 20 bp, Artificial sequence
  SiRNA target sequence
taataacaagttagacttag

SEQ ID NO: 22360 - DNA, 20 bp, Artificial sequence
  SiRNA target sequence
aataacaagttagacttagc

SEQ ID NO: 22361 - DNA, 20 bp, Artificial sequence
  SiRNA target sequence
ataacaagttagacttagct

SEQ ID NO: 22362 - DNA, 20 bp, Artificial sequence
  SiRNA target sequence
taacaagttagacttagctt

SEQ ID NO: 22363 - DNA, 20 bp, Artificial sequence
  SiRNA target sequence
aacaagttagacttagcttg

SEQ ID NO: 22364 - DNA, 20 bp, Artificial sequence
  SiRNA target sequence
acaagttagacttagcttgc

SEQ ID NO: 22365 - DNA, 20 bp, Artificial sequence
  SiRNA target sequence
caagttagacttagcttgct

SEQ ID NO: 22366 - DNA, 20 bp, Artificial sequence
  SiRNA target sequence
aagttagacttagcttgctc

SEQ ID NO: 22367 - DNA, 20 bp, Artificial sequence
  SiRNA target sequence
agttagacttagcttgctca

SEQ ID NO: 22368 - DNA, 20 bp, Artificial sequence
  SiRNA target sequence
gttagacttagcttgctcac

SEQ ID NO: 22369 - DNA, 20 bp, Artificial sequence
  SiRNA target sequence
ttagacttagcttgctcacc

SEQ ID NO: 22370 - DNA, 20 bp, Artificial sequence
  SiRNA target sequence
tagacttagcttgctcacct

SEQ ID NO: 22371 - DNA, 20 bp, Artificial sequence
  SiRNA target sequence
agacttagcttgctcacctg

SEQ ID NO: 22372 - DNA, 20 bp, Artificial sequence
  SiRNA target sequence
gacttagcttgctcacctgt

SEQ ID NO: 22373 - DNA, 20 bp, Artificial sequence
  SiRNA target sequence
acttagcttgctcacctgtt

SEQ ID NO: 22374 - DNA, 20 bp, Artificial sequence
  SiRNA target sequence
cttagcttgctcacctgtta

SEQ ID NO: 22375 - DNA, 20 bp, Artificial sequence
  SiRNA target sequence
ttagcttgctcacctgttaa

SEQ ID NO: 22376 - DNA, 20 bp, Artificial sequence
  SiRNA target sequence
tagcttgctcacctgttaaa

SEQ ID NO: 22377 - DNA, 20 bp, Artificial sequence
  SiRNA target sequence
agcttgctcacctgttaaaa

SEQ ID NO: 22378 - DNA, 20 bp, Artificial sequence
  SiRNA target sequence
gcttgctcacctgttaaaat

SEQ ID NO: 22379 - DNA, 20 bp, Artificial sequence
  SiRNA target sequence
cttgctcacctgttaaaatt

SEQ ID NO: 22380 - DNA, 20 bp, Artificial sequence
  SiRNA target sequence
ttgctcacctgttaaaattt

SEQ ID NO: 22381 - DNA, 20 bp, Artificial sequence
  SiRNA target sequence
tgctcacctgttaaaatttt

SEQ ID NO: 22382 - DNA, 20 bp, Artificial sequence
  SiRNA target sequence
gctcacctgttaaaatttta

SEQ ID NO: 22383 - DNA, 20 bp, Artificial sequence
  SiRNA target sequence
ctcacctgttaaaattttat

SEQ ID NO: 22384 - DNA, 20 bp, Artificial sequence
  SiRNA target sequence
tcacctgttaaaattttatc

SEQ ID NO: 22385 - DNA, 20 bp, Artificial sequence
  SiRNA target sequence
cacctgttaaaattttatct

SEQ ID NO: 22386 - DNA, 20 bp, Artificial sequence
  SiRNA target sequence
acctgttaaaattttatctt

SEQ ID NO: 22387 - DNA, 20 bp, Artificial sequence
  SiRNA target sequence
cctgttaaaattttatcttt

SEQ ID NO: 22388 - DNA, 20 bp, Artificial sequence
  SiRNA target sequence
ctgttaaaattttatcttta

SEQ ID NO: 22389 - DNA, 20 bp, Artificial sequence
  SiRNA target sequence
tgttaaaattttatctttaa

SEQ ID NO: 22390 - DNA, 20 bp, Artificial sequence
  SiRNA target sequence
gttaaaattttatctttaaa

SEQ ID NO: 22391 - DNA, 20 bp, Artificial sequence
  SiRNA target sequence
ttaaaattttatctttaaaa

SEQ ID NO: 22392 - DNA, 20 bp, Artificial sequence
  SiRNA target sequence
taaaattttatctttaaaaa

SEQ ID NO: 22393 - DNA, 20 bp, Artificial sequence
  SiRNA target sequence
aaaattttatctttaaaaat

SEQ ID NO: 22394 - DNA, 20 bp, Artificial sequence
  SiRNA target sequence
aaattttatctttaaaaatt

SEQ ID NO: 22395 - DNA, 20 bp, Artificial sequence
  SiRNA target sequence
aattttatctttaaaaattg

SEQ ID NO: 22396 - DNA, 20 bp, Artificial sequence
  SiRNA target sequence
attttatctttaaaaattga

SEQ ID NO: 22397 - DNA, 20 bp, Artificial sequence
  SiRNA target sequence
ttttatctttaaaaattgat

SEQ ID NO: 22398 - DNA, 20 bp, Artificial sequence
  SiRNA target sequence
tttatctttaaaaattgata

SEQ ID NO: 22399 - DNA, 20 bp, Artificial sequence
  SiRNA target sequence
ttatctttaaaaattgatac

SEQ ID NO: 22400 - DNA, 20 bp, Artificial sequence
  SiRNA target sequence
tatctttaaaaattgatacc

SEQ ID NO: 22401 - DNA, 20 bp, Artificial sequence
  SiRNA target sequence
atctttaaaaattgatacca

SEQ ID NO: 22402 - DNA, 20 bp, Artificial sequence
  SiRNA target sequence
tctttaaaaattgataccac

SEQ ID NO: 22403 - DNA, 20 bp, Artificial sequence
  SiRNA target sequence
ctttaaaaattgataccacc

SEQ ID NO: 22404 - DNA, 20 bp, Artificial sequence
  SiRNA target sequence
tttaaaaattgataccaccg

SEQ ID NO: 22405 - DNA, 20 bp, Artificial sequence
  SiRNA target sequence
ttaaaaattgataccaccga

SEQ ID NO: 22406 - DNA, 20 bp, Artificial sequence
  SiRNA target sequence
taaaaattgataccaccgat

SEQ ID NO: 22407 - DNA, 20 bp, Artificial sequence
  SiRNA target sequence
aaaaattgataccaccgatg

SEQ ID NO: 22408 - DNA, 20 bp, Artificial sequence
  SiRNA target sequence
aaaattgataccaccgatgg

SEQ ID NO: 22409 - DNA, 20 bp, Artificial sequence
  SiRNA target sequence
aaattgataccaccgatggt

SEQ ID NO: 22410 - DNA, 20 bp, Artificial sequence
  SiRNA target sequence
aattgataccaccgatggtg

SEQ ID NO: 22411 - DNA, 20 bp, Artificial sequence
  SiRNA target sequence
attgataccaccgatggtgt

SEQ ID NO: 22412 - DNA, 20 bp, Artificial sequence
  SiRNA target sequence
ttgataccaccgatggtgta

SEQ ID NO: 22413 - DNA, 20 bp, Artificial sequence
  SiRNA target sequence
tgataccaccgatggtgtag

SEQ ID NO: 22414 - DNA, 20 bp, Artificial sequence
  SiRNA target sequence
gataccaccgatggtgtagt

SEQ ID NO: 22415 - DNA, 20 bp, Artificial sequence
  SiRNA target sequence
ataccaccgatggtgtagtt

SEQ ID NO: 22416 - DNA, 20 bp, Artificial sequence
  SiRNA target sequence
taccaccgatggtgtagttc

SEQ ID NO: 22417 - DNA, 20 bp, Artificial sequence
  SiRNA target sequence
accaccgatggtgtagttct

SEQ ID NO: 22418 - DNA, 20 bp, Artificial sequence
  SiRNA target sequence
ccaccgatggtgtagttcta

SEQ ID NO: 22419 - DNA, 20 bp, Artificial sequence
  SiRNA target sequence
caccgatggtgtagttctac

SEQ ID NO: 22420 - DNA, 20 bp, Artificial sequence
  SiRNA target sequence
accgatggtgtagttctacc

SEQ ID NO: 22421 - DNA, 20 bp, Artificial sequence
  SiRNA target sequence
ccgatggtgtagttctacca

SEQ ID NO: 22422 - DNA, 20 bp, Artificial sequence
  SiRNA target sequence
cgatggtgtagttctaccac

SEQ ID NO: 22423 - DNA, 20 bp, Artificial sequence
  SiRNA target sequence
gatggtgtagttctaccacc

SEQ ID NO: 22424 - DNA, 20 bp, Artificial sequence
  SiRNA target sequence
atggtgtagttctaccacct

SEQ ID NO: 22425 - DNA, 20 bp, Artificial sequence
  SiRNA target sequence
tggtgtagttctaccacctt

SEQ ID NO: 22426 - DNA, 20 bp, Artificial sequence
  SiRNA target sequence
ggtgtagttctaccaccttc

SEQ ID NO: 22427 - DNA, 20 bp, Artificial sequence
  SiRNA target sequence
gtgtagttctaccaccttct

SEQ ID NO: 22428 - DNA, 20 bp, Artificial sequence
  SiRNA target sequence
tgtagttctaccaccttctt

SEQ ID NO: 22429 - DNA, 20 bp, Artificial sequence
  SiRNA target sequence
gtagttctaccaccttcttc

SEQ ID NO: 22430 - DNA, 20 bp, Artificial sequence
  SiRNA target sequence
tagttctaccaccttcttcg

SEQ ID NO: 22431 - DNA, 20 bp, Artificial sequence
  SiRNA target sequence
agttctaccaccttcttcgt

SEQ ID NO: 22432 - DNA, 20 bp, Artificial sequence
  SiRNA target sequence
gttctaccaccttcttcgtt

SEQ ID NO: 22433 - DNA, 20 bp, Artificial sequence
  SiRNA target sequence
ttctaccaccttcttcgttt

SEQ ID NO: 22434 - DNA, 20 bp, Artificial sequence
  SiRNA target sequence
tctaccaccttcttcgtttt

SEQ ID NO: 22435 - DNA, 20 bp, Artificial sequence
  SiRNA target sequence
ctaccaccttcttcgttttc

SEQ ID NO: 22436 - DNA, 20 bp, Artificial sequence
  SiRNA target sequence
taccaccttcttcgttttca

SEQ ID NO: 22437 - DNA, 20 bp, Artificial sequence
  SiRNA target sequence
accaccttcttcgttttcaa

SEQ ID NO: 22438 - DNA, 20 bp, Artificial sequence
  SiRNA target sequence
ccaccttcttcgttttcaat

SEQ ID NO: 22439 - DNA, 20 bp, Artificial sequence
  SiRNA target sequence
caccttcttcgttttcaata

SEQ ID NO: 22440 - DNA, 20 bp, Artificial sequence
  SiRNA target sequence
accttcttcgttttcaataa

SEQ ID NO: 22441 - DNA, 20 bp, Artificial sequence
  SiRNA target sequence
ccttcttcgttttcaataat

SEQ ID NO: 22442 - DNA, 20 bp, Artificial sequence
  SiRNA target sequence
cttcttcgttttcaataatt

SEQ ID NO: 22443 - DNA, 20 bp, Artificial sequence
  SiRNA target sequence
ttcttcgttttcaataattt

SEQ ID NO: 22444 - DNA, 20 bp, Artificial sequence
  SiRNA target sequence
tcttcgttttcaataatttg

SEQ ID NO: 22445 - DNA, 20 bp, Artificial sequence
  SiRNA target sequence
cttcgttttcaataatttgt

SEQ ID NO: 22446 - DNA, 20 bp, Artificial sequence
  SiRNA target sequence
ttcgttttcaataatttgtg

SEQ ID NO: 22447 - DNA, 20 bp, Artificial sequence
  SiRNA target sequence
tcgttttcaataatttgtgg

SEQ ID NO: 22448 - DNA, 20 bp, Artificial sequence
  SiRNA target sequence
cgttttcaataatttgtggg

SEQ ID NO: 22449 - DNA, 20 bp, Artificial sequence
  SiRNA target sequence
gttttcaataatttgtggga

SEQ ID NO: 22450 - DNA, 20 bp, Artificial sequence
  SiRNA target sequence
ttttcaataatttgtgggat

SEQ ID NO: 22451 - DNA, 20 bp, Artificial sequence
  SiRNA target sequence
tttcaataatttgtgggata

SEQ ID NO: 22452 - DNA, 20 bp, Artificial sequence
  SiRNA target sequence
ttcaataatttgtgggatat

SEQ ID NO: 22453 - DNA, 20 bp, Artificial sequence
  SiRNA target sequence
tcaataatttgtgggatatt

SEQ ID NO: 22454 - DNA, 20 bp, Artificial sequence
  SiRNA target sequence
caataatttgtgggatattg

SEQ ID NO: 22455 - DNA, 20 bp, Artificial sequence
  SiRNA target sequence
aataatttgtgggatattgt

SEQ ID NO: 22456 - DNA, 20 bp, Artificial sequence
  SiRNA target sequence
ataatttgtgggatattgtt

SEQ ID NO: 22457 - DNA, 20 bp, Artificial sequence
  SiRNA target sequence
taatttgtgggatattgtta

SEQ ID NO: 22458 - DNA, 20 bp, Artificial sequence
  SiRNA target sequence
aatttgtgggatattgttat

SEQ ID NO: 22459 - DNA, 20 bp, Artificial sequence
  SiRNA target sequence
atttgtgggatattgttatg

SEQ ID NO: 22460 - DNA, 20 bp, Artificial sequence
  SiRNA target sequence
tttgtgggatattgttatgt

SEQ ID NO: 22461 - DNA, 20 bp, Artificial sequence
  SiRNA target sequence
ttgtgggatattgttatgta

SEQ ID NO: 22462 - DNA, 20 bp, Artificial sequence
  SiRNA target sequence
tgtgggatattgttatgtat

SEQ ID NO: 22463 - DNA, 20 bp, Artificial sequence
  SiRNA target sequence
gtgggatattgttatgtata

SEQ ID NO: 22464 - DNA, 20 bp, Artificial sequence
  SiRNA target sequence
tgggatattgttatgtataa

SEQ ID NO: 22465 - DNA, 20 bp, Artificial sequence
  SiRNA target sequence
gggatattgttatgtataag

SEQ ID NO: 22466 - DNA, 20 bp, Artificial sequence
  SiRNA target sequence
ggatattgttatgtataaga

SEQ ID NO: 22467 - DNA, 20 bp, Artificial sequence
  SiRNA target sequence
gatattgttatgtataagag

SEQ ID NO: 22468 - DNA, 20 bp, Artificial sequence
  SiRNA target sequence
atattgttatgtataagaga

SEQ ID NO: 22469 - DNA, 20 bp, Artificial sequence
  SiRNA target sequence
tattgttatgtataagagac

SEQ ID NO: 22470 - DNA, 20 bp, Artificial sequence
  SiRNA target sequence
attgttatgtataagagaca

SEQ ID NO: 22471 - DNA, 20 bp, Artificial sequence
  SiRNA target sequence
ttgttatgtataagagacac

SEQ ID NO: 22472 - DNA, 20 bp, Artificial sequence
  SiRNA target sequence
tgttatgtataagagacaca

SEQ ID NO: 22473 - DNA, 20 bp, Artificial sequence
  SiRNA target sequence
gttatgtataagagacacac

SEQ ID NO: 22474 - DNA, 20 bp, Artificial sequence
  SiRNA target sequence
ttatgtataagagacacaca

SEQ ID NO: 22475 - DNA, 20 bp, Artificial sequence
  SiRNA target sequence
tatgtataagagacacacaa

SEQ ID NO: 22476 - DNA, 20 bp, Artificial sequence
  SiRNA target sequence
atgtataagagacacacaag

SEQ ID NO: 22477 - DNA, 20 bp, Artificial sequence
  SiRNA target sequence
tgtataagagacacacaaga

SEQ ID NO: 22478 - DNA, 20 bp, Artificial sequence
  SiRNA target sequence
gtataagagacacacaagaa

SEQ ID NO: 22479 - DNA, 20 bp, Artificial sequence
  SiRNA target sequence
tataagagacacacaagaat

SEQ ID NO: 22480 - DNA, 20 bp, Artificial sequence
  SiRNA target sequence
ataagagacacacaagaatt

SEQ ID NO: 22481 - DNA, 20 bp, Artificial sequence
  SiRNA target sequence
taagagacacacaagaattg

SEQ ID NO: 22482 - DNA, 20 bp, Artificial sequence
  SiRNA target sequence
aagagacacacaagaattgg

SEQ ID NO: 22483 - DNA, 20 bp, Artificial sequence
  SiRNA target sequence
agagacacacaagaattggt

SEQ ID NO: 22484 - DNA, 20 bp, Artificial sequence
  SiRNA target sequence
gagacacacaagaattggtt

SEQ ID NO: 22485 - DNA, 20 bp, Artificial sequence
  SiRNA target sequence
agacacacaagaattggttg

SEQ ID NO: 22486 - DNA, 20 bp, Artificial sequence
  SiRNA target sequence
gacacacaagaattggttgt

SEQ ID NO: 22487 - DNA, 20 bp, Artificial sequence
  SiRNA target sequence
acacacaagaattggttgtt

SEQ ID NO: 22488 - DNA, 20 bp, Artificial sequence
  SiRNA target sequence
cacacaagaattggttgttc

SEQ ID NO: 22489 - DNA, 20 bp, Artificial sequence
  SiRNA target sequence
acacaagaattggttgttcc

SEQ ID NO: 22490 - DNA, 20 bp, Artificial sequence
  SiRNA target sequence
cacaagaattggttgttcct

SEQ ID NO: 22491 - DNA, 20 bp, Artificial sequence
  SiRNA target sequence
acaagaattggttgttccta

SEQ ID NO: 22492 - DNA, 20 bp, Artificial sequence
  SiRNA target sequence
caagaattggttgttcctag

SEQ ID NO: 22493 - DNA, 20 bp, Artificial sequence
  SiRNA target sequence
aagaattggttgttcctaga

SEQ ID NO: 22494 - DNA, 20 bp, Artificial sequence
  SiRNA target sequence
agaattggttgttcctagat

SEQ ID NO: 22495 - DNA, 20 bp, Artificial sequence
  SiRNA target sequence
gaattggttgttcctagatc

SEQ ID NO: 22496 - DNA, 20 bp, Artificial sequence
  SiRNA target sequence
aattggttgttcctagatca

SEQ ID NO: 22497 - DNA, 20 bp, Artificial sequence
  SiRNA target sequence
attggttgttcctagatcaa

SEQ ID NO: 22498 - DNA, 20 bp, Artificial sequence
  SiRNA target sequence
ttggttgttcctagatcaat

SEQ ID NO: 22499 - DNA, 20 bp, Artificial sequence
  SiRNA target sequence
tggttgttcctagatcaatt

SEQ ID NO: 22500 - DNA, 20 bp, Artificial sequence
  SiRNA target sequence
ggttgttcctagatcaattc

SEQ ID NO: 22501 - DNA, 20 bp, Artificial sequence
  SiRNA target sequence
gttgttcctagatcaattcc

SEQ ID NO: 22502 - DNA, 20 bp, Artificial sequence
  SiRNA target sequence
ttgttcctagatcaattcct

SEQ ID NO: 22503 - DNA, 20 bp, Artificial sequence
  SiRNA target sequence
tgttcctagatcaattccta

SEQ ID NO: 22504 - DNA, 20 bp, Artificial sequence
  SiRNA target sequence
gttcctagatcaattcctat

SEQ ID NO: 22505 - DNA, 20 bp, Artificial sequence
  SiRNA target sequence
ttcctagatcaattcctatt

SEQ ID NO: 22506 - DNA, 20 bp, Artificial sequence
  SiRNA target sequence
tcctagatcaattcctatta

SEQ ID NO: 22507 - DNA, 20 bp, Artificial sequence
  SiRNA target sequence
cctagatcaattcctattat

SEQ ID NO: 22508 - DNA, 20 bp, Artificial sequence
  SiRNA target sequence
ctagatcaattcctattatt

SEQ ID NO: 22509 - DNA, 20 bp, Artificial sequence
  SiRNA target sequence
tagatcaattcctattattt

SEQ ID NO: 22510 - DNA, 20 bp, Artificial sequence
  SiRNA target sequence
agatcaattcctattatttt

SEQ ID NO: 22511 - DNA, 20 bp, Artificial sequence
  SiRNA target sequence
gatcaattcctattatttta

SEQ ID NO: 22512 - DNA, 20 bp, Artificial sequence
  SiRNA target sequence
atcaattcctattattttag

SEQ ID NO: 22513 - DNA, 20 bp, Artificial sequence
  SiRNA target sequence
tcaattcctattattttaga

SEQ ID NO: 22514 - DNA, 20 bp, Artificial sequence
  SiRNA target sequence
caattcctattattttagag

SEQ ID NO: 22515 - DNA, 20 bp, Artificial sequence
  SiRNA target sequence
aattcctattattttagagc

SEQ ID NO: 22516 - DNA, 20 bp, Artificial sequence
  SiRNA target sequence
attcctattattttagagct

SEQ ID NO: 22517 - DNA, 20 bp, Artificial sequence
  SiRNA target sequence
ttcctattattttagagcta

SEQ ID NO: 22518 - DNA, 20 bp, Artificial sequence
  SiRNA target sequence
tcctattattttagagctaa

SEQ ID NO: 22519 - DNA, 20 bp, Artificial sequence
  SiRNA target sequence
cctattattttagagctaat

SEQ ID NO: 22520 - DNA, 20 bp, Artificial sequence
  SiRNA target sequence
ctattattttagagctaatt

SEQ ID NO: 22521 - DNA, 20 bp, Artificial sequence
  SiRNA target sequence
tattattttagagctaattt

SEQ ID NO: 22522 - DNA, 20 bp, Artificial sequence
  SiRNA target sequence
attattttagagctaatttc

SEQ ID NO: 22523 - DNA, 20 bp, Artificial sequence
  SiRNA target sequence
ttattttagagctaatttct

SEQ ID NO: 22524 - DNA, 20 bp, Artificial sequence
  SiRNA target sequence
tattttagagctaatttctt

SEQ ID NO: 22525 - DNA, 20 bp, Artificial sequence
  SiRNA target sequence
attttagagctaatttcttc

SEQ ID NO: 22526 - DNA, 20 bp, Artificial sequence
  SiRNA target sequence
ttttagagctaatttcttct

SEQ ID NO: 22527 - DNA, 20 bp, Artificial sequence
  SiRNA target sequence
tttagagctaatttcttctt

SEQ ID NO: 22528 - DNA, 20 bp, Artificial sequence
  SiRNA target sequence
ttagagctaatttcttcttt

SEQ ID NO: 22529 - DNA, 20 bp, Artificial sequence
  SiRNA target sequence
tagagctaatttcttcttta

SEQ ID NO: 22530 - DNA, 20 bp, Artificial sequence
  SiRNA target sequence
agagctaatttcttctttag

SEQ ID NO: 22531 - DNA, 20 bp, Artificial sequence
  SiRNA target sequence
gagctaatttcttctttaga

SEQ ID NO: 22532 - DNA, 20 bp, Artificial sequence
  SiRNA target sequence
agctaatttcttctttagac

SEQ ID NO: 22533 - DNA, 20 bp, Artificial sequence
  SiRNA target sequence
gctaatttcttctttagaca

SEQ ID NO: 22534 - DNA, 20 bp, Artificial sequence
  SiRNA target sequence
ctaatttcttctttagacat

SEQ ID NO: 22535 - DNA, 21 bp, Artificial sequence
  SiRNA target sequence
ttaagaatttttcaatatttt

SEQ ID NO: 22536 - DNA, 21 bp, Artificial sequence
  SiRNA target sequence
taagaatttttcaatattttt

SEQ ID NO: 22537 - DNA, 21 bp, Artificial sequence
  SiRNA target sequence
aagaatttttcaatatttttt

SEQ ID NO: 22538 - DNA, 21 bp, Artificial sequence
  SiRNA target sequence
agaatttttcaatattttttt

SEQ ID NO: 22539 - DNA, 21 bp, Artificial sequence
  SiRNA target sequence
gaatttttcaatatttttttt

SEQ ID NO: 22540 - DNA, 21 bp, Artificial sequence
  SiRNA target sequence
aatttttcaatattttttttg

SEQ ID NO: 22541 - DNA, 21 bp, Artificial sequence
  SiRNA target sequence
atttttcaatattttttttgc

SEQ ID NO: 22542 - DNA, 21 bp, Artificial sequence
  SiRNA target sequence
tttttcaatattttttttgct

SEQ ID NO: 22543 - DNA, 21 bp, Artificial sequence
  SiRNA target sequence
ttttcaatattttttttgctt

SEQ ID NO: 22544 - DNA, 21 bp, Artificial sequence
  SiRNA target sequence
tttcaatattttttttgcttg

SEQ ID NO: 22545 - DNA, 21 bp, Artificial sequence
  SiRNA target sequence
ttcaatattttttttgcttgt

SEQ ID NO: 22546 - DNA, 21 bp, Artificial sequence
  SiRNA target sequence
tcaatattttttttgcttgtt

SEQ ID NO: 22547 - DNA, 21 bp, Artificial sequence
  SiRNA target sequence
caatattttttttgcttgttc

SEQ ID NO: 22548 - DNA, 21 bp, Artificial sequence
  SiRNA target sequence
aatattttttttgcttgttct

SEQ ID NO: 22549 - DNA, 21 bp, Artificial sequence
  SiRNA target sequence
atattttttttgcttgttcta

SEQ ID NO: 22550 - DNA, 21 bp, Artificial sequence
  SiRNA target sequence
tattttttttgcttgttctaa

SEQ ID NO: 22551 - DNA, 21 bp, Artificial sequence
  SiRNA target sequence
attttttttgcttgttctaag

SEQ ID NO: 22552 - DNA, 21 bp, Artificial sequence
  SiRNA target sequence
ttttttttgcttgttctaagt

SEQ ID NO: 22553 - DNA, 21 bp, Artificial sequence
  SiRNA target sequence
tttttttgcttgttctaagtc

SEQ ID NO: 22554 - DNA, 21 bp, Artificial sequence
  SiRNA target sequence
ttttttgcttgttctaagtca

SEQ ID NO: 22555 - DNA, 21 bp, Artificial sequence
  SiRNA target sequence
tttttgcttgttctaagtcat

SEQ ID NO: 22556 - DNA, 21 bp, Artificial sequence
  SiRNA target sequence
ttttgcttgttctaagtcata

SEQ ID NO: 22557 - DNA, 21 bp, Artificial sequence
  SiRNA target sequence
tttgcttgttctaagtcataa

SEQ ID NO: 22558 - DNA, 21 bp, Artificial sequence
  SiRNA target sequence
ttgcttgttctaagtcataaa

SEQ ID NO: 22559 - DNA, 21 bp, Artificial sequence
  SiRNA target sequence
tgcttgttctaagtcataaat

SEQ ID NO: 22560 - DNA, 21 bp, Artificial sequence
  SiRNA target sequence
gcttgttctaagtcataaatt

SEQ ID NO: 22561 - DNA, 21 bp, Artificial sequence
  SiRNA target sequence
cttgttctaagtcataaattt

SEQ ID NO: 22562 - DNA, 21 bp, Artificial sequence
  SiRNA target sequence
ttgttctaagtcataaatttt

SEQ ID NO: 22563 - DNA, 21 bp, Artificial sequence
  SiRNA target sequence
tgttctaagtcataaattttt

SEQ ID NO: 22564 - DNA, 21 bp, Artificial sequence
  SiRNA target sequence
gttctaagtcataaatttttt

SEQ ID NO: 22565 - DNA, 21 bp, Artificial sequence
  SiRNA target sequence
ttctaagtcataaattttttt

SEQ ID NO: 22566 - DNA, 21 bp, Artificial sequence
  SiRNA target sequence
tctaagtcataaattttttta

SEQ ID NO: 22567 - DNA, 21 bp, Artificial sequence
  SiRNA target sequence
ctaagtcataaatttttttag

SEQ ID NO: 22568 - DNA, 21 bp, Artificial sequence
  SiRNA target sequence
taagtcataaatttttttagt

SEQ ID NO: 22569 - DNA, 21 bp, Artificial sequence
  SiRNA target sequence
aagtcataaatttttttagtc

SEQ ID NO: 22570 - DNA, 21 bp, Artificial sequence
  SiRNA target sequence
agtcataaatttttttagtca

SEQ ID NO: 22571 - DNA, 21 bp, Artificial sequence
  SiRNA target sequence
gtcataaatttttttagtcaa

SEQ ID NO: 22572 - DNA, 21 bp, Artificial sequence
  SiRNA target sequence
tcataaatttttttagtcaaa

SEQ ID NO: 22573 - DNA, 21 bp, Artificial sequence
  SiRNA target sequence
cataaatttttttagtcaaat

SEQ ID NO: 22574 - DNA, 21 bp, Artificial sequence
  SiRNA target sequence
ataaatttttttagtcaaata

SEQ ID NO: 22575 - DNA, 21 bp, Artificial sequence
  SiRNA target sequence
taaatttttttagtcaaatat

SEQ ID NO: 22576 - DNA, 21 bp, Artificial sequence
  SiRNA target sequence
aaatttttttagtcaaatatg

SEQ ID NO: 22577 - DNA, 21 bp, Artificial sequence
  SiRNA target sequence
aatttttttagtcaaatatga

SEQ ID NO: 22578 - DNA, 21 bp, Artificial sequence
  SiRNA target sequence
atttttttagtcaaatatgac

SEQ ID NO: 22579 - DNA, 21 bp, Artificial sequence
  SiRNA target sequence
tttttttagtcaaatatgact

SEQ ID NO: 22580 - DNA, 21 bp, Artificial sequence
  SiRNA target sequence
ttttttagtcaaatatgactt

SEQ ID NO: 22581 - DNA, 21 bp, Artificial sequence
  SiRNA target sequence
tttttagtcaaatatgacttt

SEQ ID NO: 22582 - DNA, 21 bp, Artificial sequence
  SiRNA target sequence
ttttagtcaaatatgacttta

SEQ ID NO: 22583 - DNA, 21 bp, Artificial sequence
  SiRNA target sequence
tttagtcaaatatgactttaa

SEQ ID NO: 22584 - DNA, 21 bp, Artificial sequence
  SiRNA target sequence
ttagtcaaatatgactttaaa

SEQ ID NO: 22585 - DNA, 21 bp, Artificial sequence
  SiRNA target sequence
tagtcaaatatgactttaaaa

SEQ ID NO: 22586 - DNA, 21 bp, Artificial sequence
  SiRNA target sequence
agtcaaatatgactttaaaat

SEQ ID NO: 22587 - DNA, 21 bp, Artificial sequence
  SiRNA target sequence
gtcaaatatgactttaaaatc

SEQ ID NO: 22588 - DNA, 21 bp, Artificial sequence
  SiRNA target sequence
tcaaatatgactttaaaatct

SEQ ID NO: 22589 - DNA, 21 bp, Artificial sequence
  SiRNA target sequence
caaatatgactttaaaatctc

SEQ ID NO: 22590 - DNA, 21 bp, Artificial sequence
  SiRNA target sequence
aaatatgactttaaaatctct

SEQ ID NO: 22591 - DNA, 21 bp, Artificial sequence
  SiRNA target sequence
aatatgactttaaaatctctt

SEQ ID NO: 22592 - DNA, 21 bp, Artificial sequence
  SiRNA target sequence
atatgactttaaaatctcttt

SEQ ID NO: 22593 - DNA, 21 bp, Artificial sequence
  SiRNA target sequence
tatgactttaaaatctctttt

SEQ ID NO: 22594 - DNA, 21 bp, Artificial sequence
  SiRNA target sequence
atgactttaaaatctcttttg

SEQ ID NO: 22595 - DNA, 21 bp, Artificial sequence
  SiRNA target sequence
tgactttaaaatctcttttgt

SEQ ID NO: 22596 - DNA, 21 bp, Artificial sequence
  SiRNA target sequence
gactttaaaatctcttttgtt

SEQ ID NO: 22597 - DNA, 21 bp, Artificial sequence
  SiRNA target sequence
actttaaaatctcttttgttt

SEQ ID NO: 22598 - DNA, 21 bp, Artificial sequence
  SiRNA target sequence
ctttaaaatctcttttgtttc

SEQ ID NO: 22599 - DNA, 21 bp, Artificial sequence
  SiRNA target sequence
tttaaaatctcttttgtttca

SEQ ID NO: 22600 - DNA, 21 bp, Artificial sequence
  SiRNA target sequence
ttaaaatctcttttgtttcat

SEQ ID NO: 22601 - DNA, 21 bp, Artificial sequence
  SiRNA target sequence
taaaatctcttttgtttcatc

SEQ ID NO: 22602 - DNA, 21 bp, Artificial sequence
  SiRNA target sequence
aaaatctcttttgtttcatct

SEQ ID NO: 22603 - DNA, 21 bp, Artificial sequence
  SiRNA target sequence
aaatctcttttgtttcatctg

SEQ ID NO: 22604 - DNA, 21 bp, Artificial sequence
  SiRNA target sequence
aatctcttttgtttcatctgt

SEQ ID NO: 22605 - DNA, 21 bp, Artificial sequence
  SiRNA target sequence
atctcttttgtttcatctgtt

SEQ ID NO: 22606 - DNA, 21 bp, Artificial sequence
  SiRNA target sequence
tctcttttgtttcatctgtta

SEQ ID NO: 22607 - DNA, 21 bp, Artificial sequence
  SiRNA target sequence
ctcttttgtttcatctgttac

SEQ ID NO: 22608 - DNA, 21 bp, Artificial sequence
  SiRNA target sequence
tcttttgtttcatctgttact

SEQ ID NO: 22609 - DNA, 21 bp, Artificial sequence
  SiRNA target sequence
cttttgtttcatctgttactt

SEQ ID NO: 22610 - DNA, 21 bp, Artificial sequence
  SiRNA target sequence
ttttgtttcatctgttacttg

SEQ ID NO: 22611 - DNA, 21 bp, Artificial sequence
  SiRNA target sequence
tttgtttcatctgttacttgt

SEQ ID NO: 22612 - DNA, 21 bp, Artificial sequence
  SiRNA target sequence
ttgtttcatctgttacttgtt

SEQ ID NO: 22613 - DNA, 21 bp, Artificial sequence
  SiRNA target sequence
tgtttcatctgttacttgttt

SEQ ID NO: 22614 - DNA, 21 bp, Artificial sequence
  SiRNA target sequence
gtttcatctgttacttgtttg

SEQ ID NO: 22615 - DNA, 21 bp, Artificial sequence
  SiRNA target sequence
tttcatctgttacttgtttgt

SEQ ID NO: 22616 - DNA, 21 bp, Artificial sequence
  SiRNA target sequence
ttcatctgttacttgtttgta

SEQ ID NO: 22617 - DNA, 21 bp, Artificial sequence
  SiRNA target sequence
tcatctgttacttgtttgtac

SEQ ID NO: 22618 - DNA, 21 bp, Artificial sequence
  SiRNA target sequence
catctgttacttgtttgtact

SEQ ID NO: 22619 - DNA, 21 bp, Artificial sequence
  SiRNA target sequence
atctgttacttgtttgtactt

SEQ ID NO: 22620 - DNA, 21 bp, Artificial sequence
  SiRNA target sequence
tctgttacttgtttgtacttt

SEQ ID NO: 22621 - DNA, 21 bp, Artificial sequence
  SiRNA target sequence
ctgttacttgtttgtacttta

SEQ ID NO: 22622 - DNA, 21 bp, Artificial sequence
  SiRNA target sequence
tgttacttgtttgtactttaa

SEQ ID NO: 22623 - DNA, 21 bp, Artificial sequence
  SiRNA target sequence
gttacttgtttgtactttaaa

SEQ ID NO: 22624 - DNA, 21 bp, Artificial sequence
  SiRNA target sequence
ttacttgtttgtactttaaaa

SEQ ID NO: 22625 - DNA, 21 bp, Artificial sequence
  SiRNA target sequence
tacttgtttgtactttaaaaa

SEQ ID NO: 22626 - DNA, 21 bp, Artificial sequence
  SiRNA target sequence
acttgtttgtactttaaaaat

SEQ ID NO: 22627 - DNA, 21 bp, Artificial sequence
  SiRNA target sequence
cttgtttgtactttaaaaatt

SEQ ID NO: 22628 - DNA, 21 bp, Artificial sequence
  SiRNA target sequence
ttgtttgtactttaaaaattg

SEQ ID NO: 22629 - DNA, 21 bp, Artificial sequence
  SiRNA target sequence
tgtttgtactttaaaaattgt

SEQ ID NO: 22630 - DNA, 21 bp, Artificial sequence
  SiRNA target sequence
gtttgtactttaaaaattgtt

SEQ ID NO: 22631 - DNA, 21 bp, Artificial sequence
  SiRNA target sequence
tttgtactttaaaaattgttg

SEQ ID NO: 22632 - DNA, 21 bp, Artificial sequence
  SiRNA target sequence
ttgtactttaaaaattgttga

SEQ ID NO: 22633 - DNA, 21 bp, Artificial sequence
  SiRNA target sequence
tgtactttaaaaattgttgaa

SEQ ID NO: 22634 - DNA, 21 bp, Artificial sequence
  SiRNA target sequence
gtactttaaaaattgttgaat

SEQ ID NO: 22635 - DNA, 21 bp, Artificial sequence
  SiRNA target sequence
tactttaaaaattgttgaatt

SEQ ID NO: 22636 - DNA, 21 bp, Artificial sequence
  SiRNA target sequence
actttaaaaattgttgaattt

SEQ ID NO: 22637 - DNA, 21 bp, Artificial sequence
  SiRNA target sequence
ctttaaaaattgttgaatttc

SEQ ID NO: 22638 - DNA, 21 bp, Artificial sequence
  SiRNA target sequence
tttaaaaattgttgaatttca

SEQ ID NO: 22639 - DNA, 21 bp, Artificial sequence
  SiRNA target sequence
ttaaaaattgttgaatttcaa

SEQ ID NO: 22640 - DNA, 21 bp, Artificial sequence
  SiRNA target sequence
taaaaattgttgaatttcaat

SEQ ID NO: 22641 - DNA, 21 bp, Artificial sequence
  SiRNA target sequence
aaaaattgttgaatttcaatt

SEQ ID NO: 22642 - DNA, 21 bp, Artificial sequence
  SiRNA target sequence
aaaattgttgaatttcaattt

SEQ ID NO: 22643 - DNA, 21 bp, Artificial sequence
  SiRNA target sequence
aaattgttgaatttcaatttt

SEQ ID NO: 22644 - DNA, 21 bp, Artificial sequence
  SiRNA target sequence
aattgttgaatttcaatttta

SEQ ID NO: 22645 - DNA, 21 bp, Artificial sequence
  SiRNA target sequence
attgttgaatttcaattttaa

SEQ ID NO: 22646 - DNA, 21 bp, Artificial sequence
  SiRNA target sequence
ttgttgaatttcaattttaaa

SEQ ID NO: 22647 - DNA, 21 bp, Artificial sequence
  SiRNA target sequence
tgttgaatttcaattttaaat

SEQ ID NO: 22648 - DNA, 21 bp, Artificial sequence
  SiRNA target sequence
gttgaatttcaattttaaatt

SEQ ID NO: 22649 - DNA, 21 bp, Artificial sequence
  SiRNA target sequence
ttgaatttcaattttaaattc

SEQ ID NO: 22650 - DNA, 21 bp, Artificial sequence
  SiRNA target sequence
tgaatttcaattttaaattcg

SEQ ID NO: 22651 - DNA, 21 bp, Artificial sequence
  SiRNA target sequence
gaatttcaattttaaattcgg

SEQ ID NO: 22652 - DNA, 21 bp, Artificial sequence
  SiRNA target sequence
aatttcaattttaaattcggc

SEQ ID NO: 22653 - DNA, 21 bp, Artificial sequence
  SiRNA target sequence
atttcaattttaaattcggca

SEQ ID NO: 22654 - DNA, 21 bp, Artificial sequence
  SiRNA target sequence
tttcaattttaaattcggcac

SEQ ID NO: 22655 - DNA, 21 bp, Artificial sequence
  SiRNA target sequence
ttcaattttaaattcggcaca

SEQ ID NO: 22656 - DNA, 21 bp, Artificial sequence
  SiRNA target sequence
tcaattttaaattcggcacaa

SEQ ID NO: 22657 - DNA, 21 bp, Artificial sequence
  SiRNA target sequence
caattttaaattcggcacaat

SEQ ID NO: 22658 - DNA, 21 bp, Artificial sequence
  SiRNA target sequence
aattttaaattcggcacaatt

SEQ ID NO: 22659 - DNA, 21 bp, Artificial sequence
  SiRNA target sequence
attttaaattcggcacaattt

SEQ ID NO: 22660 - DNA, 21 bp, Artificial sequence
  SiRNA target sequence
ttttaaattcggcacaatttt

SEQ ID NO: 22661 - DNA, 21 bp, Artificial sequence
  SiRNA target sequence
tttaaattcggcacaattttt

SEQ ID NO: 22662 - DNA, 21 bp, Artificial sequence
  SiRNA target sequence
ttaaattcggcacaatttttt

SEQ ID NO: 22663 - DNA, 21 bp, Artificial sequence
  SiRNA target sequence
taaattcggcacaattttttt

SEQ ID NO: 22664 - DNA, 21 bp, Artificial sequence
  SiRNA target sequence
aaattcggcacaatttttttc

SEQ ID NO: 22665 - DNA, 21 bp, Artificial sequence
  SiRNA target sequence
aattcggcacaatttttttca

SEQ ID NO: 22666 - DNA, 21 bp, Artificial sequence
  SiRNA target sequence
attcggcacaatttttttcaa

SEQ ID NO: 22667 - DNA, 21 bp, Artificial sequence
  SiRNA target sequence
ttcggcacaatttttttcaat

SEQ ID NO: 22668 - DNA, 21 bp, Artificial sequence
  SiRNA target sequence
tcggcacaatttttttcaatt

SEQ ID NO: 22669 - DNA, 21 bp, Artificial sequence
  SiRNA target sequence
cggcacaatttttttcaattt

SEQ ID NO: 22670 - DNA, 21 bp, Artificial sequence
  SiRNA target sequence
ggcacaatttttttcaatttc

SEQ ID NO: 22671 - DNA, 21 bp, Artificial sequence
  SiRNA target sequence
gcacaatttttttcaatttca

SEQ ID NO: 22672 - DNA, 21 bp, Artificial sequence
  SiRNA target sequence
cacaatttttttcaatttcat

SEQ ID NO: 22673 - DNA, 21 bp, Artificial sequence
  SiRNA target sequence
acaatttttttcaatttcatc

SEQ ID NO: 22674 - DNA, 21 bp, Artificial sequence
  SiRNA target sequence
caatttttttcaatttcatct

SEQ ID NO: 22675 - DNA, 21 bp, Artificial sequence
  SiRNA target sequence
aatttttttcaatttcatctt

SEQ ID NO: 22676 - DNA, 21 bp, Artificial sequence
  SiRNA target sequence
atttttttcaatttcatcttt

SEQ ID NO: 22677 - DNA, 21 bp, Artificial sequence
  SiRNA target sequence
tttttttcaatttcatctttt

SEQ ID NO: 22678 - DNA, 21 bp, Artificial sequence
  SiRNA target sequence
ttttttcaatttcatcttttt

SEQ ID NO: 22679 - DNA, 21 bp, Artificial sequence
  SiRNA target sequence
tttttcaatttcatctttttt

SEQ ID NO: 22680 - DNA, 21 bp, Artificial sequence
  SiRNA target sequence
ttttcaatttcatcttttttc

SEQ ID NO: 22681 - DNA, 21 bp, Artificial sequence
  SiRNA target sequence
tttcaatttcatcttttttcg

SEQ ID NO: 22682 - DNA, 21 bp, Artificial sequence
  SiRNA target sequence
ttcaatttcatcttttttcga

SEQ ID NO: 22683 - DNA, 21 bp, Artificial sequence
  SiRNA target sequence
tcaatttcatcttttttcgaa

SEQ ID NO: 22684 - DNA, 21 bp, Artificial sequence
  SiRNA target sequence
caatttcatcttttttcgaat

SEQ ID NO: 22685 - DNA, 21 bp, Artificial sequence
  SiRNA target sequence
aatttcatcttttttcgaatt

SEQ ID NO: 22686 - DNA, 21 bp, Artificial sequence
  SiRNA target sequence
atttcatcttttttcgaattt

SEQ ID NO: 22687 - DNA, 21 bp, Artificial sequence
  SiRNA target sequence
tttcatcttttttcgaatttt

SEQ ID NO: 22688 - DNA, 21 bp, Artificial sequence
  SiRNA target sequence
ttcatcttttttcgaattttc

SEQ ID NO: 22689 - DNA, 21 bp, Artificial sequence
  SiRNA target sequence
tcatcttttttcgaattttct

SEQ ID NO: 22690 - DNA, 21 bp, Artificial sequence
  SiRNA target sequence
catcttttttcgaattttctt

SEQ ID NO: 22691 - DNA, 21 bp, Artificial sequence
  SiRNA target sequence
atcttttttcgaattttcttc

SEQ ID NO: 22692 - DNA, 21 bp, Artificial sequence
  SiRNA target sequence
tcttttttcgaattttcttcg

SEQ ID NO: 22693 - DNA, 21 bp, Artificial sequence
  SiRNA target sequence
cttttttcgaattttcttcgg

SEQ ID NO: 22694 - DNA, 21 bp, Artificial sequence
  SiRNA target sequence
ttttttcgaattttcttcggc

SEQ ID NO: 22695 - DNA, 21 bp, Artificial sequence
  SiRNA target sequence
tttttcgaattttcttcggct

SEQ ID NO: 22696 - DNA, 21 bp, Artificial sequence
  SiRNA target sequence
ttttcgaattttcttcggctt

SEQ ID NO: 22697 - DNA, 21 bp, Artificial sequence
  SiRNA target sequence
tttcgaattttcttcggcttc

SEQ ID NO: 22698 - DNA, 21 bp, Artificial sequence
  SiRNA target sequence
ttcgaattttcttcggcttct

SEQ ID NO: 22699 - DNA, 21 bp, Artificial sequence
  SiRNA target sequence
tcgaattttcttcggcttctc

SEQ ID NO: 22700 - DNA, 21 bp, Artificial sequence
  SiRNA target sequence
cgaattttcttcggcttctcg

SEQ ID NO: 22701 - DNA, 21 bp, Artificial sequence
  SiRNA target sequence
gaattttcttcggcttctcgt

SEQ ID NO: 22702 - DNA, 21 bp, Artificial sequence
  SiRNA target sequence
aattttcttcggcttctcgta

SEQ ID NO: 22703 - DNA, 21 bp, Artificial sequence
  SiRNA target sequence
attttcttcggcttctcgtat

SEQ ID NO: 22704 - DNA, 21 bp, Artificial sequence
  SiRNA target sequence
ttttcttcggcttctcgtatc

SEQ ID NO: 22705 - DNA, 21 bp, Artificial sequence
  SiRNA target sequence
tttcttcggcttctcgtatca

SEQ ID NO: 22706 - DNA, 21 bp, Artificial sequence
  SiRNA target sequence
ttcttcggcttctcgtatcat

SEQ ID NO: 22707 - DNA, 21 bp, Artificial sequence
  SiRNA target sequence
tcttcggcttctcgtatcatt

SEQ ID NO: 22708 - DNA, 21 bp, Artificial sequence
  SiRNA target sequence
cttcggcttctcgtatcattt

SEQ ID NO: 22709 - DNA, 21 bp, Artificial sequence
  SiRNA target sequence
ttcggcttctcgtatcatttg

SEQ ID NO: 22710 - DNA, 21 bp, Artificial sequence
  SiRNA target sequence
tcggcttctcgtatcatttgc

SEQ ID NO: 22711 - DNA, 21 bp, Artificial sequence
  SiRNA target sequence
cggcttctcgtatcatttgcg

SEQ ID NO: 22712 - DNA, 21 bp, Artificial sequence
  SiRNA target sequence
ggcttctcgtatcatttgcga

SEQ ID NO: 22713 - DNA, 21 bp, Artificial sequence
  SiRNA target sequence
gcttctcgtatcatttgcgaa

SEQ ID NO: 22714 - DNA, 21 bp, Artificial sequence
  SiRNA target sequence
cttctcgtatcatttgcgaaa

SEQ ID NO: 22715 - DNA, 21 bp, Artificial sequence
  SiRNA target sequence
ttctcgtatcatttgcgaaat

SEQ ID NO: 22716 - DNA, 21 bp, Artificial sequence
  SiRNA target sequence
tctcgtatcatttgcgaaatt

SEQ ID NO: 22717 - DNA, 21 bp, Artificial sequence
  SiRNA target sequence
ctcgtatcatttgcgaaattt

SEQ ID NO: 22718 - DNA, 21 bp, Artificial sequence
  SiRNA target sequence
tcgtatcatttgcgaaatttc

SEQ ID NO: 22719 - DNA, 21 bp, Artificial sequence
  SiRNA target sequence
cgtatcatttgcgaaatttca

SEQ ID NO: 22720 - DNA, 21 bp, Artificial sequence
  SiRNA target sequence
gtatcatttgcgaaatttcac

SEQ ID NO: 22721 - DNA, 21 bp, Artificial sequence
  SiRNA target sequence
tatcatttgcgaaatttcacc

SEQ ID NO: 22722 - DNA, 21 bp, Artificial sequence
  SiRNA target sequence
atcatttgcgaaatttcacct

SEQ ID NO: 22723 - DNA, 21 bp, Artificial sequence
  SiRNA target sequence
tcatttgcgaaatttcacctt

SEQ ID NO: 22724 - DNA, 21 bp, Artificial sequence
  SiRNA target sequence
catttgcgaaatttcaccttc

SEQ ID NO: 22725 - DNA, 21 bp, Artificial sequence
  SiRNA target sequence
atttgcgaaatttcaccttca

SEQ ID NO: 22726 - DNA, 21 bp, Artificial sequence
  SiRNA target sequence
tttgcgaaatttcaccttcat

SEQ ID NO: 22727 - DNA, 21 bp, Artificial sequence
  SiRNA target sequence
ttgcgaaatttcaccttcatt

SEQ ID NO: 22728 - DNA, 21 bp, Artificial sequence
  SiRNA target sequence
tgcgaaatttcaccttcattt

SEQ ID NO: 22729 - DNA, 21 bp, Artificial sequence
  SiRNA target sequence
gcgaaatttcaccttcattta

SEQ ID NO: 22730 - DNA, 21 bp, Artificial sequence
  SiRNA target sequence
cgaaatttcaccttcatttaa

SEQ ID NO: 22731 - DNA, 21 bp, Artificial sequence
  SiRNA target sequence
gaaatttcaccttcatttaat

SEQ ID NO: 22732 - DNA, 21 bp, Artificial sequence
  SiRNA target sequence
aaatttcaccttcatttaatc

SEQ ID NO: 22733 - DNA, 21 bp, Artificial sequence
  SiRNA target sequence
aatttcaccttcatttaatcc

SEQ ID NO: 22734 - DNA, 21 bp, Artificial sequence
  SiRNA target sequence
atttcaccttcatttaatcca

SEQ ID NO: 22735 - DNA, 21 bp, Artificial sequence
  SiRNA target sequence
tttcaccttcatttaatccac

SEQ ID NO: 22736 - DNA, 21 bp, Artificial sequence
  SiRNA target sequence
ttcaccttcatttaatccact

SEQ ID NO: 22737 - DNA, 21 bp, Artificial sequence
  SiRNA target sequence
tcaccttcatttaatccactt

SEQ ID NO: 22738 - DNA, 21 bp, Artificial sequence
  SiRNA target sequence
caccttcatttaatccacttg

SEQ ID NO: 22739 - DNA, 21 bp, Artificial sequence
  SiRNA target sequence
accttcatttaatccacttga

SEQ ID NO: 22740 - DNA, 21 bp, Artificial sequence
  SiRNA target sequence
ccttcatttaatccacttgaa

SEQ ID NO: 22741 - DNA, 21 bp, Artificial sequence
  SiRNA target sequence
cttcatttaatccacttgaag

SEQ ID NO: 22742 - DNA, 21 bp, Artificial sequence
  SiRNA target sequence
ttcatttaatccacttgaagg

SEQ ID NO: 22743 - DNA, 21 bp, Artificial sequence
  SiRNA target sequence
tcatttaatccacttgaaggc

SEQ ID NO: 22744 - DNA, 21 bp, Artificial sequence
  SiRNA target sequence
catttaatccacttgaaggca

SEQ ID NO: 22745 - DNA, 21 bp, Artificial sequence
  SiRNA target sequence
atttaatccacttgaaggcac

SEQ ID NO: 22746 - DNA, 21 bp, Artificial sequence
  SiRNA target sequence
tttaatccacttgaaggcaca

SEQ ID NO: 22747 - DNA, 21 bp, Artificial sequence
  SiRNA target sequence
ttaatccacttgaaggcacaa

SEQ ID NO: 22748 - DNA, 21 bp, Artificial sequence
  SiRNA target sequence
taatccacttgaaggcacaat

SEQ ID NO: 22749 - DNA, 21 bp, Artificial sequence
  SiRNA target sequence
aatccacttgaaggcacaatt

SEQ ID NO: 22750 - DNA, 21 bp, Artificial sequence
  SiRNA target sequence
atccacttgaaggcacaattt

SEQ ID NO: 22751 - DNA, 21 bp, Artificial sequence
  SiRNA target sequence
tccacttgaaggcacaatttc

SEQ ID NO: 22752 - DNA, 21 bp, Artificial sequence
  SiRNA target sequence
ccacttgaaggcacaatttcg

SEQ ID NO: 22753 - DNA, 21 bp, Artificial sequence
  SiRNA target sequence
cacttgaaggcacaatttcga

SEQ ID NO: 22754 - DNA, 21 bp, Artificial sequence
  SiRNA target sequence
acttgaaggcacaatttcgat

SEQ ID NO: 22755 - DNA, 21 bp, Artificial sequence
  SiRNA target sequence
cttgaaggcacaatttcgatt

SEQ ID NO: 22756 - DNA, 21 bp, Artificial sequence
  SiRNA target sequence
ttgaaggcacaatttcgattt

SEQ ID NO: 22757 - DNA, 21 bp, Artificial sequence
  SiRNA target sequence
tgaaggcacaatttcgatttc

SEQ ID NO: 22758 - DNA, 21 bp, Artificial sequence
  SiRNA target sequence
gaaggcacaatttcgatttct

SEQ ID NO: 22759 - DNA, 21 bp, Artificial sequence
  SiRNA target sequence
aaggcacaatttcgatttctt

SEQ ID NO: 22760 - DNA, 21 bp, Artificial sequence
  SiRNA target sequence
aggcacaatttcgatttcttg

SEQ ID NO: 22761 - DNA, 21 bp, Artificial sequence
  SiRNA target sequence
ggcacaatttcgatttcttgc

SEQ ID NO: 22762 - DNA, 21 bp, Artificial sequence
  SiRNA target sequence
gcacaatttcgatttcttgct

SEQ ID NO: 22763 - DNA, 21 bp, Artificial sequence
  SiRNA target sequence
cacaatttcgatttcttgctt

SEQ ID NO: 22764 - DNA, 21 bp, Artificial sequence
  SiRNA target sequence
acaatttcgatttcttgcttt

SEQ ID NO: 22765 - DNA, 21 bp, Artificial sequence
  SiRNA target sequence
caatttcgatttcttgctttt

SEQ ID NO: 22766 - DNA, 21 bp, Artificial sequence
  SiRNA target sequence
aatttcgatttcttgcttttt

SEQ ID NO: 22767 - DNA, 21 bp, Artificial sequence
  SiRNA target sequence
atttcgatttcttgctttttt

SEQ ID NO: 22768 - DNA, 21 bp, Artificial sequence
  SiRNA target sequence
tttcgatttcttgcttttttt

SEQ ID NO: 22769 - DNA, 21 bp, Artificial sequence
  SiRNA target sequence
ttcgatttcttgctttttttt

SEQ ID NO: 22770 - DNA, 21 bp, Artificial sequence
  SiRNA target sequence
tcgatttcttgcttttttttc

SEQ ID NO: 22771 - DNA, 21 bp, Artificial sequence
  SiRNA target sequence
cgatttcttgcttttttttcg

SEQ ID NO: 22772 - DNA, 21 bp, Artificial sequence
  SiRNA target sequence
gatttcttgcttttttttcgt

SEQ ID NO: 22773 - DNA, 21 bp, Artificial sequence
  SiRNA target sequence
atttcttgcttttttttcgtt

SEQ ID NO: 22774 - DNA, 21 bp, Artificial sequence
  SiRNA target sequence
tttcttgcttttttttcgtta

SEQ ID NO: 22775 - DNA, 21 bp, Artificial sequence
  SiRNA target sequence
ttcttgcttttttttcgttat

SEQ ID NO: 22776 - DNA, 21 bp, Artificial sequence
  SiRNA target sequence
tcttgcttttttttcgttatc

SEQ ID NO: 22777 - DNA, 21 bp, Artificial sequence
  SiRNA target sequence
cttgcttttttttcgttatcc

SEQ ID NO: 22778 - DNA, 21 bp, Artificial sequence
  SiRNA target sequence
ttgcttttttttcgttatccc

SEQ ID NO: 22779 - DNA, 21 bp, Artificial sequence
  SiRNA target sequence
tgcttttttttcgttatcccg

SEQ ID NO: 22780 - DNA, 21 bp, Artificial sequence
  SiRNA target sequence
gcttttttttcgttatcccgt

SEQ ID NO: 22781 - DNA, 21 bp, Artificial sequence
  SiRNA target sequence
cttttttttcgttatcccgtc

SEQ ID NO: 22782 - DNA, 21 bp, Artificial sequence
  SiRNA target sequence
ttttttttcgttatcccgtct

SEQ ID NO: 22783 - DNA, 21 bp, Artificial sequence
  SiRNA target sequence
tttttttcgttatcccgtctt

SEQ ID NO: 22784 - DNA, 21 bp, Artificial sequence
  SiRNA target sequence
ttttttcgttatcccgtcttg

SEQ ID NO: 22785 - DNA, 21 bp, Artificial sequence
  SiRNA target sequence
tttttcgttatcccgtcttgc

SEQ ID NO: 22786 - DNA, 21 bp, Artificial sequence
  SiRNA target sequence
ttttcgttatcccgtcttgcg

SEQ ID NO: 22787 - DNA, 21 bp, Artificial sequence
  SiRNA target sequence
tttcgttatcccgtcttgcgc

SEQ ID NO: 22788 - DNA, 21 bp, Artificial sequence
  SiRNA target sequence
ttcgttatcccgtcttgcgca

SEQ ID NO: 22789 - DNA, 21 bp, Artificial sequence
  SiRNA target sequence
tcgttatcccgtcttgcgcag

SEQ ID NO: 22790 - DNA, 21 bp, Artificial sequence
  SiRNA target sequence
cgttatcccgtcttgcgcaga

SEQ ID NO: 22791 - DNA, 21 bp, Artificial sequence
  SiRNA target sequence
gttatcccgtcttgcgcagat

SEQ ID NO: 22792 - DNA, 21 bp, Artificial sequence
  SiRNA target sequence
ttatcccgtcttgcgcagata

SEQ ID NO: 22793 - DNA, 21 bp, Artificial sequence
  SiRNA target sequence
tatcccgtcttgcgcagatac

SEQ ID NO: 22794 - DNA, 21 bp, Artificial sequence
  SiRNA target sequence
atcccgtcttgcgcagatact

SEQ ID NO: 22795 - DNA, 21 bp, Artificial sequence
  SiRNA target sequence
tcccgtcttgcgcagatactt

SEQ ID NO: 22796 - DNA, 21 bp, Artificial sequence
  SiRNA target sequence
cccgtcttgcgcagatacttt

SEQ ID NO: 22797 - DNA, 21 bp, Artificial sequence
  SiRNA target sequence
ccgtcttgcgcagatactttg

SEQ ID NO: 22798 - DNA, 21 bp, Artificial sequence
  SiRNA target sequence
cgtcttgcgcagatactttgt

SEQ ID NO: 22799 - DNA, 21 bp, Artificial sequence
  SiRNA target sequence
gtcttgcgcagatactttgta

SEQ ID NO: 22800 - DNA, 21 bp, Artificial sequence
  SiRNA target sequence
tcttgcgcagatactttgtat

SEQ ID NO: 22801 - DNA, 21 bp, Artificial sequence
  SiRNA target sequence
cttgcgcagatactttgtata

SEQ ID NO: 22802 - DNA, 21 bp, Artificial sequence
  SiRNA target sequence
ttgcgcagatactttgtatat

SEQ ID NO: 22803 - DNA, 21 bp, Artificial sequence
  SiRNA target sequence
tgcgcagatactttgtatatt

SEQ ID NO: 22804 - DNA, 21 bp, Artificial sequence
  SiRNA target sequence
gcgcagatactttgtatattc

SEQ ID NO: 22805 - DNA, 21 bp, Artificial sequence
  SiRNA target sequence
cgcagatactttgtatattcc

SEQ ID NO: 22806 - DNA, 21 bp, Artificial sequence
  SiRNA target sequence
gcagatactttgtatattccg

SEQ ID NO: 22807 - DNA, 21 bp, Artificial sequence
  SiRNA target sequence
cagatactttgtatattccgt

SEQ ID NO: 22808 - DNA, 21 bp, Artificial sequence
  SiRNA target sequence
agatactttgtatattccgtt

SEQ ID NO: 22809 - DNA, 21 bp, Artificial sequence
  SiRNA target sequence
gatactttgtatattccgtta

SEQ ID NO: 22810 - DNA, 21 bp, Artificial sequence
  SiRNA target sequence
atactttgtatattccgttag

SEQ ID NO: 22811 - DNA, 21 bp, Artificial sequence
  SiRNA target sequence
tactttgtatattccgttagc

SEQ ID NO: 22812 - DNA, 21 bp, Artificial sequence
  SiRNA target sequence
actttgtatattccgttagca

SEQ ID NO: 22813 - DNA, 21 bp, Artificial sequence
  SiRNA target sequence
ctttgtatattccgttagcat

SEQ ID NO: 22814 - DNA, 21 bp, Artificial sequence
  SiRNA target sequence
tttgtatattccgttagcatc

SEQ ID NO: 22815 - DNA, 21 bp, Artificial sequence
  SiRNA target sequence
ttgtatattccgttagcatcg

SEQ ID NO: 22816 - DNA, 21 bp, Artificial sequence
  SiRNA target sequence
tgtatattccgttagcatcgg

SEQ ID NO: 22817 - DNA, 21 bp, Artificial sequence
  SiRNA target sequence
gtatattccgttagcatcggc

SEQ ID NO: 22818 - DNA, 21 bp, Artificial sequence
  SiRNA target sequence
tatattccgttagcatcggct

SEQ ID NO: 22819 - DNA, 21 bp, Artificial sequence
  SiRNA target sequence
atattccgttagcatcggctt

SEQ ID NO: 22820 - DNA, 21 bp, Artificial sequence
  SiRNA target sequence
tattccgttagcatcggcttc

SEQ ID NO: 22821 - DNA, 21 bp, Artificial sequence
  SiRNA target sequence
attccgttagcatcggcttca

SEQ ID NO: 22822 - DNA, 21 bp, Artificial sequence
  SiRNA target sequence
ttccgttagcatcggcttcaa

SEQ ID NO: 22823 - DNA, 21 bp, Artificial sequence
  SiRNA target sequence
tccgttagcatcggcttcaaa

SEQ ID NO: 22824 - DNA, 21 bp, Artificial sequence
  SiRNA target sequence
ccgttagcatcggcttcaaat

SEQ ID NO: 22825 - DNA, 21 bp, Artificial sequence
  SiRNA target sequence
cgttagcatcggcttcaaatg

SEQ ID NO: 22826 - DNA, 21 bp, Artificial sequence
  SiRNA target sequence
gttagcatcggcttcaaatgt

SEQ ID NO: 22827 - DNA, 21 bp, Artificial sequence
  SiRNA target sequence
ttagcatcggcttcaaatgta

SEQ ID NO: 22828 - DNA, 21 bp, Artificial sequence
  SiRNA target sequence
tagcatcggcttcaaatgtaa

SEQ ID NO: 22829 - DNA, 21 bp, Artificial sequence
  SiRNA target sequence
agcatcggcttcaaatgtaac

SEQ ID NO: 22830 - DNA, 21 bp, Artificial sequence
  SiRNA target sequence
gcatcggcttcaaatgtaaca

SEQ ID NO: 22831 - DNA, 21 bp, Artificial sequence
  SiRNA target sequence
catcggcttcaaatgtaacat

SEQ ID NO: 22832 - DNA, 21 bp, Artificial sequence
  SiRNA target sequence
atcggcttcaaatgtaacatc

SEQ ID NO: 22833 - DNA, 21 bp, Artificial sequence
  SiRNA target sequence
tcggcttcaaatgtaacatct

SEQ ID NO: 22834 - DNA, 21 bp, Artificial sequence
  SiRNA target sequence
cggcttcaaatgtaacatcta

SEQ ID NO: 22835 - DNA, 21 bp, Artificial sequence
  SiRNA target sequence
ggcttcaaatgtaacatctat

SEQ ID NO: 22836 - DNA, 21 bp, Artificial sequence
  SiRNA target sequence
gcttcaaatgtaacatctatc

SEQ ID NO: 22837 - DNA, 21 bp, Artificial sequence
  SiRNA target sequence
cttcaaatgtaacatctatct

SEQ ID NO: 22838 - DNA, 21 bp, Artificial sequence
  SiRNA target sequence
ttcaaatgtaacatctatctt

SEQ ID NO: 22839 - DNA, 21 bp, Artificial sequence
  SiRNA target sequence
tcaaatgtaacatctatcttt

SEQ ID NO: 22840 - DNA, 21 bp, Artificial sequence
  SiRNA target sequence
caaatgtaacatctatctttg

SEQ ID NO: 22841 - DNA, 21 bp, Artificial sequence
  SiRNA target sequence
aaatgtaacatctatctttgg

SEQ ID NO: 22842 - DNA, 21 bp, Artificial sequence
  SiRNA target sequence
aatgtaacatctatctttgga

SEQ ID NO: 22843 - DNA, 21 bp, Artificial sequence
  SiRNA target sequence
atgtaacatctatctttggaa

SEQ ID NO: 22844 - DNA, 21 bp, Artificial sequence
  SiRNA target sequence
tgtaacatctatctttggaat

SEQ ID NO: 22845 - DNA, 21 bp, Artificial sequence
  SiRNA target sequence
gtaacatctatctttggaata

SEQ ID NO: 22846 - DNA, 21 bp, Artificial sequence
  SiRNA target sequence
taacatctatctttggaatac

SEQ ID NO: 22847 - DNA, 21 bp, Artificial sequence
  SiRNA target sequence
aacatctatctttggaatacc

SEQ ID NO: 22848 - DNA, 21 bp, Artificial sequence
  SiRNA target sequence
acatctatctttggaatacct

SEQ ID NO: 22849 - DNA, 21 bp, Artificial sequence
  SiRNA target sequence
catctatctttggaatacctg

SEQ ID NO: 22850 - DNA, 21 bp, Artificial sequence
  SiRNA target sequence
atctatctttggaatacctgc

SEQ ID NO: 22851 - DNA, 21 bp, Artificial sequence
  SiRNA target sequence
tctatctttggaatacctgca

SEQ ID NO: 22852 - DNA, 21 bp, Artificial sequence
  SiRNA target sequence
ctatctttggaatacctgcag

SEQ ID NO: 22853 - DNA, 21 bp, Artificial sequence
  SiRNA target sequence
tatctttggaatacctgcagg

SEQ ID NO: 22854 - DNA, 21 bp, Artificial sequence
  SiRNA target sequence
atctttggaatacctgcaggt

SEQ ID NO: 22855 - DNA, 21 bp, Artificial sequence
  SiRNA target sequence
tctttggaatacctgcaggtg

SEQ ID NO: 22856 - DNA, 21 bp, Artificial sequence
  SiRNA target sequence
ctttggaatacctgcaggtgc

SEQ ID NO: 22857 - DNA, 21 bp, Artificial sequence
  SiRNA target sequence
tttggaatacctgcaggtgct

SEQ ID NO: 22858 - DNA, 21 bp, Artificial sequence
  SiRNA target sequence
ttggaatacctgcaggtgctt

SEQ ID NO: 22859 - DNA, 21 bp, Artificial sequence
  SiRNA target sequence
tggaatacctgcaggtgcttt

SEQ ID NO: 22860 - DNA, 21 bp, Artificial sequence
  SiRNA target sequence
ggaatacctgcaggtgcttta

SEQ ID NO: 22861 - DNA, 21 bp, Artificial sequence
  SiRNA target sequence
gaatacctgcaggtgctttag

SEQ ID NO: 22862 - DNA, 21 bp, Artificial sequence
  SiRNA target sequence
aatacctgcaggtgctttagg

SEQ ID NO: 22863 - DNA, 21 bp, Artificial sequence
  SiRNA target sequence
atacctgcaggtgctttagga

SEQ ID NO: 22864 - DNA, 21 bp, Artificial sequence
  SiRNA target sequence
tacctgcaggtgctttaggaa

SEQ ID NO: 22865 - DNA, 21 bp, Artificial sequence
  SiRNA target sequence
acctgcaggtgctttaggaat

SEQ ID NO: 22866 - DNA, 21 bp, Artificial sequence
  SiRNA target sequence
cctgcaggtgctttaggaatg

SEQ ID NO: 22867 - DNA, 21 bp, Artificial sequence
  SiRNA target sequence
ctgcaggtgctttaggaatgt

SEQ ID NO: 22868 - DNA, 21 bp, Artificial sequence
  SiRNA target sequence
tgcaggtgctttaggaatgtt

SEQ ID NO: 22869 - DNA, 21 bp, Artificial sequence
  SiRNA target sequence
gcaggtgctttaggaatgttt

SEQ ID NO: 22870 - DNA, 21 bp, Artificial sequence
  SiRNA target sequence
caggtgctttaggaatgtttt

SEQ ID NO: 22871 - DNA, 21 bp, Artificial sequence
  SiRNA target sequence
aggtgctttaggaatgttttt

SEQ ID NO: 22872 - DNA, 21 bp, Artificial sequence
  SiRNA target sequence
ggtgctttaggaatgtttttg

SEQ ID NO: 22873 - DNA, 21 bp, Artificial sequence
  SiRNA target sequence
gtgctttaggaatgtttttga

SEQ ID NO: 22874 - DNA, 21 bp, Artificial sequence
  SiRNA target sequence
tgctttaggaatgtttttgag

SEQ ID NO: 22875 - DNA, 21 bp, Artificial sequence
  SiRNA target sequence
gctttaggaatgtttttgagc

SEQ ID NO: 22876 - DNA, 21 bp, Artificial sequence
  SiRNA target sequence
ctttaggaatgtttttgagct

SEQ ID NO: 22877 - DNA, 21 bp, Artificial sequence
  SiRNA target sequence
tttaggaatgtttttgagctt

SEQ ID NO: 22878 - DNA, 21 bp, Artificial sequence
  SiRNA target sequence
ttaggaatgtttttgagcttt

SEQ ID NO: 22879 - DNA, 21 bp, Artificial sequence
  SiRNA target sequence
taggaatgtttttgagcttta

SEQ ID NO: 22880 - DNA, 21 bp, Artificial sequence
  SiRNA target sequence
aggaatgtttttgagctttat

SEQ ID NO: 22881 - DNA, 21 bp, Artificial sequence
  SiRNA target sequence
ggaatgtttttgagctttata

SEQ ID NO: 22882 - DNA, 21 bp, Artificial sequence
  SiRNA target sequence
gaatgtttttgagctttatag

SEQ ID NO: 22883 - DNA, 21 bp, Artificial sequence
  SiRNA target sequence
aatgtttttgagctttatagc

SEQ ID NO: 22884 - DNA, 21 bp, Artificial sequence
  SiRNA target sequence
atgtttttgagctttatagct

SEQ ID NO: 22885 - DNA, 21 bp, Artificial sequence
  SiRNA target sequence
tgtttttgagctttatagctc

SEQ ID NO: 22886 - DNA, 21 bp, Artificial sequence
  SiRNA target sequence
gtttttgagctttatagctcc

SEQ ID NO: 22887 - DNA, 21 bp, Artificial sequence
  SiRNA target sequence
tttttgagctttatagctcct

SEQ ID NO: 22888 - DNA, 21 bp, Artificial sequence
  SiRNA target sequence
ttttgagctttatagctccta

SEQ ID NO: 22889 - DNA, 21 bp, Artificial sequence
  SiRNA target sequence
tttgagctttatagctcctaa

SEQ ID NO: 22890 - DNA, 21 bp, Artificial sequence
  SiRNA target sequence
ttgagctttatagctcctaaa

SEQ ID NO: 22891 - DNA, 21 bp, Artificial sequence
  SiRNA target sequence
tgagctttatagctcctaaat

SEQ ID NO: 22892 - DNA, 21 bp, Artificial sequence
  SiRNA target sequence
gagctttatagctcctaaata

SEQ ID NO: 22893 - DNA, 21 bp, Artificial sequence
  SiRNA target sequence
agctttatagctcctaaatat

SEQ ID NO: 22894 - DNA, 21 bp, Artificial sequence
  SiRNA target sequence
gctttatagctcctaaatatt

SEQ ID NO: 22895 - DNA, 21 bp, Artificial sequence
  SiRNA target sequence
ctttatagctcctaaatattt

SEQ ID NO: 22896 - DNA, 21 bp, Artificial sequence
  SiRNA target sequence
tttatagctcctaaatattta

SEQ ID NO: 22897 - DNA, 21 bp, Artificial sequence
  SiRNA target sequence
ttatagctcctaaatatttat

SEQ ID NO: 22898 - DNA, 21 bp, Artificial sequence
  SiRNA target sequence
tatagctcctaaatatttatt

SEQ ID NO: 22899 - DNA, 21 bp, Artificial sequence
  SiRNA target sequence
atagctcctaaatatttattg

SEQ ID NO: 22900 - DNA, 21 bp, Artificial sequence
  SiRNA target sequence
tagctcctaaatatttattgt

SEQ ID NO: 22901 - DNA, 21 bp, Artificial sequence
  SiRNA target sequence
agctcctaaatatttattgtc

SEQ ID NO: 22902 - DNA, 21 bp, Artificial sequence
  SiRNA target sequence
gctcctaaatatttattgtct

SEQ ID NO: 22903 - DNA, 21 bp, Artificial sequence
  SiRNA target sequence
ctcctaaatatttattgtctt

SEQ ID NO: 22904 - DNA, 21 bp, Artificial sequence
  SiRNA target sequence
tcctaaatatttattgtcttt

SEQ ID NO: 22905 - DNA, 21 bp, Artificial sequence
  SiRNA target sequence
cctaaatatttattgtctttt

SEQ ID NO: 22906 - DNA, 21 bp, Artificial sequence
  SiRNA target sequence
ctaaatatttattgtctttta

SEQ ID NO: 22907 - DNA, 21 bp, Artificial sequence
  SiRNA target sequence
taaatatttattgtcttttac

SEQ ID NO: 22908 - DNA, 21 bp, Artificial sequence
  SiRNA target sequence
aaatatttattgtcttttacc

SEQ ID NO: 22909 - DNA, 21 bp, Artificial sequence
  SiRNA target sequence
aatatttattgtcttttacca

SEQ ID NO: 22910 - DNA, 21 bp, Artificial sequence
  SiRNA target sequence
atatttattgtcttttaccat

SEQ ID NO: 22911 - DNA, 21 bp, Artificial sequence
  SiRNA target sequence
tatttattgtcttttaccatc

SEQ ID NO: 22912 - DNA, 21 bp, Artificial sequence
  SiRNA target sequence
atttattgtcttttaccatct

SEQ ID NO: 22913 - DNA, 21 bp, Artificial sequence
  SiRNA target sequence
tttattgtcttttaccatctt

SEQ ID NO: 22914 - DNA, 21 bp, Artificial sequence
  SiRNA target sequence
ttattgtcttttaccatcttt

SEQ ID NO: 22915 - DNA, 21 bp, Artificial sequence
  SiRNA target sequence
tattgtcttttaccatctttc

SEQ ID NO: 22916 - DNA, 21 bp, Artificial sequence
  SiRNA target sequence
attgtcttttaccatctttct

SEQ ID NO: 22917 - DNA, 21 bp, Artificial sequence
  SiRNA target sequence
ttgtcttttaccatctttctt

SEQ ID NO: 22918 - DNA, 21 bp, Artificial sequence
  SiRNA target sequence
tgtcttttaccatctttcttt

SEQ ID NO: 22919 - DNA, 21 bp, Artificial sequence
  SiRNA target sequence
gtcttttaccatctttctttc

SEQ ID NO: 22920 - DNA, 21 bp, Artificial sequence
  SiRNA target sequence
tcttttaccatctttctttct

SEQ ID NO: 22921 - DNA, 21 bp, Artificial sequence
  SiRNA target sequence
cttttaccatctttctttctc

SEQ ID NO: 22922 - DNA, 21 bp, Artificial sequence
  SiRNA target sequence
ttttaccatctttctttctcc

SEQ ID NO: 22923 - DNA, 21 bp, Artificial sequence
  SiRNA target sequence
tttaccatctttctttctcct

SEQ ID NO: 22924 - DNA, 21 bp, Artificial sequence
  SiRNA target sequence
ttaccatctttctttctcctt

SEQ ID NO: 22925 - DNA, 21 bp, Artificial sequence
  SiRNA target sequence
taccatctttctttctccttg

SEQ ID NO: 22926 - DNA, 21 bp, Artificial sequence
  SiRNA target sequence
accatctttctttctccttga

SEQ ID NO: 22927 - DNA, 21 bp, Artificial sequence
  SiRNA target sequence
ccatctttctttctccttgat

SEQ ID NO: 22928 - DNA, 21 bp, Artificial sequence
  SiRNA target sequence
catctttctttctccttgata

SEQ ID NO: 22929 - DNA, 21 bp, Artificial sequence
  SiRNA target sequence
atctttctttctccttgatat

SEQ ID NO: 22930 - DNA, 21 bp, Artificial sequence
  SiRNA target sequence
tctttctttctccttgatata

SEQ ID NO: 22931 - DNA, 21 bp, Artificial sequence
  SiRNA target sequence
ctttctttctccttgatatat

SEQ ID NO: 22932 - DNA, 21 bp, Artificial sequence
  SiRNA target sequence
tttctttctccttgatatatt

SEQ ID NO: 22933 - DNA, 21 bp, Artificial sequence
  SiRNA target sequence
ttctttctccttgatatattc

SEQ ID NO: 22934 - DNA, 21 bp, Artificial sequence
  SiRNA target sequence
tctttctccttgatatattct

SEQ ID NO: 22935 - DNA, 21 bp, Artificial sequence
  SiRNA target sequence
ctttctccttgatatattcta

SEQ ID NO: 22936 - DNA, 21 bp, Artificial sequence
  SiRNA target sequence
tttctccttgatatattctaa

SEQ ID NO: 22937 - DNA, 21 bp, Artificial sequence
  SiRNA target sequence
ttctccttgatatattctaat

SEQ ID NO: 22938 - DNA, 21 bp, Artificial sequence
  SiRNA target sequence
tctccttgatatattctaata

SEQ ID NO: 22939 - DNA, 21 bp, Artificial sequence
  SiRNA target sequence
ctccttgatatattctaatat

SEQ ID NO: 22940 - DNA, 21 bp, Artificial sequence
  SiRNA target sequence
tccttgatatattctaatatc

SEQ ID NO: 22941 - DNA, 21 bp, Artificial sequence
  SiRNA target sequence
ccttgatatattctaatatct

SEQ ID NO: 22942 - DNA, 21 bp, Artificial sequence
  SiRNA target sequence
cttgatatattctaatatcta

SEQ ID NO: 22943 - DNA, 21 bp, Artificial sequence
  SiRNA target sequence
ttgatatattctaatatctac

SEQ ID NO: 22944 - DNA, 21 bp, Artificial sequence
  SiRNA target sequence
tgatatattctaatatctact

SEQ ID NO: 22945 - DNA, 21 bp, Artificial sequence
  SiRNA target sequence
gatatattctaatatctactt

SEQ ID NO: 22946 - DNA, 21 bp, Artificial sequence
  SiRNA target sequence
atatattctaatatctacttc

SEQ ID NO: 22947 - DNA, 21 bp, Artificial sequence
  SiRNA target sequence
tatattctaatatctacttcg

SEQ ID NO: 22948 - DNA, 21 bp, Artificial sequence
  SiRNA target sequence
atattctaatatctacttcgg

SEQ ID NO: 22949 - DNA, 21 bp, Artificial sequence
  SiRNA target sequence
tattctaatatctacttcgga

SEQ ID NO: 22950 - DNA, 21 bp, Artificial sequence
  SiRNA target sequence
attctaatatctacttcggat

SEQ ID NO: 22951 - DNA, 21 bp, Artificial sequence
  SiRNA target sequence
ttctaatatctacttcggatt

SEQ ID NO: 22952 - DNA, 21 bp, Artificial sequence
  SiRNA target sequence
tctaatatctacttcggattg

SEQ ID NO: 22953 - DNA, 21 bp, Artificial sequence
  SiRNA target sequence
ctaatatctacttcggattga

SEQ ID NO: 22954 - DNA, 21 bp, Artificial sequence
  SiRNA target sequence
taatatctacttcggattgat

SEQ ID NO: 22955 - DNA, 21 bp, Artificial sequence
  SiRNA target sequence
aatatctacttcggattgatt

SEQ ID NO: 22956 - DNA, 21 bp, Artificial sequence
  SiRNA target sequence
atatctacttcggattgatta

SEQ ID NO: 22957 - DNA, 21 bp, Artificial sequence
  SiRNA target sequence
tatctacttcggattgattat

SEQ ID NO: 22958 - DNA, 21 bp, Artificial sequence
  SiRNA target sequence
atctacttcggattgattatc

SEQ ID NO: 22959 - DNA, 21 bp, Artificial sequence
  SiRNA target sequence
tctacttcggattgattatct

SEQ ID NO: 22960 - DNA, 21 bp, Artificial sequence
  SiRNA target sequence
ctacttcggattgattatctt

SEQ ID NO: 22961 - DNA, 21 bp, Artificial sequence
  SiRNA target sequence
tacttcggattgattatcttc

SEQ ID NO: 22962 - DNA, 21 bp, Artificial sequence
  SiRNA target sequence
acttcggattgattatcttca

SEQ ID NO: 22963 - DNA, 21 bp, Artificial sequence
  SiRNA target sequence
cttcggattgattatcttcag

SEQ ID NO: 22964 - DNA, 21 bp, Artificial sequence
  SiRNA target sequence
ttcggattgattatcttcaga

SEQ ID NO: 22965 - DNA, 21 bp, Artificial sequence
  SiRNA target sequence
tcggattgattatcttcagag

SEQ ID NO: 22966 - DNA, 21 bp, Artificial sequence
  SiRNA target sequence
cggattgattatcttcagagg

SEQ ID NO: 22967 - DNA, 21 bp, Artificial sequence
  SiRNA target sequence
ggattgattatcttcagaggt

SEQ ID NO: 22968 - DNA, 21 bp, Artificial sequence
  SiRNA target sequence
gattgattatcttcagaggta

SEQ ID NO: 22969 - DNA, 21 bp, Artificial sequence
  SiRNA target sequence
attgattatcttcagaggtag

SEQ ID NO: 22970 - DNA, 21 bp, Artificial sequence
  SiRNA target sequence
ttgattatcttcagaggtaga

SEQ ID NO: 22971 - DNA, 21 bp, Artificial sequence
  SiRNA target sequence
tgattatcttcagaggtagaa

SEQ ID NO: 22972 - DNA, 21 bp, Artificial sequence
  SiRNA target sequence
gattatcttcagaggtagaaa

SEQ ID NO: 22973 - DNA, 21 bp, Artificial sequence
  SiRNA target sequence
attatcttcagaggtagaaaa

SEQ ID NO: 22974 - DNA, 21 bp, Artificial sequence
  SiRNA target sequence
ttatcttcagaggtagaaaaa

SEQ ID NO: 22975 - DNA, 21 bp, Artificial sequence
  SiRNA target sequence
tatcttcagaggtagaaaaac

SEQ ID NO: 22976 - DNA, 21 bp, Artificial sequence
  SiRNA target sequence
atcttcagaggtagaaaaact

SEQ ID NO: 22977 - DNA, 21 bp, Artificial sequence
  SiRNA target sequence
tcttcagaggtagaaaaactg

SEQ ID NO: 22978 - DNA, 21 bp, Artificial sequence
  SiRNA target sequence
cttcagaggtagaaaaactgt

SEQ ID NO: 22979 - DNA, 21 bp, Artificial sequence
  SiRNA target sequence
ttcagaggtagaaaaactgtg

SEQ ID NO: 22980 - DNA, 21 bp, Artificial sequence
  SiRNA target sequence
tcagaggtagaaaaactgtgt

SEQ ID NO: 22981 - DNA, 21 bp, Artificial sequence
  SiRNA target sequence
cagaggtagaaaaactgtgtg

SEQ ID NO: 22982 - DNA, 21 bp, Artificial sequence
  SiRNA target sequence
agaggtagaaaaactgtgtgt

SEQ ID NO: 22983 - DNA, 21 bp, Artificial sequence
  SiRNA target sequence
gaggtagaaaaactgtgtgtt

SEQ ID NO: 22984 - DNA, 21 bp, Artificial sequence
  SiRNA target sequence
aggtagaaaaactgtgtgttt

SEQ ID NO: 22985 - DNA, 21 bp, Artificial sequence
  SiRNA target sequence
ggtagaaaaactgtgtgtttc

SEQ ID NO: 22986 - DNA, 21 bp, Artificial sequence
  SiRNA target sequence
gtagaaaaactgtgtgtttcc

SEQ ID NO: 22987 - DNA, 21 bp, Artificial sequence
  SiRNA target sequence
tagaaaaactgtgtgtttcct

SEQ ID NO: 22988 - DNA, 21 bp, Artificial sequence
  SiRNA target sequence
agaaaaactgtgtgtttcctt

SEQ ID NO: 22989 - DNA, 21 bp, Artificial sequence
  SiRNA target sequence
gaaaaactgtgtgtttcctta

SEQ ID NO: 22990 - DNA, 21 bp, Artificial sequence
  SiRNA target sequence
aaaaactgtgtgtttccttaa

SEQ ID NO: 22991 - DNA, 21 bp, Artificial sequence
  SiRNA target sequence
aaaactgtgtgtttccttaaa

SEQ ID NO: 22992 - DNA, 21 bp, Artificial sequence
  SiRNA target sequence
aaactgtgtgtttccttaaat

SEQ ID NO: 22993 - DNA, 21 bp, Artificial sequence
  SiRNA target sequence
aactgtgtgtttccttaaatg

SEQ ID NO: 22994 - DNA, 21 bp, Artificial sequence
  SiRNA target sequence
actgtgtgtttccttaaatgg

SEQ ID NO: 22995 - DNA, 21 bp, Artificial sequence
  SiRNA target sequence
ctgtgtgtttccttaaatgga

SEQ ID NO: 22996 - DNA, 21 bp, Artificial sequence
  SiRNA target sequence
tgtgtgtttccttaaatggaa

SEQ ID NO: 22997 - DNA, 21 bp, Artificial sequence
  SiRNA target sequence
gtgtgtttccttaaatggaat

SEQ ID NO: 22998 - DNA, 21 bp, Artificial sequence
  SiRNA target sequence
tgtgtttccttaaatggaata

SEQ ID NO: 22999 - DNA, 21 bp, Artificial sequence
  SiRNA target sequence
gtgtttccttaaatggaatag

SEQ ID NO: 23000 - DNA, 21 bp, Artificial sequence
  SiRNA target sequence
tgtttccttaaatggaatagt

SEQ ID NO: 23001 - DNA, 21 bp, Artificial sequence
  SiRNA target sequence
gtttccttaaatggaatagta

SEQ ID NO: 23002 - DNA, 21 bp, Artificial sequence
  SiRNA target sequence
tttccttaaatggaatagtag

SEQ ID NO: 23003 - DNA, 21 bp, Artificial sequence
  SiRNA target sequence
ttccttaaatggaatagtaga

SEQ ID NO: 23004 - DNA, 21 bp, Artificial sequence
  SiRNA target sequence
tccttaaatggaatagtagaa

SEQ ID NO: 23005 - DNA, 21 bp, Artificial sequence
  SiRNA target sequence
ccttaaatggaatagtagaat

SEQ ID NO: 23006 - DNA, 21 bp, Artificial sequence
  SiRNA target sequence
cttaaatggaatagtagaatt

SEQ ID NO: 23007 - DNA, 21 bp, Artificial sequence
  SiRNA target sequence
ttaaatggaatagtagaattt

SEQ ID NO: 23008 - DNA, 21 bp, Artificial sequence
  SiRNA target sequence
taaatggaatagtagaatttc

SEQ ID NO: 23009 - DNA, 21 bp, Artificial sequence
  SiRNA target sequence
aaatggaatagtagaatttct

SEQ ID NO: 23010 - DNA, 21 bp, Artificial sequence
  SiRNA target sequence
aatggaatagtagaatttcta

SEQ ID NO: 23011 - DNA, 21 bp, Artificial sequence
  SiRNA target sequence
atggaatagtagaatttctat

SEQ ID NO: 23012 - DNA, 21 bp, Artificial sequence
  SiRNA target sequence
tggaatagtagaatttctatg

SEQ ID NO: 23013 - DNA, 21 bp, Artificial sequence
  SiRNA target sequence
ggaatagtagaatttctatga

SEQ ID NO: 23014 - DNA, 21 bp, Artificial sequence
  SiRNA target sequence
gaatagtagaatttctatgaa

SEQ ID NO: 23015 - DNA, 21 bp, Artificial sequence
  SiRNA target sequence
aatagtagaatttctatgaat

SEQ ID NO: 23016 - DNA, 21 bp, Artificial sequence
  SiRNA target sequence
atagtagaatttctatgaatt

SEQ ID NO: 23017 - DNA, 21 bp, Artificial sequence
  SiRNA target sequence
tagtagaatttctatgaatta

SEQ ID NO: 23018 - DNA, 21 bp, Artificial sequence
  SiRNA target sequence
agtagaatttctatgaattat

SEQ ID NO: 23019 - DNA, 21 bp, Artificial sequence
  SiRNA target sequence
gtagaatttctatgaattatc

SEQ ID NO: 23020 - DNA, 21 bp, Artificial sequence
  SiRNA target sequence
tagaatttctatgaattatct

SEQ ID NO: 23021 - DNA, 21 bp, Artificial sequence
  SiRNA target sequence
agaatttctatgaattatctt

SEQ ID NO: 23022 - DNA, 21 bp, Artificial sequence
  SiRNA target sequence
gaatttctatgaattatctta

SEQ ID NO: 23023 - DNA, 21 bp, Artificial sequence
  SiRNA target sequence
aatttctatgaattatcttat

SEQ ID NO: 23024 - DNA, 21 bp, Artificial sequence
  SiRNA target sequence
atttctatgaattatcttatt

SEQ ID NO: 23025 - DNA, 21 bp, Artificial sequence
  SiRNA target sequence
tttctatgaattatcttatta

SEQ ID NO: 23026 - DNA, 21 bp, Artificial sequence
  SiRNA target sequence
ttctatgaattatcttattaa

SEQ ID NO: 23027 - DNA, 21 bp, Artificial sequence
  SiRNA target sequence
tctatgaattatcttattaaa

SEQ ID NO: 23028 - DNA, 21 bp, Artificial sequence
  SiRNA target sequence
ctatgaattatcttattaaaa

SEQ ID NO: 23029 - DNA, 21 bp, Artificial sequence
  SiRNA target sequence
tatgaattatcttattaaaaa

SEQ ID NO: 23030 - DNA, 21 bp, Artificial sequence
  SiRNA target sequence
atgaattatcttattaaaaat

SEQ ID NO: 23031 - DNA, 21 bp, Artificial sequence
  SiRNA target sequence
tgaattatcttattaaaaatc

SEQ ID NO: 23032 - DNA, 21 bp, Artificial sequence
  SiRNA target sequence
gaattatcttattaaaaatcc

SEQ ID NO: 23033 - DNA, 21 bp, Artificial sequence
  SiRNA target sequence
aattatcttattaaaaatccc

SEQ ID NO: 23034 - DNA, 21 bp, Artificial sequence
  SiRNA target sequence
attatcttattaaaaatcccg

SEQ ID NO: 23035 - DNA, 21 bp, Artificial sequence
  SiRNA target sequence
ttatcttattaaaaatcccgc

SEQ ID NO: 23036 - DNA, 21 bp, Artificial sequence
  SiRNA target sequence
tatcttattaaaaatcccgcc

SEQ ID NO: 23037 - DNA, 21 bp, Artificial sequence
  SiRNA target sequence
atcttattaaaaatcccgccc

SEQ ID NO: 23038 - DNA, 21 bp, Artificial sequence
  SiRNA target sequence
tcttattaaaaatcccgccca

SEQ ID NO: 23039 - DNA, 21 bp, Artificial sequence
  SiRNA target sequence
cttattaaaaatcccgcccaa

SEQ ID NO: 23040 - DNA, 21 bp, Artificial sequence
  SiRNA target sequence
ttattaaaaatcccgcccaaa

SEQ ID NO: 23041 - DNA, 21 bp, Artificial sequence
  SiRNA target sequence
tattaaaaatcccgcccaaaa

SEQ ID NO: 23042 - DNA, 21 bp, Artificial sequence
  SiRNA target sequence
attaaaaatcccgcccaaaag

SEQ ID NO: 23043 - DNA, 21 bp, Artificial sequence
  SiRNA target sequence
ttaaaaatcccgcccaaaagc

SEQ ID NO: 23044 - DNA, 21 bp, Artificial sequence
  SiRNA target sequence
taaaaatcccgcccaaaagct

SEQ ID NO: 23045 - DNA, 21 bp, Artificial sequence
  SiRNA target sequence
aaaaatcccgcccaaaagctc

SEQ ID NO: 23046 - DNA, 21 bp, Artificial sequence
  SiRNA target sequence
aaaatcccgcccaaaagctct

SEQ ID NO: 23047 - DNA, 21 bp, Artificial sequence
  SiRNA target sequence
aaatcccgcccaaaagctcta

SEQ ID NO: 23048 - DNA, 21 bp, Artificial sequence
  SiRNA target sequence
aatcccgcccaaaagctctat

SEQ ID NO: 23049 - DNA, 21 bp, Artificial sequence
  SiRNA target sequence
atcccgcccaaaagctctata

SEQ ID NO: 23050 - DNA, 21 bp, Artificial sequence
  SiRNA target sequence
tcccgcccaaaagctctatac

SEQ ID NO: 23051 - DNA, 21 bp, Artificial sequence
  SiRNA target sequence
cccgcccaaaagctctatacc

SEQ ID NO: 23052 - DNA, 21 bp, Artificial sequence
  SiRNA target sequence
ccgcccaaaagctctatacct

SEQ ID NO: 23053 - DNA, 21 bp, Artificial sequence
  SiRNA target sequence
cgcccaaaagctctataccta

SEQ ID NO: 23054 - DNA, 21 bp, Artificial sequence
  SiRNA target sequence
gcccaaaagctctatacctaa

SEQ ID NO: 23055 - DNA, 21 bp, Artificial sequence
  SiRNA target sequence
cccaaaagctctatacctaaa

SEQ ID NO: 23056 - DNA, 21 bp, Artificial sequence
  SiRNA target sequence
ccaaaagctctatacctaaac

SEQ ID NO: 23057 - DNA, 21 bp, Artificial sequence
  SiRNA target sequence
caaaagctctatacctaaact

SEQ ID NO: 23058 - DNA, 21 bp, Artificial sequence
  SiRNA target sequence
aaaagctctatacctaaactc

SEQ ID NO: 23059 - DNA, 21 bp, Artificial sequence
  SiRNA target sequence
aaagctctatacctaaactca

SEQ ID NO: 23060 - DNA, 21 bp, Artificial sequence
  SiRNA target sequence
aagctctatacctaaactcaa

SEQ ID NO: 23061 - DNA, 21 bp, Artificial sequence
  SiRNA target sequence
agctctatacctaaactcaat

SEQ ID NO: 23062 - DNA, 21 bp, Artificial sequence
  SiRNA target sequence
gctctatacctaaactcaatg

SEQ ID NO: 23063 - DNA, 21 bp, Artificial sequence
  SiRNA target sequence
ctctatacctaaactcaatgg

SEQ ID NO: 23064 - DNA, 21 bp, Artificial sequence
  SiRNA target sequence
tctatacctaaactcaatggt

SEQ ID NO: 23065 - DNA, 21 bp, Artificial sequence
  SiRNA target sequence
ctatacctaaactcaatggta

SEQ ID NO: 23066 - DNA, 21 bp, Artificial sequence
  SiRNA target sequence
tatacctaaactcaatggtac

SEQ ID NO: 23067 - DNA, 21 bp, Artificial sequence
  SiRNA target sequence
atacctaaactcaatggtact

SEQ ID NO: 23068 - DNA, 21 bp, Artificial sequence
  SiRNA target sequence
tacctaaactcaatggtacta

SEQ ID NO: 23069 - DNA, 21 bp, Artificial sequence
  SiRNA target sequence
acctaaactcaatggtactac

SEQ ID NO: 23070 - DNA, 21 bp, Artificial sequence
  SiRNA target sequence
cctaaactcaatggtactaca

SEQ ID NO: 23071 - DNA, 21 bp, Artificial sequence
  SiRNA target sequence
ctaaactcaatggtactacat

SEQ ID NO: 23072 - DNA, 21 bp, Artificial sequence
  SiRNA target sequence
taaactcaatggtactacatc

SEQ ID NO: 23073 - DNA, 21 bp, Artificial sequence
  SiRNA target sequence
aaactcaatggtactacatcc

SEQ ID NO: 23074 - DNA, 21 bp, Artificial sequence
  SiRNA target sequence
aactcaatggtactacatcca

SEQ ID NO: 23075 - DNA, 21 bp, Artificial sequence
  SiRNA target sequence
actcaatggtactacatccaa

SEQ ID NO: 23076 - DNA, 21 bp, Artificial sequence
  SiRNA target sequence
ctcaatggtactacatccaat

SEQ ID NO: 23077 - DNA, 21 bp, Artificial sequence
  SiRNA target sequence
tcaatggtactacatccaata

SEQ ID NO: 23078 - DNA, 21 bp, Artificial sequence
  SiRNA target sequence
caatggtactacatccaataa

SEQ ID NO: 23079 - DNA, 21 bp, Artificial sequence
  SiRNA target sequence
aatggtactacatccaataat

SEQ ID NO: 23080 - DNA, 21 bp, Artificial sequence
  SiRNA target sequence
atggtactacatccaataata

SEQ ID NO: 23081 - DNA, 21 bp, Artificial sequence
  SiRNA target sequence
tggtactacatccaataatag

SEQ ID NO: 23082 - DNA, 21 bp, Artificial sequence
  SiRNA target sequence
ggtactacatccaataatagg

SEQ ID NO: 23083 - DNA, 21 bp, Artificial sequence
  SiRNA target sequence
gtactacatccaataatagga

SEQ ID NO: 23084 - DNA, 21 bp, Artificial sequence
  SiRNA target sequence
tactacatccaataataggac

SEQ ID NO: 23085 - DNA, 21 bp, Artificial sequence
  SiRNA target sequence
actacatccaataataggaca

SEQ ID NO: 23086 - DNA, 21 bp, Artificial sequence
  SiRNA target sequence
ctacatccaataataggacat

SEQ ID NO: 23087 - DNA, 21 bp, Artificial sequence
  SiRNA target sequence
tacatccaataataggacatc

SEQ ID NO: 23088 - DNA, 21 bp, Artificial sequence
  SiRNA target sequence
acatccaataataggacatct

SEQ ID NO: 23089 - DNA, 21 bp, Artificial sequence
  SiRNA target sequence
catccaataataggacatctt

SEQ ID NO: 23090 - DNA, 21 bp, Artificial sequence
  SiRNA target sequence
atccaataataggacatcttt

SEQ ID NO: 23091 - DNA, 21 bp, Artificial sequence
  SiRNA target sequence
tccaataataggacatctttt

SEQ ID NO: 23092 - DNA, 21 bp, Artificial sequence
  SiRNA target sequence
ccaataataggacatctttta

SEQ ID NO: 23093 - DNA, 21 bp, Artificial sequence
  SiRNA target sequence
caataataggacatcttttat

SEQ ID NO: 23094 - DNA, 21 bp, Artificial sequence
  SiRNA target sequence
aataataggacatcttttatt

SEQ ID NO: 23095 - DNA, 21 bp, Artificial sequence
  SiRNA target sequence
ataataggacatcttttattt

SEQ ID NO: 23096 - DNA, 21 bp, Artificial sequence
  SiRNA target sequence
taataggacatcttttatttt

SEQ ID NO: 23097 - DNA, 21 bp, Artificial sequence
  SiRNA target sequence
aataggacatcttttattttt

SEQ ID NO: 23098 - DNA, 21 bp, Artificial sequence
  SiRNA target sequence
ataggacatcttttatttttc

SEQ ID NO: 23099 - DNA, 21 bp, Artificial sequence
  SiRNA target sequence
taggacatcttttatttttcc

SEQ ID NO: 23100 - DNA, 21 bp, Artificial sequence
  SiRNA target sequence
aggacatcttttatttttcct

SEQ ID NO: 23101 - DNA, 21 bp, Artificial sequence
  SiRNA target sequence
ggacatcttttatttttcctt

SEQ ID NO: 23102 - DNA, 21 bp, Artificial sequence
  SiRNA target sequence
gacatcttttatttttccttc

SEQ ID NO: 23103 - DNA, 21 bp, Artificial sequence
  SiRNA target sequence
acatcttttatttttccttct

SEQ ID NO: 23104 - DNA, 21 bp, Artificial sequence
  SiRNA target sequence
catcttttatttttccttcta

SEQ ID NO: 23105 - DNA, 21 bp, Artificial sequence
  SiRNA target sequence
atcttttatttttccttctaa

SEQ ID NO: 23106 - DNA, 21 bp, Artificial sequence
  SiRNA target sequence
tcttttatttttccttctaac

SEQ ID NO: 23107 - DNA, 21 bp, Artificial sequence
  SiRNA target sequence
cttttatttttccttctaaca

SEQ ID NO: 23108 - DNA, 21 bp, Artificial sequence
  SiRNA target sequence
ttttatttttccttctaacac

SEQ ID NO: 23109 - DNA, 21 bp, Artificial sequence
  SiRNA target sequence
tttatttttccttctaacacg

SEQ ID NO: 23110 - DNA, 21 bp, Artificial sequence
  SiRNA target sequence
ttatttttccttctaacacgc

SEQ ID NO: 23111 - DNA, 21 bp, Artificial sequence
  SiRNA target sequence
tatttttccttctaacacgcc

SEQ ID NO: 23112 - DNA, 21 bp, Artificial sequence
  SiRNA target sequence
atttttccttctaacacgcct

SEQ ID NO: 23113 - DNA, 21 bp, Artificial sequence
  SiRNA target sequence
tttttccttctaacacgcctg

SEQ ID NO: 23114 - DNA, 21 bp, Artificial sequence
  SiRNA target sequence
ttttccttctaacacgcctgc

SEQ ID NO: 23115 - DNA, 21 bp, Artificial sequence
  SiRNA target sequence
tttccttctaacacgcctgct

SEQ ID NO: 23116 - DNA, 21 bp, Artificial sequence
  SiRNA target sequence
ttccttctaacacgcctgctt

SEQ ID NO: 23117 - DNA, 21 bp, Artificial sequence
  SiRNA target sequence
tccttctaacacgcctgcttg

SEQ ID NO: 23118 - DNA, 21 bp, Artificial sequence
  SiRNA target sequence
ccttctaacacgcctgcttgt

SEQ ID NO: 23119 - DNA, 21 bp, Artificial sequence
  SiRNA target sequence
cttctaacacgcctgcttgta

SEQ ID NO: 23120 - DNA, 21 bp, Artificial sequence
  SiRNA target sequence
ttctaacacgcctgcttgtag

SEQ ID NO: 23121 - DNA, 21 bp, Artificial sequence
  SiRNA target sequence
tctaacacgcctgcttgtaga

SEQ ID NO: 23122 - DNA, 21 bp, Artificial sequence
  SiRNA target sequence
ctaacacgcctgcttgtagag

SEQ ID NO: 23123 - DNA, 21 bp, Artificial sequence
  SiRNA target sequence
taacacgcctgcttgtagagc

SEQ ID NO: 23124 - DNA, 21 bp, Artificial sequence
  SiRNA target sequence
aacacgcctgcttgtagagcg

SEQ ID NO: 23125 - DNA, 21 bp, Artificial sequence
  SiRNA target sequence
acacgcctgcttgtagagcgg

SEQ ID NO: 23126 - DNA, 21 bp, Artificial sequence
  SiRNA target sequence
cacgcctgcttgtagagcggc

SEQ ID NO: 23127 - DNA, 21 bp, Artificial sequence
  SiRNA target sequence
acgcctgcttgtagagcggcc

SEQ ID NO: 23128 - DNA, 21 bp, Artificial sequence
  SiRNA target sequence
cgcctgcttgtagagcggccc

SEQ ID NO: 23129 - DNA, 21 bp, Artificial sequence
  SiRNA target sequence
gcctgcttgtagagcggcccc

SEQ ID NO: 23130 - DNA, 21 bp, Artificial sequence
  SiRNA target sequence
cctgcttgtagagcggcccct

SEQ ID NO: 23131 - DNA, 21 bp, Artificial sequence
  SiRNA target sequence
ctgcttgtagagcggcccctt

SEQ ID NO: 23132 - DNA, 21 bp, Artificial sequence
  SiRNA target sequence
tgcttgtagagcggccccttt

SEQ ID NO: 23133 - DNA, 21 bp, Artificial sequence
  SiRNA target sequence
gcttgtagagcggccccttta

SEQ ID NO: 23134 - DNA, 21 bp, Artificial sequence
  SiRNA target sequence
cttgtagagcggcccctttag

SEQ ID NO: 23135 - DNA, 21 bp, Artificial sequence
  SiRNA target sequence
ttgtagagcggcccctttagc

SEQ ID NO: 23136 - DNA, 21 bp, Artificial sequence
  SiRNA target sequence
tgtagagcggcccctttagca

SEQ ID NO: 23137 - DNA, 21 bp, Artificial sequence
  SiRNA target sequence
gtagagcggcccctttagcaa

SEQ ID NO: 23138 - DNA, 21 bp, Artificial sequence
  SiRNA target sequence
tagagcggcccctttagcaac

SEQ ID NO: 23139 - DNA, 21 bp, Artificial sequence
  SiRNA target sequence
agagcggcccctttagcaaca

SEQ ID NO: 23140 - DNA, 21 bp, Artificial sequence
  SiRNA target sequence
gagcggcccctttagcaacag

SEQ ID NO: 23141 - DNA, 21 bp, Artificial sequence
  SiRNA target sequence
agcggcccctttagcaacagc

SEQ ID NO: 23142 - DNA, 21 bp, Artificial sequence
  SiRNA target sequence
gcggcccctttagcaacagct

SEQ ID NO: 23143 - DNA, 21 bp, Artificial sequence
  SiRNA target sequence
cggcccctttagcaacagctt

SEQ ID NO: 23144 - DNA, 21 bp, Artificial sequence
  SiRNA target sequence
ggcccctttagcaacagcttc

SEQ ID NO: 23145 - DNA, 21 bp, Artificial sequence
  SiRNA target sequence
gcccctttagcaacagcttca

SEQ ID NO: 23146 - DNA, 21 bp, Artificial sequence
  SiRNA target sequence
cccctttagcaacagcttcat

SEQ ID NO: 23147 - DNA, 21 bp, Artificial sequence
  SiRNA target sequence
ccctttagcaacagcttcatc

SEQ ID NO: 23148 - DNA, 21 bp, Artificial sequence
  SiRNA target sequence
cctttagcaacagcttcatct

SEQ ID NO: 23149 - DNA, 21 bp, Artificial sequence
  SiRNA target sequence
ctttagcaacagcttcatctg

SEQ ID NO: 23150 - DNA, 21 bp, Artificial sequence
  SiRNA target sequence
tttagcaacagcttcatctgg

SEQ ID NO: 23151 - DNA, 21 bp, Artificial sequence
  SiRNA target sequence
ttagcaacagcttcatctgga

SEQ ID NO: 23152 - DNA, 21 bp, Artificial sequence
  SiRNA target sequence
tagcaacagcttcatctggat

SEQ ID NO: 23153 - DNA, 21 bp, Artificial sequence
  SiRNA target sequence
agcaacagcttcatctggatt

SEQ ID NO: 23154 - DNA, 21 bp, Artificial sequence
  SiRNA target sequence
gcaacagcttcatctggatta

SEQ ID NO: 23155 - DNA, 21 bp, Artificial sequence
  SiRNA target sequence
caacagcttcatctggattaa

SEQ ID NO: 23156 - DNA, 21 bp, Artificial sequence
  SiRNA target sequence
aacagcttcatctggattaat

SEQ ID NO: 23157 - DNA, 21 bp, Artificial sequence
  SiRNA target sequence
acagcttcatctggattaata

SEQ ID NO: 23158 - DNA, 21 bp, Artificial sequence
  SiRNA target sequence
cagcttcatctggattaatat

SEQ ID NO: 23159 - DNA, 21 bp, Artificial sequence
  SiRNA target sequence
agcttcatctggattaatatt

SEQ ID NO: 23160 - DNA, 21 bp, Artificial sequence
  SiRNA target sequence
gcttcatctggattaatattt

SEQ ID NO: 23161 - DNA, 21 bp, Artificial sequence
  SiRNA target sequence
cttcatctggattaatatttg

SEQ ID NO: 23162 - DNA, 21 bp, Artificial sequence
  SiRNA target sequence
ttcatctggattaatatttgt

SEQ ID NO: 23163 - DNA, 21 bp, Artificial sequence
  SiRNA target sequence
tcatctggattaatatttgta

SEQ ID NO: 23164 - DNA, 21 bp, Artificial sequence
  SiRNA target sequence
catctggattaatatttgtag

SEQ ID NO: 23165 - DNA, 21 bp, Artificial sequence
  SiRNA target sequence
atctggattaatatttgtaga

SEQ ID NO: 23166 - DNA, 21 bp, Artificial sequence
  SiRNA target sequence
tctggattaatatttgtagaa

SEQ ID NO: 23167 - DNA, 21 bp, Artificial sequence
  SiRNA target sequence
ctggattaatatttgtagaag

SEQ ID NO: 23168 - DNA, 21 bp, Artificial sequence
  SiRNA target sequence
tggattaatatttgtagaagg

SEQ ID NO: 23169 - DNA, 21 bp, Artificial sequence
  SiRNA target sequence
ggattaatatttgtagaaggc

SEQ ID NO: 23170 - DNA, 21 bp, Artificial sequence
  SiRNA target sequence
gattaatatttgtagaaggct

SEQ ID NO: 23171 - DNA, 21 bp, Artificial sequence
  SiRNA target sequence
attaatatttgtagaaggctc

SEQ ID NO: 23172 - DNA, 21 bp, Artificial sequence
  SiRNA target sequence
ttaatatttgtagaaggctcg

SEQ ID NO: 23173 - DNA, 21 bp, Artificial sequence
  SiRNA target sequence
taatatttgtagaaggctcga

SEQ ID NO: 23174 - DNA, 21 bp, Artificial sequence
  SiRNA target sequence
aatatttgtagaaggctcgat

SEQ ID NO: 23175 - DNA, 21 bp, Artificial sequence
  SiRNA target sequence
atatttgtagaaggctcgata

SEQ ID NO: 23176 - DNA, 21 bp, Artificial sequence
  SiRNA target sequence
tatttgtagaaggctcgatac

SEQ ID NO: 23177 - DNA, 21 bp, Artificial sequence
  SiRNA target sequence
atttgtagaaggctcgatacc

SEQ ID NO: 23178 - DNA, 21 bp, Artificial sequence
  SiRNA target sequence
tttgtagaaggctcgatacca

SEQ ID NO: 23179 - DNA, 21 bp, Artificial sequence
  SiRNA target sequence
ttgtagaaggctcgataccaa

SEQ ID NO: 23180 - DNA, 21 bp, Artificial sequence
  SiRNA target sequence
tgtagaaggctcgataccaaa

SEQ ID NO: 23181 - DNA, 21 bp, Artificial sequence
  SiRNA target sequence
gtagaaggctcgataccaaaa

SEQ ID NO: 23182 - DNA, 21 bp, Artificial sequence
  SiRNA target sequence
tagaaggctcgataccaaaaa

SEQ ID NO: 23183 - DNA, 21 bp, Artificial sequence
  SiRNA target sequence
agaaggctcgataccaaaaat

SEQ ID NO: 23184 - DNA, 21 bp, Artificial sequence
  SiRNA target sequence
gaaggctcgataccaaaaatc

SEQ ID NO: 23185 - DNA, 21 bp, Artificial sequence
  SiRNA target sequence
aaggctcgataccaaaaatct

SEQ ID NO: 23186 - DNA, 21 bp, Artificial sequence
  SiRNA target sequence
aggctcgataccaaaaatctt

SEQ ID NO: 23187 - DNA, 21 bp, Artificial sequence
  SiRNA target sequence
ggctcgataccaaaaatcttc

SEQ ID NO: 23188 - DNA, 21 bp, Artificial sequence
  SiRNA target sequence
gctcgataccaaaaatcttct

SEQ ID NO: 23189 - DNA, 21 bp, Artificial sequence
  SiRNA target sequence
ctcgataccaaaaatcttctt

SEQ ID NO: 23190 - DNA, 21 bp, Artificial sequence
  SiRNA target sequence
tcgataccaaaaatcttctta

SEQ ID NO: 23191 - DNA, 21 bp, Artificial sequence
  SiRNA target sequence
cgataccaaaaatcttcttaa

SEQ ID NO: 23192 - DNA, 21 bp, Artificial sequence
  SiRNA target sequence
gataccaaaaatcttcttaac

SEQ ID NO: 23193 - DNA, 21 bp, Artificial sequence
  SiRNA target sequence
ataccaaaaatcttcttaaca

SEQ ID NO: 23194 - DNA, 21 bp, Artificial sequence
  SiRNA target sequence
taccaaaaatcttcttaacaa

SEQ ID NO: 23195 - DNA, 21 bp, Artificial sequence
  SiRNA target sequence
accaaaaatcttcttaacaag

SEQ ID NO: 23196 - DNA, 21 bp, Artificial sequence
  SiRNA target sequence
ccaaaaatcttcttaacaagt

SEQ ID NO: 23197 - DNA, 21 bp, Artificial sequence
  SiRNA target sequence
caaaaatcttcttaacaagtt

SEQ ID NO: 23198 - DNA, 21 bp, Artificial sequence
  SiRNA target sequence
aaaaatcttcttaacaagttt

SEQ ID NO: 23199 - DNA, 21 bp, Artificial sequence
  SiRNA target sequence
aaaatcttcttaacaagtttt

SEQ ID NO: 23200 - DNA, 21 bp, Artificial sequence
  SiRNA target sequence
aaatcttcttaacaagttttc

SEQ ID NO: 23201 - DNA, 21 bp, Artificial sequence
  SiRNA target sequence
aatcttcttaacaagttttct

SEQ ID NO: 23202 - DNA, 21 bp, Artificial sequence
  SiRNA target sequence
atcttcttaacaagttttcta

SEQ ID NO: 23203 - DNA, 21 bp, Artificial sequence
  SiRNA target sequence
tcttcttaacaagttttctaa

SEQ ID NO: 23204 - DNA, 21 bp, Artificial sequence
  SiRNA target sequence
cttcttaacaagttttctaac

SEQ ID NO: 23205 - DNA, 21 bp, Artificial sequence
  SiRNA target sequence
ttcttaacaagttttctaaca

SEQ ID NO: 23206 - DNA, 21 bp, Artificial sequence
  SiRNA target sequence
tcttaacaagttttctaacat

SEQ ID NO: 23207 - DNA, 21 bp, Artificial sequence
  SiRNA target sequence
cttaacaagttttctaacata

SEQ ID NO: 23208 - DNA, 21 bp, Artificial sequence
  SiRNA target sequence
ttaacaagttttctaacatac

SEQ ID NO: 23209 - DNA, 21 bp, Artificial sequence
  SiRNA target sequence
taacaagttttctaacatacg

SEQ ID NO: 23210 - DNA, 21 bp, Artificial sequence
  SiRNA target sequence
aacaagttttctaacatacgg

SEQ ID NO: 23211 - DNA, 21 bp, Artificial sequence
  SiRNA target sequence
acaagttttctaacatacggc

SEQ ID NO: 23212 - DNA, 21 bp, Artificial sequence
  SiRNA target sequence
caagttttctaacatacggca

SEQ ID NO: 23213 - DNA, 21 bp, Artificial sequence
  SiRNA target sequence
aagttttctaacatacggcat

SEQ ID NO: 23214 - DNA, 21 bp, Artificial sequence
  SiRNA target sequence
agttttctaacatacggcatt

SEQ ID NO: 23215 - DNA, 21 bp, Artificial sequence
  SiRNA target sequence
gttttctaacatacggcattc

SEQ ID NO: 23216 - DNA, 21 bp, Artificial sequence
  SiRNA target sequence
ttttctaacatacggcattcg

SEQ ID NO: 23217 - DNA, 21 bp, Artificial sequence
  SiRNA target sequence
tttctaacatacggcattcgt

SEQ ID NO: 23218 - DNA, 21 bp, Artificial sequence
  SiRNA target sequence
ttctaacatacggcattcgtg

SEQ ID NO: 23219 - DNA, 21 bp, Artificial sequence
  SiRNA target sequence
tctaacatacggcattcgtgt

SEQ ID NO: 23220 - DNA, 21 bp, Artificial sequence
  SiRNA target sequence
ctaacatacggcattcgtgtc

SEQ ID NO: 23221 - DNA, 21 bp, Artificial sequence
  SiRNA target sequence
taacatacggcattcgtgtca

SEQ ID NO: 23222 - DNA, 21 bp, Artificial sequence
  SiRNA target sequence
aacatacggcattcgtgtcat

SEQ ID NO: 23223 - DNA, 21 bp, Artificial sequence
  SiRNA target sequence
acatacggcattcgtgtcatt

SEQ ID NO: 23224 - DNA, 21 bp, Artificial sequence
  SiRNA target sequence
catacggcattcgtgtcattc

SEQ ID NO: 23225 - DNA, 21 bp, Artificial sequence
  SiRNA target sequence
atacggcattcgtgtcattcc

SEQ ID NO: 23226 - DNA, 21 bp, Artificial sequence
  SiRNA target sequence
tacggcattcgtgtcattcca

SEQ ID NO: 23227 - DNA, 21 bp, Artificial sequence
  SiRNA target sequence
acggcattcgtgtcattccac

SEQ ID NO: 23228 - DNA, 21 bp, Artificial sequence
  SiRNA target sequence
cggcattcgtgtcattccacc

SEQ ID NO: 23229 - DNA, 21 bp, Artificial sequence
  SiRNA target sequence
ggcattcgtgtcattccaccc

SEQ ID NO: 23230 - DNA, 21 bp, Artificial sequence
  SiRNA target sequence
gcattcgtgtcattccaccca

SEQ ID NO: 23231 - DNA, 21 bp, Artificial sequence
  SiRNA target sequence
cattcgtgtcattccacccac

SEQ ID NO: 23232 - DNA, 21 bp, Artificial sequence
  SiRNA target sequence
attcgtgtcattccacccaca

SEQ ID NO: 23233 - DNA, 21 bp, Artificial sequence
  SiRNA target sequence
ttcgtgtcattccacccacaa

SEQ ID NO: 23234 - DNA, 21 bp, Artificial sequence
  SiRNA target sequence
tcgtgtcattccacccacaag

SEQ ID NO: 23235 - DNA, 21 bp, Artificial sequence
  SiRNA target sequence
cgtgtcattccacccacaagt

SEQ ID NO: 23236 - DNA, 21 bp, Artificial sequence
  SiRNA target sequence
gtgtcattccacccacaagta

SEQ ID NO: 23237 - DNA, 21 bp, Artificial sequence
  SiRNA target sequence
tgtcattccacccacaagtat

SEQ ID NO: 23238 - DNA, 21 bp, Artificial sequence
  SiRNA target sequence
gtcattccacccacaagtata

SEQ ID NO: 23239 - DNA, 21 bp, Artificial sequence
  SiRNA target sequence
tcattccacccacaagtataa

SEQ ID NO: 23240 - DNA, 21 bp, Artificial sequence
  SiRNA target sequence
cattccacccacaagtataac

SEQ ID NO: 23241 - DNA, 21 bp, Artificial sequence
  SiRNA target sequence
attccacccacaagtataacg

SEQ ID NO: 23242 - DNA, 21 bp, Artificial sequence
  SiRNA target sequence
ttccacccacaagtataacgt

SEQ ID NO: 23243 - DNA, 21 bp, Artificial sequence
  SiRNA target sequence
tccacccacaagtataacgtg

SEQ ID NO: 23244 - DNA, 21 bp, Artificial sequence
  SiRNA target sequence
ccacccacaagtataacgtgt

SEQ ID NO: 23245 - DNA, 21 bp, Artificial sequence
  SiRNA target sequence
cacccacaagtataacgtgtt

SEQ ID NO: 23246 - DNA, 21 bp, Artificial sequence
  SiRNA target sequence
acccacaagtataacgtgttt

SEQ ID NO: 23247 - DNA, 21 bp, Artificial sequence
  SiRNA target sequence
cccacaagtataacgtgttta

SEQ ID NO: 23248 - DNA, 21 bp, Artificial sequence
  SiRNA target sequence
ccacaagtataacgtgtttaa

SEQ ID NO: 23249 - DNA, 21 bp, Artificial sequence
  SiRNA target sequence
cacaagtataacgtgtttaat

SEQ ID NO: 23250 - DNA, 21 bp, Artificial sequence
  SiRNA target sequence
acaagtataacgtgtttaata

SEQ ID NO: 23251 - DNA, 21 bp, Artificial sequence
  SiRNA target sequence
caagtataacgtgtttaatat

SEQ ID NO: 23252 - DNA, 21 bp, Artificial sequence
  SiRNA target sequence
aagtataacgtgtttaatatc

SEQ ID NO: 23253 - DNA, 21 bp, Artificial sequence
  SiRNA target sequence
agtataacgtgtttaatatca

SEQ ID NO: 23254 - DNA, 21 bp, Artificial sequence
  SiRNA target sequence
gtataacgtgtttaatatcac

SEQ ID NO: 23255 - DNA, 21 bp, Artificial sequence
  SiRNA target sequence
tataacgtgtttaatatcact

SEQ ID NO: 23256 - DNA, 21 bp, Artificial sequence
  SiRNA target sequence
ataacgtgtttaatatcactt

SEQ ID NO: 23257 - DNA, 21 bp, Artificial sequence
  SiRNA target sequence
taacgtgtttaatatcacttt

SEQ ID NO: 23258 - DNA, 21 bp, Artificial sequence
  SiRNA target sequence
aacgtgtttaatatcactttt

SEQ ID NO: 23259 - DNA, 21 bp, Artificial sequence
  SiRNA target sequence
acgtgtttaatatcactttta

SEQ ID NO: 23260 - DNA, 21 bp, Artificial sequence
  SiRNA target sequence
cgtgtttaatatcacttttag

SEQ ID NO: 23261 - DNA, 21 bp, Artificial sequence
  SiRNA target sequence
gtgtttaatatcacttttagt

SEQ ID NO: 23262 - DNA, 21 bp, Artificial sequence
  SiRNA target sequence
tgtttaatatcacttttagtt

SEQ ID NO: 23263 - DNA, 21 bp, Artificial sequence
  SiRNA target sequence
gtttaatatcacttttagtta

SEQ ID NO: 23264 - DNA, 21 bp, Artificial sequence
  SiRNA target sequence
tttaatatcacttttagttat

SEQ ID NO: 23265 - DNA, 21 bp, Artificial sequence
  SiRNA target sequence
ttaatatcacttttagttata

SEQ ID NO: 23266 - DNA, 21 bp, Artificial sequence
  SiRNA target sequence
taatatcacttttagttatat

SEQ ID NO: 23267 - DNA, 21 bp, Artificial sequence
  SiRNA target sequence
aatatcacttttagttatatt

SEQ ID NO: 23268 - DNA, 21 bp, Artificial sequence
  SiRNA target sequence
atatcacttttagttatattg

SEQ ID NO: 23269 - DNA, 21 bp, Artificial sequence
  SiRNA target sequence
tatcacttttagttatattgg

SEQ ID NO: 23270 - DNA, 21 bp, Artificial sequence
  SiRNA target sequence
atcacttttagttatattggc

SEQ ID NO: 23271 - DNA, 21 bp, Artificial sequence
  SiRNA target sequence
tcacttttagttatattggca

SEQ ID NO: 23272 - DNA, 21 bp, Artificial sequence
  SiRNA target sequence
cacttttagttatattggcat

SEQ ID NO: 23273 - DNA, 21 bp, Artificial sequence
  SiRNA target sequence
acttttagttatattggcatc

SEQ ID NO: 23274 - DNA, 21 bp, Artificial sequence
  SiRNA target sequence
cttttagttatattggcatct

SEQ ID NO: 23275 - DNA, 21 bp, Artificial sequence
  SiRNA target sequence
ttttagttatattggcatctc

SEQ ID NO: 23276 - DNA, 21 bp, Artificial sequence
  SiRNA target sequence
tttagttatattggcatctct

SEQ ID NO: 23277 - DNA, 21 bp, Artificial sequence
  SiRNA target sequence
ttagttatattggcatctcta

SEQ ID NO: 23278 - DNA, 21 bp, Artificial sequence
  SiRNA target sequence
tagttatattggcatctctaa

SEQ ID NO: 23279 - DNA, 21 bp, Artificial sequence
  SiRNA target sequence
agttatattggcatctctaat

SEQ ID NO: 23280 - DNA, 21 bp, Artificial sequence
  SiRNA target sequence
gttatattggcatctctaata

SEQ ID NO: 23281 - DNA, 21 bp, Artificial sequence
  SiRNA target sequence
ttatattggcatctctaatag

SEQ ID NO: 23282 - DNA, 21 bp, Artificial sequence
  SiRNA target sequence
tatattggcatctctaatagc

SEQ ID NO: 23283 - DNA, 21 bp, Artificial sequence
  SiRNA target sequence
atattggcatctctaatagct

SEQ ID NO: 23284 - DNA, 21 bp, Artificial sequence
  SiRNA target sequence
tattggcatctctaatagctt

SEQ ID NO: 23285 - DNA, 21 bp, Artificial sequence
  SiRNA target sequence
attggcatctctaatagcttt

SEQ ID NO: 23286 - DNA, 21 bp, Artificial sequence
  SiRNA target sequence
ttggcatctctaatagcttta

SEQ ID NO: 23287 - DNA, 21 bp, Artificial sequence
  SiRNA target sequence
tggcatctctaatagctttaa

SEQ ID NO: 23288 - DNA, 21 bp, Artificial sequence
  SiRNA target sequence
ggcatctctaatagctttaag

SEQ ID NO: 23289 - DNA, 21 bp, Artificial sequence
  SiRNA target sequence
gcatctctaatagctttaaga

SEQ ID NO: 23290 - DNA, 21 bp, Artificial sequence
  SiRNA target sequence
catctctaatagctttaagac

SEQ ID NO: 23291 - DNA, 21 bp, Artificial sequence
  SiRNA target sequence
atctctaatagctttaagaca

SEQ ID NO: 23292 - DNA, 21 bp, Artificial sequence
  SiRNA target sequence
tctctaatagctttaagacag

SEQ ID NO: 23293 - DNA, 21 bp, Artificial sequence
  SiRNA target sequence
ctctaatagctttaagacagg

SEQ ID NO: 23294 - DNA, 21 bp, Artificial sequence
  SiRNA target sequence
tctaatagctttaagacaggg

SEQ ID NO: 23295 - DNA, 21 bp, Artificial sequence
  SiRNA target sequence
ctaatagctttaagacagggg

SEQ ID NO: 23296 - DNA, 21 bp, Artificial sequence
  SiRNA target sequence
taatagctttaagacaggggt

SEQ ID NO: 23297 - DNA, 21 bp, Artificial sequence
  SiRNA target sequence
aatagctttaagacaggggtt

SEQ ID NO: 23298 - DNA, 21 bp, Artificial sequence
  SiRNA target sequence
atagctttaagacaggggttt

SEQ ID NO: 23299 - DNA, 21 bp, Artificial sequence
  SiRNA target sequence
tagctttaagacaggggttta

SEQ ID NO: 23300 - DNA, 21 bp, Artificial sequence
  SiRNA target sequence
agctttaagacaggggtttat

SEQ ID NO: 23301 - DNA, 21 bp, Artificial sequence
  SiRNA target sequence
gctttaagacaggggtttatt

SEQ ID NO: 23302 - DNA, 21 bp, Artificial sequence
  SiRNA target sequence
ctttaagacaggggtttattg

SEQ ID NO: 23303 - DNA, 21 bp, Artificial sequence
  SiRNA target sequence
tttaagacaggggtttattgt

SEQ ID NO: 23304 - DNA, 21 bp, Artificial sequence
  SiRNA target sequence
ttaagacaggggtttattgtt

SEQ ID NO: 23305 - DNA, 21 bp, Artificial sequence
  SiRNA target sequence
taagacaggggtttattgttt

SEQ ID NO: 23306 - DNA, 21 bp, Artificial sequence
  SiRNA target sequence
aagacaggggtttattgtttt

SEQ ID NO: 23307 - DNA, 21 bp, Artificial sequence
  SiRNA target sequence
agacaggggtttattgttttg

SEQ ID NO: 23308 - DNA, 21 bp, Artificial sequence
  SiRNA target sequence
gacaggggtttattgttttgt

SEQ ID NO: 23309 - DNA, 21 bp, Artificial sequence
  SiRNA target sequence
acaggggtttattgttttgtc

SEQ ID NO: 23310 - DNA, 21 bp, Artificial sequence
  SiRNA target sequence
caggggtttattgttttgtct

SEQ ID NO: 23311 - DNA, 21 bp, Artificial sequence
  SiRNA target sequence
aggggtttattgttttgtcta

SEQ ID NO: 23312 - DNA, 21 bp, Artificial sequence
  SiRNA target sequence
ggggtttattgttttgtctat

SEQ ID NO: 23313 - DNA, 21 bp, Artificial sequence
  SiRNA target sequence
gggtttattgttttgtctatt

SEQ ID NO: 23314 - DNA, 21 bp, Artificial sequence
  SiRNA target sequence
ggtttattgttttgtctatta

SEQ ID NO: 23315 - DNA, 21 bp, Artificial sequence
  SiRNA target sequence
gtttattgttttgtctattaa

SEQ ID NO: 23316 - DNA, 21 bp, Artificial sequence
  SiRNA target sequence
tttattgttttgtctattaac

SEQ ID NO: 23317 - DNA, 21 bp, Artificial sequence
  SiRNA target sequence
ttattgttttgtctattaact

SEQ ID NO: 23318 - DNA, 21 bp, Artificial sequence
  SiRNA target sequence
tattgttttgtctattaactt

SEQ ID NO: 23319 - DNA, 21 bp, Artificial sequence
  SiRNA target sequence
attgttttgtctattaacttt

SEQ ID NO: 23320 - DNA, 21 bp, Artificial sequence
  SiRNA target sequence
ttgttttgtctattaactttt

SEQ ID NO: 23321 - DNA, 21 bp, Artificial sequence
  SiRNA target sequence
tgttttgtctattaacttttt

SEQ ID NO: 23322 - DNA, 21 bp, Artificial sequence
  SiRNA target sequence
gttttgtctattaactttttt

SEQ ID NO: 23323 - DNA, 21 bp, Artificial sequence
  SiRNA target sequence
ttttgtctattaacttttttg

SEQ ID NO: 23324 - DNA, 21 bp, Artificial sequence
  SiRNA target sequence
tttgtctattaacttttttgt

SEQ ID NO: 23325 - DNA, 21 bp, Artificial sequence
  SiRNA target sequence
ttgtctattaacttttttgta

SEQ ID NO: 23326 - DNA, 21 bp, Artificial sequence
  SiRNA target sequence
tgtctattaacttttttgtaa

SEQ ID NO: 23327 - DNA, 21 bp, Artificial sequence
  SiRNA target sequence
gtctattaacttttttgtaat

SEQ ID NO: 23328 - DNA, 21 bp, Artificial sequence
  SiRNA target sequence
tctattaacttttttgtaatt

SEQ ID NO: 23329 - DNA, 21 bp, Artificial sequence
  SiRNA target sequence
ctattaacttttttgtaattt

SEQ ID NO: 23330 - DNA, 21 bp, Artificial sequence
  SiRNA target sequence
tattaacttttttgtaatttt

SEQ ID NO: 23331 - DNA, 21 bp, Artificial sequence
  SiRNA target sequence
attaacttttttgtaattttt

SEQ ID NO: 23332 - DNA, 21 bp, Artificial sequence
  SiRNA target sequence
ttaacttttttgtaatttttt

SEQ ID NO: 23333 - DNA, 21 bp, Artificial sequence
  SiRNA target sequence
taacttttttgtaattttttc

SEQ ID NO: 23334 - DNA, 21 bp, Artificial sequence
  SiRNA target sequence
aacttttttgtaattttttca

SEQ ID NO: 23335 - DNA, 21 bp, Artificial sequence
  SiRNA target sequence
acttttttgtaattttttcaa

SEQ ID NO: 23336 - DNA, 21 bp, Artificial sequence
  SiRNA target sequence
cttttttgtaattttttcaaa

SEQ ID NO: 23337 - DNA, 21 bp, Artificial sequence
  SiRNA target sequence
ttttttgtaattttttcaaat

SEQ ID NO: 23338 - DNA, 21 bp, Artificial sequence
  SiRNA target sequence
tttttgtaattttttcaaatt

SEQ ID NO: 23339 - DNA, 21 bp, Artificial sequence
  SiRNA target sequence
ttttgtaattttttcaaattc

SEQ ID NO: 23340 - DNA, 21 bp, Artificial sequence
  SiRNA target sequence
tttgtaattttttcaaattcg

SEQ ID NO: 23341 - DNA, 21 bp, Artificial sequence
  SiRNA target sequence
ttgtaattttttcaaattcgt

SEQ ID NO: 23342 - DNA, 21 bp, Artificial sequence
  SiRNA target sequence
tgtaattttttcaaattcgtc

SEQ ID NO: 23343 - DNA, 21 bp, Artificial sequence
  SiRNA target sequence
gtaattttttcaaattcgtcg

SEQ ID NO: 23344 - DNA, 21 bp, Artificial sequence
  SiRNA target sequence
taattttttcaaattcgtcgc

SEQ ID NO: 23345 - DNA, 21 bp, Artificial sequence
  SiRNA target sequence
aattttttcaaattcgtcgcg

SEQ ID NO: 23346 - DNA, 21 bp, Artificial sequence
  SiRNA target sequence
attttttcaaattcgtcgcgt

SEQ ID NO: 23347 - DNA, 21 bp, Artificial sequence
  SiRNA target sequence
ttttttcaaattcgtcgcgtg

SEQ ID NO: 23348 - DNA, 21 bp, Artificial sequence
  SiRNA target sequence
tttttcaaattcgtcgcgtgt

SEQ ID NO: 23349 - DNA, 21 bp, Artificial sequence
  SiRNA target sequence
ttttcaaattcgtcgcgtgta

SEQ ID NO: 23350 - DNA, 21 bp, Artificial sequence
  SiRNA target sequence
tttcaaattcgtcgcgtgtaa

SEQ ID NO: 23351 - DNA, 21 bp, Artificial sequence
  SiRNA target sequence
ttcaaattcgtcgcgtgtaat

SEQ ID NO: 23352 - DNA, 21 bp, Artificial sequence
  SiRNA target sequence
tcaaattcgtcgcgtgtaatt

SEQ ID NO: 23353 - DNA, 21 bp, Artificial sequence
  SiRNA target sequence
caaattcgtcgcgtgtaatta

SEQ ID NO: 23354 - DNA, 21 bp, Artificial sequence
  SiRNA target sequence
aaattcgtcgcgtgtaattac

SEQ ID NO: 23355 - DNA, 21 bp, Artificial sequence
  SiRNA target sequence
aattcgtcgcgtgtaattacc

SEQ ID NO: 23356 - DNA, 21 bp, Artificial sequence
  SiRNA target sequence
attcgtcgcgtgtaattacct

SEQ ID NO: 23357 - DNA, 21 bp, Artificial sequence
  SiRNA target sequence
ttcgtcgcgtgtaattacctc

SEQ ID NO: 23358 - DNA, 21 bp, Artificial sequence
  SiRNA target sequence
tcgtcgcgtgtaattacctct

SEQ ID NO: 23359 - DNA, 21 bp, Artificial sequence
  SiRNA target sequence
cgtcgcgtgtaattacctctt

SEQ ID NO: 23360 - DNA, 21 bp, Artificial sequence
  SiRNA target sequence
gtcgcgtgtaattacctcttt

SEQ ID NO: 23361 - DNA, 21 bp, Artificial sequence
  SiRNA target sequence
tcgcgtgtaattacctctttt

SEQ ID NO: 23362 - DNA, 21 bp, Artificial sequence
  SiRNA target sequence
cgcgtgtaattacctctttta

SEQ ID NO: 23363 - DNA, 21 bp, Artificial sequence
  SiRNA target sequence
gcgtgtaattacctcttttaa

SEQ ID NO: 23364 - DNA, 21 bp, Artificial sequence
  SiRNA target sequence
cgtgtaattacctcttttaag

SEQ ID NO: 23365 - DNA, 21 bp, Artificial sequence
  SiRNA target sequence
gtgtaattacctcttttaagt

SEQ ID NO: 23366 - DNA, 21 bp, Artificial sequence
  SiRNA target sequence
tgtaattacctcttttaagtg

SEQ ID NO: 23367 - DNA, 21 bp, Artificial sequence
  SiRNA target sequence
gtaattacctcttttaagtga

SEQ ID NO: 23368 - DNA, 21 bp, Artificial sequence
  SiRNA target sequence
taattacctcttttaagtgat

SEQ ID NO: 23369 - DNA, 21 bp, Artificial sequence
  SiRNA target sequence
aattacctcttttaagtgata

SEQ ID NO: 23370 - DNA, 21 bp, Artificial sequence
  SiRNA target sequence
attacctcttttaagtgataa

SEQ ID NO: 23371 - DNA, 21 bp, Artificial sequence
  SiRNA target sequence
ttacctcttttaagtgataat

SEQ ID NO: 23372 - DNA, 21 bp, Artificial sequence
  SiRNA target sequence
tacctcttttaagtgataatt

SEQ ID NO: 23373 - DNA, 21 bp, Artificial sequence
  SiRNA target sequence
acctcttttaagtgataattc

SEQ ID NO: 23374 - DNA, 21 bp, Artificial sequence
  SiRNA target sequence
cctcttttaagtgataattct

SEQ ID NO: 23375 - DNA, 21 bp, Artificial sequence
  SiRNA target sequence
ctcttttaagtgataattctt

SEQ ID NO: 23376 - DNA, 21 bp, Artificial sequence
  SiRNA target sequence
tcttttaagtgataattcttt

SEQ ID NO: 23377 - DNA, 21 bp, Artificial sequence
  SiRNA target sequence
cttttaagtgataattctttt

SEQ ID NO: 23378 - DNA, 21 bp, Artificial sequence
  SiRNA target sequence
ttttaagtgataattcttttt

SEQ ID NO: 23379 - DNA, 21 bp, Artificial sequence
  SiRNA target sequence
tttaagtgataattcttttta

SEQ ID NO: 23380 - DNA, 21 bp, Artificial sequence
  SiRNA target sequence
ttaagtgataattctttttac

SEQ ID NO: 23381 - DNA, 21 bp, Artificial sequence
  SiRNA target sequence
taagtgataattctttttact

SEQ ID NO: 23382 - DNA, 21 bp, Artificial sequence
  SiRNA target sequence
aagtgataattctttttacta

SEQ ID NO: 23383 - DNA, 21 bp, Artificial sequence
  SiRNA target sequence
agtgataattctttttactat

SEQ ID NO: 23384 - DNA, 21 bp, Artificial sequence
  SiRNA target sequence
gtgataattctttttactatc

SEQ ID NO: 23385 - DNA, 21 bp, Artificial sequence
  SiRNA target sequence
tgataattctttttactatcg

SEQ ID NO: 23386 - DNA, 21 bp, Artificial sequence
  SiRNA target sequence
gataattctttttactatcgt

SEQ ID NO: 23387 - DNA, 21 bp, Artificial sequence
  SiRNA target sequence
ataattctttttactatcgtt

SEQ ID NO: 23388 - DNA, 21 bp, Artificial sequence
  SiRNA target sequence
taattctttttactatcgtta

SEQ ID NO: 23389 - DNA, 21 bp, Artificial sequence
  SiRNA target sequence
aattctttttactatcgttat

SEQ ID NO: 23390 - DNA, 21 bp, Artificial sequence
  SiRNA target sequence
attctttttactatcgttata

SEQ ID NO: 23391 - DNA, 21 bp, Artificial sequence
  SiRNA target sequence
ttctttttactatcgttataa

SEQ ID NO: 23392 - DNA, 21 bp, Artificial sequence
  SiRNA target sequence
tctttttactatcgttataaa

SEQ ID NO: 23393 - DNA, 21 bp, Artificial sequence
  SiRNA target sequence
ctttttactatcgttataaat

SEQ ID NO: 23394 - DNA, 21 bp, Artificial sequence
  SiRNA target sequence
tttttactatcgttataaata

SEQ ID NO: 23395 - DNA, 21 bp, Artificial sequence
  SiRNA target sequence
ttttactatcgttataaatat

SEQ ID NO: 23396 - DNA, 21 bp, Artificial sequence
  SiRNA target sequence
tttactatcgttataaatata

SEQ ID NO: 23397 - DNA, 21 bp, Artificial sequence
  SiRNA target sequence
ttactatcgttataaatatac

SEQ ID NO: 23398 - DNA, 21 bp, Artificial sequence
  SiRNA target sequence
tactatcgttataaatatacg

SEQ ID NO: 23399 - DNA, 21 bp, Artificial sequence
  SiRNA target sequence
actatcgttataaatatacgg

SEQ ID NO: 23400 - DNA, 21 bp, Artificial sequence
  SiRNA target sequence
ctatcgttataaatatacgga

SEQ ID NO: 23401 - DNA, 21 bp, Artificial sequence
  SiRNA target sequence
tatcgttataaatatacggaa

SEQ ID NO: 23402 - DNA, 21 bp, Artificial sequence
  SiRNA target sequence
atcgttataaatatacggaat

SEQ ID NO: 23403 - DNA, 21 bp, Artificial sequence
  SiRNA target sequence
tcgttataaatatacggaata

SEQ ID NO: 23404 - DNA, 21 bp, Artificial sequence
  SiRNA target sequence
cgttataaatatacggaatat

SEQ ID NO: 23405 - DNA, 21 bp, Artificial sequence
  SiRNA target sequence
gttataaatatacggaatatt

SEQ ID NO: 23406 - DNA, 21 bp, Artificial sequence
  SiRNA target sequence
ttataaatatacggaatatta

SEQ ID NO: 23407 - DNA, 21 bp, Artificial sequence
  SiRNA target sequence
tataaatatacggaatattaa

SEQ ID NO: 23408 - DNA, 21 bp, Artificial sequence
  SiRNA target sequence
ataaatatacggaatattaat

SEQ ID NO: 23409 - DNA, 21 bp, Artificial sequence
  SiRNA target sequence
taaatatacggaatattaatt

SEQ ID NO: 23410 - DNA, 21 bp, Artificial sequence
  SiRNA target sequence
aaatatacggaatattaattt

SEQ ID NO: 23411 - DNA, 21 bp, Artificial sequence
  SiRNA target sequence
aatatacggaatattaatttc

SEQ ID NO: 23412 - DNA, 21 bp, Artificial sequence
  SiRNA target sequence
atatacggaatattaatttca

SEQ ID NO: 23413 - DNA, 21 bp, Artificial sequence
  SiRNA target sequence
tatacggaatattaatttcag

SEQ ID NO: 23414 - DNA, 21 bp, Artificial sequence
  SiRNA target sequence
atacggaatattaatttcaga

SEQ ID NO: 23415 - DNA, 21 bp, Artificial sequence
  SiRNA target sequence
tacggaatattaatttcagac

SEQ ID NO: 23416 - DNA, 21 bp, Artificial sequence
  SiRNA target sequence
acggaatattaatttcagacg

SEQ ID NO: 23417 - DNA, 21 bp, Artificial sequence
  SiRNA target sequence
cggaatattaatttcagacga

SEQ ID NO: 23418 - DNA, 21 bp, Artificial sequence
  SiRNA target sequence
ggaatattaatttcagacgaa

SEQ ID NO: 23419 - DNA, 21 bp, Artificial sequence
  SiRNA target sequence
gaatattaatttcagacgaaa

SEQ ID NO: 23420 - DNA, 21 bp, Artificial sequence
  SiRNA target sequence
aatattaatttcagacgaaag

SEQ ID NO: 23421 - DNA, 21 bp, Artificial sequence
  SiRNA target sequence
atattaatttcagacgaaaga

SEQ ID NO: 23422 - DNA, 21 bp, Artificial sequence
  SiRNA target sequence
tattaatttcagacgaaagat

SEQ ID NO: 23423 - DNA, 21 bp, Artificial sequence
  SiRNA target sequence
attaatttcagacgaaagatt

SEQ ID NO: 23424 - DNA, 21 bp, Artificial sequence
  SiRNA target sequence
ttaatttcagacgaaagatta

SEQ ID NO: 23425 - DNA, 21 bp, Artificial sequence
  SiRNA target sequence
taatttcagacgaaagattag

SEQ ID NO: 23426 - DNA, 21 bp, Artificial sequence
  SiRNA target sequence
aatttcagacgaaagattaga

SEQ ID NO: 23427 - DNA, 21 bp, Artificial sequence
  SiRNA target sequence
atttcagacgaaagattagac

SEQ ID NO: 23428 - DNA, 21 bp, Artificial sequence
  SiRNA target sequence
tttcagacgaaagattagacg

SEQ ID NO: 23429 - DNA, 21 bp, Artificial sequence
  SiRNA target sequence
ttcagacgaaagattagacga

SEQ ID NO: 23430 - DNA, 21 bp, Artificial sequence
  SiRNA target sequence
tcagacgaaagattagacgac

SEQ ID NO: 23431 - DNA, 21 bp, Artificial sequence
  SiRNA target sequence
cagacgaaagattagacgaca

SEQ ID NO: 23432 - DNA, 21 bp, Artificial sequence
  SiRNA target sequence
agacgaaagattagacgacag

SEQ ID NO: 23433 - DNA, 21 bp, Artificial sequence
  SiRNA target sequence
gacgaaagattagacgacagt

SEQ ID NO: 23434 - DNA, 21 bp, Artificial sequence
  SiRNA target sequence
acgaaagattagacgacagtt

SEQ ID NO: 23435 - DNA, 21 bp, Artificial sequence
  SiRNA target sequence
cgaaagattagacgacagttc

SEQ ID NO: 23436 - DNA, 21 bp, Artificial sequence
  SiRNA target sequence
gaaagattagacgacagttct

SEQ ID NO: 23437 - DNA, 21 bp, Artificial sequence
  SiRNA target sequence
aaagattagacgacagttctt

SEQ ID NO: 23438 - DNA, 21 bp, Artificial sequence
  SiRNA target sequence
aagattagacgacagttcttt

SEQ ID NO: 23439 - DNA, 21 bp, Artificial sequence
  SiRNA target sequence
agattagacgacagttctttt

SEQ ID NO: 23440 - DNA, 21 bp, Artificial sequence
  SiRNA target sequence
gattagacgacagttcttttt

SEQ ID NO: 23441 - DNA, 21 bp, Artificial sequence
  SiRNA target sequence
attagacgacagttctttttt

SEQ ID NO: 23442 - DNA, 21 bp, Artificial sequence
  SiRNA target sequence
ttagacgacagttcttttttc

SEQ ID NO: 23443 - DNA, 21 bp, Artificial sequence
  SiRNA target sequence
tagacgacagttcttttttca

SEQ ID NO: 23444 - DNA, 21 bp, Artificial sequence
  SiRNA target sequence
agacgacagttcttttttcat

SEQ ID NO: 23445 - DNA, 21 bp, Artificial sequence
  SiRNA target sequence
gacgacagttcttttttcatt

SEQ ID NO: 23446 - DNA, 21 bp, Artificial sequence
  SiRNA target sequence
acgacagttcttttttcattt

SEQ ID NO: 23447 - DNA, 21 bp, Artificial sequence
  SiRNA target sequence
cgacagttcttttttcatttt

SEQ ID NO: 23448 - DNA, 21 bp, Artificial sequence
  SiRNA target sequence
gacagttcttttttcattttt

SEQ ID NO: 23449 - DNA, 21 bp, Artificial sequence
  SiRNA target sequence
acagttcttttttcatttttt

SEQ ID NO: 23450 - DNA, 21 bp, Artificial sequence
  SiRNA target sequence
cagttcttttttcattttttc

SEQ ID NO: 23451 - DNA, 21 bp, Artificial sequence
  SiRNA target sequence
agttcttttttcattttttcc

SEQ ID NO: 23452 - DNA, 21 bp, Artificial sequence
  SiRNA target sequence
gttcttttttcattttttccg

SEQ ID NO: 23453 - DNA, 21 bp, Artificial sequence
  SiRNA target sequence
ttcttttttcattttttccgc

SEQ ID NO: 23454 - DNA, 21 bp, Artificial sequence
  SiRNA target sequence
tcttttttcattttttccgct

SEQ ID NO: 23455 - DNA, 21 bp, Artificial sequence
  SiRNA target sequence
cttttttcattttttccgctg

SEQ ID NO: 23456 - DNA, 21 bp, Artificial sequence
  SiRNA target sequence
ttttttcattttttccgctgc

SEQ ID NO: 23457 - DNA, 21 bp, Artificial sequence
  SiRNA target sequence
tttttcattttttccgctgct

SEQ ID NO: 23458 - DNA, 21 bp, Artificial sequence
  SiRNA target sequence
ttttcattttttccgctgctt

SEQ ID NO: 23459 - DNA, 21 bp, Artificial sequence
  SiRNA target sequence
tttcattttttccgctgcttc

SEQ ID NO: 23460 - DNA, 21 bp, Artificial sequence
  SiRNA target sequence
ttcattttttccgctgcttct

SEQ ID NO: 23461 - DNA, 21 bp, Artificial sequence
  SiRNA target sequence
tcattttttccgctgcttctt

SEQ ID NO: 23462 - DNA, 21 bp, Artificial sequence
  SiRNA target sequence
cattttttccgctgcttcttt

SEQ ID NO: 23463 - DNA, 21 bp, Artificial sequence
  SiRNA target sequence
attttttccgctgcttcttta

SEQ ID NO: 23464 - DNA, 21 bp, Artificial sequence
  SiRNA target sequence
ttttttccgctgcttctttaa

SEQ ID NO: 23465 - DNA, 21 bp, Artificial sequence
  SiRNA target sequence
tttttccgctgcttctttaat

SEQ ID NO: 23466 - DNA, 21 bp, Artificial sequence
  SiRNA target sequence
ttttccgctgcttctttaatt

SEQ ID NO: 23467 - DNA, 21 bp, Artificial sequence
  SiRNA target sequence
tttccgctgcttctttaattc

SEQ ID NO: 23468 - DNA, 21 bp, Artificial sequence
  SiRNA target sequence
ttccgctgcttctttaattct

SEQ ID NO: 23469 - DNA, 21 bp, Artificial sequence
  SiRNA target sequence
tccgctgcttctttaattcta

SEQ ID NO: 23470 - DNA, 21 bp, Artificial sequence
  SiRNA target sequence
ccgctgcttctttaattctat

SEQ ID NO: 23471 - DNA, 21 bp, Artificial sequence
  SiRNA target sequence
cgctgcttctttaattctatt

SEQ ID NO: 23472 - DNA, 21 bp, Artificial sequence
  SiRNA target sequence
gctgcttctttaattctatta

SEQ ID NO: 23473 - DNA, 21 bp, Artificial sequence
  SiRNA target sequence
ctgcttctttaattctattat

SEQ ID NO: 23474 - DNA, 21 bp, Artificial sequence
  SiRNA target sequence
tgcttctttaattctattata

SEQ ID NO: 23475 - DNA, 21 bp, Artificial sequence
  SiRNA target sequence
gcttctttaattctattataa

SEQ ID NO: 23476 - DNA, 21 bp, Artificial sequence
  SiRNA target sequence
cttctttaattctattataac

SEQ ID NO: 23477 - DNA, 21 bp, Artificial sequence
  SiRNA target sequence
ttctttaattctattataaca

SEQ ID NO: 23478 - DNA, 21 bp, Artificial sequence
  SiRNA target sequence
tctttaattctattataacaa

SEQ ID NO: 23479 - DNA, 21 bp, Artificial sequence
  SiRNA target sequence
ctttaattctattataacaag

SEQ ID NO: 23480 - DNA, 21 bp, Artificial sequence
  SiRNA target sequence
tttaattctattataacaaga

SEQ ID NO: 23481 - DNA, 21 bp, Artificial sequence
  SiRNA target sequence
ttaattctattataacaagaa

SEQ ID NO: 23482 - DNA, 21 bp, Artificial sequence
  SiRNA target sequence
taattctattataacaagaat

SEQ ID NO: 23483 - DNA, 21 bp, Artificial sequence
  SiRNA target sequence
aattctattataacaagaatc

SEQ ID NO: 23484 - DNA, 21 bp, Artificial sequence
  SiRNA target sequence
attctattataacaagaatcg

SEQ ID NO: 23485 - DNA, 21 bp, Artificial sequence
  SiRNA target sequence
ttctattataacaagaatcgt

SEQ ID NO: 23486 - DNA, 21 bp, Artificial sequence
  SiRNA target sequence
tctattataacaagaatcgtg

SEQ ID NO: 23487 - DNA, 21 bp, Artificial sequence
  SiRNA target sequence
ctattataacaagaatcgtgt

SEQ ID NO: 23488 - DNA, 21 bp, Artificial sequence
  SiRNA target sequence
tattataacaagaatcgtgtt

SEQ ID NO: 23489 - DNA, 21 bp, Artificial sequence
  SiRNA target sequence
attataacaagaatcgtgttt

SEQ ID NO: 23490 - DNA, 21 bp, Artificial sequence
  SiRNA target sequence
ttataacaagaatcgtgttta

SEQ ID NO: 23491 - DNA, 21 bp, Artificial sequence
  SiRNA target sequence
tataacaagaatcgtgtttaa

SEQ ID NO: 23492 - DNA, 21 bp, Artificial sequence
  SiRNA target sequence
ataacaagaatcgtgtttaag

SEQ ID NO: 23493 - DNA, 21 bp, Artificial sequence
  SiRNA target sequence
taacaagaatcgtgtttaagt

SEQ ID NO: 23494 - DNA, 21 bp, Artificial sequence
  SiRNA target sequence
aacaagaatcgtgtttaagta

SEQ ID NO: 23495 - DNA, 21 bp, Artificial sequence
  SiRNA target sequence
acaagaatcgtgtttaagtaa

SEQ ID NO: 23496 - DNA, 21 bp, Artificial sequence
  SiRNA target sequence
caagaatcgtgtttaagtaaa

SEQ ID NO: 23497 - DNA, 21 bp, Artificial sequence
  SiRNA target sequence
aagaatcgtgtttaagtaaat

SEQ ID NO: 23498 - DNA, 21 bp, Artificial sequence
  SiRNA target sequence
agaatcgtgtttaagtaaatc

SEQ ID NO: 23499 - DNA, 21 bp, Artificial sequence
  SiRNA target sequence
gaatcgtgtttaagtaaatca

SEQ ID NO: 23500 - DNA, 21 bp, Artificial sequence
  SiRNA target sequence
aatcgtgtttaagtaaatcaa

SEQ ID NO: 23501 - DNA, 21 bp, Artificial sequence
  SiRNA target sequence
atcgtgtttaagtaaatcaat

SEQ ID NO: 23502 - DNA, 21 bp, Artificial sequence
  SiRNA target sequence
tcgtgtttaagtaaatcaatt

SEQ ID NO: 23503 - DNA, 21 bp, Artificial sequence
  SiRNA target sequence
cgtgtttaagtaaatcaattc

SEQ ID NO: 23504 - DNA, 21 bp, Artificial sequence
  SiRNA target sequence
gtgtttaagtaaatcaattcc

SEQ ID NO: 23505 - DNA, 21 bp, Artificial sequence
  SiRNA target sequence
tgtttaagtaaatcaattcct

SEQ ID NO: 23506 - DNA, 21 bp, Artificial sequence
  SiRNA target sequence
gtttaagtaaatcaattcctg

SEQ ID NO: 23507 - DNA, 21 bp, Artificial sequence
  SiRNA target sequence
tttaagtaaatcaattcctgt

SEQ ID NO: 23508 - DNA, 21 bp, Artificial sequence
  SiRNA target sequence
ttaagtaaatcaattcctgtt

SEQ ID NO: 23509 - DNA, 21 bp, Artificial sequence
  SiRNA target sequence
taagtaaatcaattcctgttc

SEQ ID NO: 23510 - DNA, 21 bp, Artificial sequence
  SiRNA target sequence
aagtaaatcaattcctgttct

SEQ ID NO: 23511 - DNA, 21 bp, Artificial sequence
  SiRNA target sequence
agtaaatcaattcctgttcta

SEQ ID NO: 23512 - DNA, 21 bp, Artificial sequence
  SiRNA target sequence
gtaaatcaattcctgttctac

SEQ ID NO: 23513 - DNA, 21 bp, Artificial sequence
  SiRNA target sequence
taaatcaattcctgttctact

SEQ ID NO: 23514 - DNA, 21 bp, Artificial sequence
  SiRNA target sequence
aaatcaattcctgttctactt

SEQ ID NO: 23515 - DNA, 21 bp, Artificial sequence
  SiRNA target sequence
aatcaattcctgttctacttt

SEQ ID NO: 23516 - DNA, 21 bp, Artificial sequence
  SiRNA target sequence
atcaattcctgttctactttt

SEQ ID NO: 23517 - DNA, 21 bp, Artificial sequence
  SiRNA target sequence
tcaattcctgttctactttta

SEQ ID NO: 23518 - DNA, 21 bp, Artificial sequence
  SiRNA target sequence
caattcctgttctacttttaa

SEQ ID NO: 23519 - DNA, 21 bp, Artificial sequence
  SiRNA target sequence
aattcctgttctacttttaaa

SEQ ID NO: 23520 - DNA, 21 bp, Artificial sequence
  SiRNA target sequence
attcctgttctacttttaaat

SEQ ID NO: 23521 - DNA, 21 bp, Artificial sequence
  SiRNA target sequence
ttcctgttctacttttaaatt

SEQ ID NO: 23522 - DNA, 21 bp, Artificial sequence
  SiRNA target sequence
tcctgttctacttttaaattt

SEQ ID NO: 23523 - DNA, 21 bp, Artificial sequence
  SiRNA target sequence
cctgttctacttttaaatttt

SEQ ID NO: 23524 - DNA, 21 bp, Artificial sequence
  SiRNA target sequence
ctgttctacttttaaattttt

SEQ ID NO: 23525 - DNA, 21 bp, Artificial sequence
  SiRNA target sequence
tgttctacttttaaatttttc

SEQ ID NO: 23526 - DNA, 21 bp, Artificial sequence
  SiRNA target sequence
gttctacttttaaatttttca

SEQ ID NO: 23527 - DNA, 21 bp, Artificial sequence
  SiRNA target sequence
ttctacttttaaatttttcat

SEQ ID NO: 23528 - DNA, 21 bp, Artificial sequence
  SiRNA target sequence
tctacttttaaatttttcatt

SEQ ID NO: 23529 - DNA, 21 bp, Artificial sequence
  SiRNA target sequence
ctacttttaaatttttcatta

SEQ ID NO: 23530 - DNA, 21 bp, Artificial sequence
  SiRNA target sequence
tacttttaaatttttcattaa

SEQ ID NO: 23531 - DNA, 21 bp, Artificial sequence
  SiRNA target sequence
acttttaaatttttcattaat

SEQ ID NO: 23532 - DNA, 21 bp, Artificial sequence
  SiRNA target sequence
cttttaaatttttcattaata

SEQ ID NO: 23533 - DNA, 21 bp, Artificial sequence
  SiRNA target sequence
ttttaaatttttcattaatat

SEQ ID NO: 23534 - DNA, 21 bp, Artificial sequence
  SiRNA target sequence
tttaaatttttcattaatata

SEQ ID NO: 23535 - DNA, 21 bp, Artificial sequence
  SiRNA target sequence
ttaaatttttcattaatataa

SEQ ID NO: 23536 - DNA, 21 bp, Artificial sequence
  SiRNA target sequence
taaatttttcattaatataat

SEQ ID NO: 23537 - DNA, 21 bp, Artificial sequence
  SiRNA target sequence
aaatttttcattaatataatc

SEQ ID NO: 23538 - DNA, 21 bp, Artificial sequence
  SiRNA target sequence
aatttttcattaatataatct

SEQ ID NO: 23539 - DNA, 21 bp, Artificial sequence
  SiRNA target sequence
atttttcattaatataatcta

SEQ ID NO: 23540 - DNA, 21 bp, Artificial sequence
  SiRNA target sequence
tttttcattaatataatctac

SEQ ID NO: 23541 - DNA, 21 bp, Artificial sequence
  SiRNA target sequence
ttttcattaatataatctact

SEQ ID NO: 23542 - DNA, 21 bp, Artificial sequence
  SiRNA target sequence
tttcattaatataatctacta

SEQ ID NO: 23543 - DNA, 21 bp, Artificial sequence
  SiRNA target sequence
ttcattaatataatctactaa

SEQ ID NO: 23544 - DNA, 21 bp, Artificial sequence
  SiRNA target sequence
tcattaatataatctactaaa

SEQ ID NO: 23545 - DNA, 21 bp, Artificial sequence
  SiRNA target sequence
cattaatataatctactaaag

SEQ ID NO: 23546 - DNA, 21 bp, Artificial sequence
  SiRNA target sequence
attaatataatctactaaagt

SEQ ID NO: 23547 - DNA, 21 bp, Artificial sequence
  SiRNA target sequence
ttaatataatctactaaagta

SEQ ID NO: 23548 - DNA, 21 bp, Artificial sequence
  SiRNA target sequence
taatataatctactaaagtat

SEQ ID NO: 23549 - DNA, 21 bp, Artificial sequence
  SiRNA target sequence
aatataatctactaaagtatt

SEQ ID NO: 23550 - DNA, 21 bp, Artificial sequence
  SiRNA target sequence
atataatctactaaagtatta

SEQ ID NO: 23551 - DNA, 21 bp, Artificial sequence
  SiRNA target sequence
tataatctactaaagtattat

SEQ ID NO: 23552 - DNA, 21 bp, Artificial sequence
  SiRNA target sequence
ataatctactaaagtattatc

SEQ ID NO: 23553 - DNA, 21 bp, Artificial sequence
  SiRNA target sequence
taatctactaaagtattatcc

SEQ ID NO: 23554 - DNA, 21 bp, Artificial sequence
  SiRNA target sequence
aatctactaaagtattatcca

SEQ ID NO: 23555 - DNA, 21 bp, Artificial sequence
  SiRNA target sequence
atctactaaagtattatccaa

SEQ ID NO: 23556 - DNA, 21 bp, Artificial sequence
  SiRNA target sequence
tctactaaagtattatccaaa

SEQ ID NO: 23557 - DNA, 21 bp, Artificial sequence
  SiRNA target sequence
ctactaaagtattatccaaat

SEQ ID NO: 23558 - DNA, 21 bp, Artificial sequence
  SiRNA target sequence
tactaaagtattatccaaatc

SEQ ID NO: 23559 - DNA, 21 bp, Artificial sequence
  SiRNA target sequence
actaaagtattatccaaatct

SEQ ID NO: 23560 - DNA, 21 bp, Artificial sequence
  SiRNA target sequence
ctaaagtattatccaaatctt

SEQ ID NO: 23561 - DNA, 21 bp, Artificial sequence
  SiRNA target sequence
taaagtattatccaaatcttc

SEQ ID NO: 23562 - DNA, 21 bp, Artificial sequence
  SiRNA target sequence
aaagtattatccaaatcttct

SEQ ID NO: 23563 - DNA, 21 bp, Artificial sequence
  SiRNA target sequence
aagtattatccaaatcttctc

SEQ ID NO: 23564 - DNA, 21 bp, Artificial sequence
  SiRNA target sequence
agtattatccaaatcttctcc

SEQ ID NO: 23565 - DNA, 21 bp, Artificial sequence
  SiRNA target sequence
gtattatccaaatcttctcct

SEQ ID NO: 23566 - DNA, 21 bp, Artificial sequence
  SiRNA target sequence
tattatccaaatcttctcctc

SEQ ID NO: 23567 - DNA, 21 bp, Artificial sequence
  SiRNA target sequence
attatccaaatcttctcctcc

SEQ ID NO: 23568 - DNA, 21 bp, Artificial sequence
  SiRNA target sequence
ttatccaaatcttctcctcct

SEQ ID NO: 23569 - DNA, 21 bp, Artificial sequence
  SiRNA target sequence
tatccaaatcttctcctccta

SEQ ID NO: 23570 - DNA, 21 bp, Artificial sequence
  SiRNA target sequence
atccaaatcttctcctcctaa

SEQ ID NO: 23571 - DNA, 21 bp, Artificial sequence
  SiRNA target sequence
tccaaatcttctcctcctaaa

SEQ ID NO: 23572 - DNA, 21 bp, Artificial sequence
  SiRNA target sequence
ccaaatcttctcctcctaaaa

SEQ ID NO: 23573 - DNA, 21 bp, Artificial sequence
  SiRNA target sequence
caaatcttctcctcctaaaaa

SEQ ID NO: 23574 - DNA, 21 bp, Artificial sequence
  SiRNA target sequence
aaatcttctcctcctaaaaaa

SEQ ID NO: 23575 - DNA, 21 bp, Artificial sequence
  SiRNA target sequence
aatcttctcctcctaaaaaag

SEQ ID NO: 23576 - DNA, 21 bp, Artificial sequence
  SiRNA target sequence
atcttctcctcctaaaaaagt

SEQ ID NO: 23577 - DNA, 21 bp, Artificial sequence
  SiRNA target sequence
tcttctcctcctaaaaaagta

SEQ ID NO: 23578 - DNA, 21 bp, Artificial sequence
  SiRNA target sequence
cttctcctcctaaaaaagtat

SEQ ID NO: 23579 - DNA, 21 bp, Artificial sequence
  SiRNA target sequence
ttctcctcctaaaaaagtatt

SEQ ID NO: 23580 - DNA, 21 bp, Artificial sequence
  SiRNA target sequence
tctcctcctaaaaaagtattt

SEQ ID NO: 23581 - DNA, 21 bp, Artificial sequence
  SiRNA target sequence
ctcctcctaaaaaagtatttc

SEQ ID NO: 23582 - DNA, 21 bp, Artificial sequence
  SiRNA target sequence
tcctcctaaaaaagtatttcc

SEQ ID NO: 23583 - DNA, 21 bp, Artificial sequence
  SiRNA target sequence
cctcctaaaaaagtatttccg

SEQ ID NO: 23584 - DNA, 21 bp, Artificial sequence
  SiRNA target sequence
ctcctaaaaaagtatttccgt

SEQ ID NO: 23585 - DNA, 21 bp, Artificial sequence
  SiRNA target sequence
tcctaaaaaagtatttccgtt

SEQ ID NO: 23586 - DNA, 21 bp, Artificial sequence
  SiRNA target sequence
cctaaaaaagtatttccgtta

SEQ ID NO: 23587 - DNA, 21 bp, Artificial sequence
  SiRNA target sequence
ctaaaaaagtatttccgttag

SEQ ID NO: 23588 - DNA, 21 bp, Artificial sequence
  SiRNA target sequence
taaaaaagtatttccgttagt

SEQ ID NO: 23589 - DNA, 21 bp, Artificial sequence
  SiRNA target sequence
aaaaaagtatttccgttagta

SEQ ID NO: 23590 - DNA, 21 bp, Artificial sequence
  SiRNA target sequence
aaaaagtatttccgttagtag

SEQ ID NO: 23591 - DNA, 21 bp, Artificial sequence
  SiRNA target sequence
aaaagtatttccgttagtaga

SEQ ID NO: 23592 - DNA, 21 bp, Artificial sequence
  SiRNA target sequence
aaagtatttccgttagtagat

SEQ ID NO: 23593 - DNA, 21 bp, Artificial sequence
  SiRNA target sequence
aagtatttccgttagtagatt

SEQ ID NO: 23594 - DNA, 21 bp, Artificial sequence
  SiRNA target sequence
agtatttccgttagtagattt

SEQ ID NO: 23595 - DNA, 21 bp, Artificial sequence
  SiRNA target sequence
gtatttccgttagtagatttt

SEQ ID NO: 23596 - DNA, 21 bp, Artificial sequence
  SiRNA target sequence
tatttccgttagtagatttta

SEQ ID NO: 23597 - DNA, 21 bp, Artificial sequence
  SiRNA target sequence
atttccgttagtagattttac

SEQ ID NO: 23598 - DNA, 21 bp, Artificial sequence
  SiRNA target sequence
tttccgttagtagattttaca

SEQ ID NO: 23599 - DNA, 21 bp, Artificial sequence
  SiRNA target sequence
ttccgttagtagattttacat

SEQ ID NO: 23600 - DNA, 21 bp, Artificial sequence
  SiRNA target sequence
tccgttagtagattttacatg

SEQ ID NO: 23601 - DNA, 21 bp, Artificial sequence
  SiRNA target sequence
ccgttagtagattttacatga

SEQ ID NO: 23602 - DNA, 21 bp, Artificial sequence
  SiRNA target sequence
cgttagtagattttacatgaa

SEQ ID NO: 23603 - DNA, 21 bp, Artificial sequence
  SiRNA target sequence
gttagtagattttacatgaaa

SEQ ID NO: 23604 - DNA, 21 bp, Artificial sequence
  SiRNA target sequence
ttagtagattttacatgaaaa

SEQ ID NO: 23605 - DNA, 21 bp, Artificial sequence
  SiRNA target sequence
tagtagattttacatgaaaaa

SEQ ID NO: 23606 - DNA, 21 bp, Artificial sequence
  SiRNA target sequence
agtagattttacatgaaaaat

SEQ ID NO: 23607 - DNA, 21 bp, Artificial sequence
  SiRNA target sequence
gtagattttacatgaaaaata

SEQ ID NO: 23608 - DNA, 21 bp, Artificial sequence
  SiRNA target sequence
tagattttacatgaaaaatac

SEQ ID NO: 23609 - DNA, 21 bp, Artificial sequence
  SiRNA target sequence
agattttacatgaaaaatacc

SEQ ID NO: 23610 - DNA, 21 bp, Artificial sequence
  SiRNA target sequence
gattttacatgaaaaatacca

SEQ ID NO: 23611 - DNA, 21 bp, Artificial sequence
  SiRNA target sequence
attttacatgaaaaataccat

SEQ ID NO: 23612 - DNA, 21 bp, Artificial sequence
  SiRNA target sequence
ttttacatgaaaaataccatt

SEQ ID NO: 23613 - DNA, 21 bp, Artificial sequence
  SiRNA target sequence
tttacatgaaaaataccatta

SEQ ID NO: 23614 - DNA, 21 bp, Artificial sequence
  SiRNA target sequence
ttacatgaaaaataccattat

SEQ ID NO: 23615 - DNA, 21 bp, Artificial sequence
  SiRNA target sequence
tacatgaaaaataccattatc

SEQ ID NO: 23616 - DNA, 21 bp, Artificial sequence
  SiRNA target sequence
acatgaaaaataccattatct

SEQ ID NO: 23617 - DNA, 21 bp, Artificial sequence
  SiRNA target sequence
catgaaaaataccattatcta

SEQ ID NO: 23618 - DNA, 21 bp, Artificial sequence
  SiRNA target sequence
atgaaaaataccattatctaa

SEQ ID NO: 23619 - DNA, 21 bp, Artificial sequence
  SiRNA target sequence
tgaaaaataccattatctaat

SEQ ID NO: 23620 - DNA, 21 bp, Artificial sequence
  SiRNA target sequence
gaaaaataccattatctaatt

SEQ ID NO: 23621 - DNA, 21 bp, Artificial sequence
  SiRNA target sequence
aaaaataccattatctaattc

SEQ ID NO: 23622 - DNA, 21 bp, Artificial sequence
  SiRNA target sequence
aaaataccattatctaattct

SEQ ID NO: 23623 - DNA, 21 bp, Artificial sequence
  SiRNA target sequence
aaataccattatctaattcta

SEQ ID NO: 23624 - DNA, 21 bp, Artificial sequence
  SiRNA target sequence
aataccattatctaattctaa

SEQ ID NO: 23625 - DNA, 21 bp, Artificial sequence
  SiRNA target sequence
ataccattatctaattctaat

SEQ ID NO: 23626 - DNA, 21 bp, Artificial sequence
  SiRNA target sequence
taccattatctaattctaata

SEQ ID NO: 23627 - DNA, 21 bp, Artificial sequence
  SiRNA target sequence
accattatctaattctaatat

SEQ ID NO: 23628 - DNA, 21 bp, Artificial sequence
  SiRNA target sequence
ccattatctaattctaatata

SEQ ID NO: 23629 - DNA, 21 bp, Artificial sequence
  SiRNA target sequence
cattatctaattctaatatac

SEQ ID NO: 23630 - DNA, 21 bp, Artificial sequence
  SiRNA target sequence
attatctaattctaatatact

SEQ ID NO: 23631 - DNA, 21 bp, Artificial sequence
  SiRNA target sequence
ttatctaattctaatatacta

SEQ ID NO: 23632 - DNA, 21 bp, Artificial sequence
  SiRNA target sequence
tatctaattctaatatactaa

SEQ ID NO: 23633 - DNA, 21 bp, Artificial sequence
  SiRNA target sequence
atctaattctaatatactaat

SEQ ID NO: 23634 - DNA, 21 bp, Artificial sequence
  SiRNA target sequence
tctaattctaatatactaatg

SEQ ID NO: 23635 - DNA, 21 bp, Artificial sequence
  SiRNA target sequence
ctaattctaatatactaatgt

SEQ ID NO: 23636 - DNA, 21 bp, Artificial sequence
  SiRNA target sequence
taattctaatatactaatgtc

SEQ ID NO: 23637 - DNA, 21 bp, Artificial sequence
  SiRNA target sequence
aattctaatatactaatgtca

SEQ ID NO: 23638 - DNA, 21 bp, Artificial sequence
  SiRNA target sequence
attctaatatactaatgtcaa

SEQ ID NO: 23639 - DNA, 21 bp, Artificial sequence
  SiRNA target sequence
ttctaatatactaatgtcaaa

SEQ ID NO: 23640 - DNA, 21 bp, Artificial sequence
  SiRNA target sequence
tctaatatactaatgtcaaaa

SEQ ID NO: 23641 - DNA, 21 bp, Artificial sequence
  SiRNA target sequence
ctaatatactaatgtcaaaag

SEQ ID NO: 23642 - DNA, 21 bp, Artificial sequence
  SiRNA target sequence
taatatactaatgtcaaaagt

SEQ ID NO: 23643 - DNA, 21 bp, Artificial sequence
  SiRNA target sequence
aatatactaatgtcaaaagtt

SEQ ID NO: 23644 - DNA, 21 bp, Artificial sequence
  SiRNA target sequence
atatactaatgtcaaaagttc

SEQ ID NO: 23645 - DNA, 21 bp, Artificial sequence
  SiRNA target sequence
tatactaatgtcaaaagttcc

SEQ ID NO: 23646 - DNA, 21 bp, Artificial sequence
  SiRNA target sequence
atactaatgtcaaaagttcct

SEQ ID NO: 23647 - DNA, 21 bp, Artificial sequence
  SiRNA target sequence
tactaatgtcaaaagttcctc

SEQ ID NO: 23648 - DNA, 21 bp, Artificial sequence
  SiRNA target sequence
actaatgtcaaaagttcctcc

SEQ ID NO: 23649 - DNA, 21 bp, Artificial sequence
  SiRNA target sequence
ctaatgtcaaaagttcctcct

SEQ ID NO: 23650 - DNA, 21 bp, Artificial sequence
  SiRNA target sequence
taatgtcaaaagttcctcctc

SEQ ID NO: 23651 - DNA, 21 bp, Artificial sequence
  SiRNA target sequence
aatgtcaaaagttcctcctcc

SEQ ID NO: 23652 - DNA, 21 bp, Artificial sequence
  SiRNA target sequence
atgtcaaaagttcctcctccc

SEQ ID NO: 23653 - DNA, 21 bp, Artificial sequence
  SiRNA target sequence
tgtcaaaagttcctcctccca

SEQ ID NO: 23654 - DNA, 21 bp, Artificial sequence
  SiRNA target sequence
gtcaaaagttcctcctcccag

SEQ ID NO: 23655 - DNA, 21 bp, Artificial sequence
  SiRNA target sequence
tcaaaagttcctcctcccaga

SEQ ID NO: 23656 - DNA, 21 bp, Artificial sequence
  SiRNA target sequence
caaaagttcctcctcccagat

SEQ ID NO: 23657 - DNA, 21 bp, Artificial sequence
  SiRNA target sequence
aaaagttcctcctcccagatc

SEQ ID NO: 23658 - DNA, 21 bp, Artificial sequence
  SiRNA target sequence
aaagttcctcctcccagatca

SEQ ID NO: 23659 - DNA, 21 bp, Artificial sequence
  SiRNA target sequence
aagttcctcctcccagatcat

SEQ ID NO: 23660 - DNA, 21 bp, Artificial sequence
  SiRNA target sequence
agttcctcctcccagatcata

SEQ ID NO: 23661 - DNA, 21 bp, Artificial sequence
  SiRNA target sequence
gttcctcctcccagatcataa

SEQ ID NO: 23662 - DNA, 21 bp, Artificial sequence
  SiRNA target sequence
ttcctcctcccagatcataaa

SEQ ID NO: 23663 - DNA, 21 bp, Artificial sequence
  SiRNA target sequence
tcctcctcccagatcataaac

SEQ ID NO: 23664 - DNA, 21 bp, Artificial sequence
  SiRNA target sequence
cctcctcccagatcataaaca

SEQ ID NO: 23665 - DNA, 21 bp, Artificial sequence
  SiRNA target sequence
ctcctcccagatcataaacag

SEQ ID NO: 23666 - DNA, 21 bp, Artificial sequence
  SiRNA target sequence
tcctcccagatcataaacagc

SEQ ID NO: 23667 - DNA, 21 bp, Artificial sequence
  SiRNA target sequence
cctcccagatcataaacagct

SEQ ID NO: 23668 - DNA, 21 bp, Artificial sequence
  SiRNA target sequence
ctcccagatcataaacagcta

SEQ ID NO: 23669 - DNA, 21 bp, Artificial sequence
  SiRNA target sequence
tcccagatcataaacagctat

SEQ ID NO: 23670 - DNA, 21 bp, Artificial sequence
  SiRNA target sequence
cccagatcataaacagctata

SEQ ID NO: 23671 - DNA, 21 bp, Artificial sequence
  SiRNA target sequence
ccagatcataaacagctataa

SEQ ID NO: 23672 - DNA, 21 bp, Artificial sequence
  SiRNA target sequence
cagatcataaacagctataat

SEQ ID NO: 23673 - DNA, 21 bp, Artificial sequence
  SiRNA target sequence
agatcataaacagctataata

SEQ ID NO: 23674 - DNA, 21 bp, Artificial sequence
  SiRNA target sequence
gatcataaacagctataatac

SEQ ID NO: 23675 - DNA, 21 bp, Artificial sequence
  SiRNA target sequence
atcataaacagctataatacc

SEQ ID NO: 23676 - DNA, 21 bp, Artificial sequence
  SiRNA target sequence
tcataaacagctataataccc

SEQ ID NO: 23677 - DNA, 21 bp, Artificial sequence
  SiRNA target sequence
cataaacagctataataccct

SEQ ID NO: 23678 - DNA, 21 bp, Artificial sequence
  SiRNA target sequence
ataaacagctataataccctg

SEQ ID NO: 23679 - DNA, 21 bp, Artificial sequence
  SiRNA target sequence
taaacagctataataccctgt

SEQ ID NO: 23680 - DNA, 21 bp, Artificial sequence
  SiRNA target sequence
aaacagctataataccctgtg

SEQ ID NO: 23681 - DNA, 21 bp, Artificial sequence
  SiRNA target sequence
aacagctataataccctgtgc

SEQ ID NO: 23682 - DNA, 21 bp, Artificial sequence
  SiRNA target sequence
acagctataataccctgtgca

SEQ ID NO: 23683 - DNA, 21 bp, Artificial sequence
  SiRNA target sequence
cagctataataccctgtgcag

SEQ ID NO: 23684 - DNA, 21 bp, Artificial sequence
  SiRNA target sequence
agctataataccctgtgcaga

SEQ ID NO: 23685 - DNA, 21 bp, Artificial sequence
  SiRNA target sequence
gctataataccctgtgcagac

SEQ ID NO: 23686 - DNA, 21 bp, Artificial sequence
  SiRNA target sequence
ctataataccctgtgcagact

SEQ ID NO: 23687 - DNA, 21 bp, Artificial sequence
  SiRNA target sequence
tataataccctgtgcagactt

SEQ ID NO: 23688 - DNA, 21 bp, Artificial sequence
  SiRNA target sequence
ataataccctgtgcagacttg

SEQ ID NO: 23689 - DNA, 21 bp, Artificial sequence
  SiRNA target sequence
taataccctgtgcagacttgt

SEQ ID NO: 23690 - DNA, 21 bp, Artificial sequence
  SiRNA target sequence
aataccctgtgcagacttgtc

SEQ ID NO: 23691 - DNA, 21 bp, Artificial sequence
  SiRNA target sequence
ataccctgtgcagacttgtca

SEQ ID NO: 23692 - DNA, 21 bp, Artificial sequence
  SiRNA target sequence
taccctgtgcagacttgtcaa

SEQ ID NO: 23693 - DNA, 21 bp, Artificial sequence
  SiRNA target sequence
accctgtgcagacttgtcaag

SEQ ID NO: 23694 - DNA, 21 bp, Artificial sequence
  SiRNA target sequence
ccctgtgcagacttgtcaagc

SEQ ID NO: 23695 - DNA, 21 bp, Artificial sequence
  SiRNA target sequence
cctgtgcagacttgtcaagcc

SEQ ID NO: 23696 - DNA, 21 bp, Artificial sequence
  SiRNA target sequence
ctgtgcagacttgtcaagccc

SEQ ID NO: 23697 - DNA, 21 bp, Artificial sequence
  SiRNA target sequence
tgtgcagacttgtcaagccca

SEQ ID NO: 23698 - DNA, 21 bp, Artificial sequence
  SiRNA target sequence
gtgcagacttgtcaagcccat

SEQ ID NO: 23699 - DNA, 21 bp, Artificial sequence
  SiRNA target sequence
tgcagacttgtcaagcccata

SEQ ID NO: 23700 - DNA, 21 bp, Artificial sequence
  SiRNA target sequence
gcagacttgtcaagcccataa

SEQ ID NO: 23701 - DNA, 21 bp, Artificial sequence
  SiRNA target sequence
cagacttgtcaagcccataag

SEQ ID NO: 23702 - DNA, 21 bp, Artificial sequence
  SiRNA target sequence
agacttgtcaagcccataagc

SEQ ID NO: 23703 - DNA, 21 bp, Artificial sequence
  SiRNA target sequence
gacttgtcaagcccataagca

SEQ ID NO: 23704 - DNA, 21 bp, Artificial sequence
  SiRNA target sequence
acttgtcaagcccataagcaa

SEQ ID NO: 23705 - DNA, 21 bp, Artificial sequence
  SiRNA target sequence
cttgtcaagcccataagcaag

SEQ ID NO: 23706 - DNA, 21 bp, Artificial sequence
  SiRNA target sequence
ttgtcaagcccataagcaagt

SEQ ID NO: 23707 - DNA, 21 bp, Artificial sequence
  SiRNA target sequence
tgtcaagcccataagcaagtg

SEQ ID NO: 23708 - DNA, 21 bp, Artificial sequence
  SiRNA target sequence
gtcaagcccataagcaagtgc

SEQ ID NO: 23709 - DNA, 21 bp, Artificial sequence
  SiRNA target sequence
tcaagcccataagcaagtgct

SEQ ID NO: 23710 - DNA, 21 bp, Artificial sequence
  SiRNA target sequence
caagcccataagcaagtgctg

SEQ ID NO: 23711 - DNA, 21 bp, Artificial sequence
  SiRNA target sequence
aagcccataagcaagtgctgc

SEQ ID NO: 23712 - DNA, 21 bp, Artificial sequence
  SiRNA target sequence
agcccataagcaagtgctgcc

SEQ ID NO: 23713 - DNA, 21 bp, Artificial sequence
  SiRNA target sequence
gcccataagcaagtgctgccg

SEQ ID NO: 23714 - DNA, 21 bp, Artificial sequence
  SiRNA target sequence
cccataagcaagtgctgccgc

SEQ ID NO: 23715 - DNA, 21 bp, Artificial sequence
  SiRNA target sequence
ccataagcaagtgctgccgca

SEQ ID NO: 23716 - DNA, 21 bp, Artificial sequence
  SiRNA target sequence
cataagcaagtgctgccgcag

SEQ ID NO: 23717 - DNA, 21 bp, Artificial sequence
  SiRNA target sequence
ataagcaagtgctgccgcagt

SEQ ID NO: 23718 - DNA, 21 bp, Artificial sequence
  SiRNA target sequence
taagcaagtgctgccgcagta

SEQ ID NO: 23719 - DNA, 21 bp, Artificial sequence
  SiRNA target sequence
aagcaagtgctgccgcagtag

SEQ ID NO: 23720 - DNA, 21 bp, Artificial sequence
  SiRNA target sequence
agcaagtgctgccgcagtagg

SEQ ID NO: 23721 - DNA, 21 bp, Artificial sequence
  SiRNA target sequence
gcaagtgctgccgcagtaggc

SEQ ID NO: 23722 - DNA, 21 bp, Artificial sequence
  SiRNA target sequence
caagtgctgccgcagtaggct

SEQ ID NO: 23723 - DNA, 21 bp, Artificial sequence
  SiRNA target sequence
aagtgctgccgcagtaggctc

SEQ ID NO: 23724 - DNA, 21 bp, Artificial sequence
  SiRNA target sequence
agtgctgccgcagtaggctca

SEQ ID NO: 23725 - DNA, 21 bp, Artificial sequence
  SiRNA target sequence
gtgctgccgcagtaggctcat

SEQ ID NO: 23726 - DNA, 21 bp, Artificial sequence
  SiRNA target sequence
tgctgccgcagtaggctcatt

SEQ ID NO: 23727 - DNA, 21 bp, Artificial sequence
  SiRNA target sequence
gctgccgcagtaggctcatta

SEQ ID NO: 23728 - DNA, 21 bp, Artificial sequence
  SiRNA target sequence
ctgccgcagtaggctcattaa

SEQ ID NO: 23729 - DNA, 21 bp, Artificial sequence
  SiRNA target sequence
tgccgcagtaggctcattaat

SEQ ID NO: 23730 - DNA, 21 bp, Artificial sequence
  SiRNA target sequence
gccgcagtaggctcattaatc

SEQ ID NO: 23731 - DNA, 21 bp, Artificial sequence
  SiRNA target sequence
ccgcagtaggctcattaatca

SEQ ID NO: 23732 - DNA, 21 bp, Artificial sequence
  SiRNA target sequence
cgcagtaggctcattaatcac

SEQ ID NO: 23733 - DNA, 21 bp, Artificial sequence
  SiRNA target sequence
gcagtaggctcattaatcact

SEQ ID NO: 23734 - DNA, 21 bp, Artificial sequence
  SiRNA target sequence
cagtaggctcattaatcactc

SEQ ID NO: 23735 - DNA, 21 bp, Artificial sequence
  SiRNA target sequence
agtaggctcattaatcactct

SEQ ID NO: 23736 - DNA, 21 bp, Artificial sequence
  SiRNA target sequence
gtaggctcattaatcactcta

SEQ ID NO: 23737 - DNA, 21 bp, Artificial sequence
  SiRNA target sequence
taggctcattaatcactctaa

SEQ ID NO: 23738 - DNA, 21 bp, Artificial sequence
  SiRNA target sequence
aggctcattaatcactctaag

SEQ ID NO: 23739 - DNA, 21 bp, Artificial sequence
  SiRNA target sequence
ggctcattaatcactctaagc

SEQ ID NO: 23740 - DNA, 21 bp, Artificial sequence
  SiRNA target sequence
gctcattaatcactctaagca

SEQ ID NO: 23741 - DNA, 21 bp, Artificial sequence
  SiRNA target sequence
ctcattaatcactctaagcac

SEQ ID NO: 23742 - DNA, 21 bp, Artificial sequence
  SiRNA target sequence
tcattaatcactctaagcact

SEQ ID NO: 23743 - DNA, 21 bp, Artificial sequence
  SiRNA target sequence
cattaatcactctaagcactt

SEQ ID NO: 23744 - DNA, 21 bp, Artificial sequence
  SiRNA target sequence
attaatcactctaagcacttg

SEQ ID NO: 23745 - DNA, 21 bp, Artificial sequence
  SiRNA target sequence
ttaatcactctaagcacttgt

SEQ ID NO: 23746 - DNA, 21 bp, Artificial sequence
  SiRNA target sequence
taatcactctaagcacttgta

SEQ ID NO: 23747 - DNA, 21 bp, Artificial sequence
  SiRNA target sequence
aatcactctaagcacttgtaa

SEQ ID NO: 23748 - DNA, 21 bp, Artificial sequence
  SiRNA target sequence
atcactctaagcacttgtaat

SEQ ID NO: 23749 - DNA, 21 bp, Artificial sequence
  SiRNA target sequence
tcactctaagcacttgtaatc

SEQ ID NO: 23750 - DNA, 21 bp, Artificial sequence
  SiRNA target sequence
cactctaagcacttgtaatcc

SEQ ID NO: 23751 - DNA, 21 bp, Artificial sequence
  SiRNA target sequence
actctaagcacttgtaatccc

SEQ ID NO: 23752 - DNA, 21 bp, Artificial sequence
  SiRNA target sequence
ctctaagcacttgtaatcccg

SEQ ID NO: 23753 - DNA, 21 bp, Artificial sequence
  SiRNA target sequence
tctaagcacttgtaatcccgc

SEQ ID NO: 23754 - DNA, 21 bp, Artificial sequence
  SiRNA target sequence
ctaagcacttgtaatcccgca

SEQ ID NO: 23755 - DNA, 21 bp, Artificial sequence
  SiRNA target sequence
taagcacttgtaatcccgcaa

SEQ ID NO: 23756 - DNA, 21 bp, Artificial sequence
  SiRNA target sequence
aagcacttgtaatcccgcaat

SEQ ID NO: 23757 - DNA, 21 bp, Artificial sequence
  SiRNA target sequence
agcacttgtaatcccgcaatc

SEQ ID NO: 23758 - DNA, 21 bp, Artificial sequence
  SiRNA target sequence
gcacttgtaatcccgcaatcc

SEQ ID NO: 23759 - DNA, 21 bp, Artificial sequence
  SiRNA target sequence
cacttgtaatcccgcaatcct

SEQ ID NO: 23760 - DNA, 21 bp, Artificial sequence
  SiRNA target sequence
acttgtaatcccgcaatcctt

SEQ ID NO: 23761 - DNA, 21 bp, Artificial sequence
  SiRNA target sequence
cttgtaatcccgcaatccttc

SEQ ID NO: 23762 - DNA, 21 bp, Artificial sequence
  SiRNA target sequence
ttgtaatcccgcaatccttcc

SEQ ID NO: 23763 - DNA, 21 bp, Artificial sequence
  SiRNA target sequence
tgtaatcccgcaatccttccc

SEQ ID NO: 23764 - DNA, 21 bp, Artificial sequence
  SiRNA target sequence
gtaatcccgcaatccttcccg

SEQ ID NO: 23765 - DNA, 21 bp, Artificial sequence
  SiRNA target sequence
taatcccgcaatccttcccgc

SEQ ID NO: 23766 - DNA, 21 bp, Artificial sequence
  SiRNA target sequence
aatcccgcaatccttcccgca

SEQ ID NO: 23767 - DNA, 21 bp, Artificial sequence
  SiRNA target sequence
atcccgcaatccttcccgcat

SEQ ID NO: 23768 - DNA, 21 bp, Artificial sequence
  SiRNA target sequence
tcccgcaatccttcccgcatc

SEQ ID NO: 23769 - DNA, 21 bp, Artificial sequence
  SiRNA target sequence
cccgcaatccttcccgcatct

SEQ ID NO: 23770 - DNA, 21 bp, Artificial sequence
  SiRNA target sequence
ccgcaatccttcccgcatctt

SEQ ID NO: 23771 - DNA, 21 bp, Artificial sequence
  SiRNA target sequence
cgcaatccttcccgcatcttt

SEQ ID NO: 23772 - DNA, 21 bp, Artificial sequence
  SiRNA target sequence
gcaatccttcccgcatcttta

SEQ ID NO: 23773 - DNA, 21 bp, Artificial sequence
  SiRNA target sequence
caatccttcccgcatctttag

SEQ ID NO: 23774 - DNA, 21 bp, Artificial sequence
  SiRNA target sequence
aatccttcccgcatctttagt

SEQ ID NO: 23775 - DNA, 21 bp, Artificial sequence
  SiRNA target sequence
atccttcccgcatctttagta

SEQ ID NO: 23776 - DNA, 21 bp, Artificial sequence
  SiRNA target sequence
tccttcccgcatctttagtag

SEQ ID NO: 23777 - DNA, 21 bp, Artificial sequence
  SiRNA target sequence
ccttcccgcatctttagtagc

SEQ ID NO: 23778 - DNA, 21 bp, Artificial sequence
  SiRNA target sequence
cttcccgcatctttagtagct

SEQ ID NO: 23779 - DNA, 21 bp, Artificial sequence
  SiRNA target sequence
ttcccgcatctttagtagctt

SEQ ID NO: 23780 - DNA, 21 bp, Artificial sequence
  SiRNA target sequence
tcccgcatctttagtagcttg

SEQ ID NO: 23781 - DNA, 21 bp, Artificial sequence
  SiRNA target sequence
cccgcatctttagtagcttgc

SEQ ID NO: 23782 - DNA, 21 bp, Artificial sequence
  SiRNA target sequence
ccgcatctttagtagcttgcc

SEQ ID NO: 23783 - DNA, 21 bp, Artificial sequence
  SiRNA target sequence
cgcatctttagtagcttgcct

SEQ ID NO: 23784 - DNA, 21 bp, Artificial sequence
  SiRNA target sequence
gcatctttagtagcttgcctt

SEQ ID NO: 23785 - DNA, 21 bp, Artificial sequence
  SiRNA target sequence
catctttagtagcttgccttt

SEQ ID NO: 23786 - DNA, 21 bp, Artificial sequence
  SiRNA target sequence
atctttagtagcttgcctttg

SEQ ID NO: 23787 - DNA, 21 bp, Artificial sequence
  SiRNA target sequence
tctttagtagcttgcctttgc

SEQ ID NO: 23788 - DNA, 21 bp, Artificial sequence
  SiRNA target sequence
ctttagtagcttgcctttgca

SEQ ID NO: 23789 - DNA, 21 bp, Artificial sequence
  SiRNA target sequence
tttagtagcttgcctttgcat

SEQ ID NO: 23790 - DNA, 21 bp, Artificial sequence
  SiRNA target sequence
ttagtagcttgcctttgcatg

SEQ ID NO: 23791 - DNA, 21 bp, Artificial sequence
  SiRNA target sequence
tagtagcttgcctttgcatgt

SEQ ID NO: 23792 - DNA, 21 bp, Artificial sequence
  SiRNA target sequence
agtagcttgcctttgcatgtc

SEQ ID NO: 23793 - DNA, 21 bp, Artificial sequence
  SiRNA target sequence
gtagcttgcctttgcatgtca

SEQ ID NO: 23794 - DNA, 21 bp, Artificial sequence
  SiRNA target sequence
tagcttgcctttgcatgtcat

SEQ ID NO: 23795 - DNA, 21 bp, Artificial sequence
  SiRNA target sequence
agcttgcctttgcatgtcatc

SEQ ID NO: 23796 - DNA, 21 bp, Artificial sequence
  SiRNA target sequence
gcttgcctttgcatgtcatca

SEQ ID NO: 23797 - DNA, 21 bp, Artificial sequence
  SiRNA target sequence
cttgcctttgcatgtcatcaa

SEQ ID NO: 23798 - DNA, 21 bp, Artificial sequence
  SiRNA target sequence
ttgcctttgcatgtcatcaaa

SEQ ID NO: 23799 - DNA, 21 bp, Artificial sequence
  SiRNA target sequence
tgcctttgcatgtcatcaaaa

SEQ ID NO: 23800 - DNA, 21 bp, Artificial sequence
  SiRNA target sequence
gcctttgcatgtcatcaaaat

SEQ ID NO: 23801 - DNA, 21 bp, Artificial sequence
  SiRNA target sequence
cctttgcatgtcatcaaaata

SEQ ID NO: 23802 - DNA, 21 bp, Artificial sequence
  SiRNA target sequence
ctttgcatgtcatcaaaatat

SEQ ID NO: 23803 - DNA, 21 bp, Artificial sequence
  SiRNA target sequence
tttgcatgtcatcaaaatatg

SEQ ID NO: 23804 - DNA, 21 bp, Artificial sequence
  SiRNA target sequence
ttgcatgtcatcaaaatatgc

SEQ ID NO: 23805 - DNA, 21 bp, Artificial sequence
  SiRNA target sequence
tgcatgtcatcaaaatatgcg

SEQ ID NO: 23806 - DNA, 21 bp, Artificial sequence
  SiRNA target sequence
gcatgtcatcaaaatatgcgg

SEQ ID NO: 23807 - DNA, 21 bp, Artificial sequence
  SiRNA target sequence
catgtcatcaaaatatgcggg

SEQ ID NO: 23808 - DNA, 21 bp, Artificial sequence
  SiRNA target sequence
atgtcatcaaaatatgcgggc

SEQ ID NO: 23809 - DNA, 21 bp, Artificial sequence
  SiRNA target sequence
tgtcatcaaaatatgcgggca

SEQ ID NO: 23810 - DNA, 21 bp, Artificial sequence
  SiRNA target sequence
gtcatcaaaatatgcgggcac

SEQ ID NO: 23811 - DNA, 21 bp, Artificial sequence
  SiRNA target sequence
tcatcaaaatatgcgggcact

SEQ ID NO: 23812 - DNA, 21 bp, Artificial sequence
  SiRNA target sequence
catcaaaatatgcgggcactg

SEQ ID NO: 23813 - DNA, 21 bp, Artificial sequence
  SiRNA target sequence
atcaaaatatgcgggcactgt

SEQ ID NO: 23814 - DNA, 21 bp, Artificial sequence
  SiRNA target sequence
tcaaaatatgcgggcactgtt

SEQ ID NO: 23815 - DNA, 21 bp, Artificial sequence
  SiRNA target sequence
caaaatatgcgggcactgtta

SEQ ID NO: 23816 - DNA, 21 bp, Artificial sequence
  SiRNA target sequence
aaaatatgcgggcactgttat

SEQ ID NO: 23817 - DNA, 21 bp, Artificial sequence
  SiRNA target sequence
aaatatgcgggcactgttata

SEQ ID NO: 23818 - DNA, 21 bp, Artificial sequence
  SiRNA target sequence
aatatgcgggcactgttataa

SEQ ID NO: 23819 - DNA, 21 bp, Artificial sequence
  SiRNA target sequence
atatgcgggcactgttataac

SEQ ID NO: 23820 - DNA, 21 bp, Artificial sequence
  SiRNA target sequence
tatgcgggcactgttataaca

SEQ ID NO: 23821 - DNA, 21 bp, Artificial sequence
  SiRNA target sequence
atgcgggcactgttataacag

SEQ ID NO: 23822 - DNA, 21 bp, Artificial sequence
  SiRNA target sequence
tgcgggcactgttataacaga

SEQ ID NO: 23823 - DNA, 21 bp, Artificial sequence
  SiRNA target sequence
gcgggcactgttataacagat

SEQ ID NO: 23824 - DNA, 21 bp, Artificial sequence
  SiRNA target sequence
cgggcactgttataacagatc

SEQ ID NO: 23825 - DNA, 21 bp, Artificial sequence
  SiRNA target sequence
gggcactgttataacagatct

SEQ ID NO: 23826 - DNA, 21 bp, Artificial sequence
  SiRNA target sequence
ggcactgttataacagatctt

SEQ ID NO: 23827 - DNA, 21 bp, Artificial sequence
  SiRNA target sequence
gcactgttataacagatctta

SEQ ID NO: 23828 - DNA, 21 bp, Artificial sequence
  SiRNA target sequence
cactgttataacagatcttaa

SEQ ID NO: 23829 - DNA, 21 bp, Artificial sequence
  SiRNA target sequence
actgttataacagatcttaat

SEQ ID NO: 23830 - DNA, 21 bp, Artificial sequence
  SiRNA target sequence
ctgttataacagatcttaata

SEQ ID NO: 23831 - DNA, 21 bp, Artificial sequence
  SiRNA target sequence
tgttataacagatcttaatac

SEQ ID NO: 23832 - DNA, 21 bp, Artificial sequence
  SiRNA target sequence
gttataacagatcttaatact

SEQ ID NO: 23833 - DNA, 21 bp, Artificial sequence
  SiRNA target sequence
ttataacagatcttaatactt

SEQ ID NO: 23834 - DNA, 21 bp, Artificial sequence
  SiRNA target sequence
tataacagatcttaatacttt

SEQ ID NO: 23835 - DNA, 21 bp, Artificial sequence
  SiRNA target sequence
ataacagatcttaatacttta

SEQ ID NO: 23836 - DNA, 21 bp, Artificial sequence
  SiRNA target sequence
taacagatcttaatactttag

SEQ ID NO: 23837 - DNA, 21 bp, Artificial sequence
  SiRNA target sequence
aacagatcttaatactttaga

SEQ ID NO: 23838 - DNA, 21 bp, Artificial sequence
  SiRNA target sequence
acagatcttaatactttagaa

SEQ ID NO: 23839 - DNA, 21 bp, Artificial sequence
  SiRNA target sequence
cagatcttaatactttagaat

SEQ ID NO: 23840 - DNA, 21 bp, Artificial sequence
  SiRNA target sequence
agatcttaatactttagaatt

SEQ ID NO: 23841 - DNA, 21 bp, Artificial sequence
  SiRNA target sequence
gatcttaatactttagaattt

SEQ ID NO: 23842 - DNA, 21 bp, Artificial sequence
  SiRNA target sequence
atcttaatactttagaattta

SEQ ID NO: 23843 - DNA, 21 bp, Artificial sequence
  SiRNA target sequence
tcttaatactttagaatttaa

SEQ ID NO: 23844 - DNA, 21 bp, Artificial sequence
  SiRNA target sequence
cttaatactttagaatttaaa

SEQ ID NO: 23845 - DNA, 21 bp, Artificial sequence
  SiRNA target sequence
ttaatactttagaatttaaaa

SEQ ID NO: 23846 - DNA, 21 bp, Artificial sequence
  SiRNA target sequence
taatactttagaatttaaaaa

SEQ ID NO: 23847 - DNA, 21 bp, Artificial sequence
  SiRNA target sequence
aatactttagaatttaaaaaa

SEQ ID NO: 23848 - DNA, 21 bp, Artificial sequence
  SiRNA target sequence
atactttagaatttaaaaaat

SEQ ID NO: 23849 - DNA, 21 bp, Artificial sequence
  SiRNA target sequence
tactttagaatttaaaaaatt

SEQ ID NO: 23850 - DNA, 21 bp, Artificial sequence
  SiRNA target sequence
actttagaatttaaaaaattc

SEQ ID NO: 23851 - DNA, 21 bp, Artificial sequence
  SiRNA target sequence
ctttagaatttaaaaaattct

SEQ ID NO: 23852 - DNA, 21 bp, Artificial sequence
  SiRNA target sequence
tttagaatttaaaaaattctc

SEQ ID NO: 23853 - DNA, 21 bp, Artificial sequence
  SiRNA target sequence
ttagaatttaaaaaattctct

SEQ ID NO: 23854 - DNA, 21 bp, Artificial sequence
  SiRNA target sequence
tagaatttaaaaaattctctg

SEQ ID NO: 23855 - DNA, 21 bp, Artificial sequence
  SiRNA target sequence
agaatttaaaaaattctctgc

SEQ ID NO: 23856 - DNA, 21 bp, Artificial sequence
  SiRNA target sequence
gaatttaaaaaattctctgcg

SEQ ID NO: 23857 - DNA, 21 bp, Artificial sequence
  SiRNA target sequence
aatttaaaaaattctctgcgg

SEQ ID NO: 23858 - DNA, 21 bp, Artificial sequence
  SiRNA target sequence
atttaaaaaattctctgcggc

SEQ ID NO: 23859 - DNA, 21 bp, Artificial sequence
  SiRNA target sequence
tttaaaaaattctctgcggca

SEQ ID NO: 23860 - DNA, 21 bp, Artificial sequence
  SiRNA target sequence
ttaaaaaattctctgcggcat

SEQ ID NO: 23861 - DNA, 21 bp, Artificial sequence
  SiRNA target sequence
taaaaaattctctgcggcatt

SEQ ID NO: 23862 - DNA, 21 bp, Artificial sequence
  SiRNA target sequence
aaaaaattctctgcggcattt

SEQ ID NO: 23863 - DNA, 21 bp, Artificial sequence
  SiRNA target sequence
aaaaattctctgcggcatttt

SEQ ID NO: 23864 - DNA, 21 bp, Artificial sequence
  SiRNA target sequence
aaaattctctgcggcattttt

SEQ ID NO: 23865 - DNA, 21 bp, Artificial sequence
  SiRNA target sequence
aaattctctgcggcatttttc

SEQ ID NO: 23866 - DNA, 21 bp, Artificial sequence
  SiRNA target sequence
aattctctgcggcatttttca

SEQ ID NO: 23867 - DNA, 21 bp, Artificial sequence
  SiRNA target sequence
attctctgcggcatttttcat

SEQ ID NO: 23868 - DNA, 21 bp, Artificial sequence
  SiRNA target sequence
ttctctgcggcatttttcatt

SEQ ID NO: 23869 - DNA, 21 bp, Artificial sequence
  SiRNA target sequence
tctctgcggcatttttcattt

SEQ ID NO: 23870 - DNA, 21 bp, Artificial sequence
  SiRNA target sequence
ctctgcggcatttttcatttt

SEQ ID NO: 23871 - DNA, 21 bp, Artificial sequence
  SiRNA target sequence
tctgcggcatttttcattttt

SEQ ID NO: 23872 - DNA, 21 bp, Artificial sequence
  SiRNA target sequence
ctgcggcatttttcatttttg

SEQ ID NO: 23873 - DNA, 21 bp, Artificial sequence
  SiRNA target sequence
tgcggcatttttcatttttga

SEQ ID NO: 23874 - DNA, 21 bp, Artificial sequence
  SiRNA target sequence
gcggcatttttcatttttgac

SEQ ID NO: 23875 - DNA, 21 bp, Artificial sequence
  SiRNA target sequence
cggcatttttcatttttgaca

SEQ ID NO: 23876 - DNA, 21 bp, Artificial sequence
  SiRNA target sequence
ggcatttttcatttttgacaa

SEQ ID NO: 23877 - DNA, 21 bp, Artificial sequence
  SiRNA target sequence
gcatttttcatttttgacaaa

SEQ ID NO: 23878 - DNA, 21 bp, Artificial sequence
  SiRNA target sequence
catttttcatttttgacaaaa

SEQ ID NO: 23879 - DNA, 21 bp, Artificial sequence
  SiRNA target sequence
atttttcatttttgacaaaat

SEQ ID NO: 23880 - DNA, 21 bp, Artificial sequence
  SiRNA target sequence
tttttcatttttgacaaaata

SEQ ID NO: 23881 - DNA, 21 bp, Artificial sequence
  SiRNA target sequence
ttttcatttttgacaaaataa

SEQ ID NO: 23882 - DNA, 21 bp, Artificial sequence
  SiRNA target sequence
tttcatttttgacaaaataaa

SEQ ID NO: 23883 - DNA, 21 bp, Artificial sequence
  SiRNA target sequence
ttcatttttgacaaaataaat

SEQ ID NO: 23884 - DNA, 21 bp, Artificial sequence
  SiRNA target sequence
tcatttttgacaaaataaatg

SEQ ID NO: 23885 - DNA, 21 bp, Artificial sequence
  SiRNA target sequence
catttttgacaaaataaatgc

SEQ ID NO: 23886 - DNA, 21 bp, Artificial sequence
  SiRNA target sequence
atttttgacaaaataaatgca

SEQ ID NO: 23887 - DNA, 21 bp, Artificial sequence
  SiRNA target sequence
tttttgacaaaataaatgcac

SEQ ID NO: 23888 - DNA, 21 bp, Artificial sequence
  SiRNA target sequence
ttttgacaaaataaatgcacc

SEQ ID NO: 23889 - DNA, 21 bp, Artificial sequence
  SiRNA target sequence
tttgacaaaataaatgcacca

SEQ ID NO: 23890 - DNA, 21 bp, Artificial sequence
  SiRNA target sequence
ttgacaaaataaatgcaccaa

SEQ ID NO: 23891 - DNA, 21 bp, Artificial sequence
  SiRNA target sequence
tgacaaaataaatgcaccaat

SEQ ID NO: 23892 - DNA, 21 bp, Artificial sequence
  SiRNA target sequence
gacaaaataaatgcaccaatt

SEQ ID NO: 23893 - DNA, 21 bp, Artificial sequence
  SiRNA target sequence
acaaaataaatgcaccaattt

SEQ ID NO: 23894 - DNA, 21 bp, Artificial sequence
  SiRNA target sequence
caaaataaatgcaccaatttg

SEQ ID NO: 23895 - DNA, 21 bp, Artificial sequence
  SiRNA target sequence
aaaataaatgcaccaatttgt

SEQ ID NO: 23896 - DNA, 21 bp, Artificial sequence
  SiRNA target sequence
aaataaatgcaccaatttgtg

SEQ ID NO: 23897 - DNA, 21 bp, Artificial sequence
  SiRNA target sequence
aataaatgcaccaatttgtgc

SEQ ID NO: 23898 - DNA, 21 bp, Artificial sequence
  SiRNA target sequence
ataaatgcaccaatttgtgca

SEQ ID NO: 23899 - DNA, 21 bp, Artificial sequence
  SiRNA target sequence
taaatgcaccaatttgtgcag

SEQ ID NO: 23900 - DNA, 21 bp, Artificial sequence
  SiRNA target sequence
aaatgcaccaatttgtgcagg

SEQ ID NO: 23901 - DNA, 21 bp, Artificial sequence
  SiRNA target sequence
aatgcaccaatttgtgcagga

SEQ ID NO: 23902 - DNA, 21 bp, Artificial sequence
  SiRNA target sequence
atgcaccaatttgtgcaggag

SEQ ID NO: 23903 - DNA, 21 bp, Artificial sequence
  SiRNA target sequence
tgcaccaatttgtgcaggaga

SEQ ID NO: 23904 - DNA, 21 bp, Artificial sequence
  SiRNA target sequence
gcaccaatttgtgcaggagaa

SEQ ID NO: 23905 - DNA, 21 bp, Artificial sequence
  SiRNA target sequence
caccaatttgtgcaggagaat

SEQ ID NO: 23906 - DNA, 21 bp, Artificial sequence
  SiRNA target sequence
accaatttgtgcaggagaata

SEQ ID NO: 23907 - DNA, 21 bp, Artificial sequence
  SiRNA target sequence
ccaatttgtgcaggagaatat

SEQ ID NO: 23908 - DNA, 21 bp, Artificial sequence
  SiRNA target sequence
caatttgtgcaggagaatatt

SEQ ID NO: 23909 - DNA, 21 bp, Artificial sequence
  SiRNA target sequence
aatttgtgcaggagaatattt

SEQ ID NO: 23910 - DNA, 21 bp, Artificial sequence
  SiRNA target sequence
atttgtgcaggagaatatttc

SEQ ID NO: 23911 - DNA, 21 bp, Artificial sequence
  SiRNA target sequence
tttgtgcaggagaatatttct

SEQ ID NO: 23912 - DNA, 21 bp, Artificial sequence
  SiRNA target sequence
ttgtgcaggagaatatttctt

SEQ ID NO: 23913 - DNA, 21 bp, Artificial sequence
  SiRNA target sequence
tgtgcaggagaatatttctta

SEQ ID NO: 23914 - DNA, 21 bp, Artificial sequence
  SiRNA target sequence
gtgcaggagaatatttcttat

SEQ ID NO: 23915 - DNA, 21 bp, Artificial sequence
  SiRNA target sequence
tgcaggagaatatttcttatt

SEQ ID NO: 23916 - DNA, 21 bp, Artificial sequence
  SiRNA target sequence
gcaggagaatatttcttattg

SEQ ID NO: 23917 - DNA, 21 bp, Artificial sequence
  SiRNA target sequence
caggagaatatttcttattgt

SEQ ID NO: 23918 - DNA, 21 bp, Artificial sequence
  SiRNA target sequence
aggagaatatttcttattgtc

SEQ ID NO: 23919 - DNA, 21 bp, Artificial sequence
  SiRNA target sequence
ggagaatatttcttattgtca

SEQ ID NO: 23920 - DNA, 21 bp, Artificial sequence
  SiRNA target sequence
gagaatatttcttattgtcaa

SEQ ID NO: 23921 - DNA, 21 bp, Artificial sequence
  SiRNA target sequence
agaatatttcttattgtcaat

SEQ ID NO: 23922 - DNA, 21 bp, Artificial sequence
  SiRNA target sequence
gaatatttcttattgtcaatt

SEQ ID NO: 23923 - DNA, 21 bp, Artificial sequence
  SiRNA target sequence
aatatttcttattgtcaattt

SEQ ID NO: 23924 - DNA, 21 bp, Artificial sequence
  SiRNA target sequence
atatttcttattgtcaatttt

SEQ ID NO: 23925 - DNA, 21 bp, Artificial sequence
  SiRNA target sequence
tatttcttattgtcaattttt

SEQ ID NO: 23926 - DNA, 21 bp, Artificial sequence
  SiRNA target sequence
atttcttattgtcaattttta

SEQ ID NO: 23927 - DNA, 21 bp, Artificial sequence
  SiRNA target sequence
tttcttattgtcaatttttat

SEQ ID NO: 23928 - DNA, 21 bp, Artificial sequence
  SiRNA target sequence
ttcttattgtcaatttttatc

SEQ ID NO: 23929 - DNA, 21 bp, Artificial sequence
  SiRNA target sequence
tcttattgtcaatttttatcc

SEQ ID NO: 23930 - DNA, 21 bp, Artificial sequence
  SiRNA target sequence
cttattgtcaatttttatcca

SEQ ID NO: 23931 - DNA, 21 bp, Artificial sequence
  SiRNA target sequence
ttattgtcaatttttatccaa

SEQ ID NO: 23932 - DNA, 21 bp, Artificial sequence
  SiRNA target sequence
tattgtcaatttttatccaaa

SEQ ID NO: 23933 - DNA, 21 bp, Artificial sequence
  SiRNA target sequence
attgtcaatttttatccaaat

SEQ ID NO: 23934 - DNA, 21 bp, Artificial sequence
  SiRNA target sequence
ttgtcaatttttatccaaata

SEQ ID NO: 23935 - DNA, 21 bp, Artificial sequence
  SiRNA target sequence
tgtcaatttttatccaaatat

SEQ ID NO: 23936 - DNA, 21 bp, Artificial sequence
  SiRNA target sequence
gtcaatttttatccaaatatc

SEQ ID NO: 23937 - DNA, 21 bp, Artificial sequence
  SiRNA target sequence
tcaatttttatccaaatatcg

SEQ ID NO: 23938 - DNA, 21 bp, Artificial sequence
  SiRNA target sequence
caatttttatccaaatatcgc

SEQ ID NO: 23939 - DNA, 21 bp, Artificial sequence
  SiRNA target sequence
aatttttatccaaatatcgcc

SEQ ID NO: 23940 - DNA, 21 bp, Artificial sequence
  SiRNA target sequence
atttttatccaaatatcgccg

SEQ ID NO: 23941 - DNA, 21 bp, Artificial sequence
  SiRNA target sequence
tttttatccaaatatcgccgt

SEQ ID NO: 23942 - DNA, 21 bp, Artificial sequence
  SiRNA target sequence
ttttatccaaatatcgccgtt

SEQ ID NO: 23943 - DNA, 21 bp, Artificial sequence
  SiRNA target sequence
tttatccaaatatcgccgtta

SEQ ID NO: 23944 - DNA, 21 bp, Artificial sequence
  SiRNA target sequence
ttatccaaatatcgccgttac

SEQ ID NO: 23945 - DNA, 21 bp, Artificial sequence
  SiRNA target sequence
tatccaaatatcgccgttaca

SEQ ID NO: 23946 - DNA, 21 bp, Artificial sequence
  SiRNA target sequence
atccaaatatcgccgttacaa

SEQ ID NO: 23947 - DNA, 21 bp, Artificial sequence
  SiRNA target sequence
tccaaatatcgccgttacaat

SEQ ID NO: 23948 - DNA, 21 bp, Artificial sequence
  SiRNA target sequence
ccaaatatcgccgttacaatg

SEQ ID NO: 23949 - DNA, 21 bp, Artificial sequence
  SiRNA target sequence
caaatatcgccgttacaatgc

SEQ ID NO: 23950 - DNA, 21 bp, Artificial sequence
  SiRNA target sequence
aaatatcgccgttacaatgct

SEQ ID NO: 23951 - DNA, 21 bp, Artificial sequence
  SiRNA target sequence
aatatcgccgttacaatgctt

SEQ ID NO: 23952 - DNA, 21 bp, Artificial sequence
  SiRNA target sequence
atatcgccgttacaatgctta

SEQ ID NO: 23953 - DNA, 21 bp, Artificial sequence
  SiRNA target sequence
tatcgccgttacaatgcttag

SEQ ID NO: 23954 - DNA, 21 bp, Artificial sequence
  SiRNA target sequence
atcgccgttacaatgcttagt

SEQ ID NO: 23955 - DNA, 21 bp, Artificial sequence
  SiRNA target sequence
tcgccgttacaatgcttagta

SEQ ID NO: 23956 - DNA, 21 bp, Artificial sequence
  SiRNA target sequence
cgccgttacaatgcttagtag

SEQ ID NO: 23957 - DNA, 21 bp, Artificial sequence
  SiRNA target sequence
gccgttacaatgcttagtagt

SEQ ID NO: 23958 - DNA, 21 bp, Artificial sequence
  SiRNA target sequence
ccgttacaatgcttagtagtg

SEQ ID NO: 23959 - DNA, 21 bp, Artificial sequence
  SiRNA target sequence
cgttacaatgcttagtagtgt

SEQ ID NO: 23960 - DNA, 21 bp, Artificial sequence
  SiRNA target sequence
gttacaatgcttagtagtgtc

SEQ ID NO: 23961 - DNA, 21 bp, Artificial sequence
  SiRNA target sequence
ttacaatgcttagtagtgtca

SEQ ID NO: 23962 - DNA, 21 bp, Artificial sequence
  SiRNA target sequence
tacaatgcttagtagtgtcat

SEQ ID NO: 23963 - DNA, 21 bp, Artificial sequence
  SiRNA target sequence
acaatgcttagtagtgtcata

SEQ ID NO: 23964 - DNA, 21 bp, Artificial sequence
  SiRNA target sequence
caatgcttagtagtgtcatat

SEQ ID NO: 23965 - DNA, 21 bp, Artificial sequence
  SiRNA target sequence
aatgcttagtagtgtcatatg

SEQ ID NO: 23966 - DNA, 21 bp, Artificial sequence
  SiRNA target sequence
atgcttagtagtgtcatatgg

SEQ ID NO: 23967 - DNA, 21 bp, Artificial sequence
  SiRNA target sequence
tgcttagtagtgtcatatggt

SEQ ID NO: 23968 - DNA, 21 bp, Artificial sequence
  SiRNA target sequence
gcttagtagtgtcatatggta

SEQ ID NO: 23969 - DNA, 21 bp, Artificial sequence
  SiRNA target sequence
cttagtagtgtcatatggtaa

SEQ ID NO: 23970 - DNA, 21 bp, Artificial sequence
  SiRNA target sequence
ttagtagtgtcatatggtaag

SEQ ID NO: 23971 - DNA, 21 bp, Artificial sequence
  SiRNA target sequence
tagtagtgtcatatggtaagc

SEQ ID NO: 23972 - DNA, 21 bp, Artificial sequence
  SiRNA target sequence
agtagtgtcatatggtaagct

SEQ ID NO: 23973 - DNA, 21 bp, Artificial sequence
  SiRNA target sequence
gtagtgtcatatggtaagctt

SEQ ID NO: 23974 - DNA, 21 bp, Artificial sequence
  SiRNA target sequence
tagtgtcatatggtaagcttt

SEQ ID NO: 23975 - DNA, 21 bp, Artificial sequence
  SiRNA target sequence
agtgtcatatggtaagctttt

SEQ ID NO: 23976 - DNA, 21 bp, Artificial sequence
  SiRNA target sequence
gtgtcatatggtaagcttttt

SEQ ID NO: 23977 - DNA, 21 bp, Artificial sequence
  SiRNA target sequence
tgtcatatggtaagcttttta

SEQ ID NO: 23978 - DNA, 21 bp, Artificial sequence
  SiRNA target sequence
gtcatatggtaagctttttaa

SEQ ID NO: 23979 - DNA, 21 bp, Artificial sequence
  SiRNA target sequence
tcatatggtaagctttttaaa

SEQ ID NO: 23980 - DNA, 21 bp, Artificial sequence
  SiRNA target sequence
catatggtaagctttttaaat

SEQ ID NO: 23981 - DNA, 21 bp, Artificial sequence
  SiRNA target sequence
atatggtaagctttttaaata

SEQ ID NO: 23982 - DNA, 21 bp, Artificial sequence
  SiRNA target sequence
tatggtaagctttttaaataa

SEQ ID NO: 23983 - DNA, 21 bp, Artificial sequence
  SiRNA target sequence
atggtaagctttttaaataat

SEQ ID NO: 23984 - DNA, 21 bp, Artificial sequence
  SiRNA target sequence
tggtaagctttttaaataatc

SEQ ID NO: 23985 - DNA, 21 bp, Artificial sequence
  SiRNA target sequence
ggtaagctttttaaataatct

SEQ ID NO: 23986 - DNA, 21 bp, Artificial sequence
  SiRNA target sequence
gtaagctttttaaataatctt

SEQ ID NO: 23987 - DNA, 21 bp, Artificial sequence
  SiRNA target sequence
taagctttttaaataatcttt

SEQ ID NO: 23988 - DNA, 21 bp, Artificial sequence
  SiRNA target sequence
aagctttttaaataatctttt

SEQ ID NO: 23989 - DNA, 21 bp, Artificial sequence
  SiRNA target sequence
agctttttaaataatctttta

SEQ ID NO: 23990 - DNA, 21 bp, Artificial sequence
  SiRNA target sequence
gctttttaaataatcttttaa

SEQ ID NO: 23991 - DNA, 21 bp, Artificial sequence
  SiRNA target sequence
ctttttaaataatcttttaat

SEQ ID NO: 23992 - DNA, 21 bp, Artificial sequence
  SiRNA target sequence
tttttaaataatcttttaatt

SEQ ID NO: 23993 - DNA, 21 bp, Artificial sequence
  SiRNA target sequence
ttttaaataatcttttaattc

SEQ ID NO: 23994 - DNA, 21 bp, Artificial sequence
  SiRNA target sequence
tttaaataatcttttaattct

SEQ ID NO: 23995 - DNA, 21 bp, Artificial sequence
  SiRNA target sequence
ttaaataatcttttaattcta

SEQ ID NO: 23996 - DNA, 21 bp, Artificial sequence
  SiRNA target sequence
taaataatcttttaattctac

SEQ ID NO: 23997 - DNA, 21 bp, Artificial sequence
  SiRNA target sequence
aaataatcttttaattctaca

SEQ ID NO: 23998 - DNA, 21 bp, Artificial sequence
  SiRNA target sequence
aataatcttttaattctacat

SEQ ID NO: 23999 - DNA, 21 bp, Artificial sequence
  SiRNA target sequence
ataatcttttaattctacatc

SEQ ID NO: 24000 - DNA, 21 bp, Artificial sequence
  SiRNA target sequence
taatcttttaattctacatca

SEQ ID NO: 24001 - DNA, 21 bp, Artificial sequence
  SiRNA target sequence
aatcttttaattctacatcat

SEQ ID NO: 24002 - DNA, 21 bp, Artificial sequence
  SiRNA target sequence
atcttttaattctacatcatc

SEQ ID NO: 24003 - DNA, 21 bp, Artificial sequence
  SiRNA target sequence
tcttttaattctacatcatca

SEQ ID NO: 24004 - DNA, 21 bp, Artificial sequence
  SiRNA target sequence
cttttaattctacatcatcaa

SEQ ID NO: 24005 - DNA, 21 bp, Artificial sequence
  SiRNA target sequence
ttttaattctacatcatcaaa

SEQ ID NO: 24006 - DNA, 21 bp, Artificial sequence
  SiRNA target sequence
tttaattctacatcatcaaat

SEQ ID NO: 24007 - DNA, 21 bp, Artificial sequence
  SiRNA target sequence
ttaattctacatcatcaaatt

SEQ ID NO: 24008 - DNA, 21 bp, Artificial sequence
  SiRNA target sequence
taattctacatcatcaaattt

SEQ ID NO: 24009 - DNA, 21 bp, Artificial sequence
  SiRNA target sequence
aattctacatcatcaaatttt

SEQ ID NO: 24010 - DNA, 21 bp, Artificial sequence
  SiRNA target sequence
attctacatcatcaaattttc

SEQ ID NO: 24011 - DNA, 21 bp, Artificial sequence
  SiRNA target sequence
ttctacatcatcaaattttcg

SEQ ID NO: 24012 - DNA, 21 bp, Artificial sequence
  SiRNA target sequence
tctacatcatcaaattttcgt

SEQ ID NO: 24013 - DNA, 21 bp, Artificial sequence
  SiRNA target sequence
ctacatcatcaaattttcgtc

SEQ ID NO: 24014 - DNA, 21 bp, Artificial sequence
  SiRNA target sequence
tacatcatcaaattttcgtcc

SEQ ID NO: 24015 - DNA, 21 bp, Artificial sequence
  SiRNA target sequence
acatcatcaaattttcgtccc

SEQ ID NO: 24016 - DNA, 21 bp, Artificial sequence
  SiRNA target sequence
catcatcaaattttcgtccca

SEQ ID NO: 24017 - DNA, 21 bp, Artificial sequence
  SiRNA target sequence
atcatcaaattttcgtcccag

SEQ ID NO: 24018 - DNA, 21 bp, Artificial sequence
  SiRNA target sequence
tcatcaaattttcgtcccagc

SEQ ID NO: 24019 - DNA, 21 bp, Artificial sequence
  SiRNA target sequence
catcaaattttcgtcccagca

SEQ ID NO: 24020 - DNA, 21 bp, Artificial sequence
  SiRNA target sequence
atcaaattttcgtcccagcaa

SEQ ID NO: 24021 - DNA, 21 bp, Artificial sequence
  SiRNA target sequence
tcaaattttcgtcccagcaat

SEQ ID NO: 24022 - DNA, 21 bp, Artificial sequence
  SiRNA target sequence
caaattttcgtcccagcaatc

SEQ ID NO: 24023 - DNA, 21 bp, Artificial sequence
  SiRNA target sequence
aaattttcgtcccagcaatct

SEQ ID NO: 24024 - DNA, 21 bp, Artificial sequence
  SiRNA target sequence
aattttcgtcccagcaatctc

SEQ ID NO: 24025 - DNA, 21 bp, Artificial sequence
  SiRNA target sequence
attttcgtcccagcaatctct

SEQ ID NO: 24026 - DNA, 21 bp, Artificial sequence
  SiRNA target sequence
ttttcgtcccagcaatctctt

SEQ ID NO: 24027 - DNA, 21 bp, Artificial sequence
  SiRNA target sequence
tttcgtcccagcaatctctta

SEQ ID NO: 24028 - DNA, 21 bp, Artificial sequence
  SiRNA target sequence
ttcgtcccagcaatctcttag

SEQ ID NO: 24029 - DNA, 21 bp, Artificial sequence
  SiRNA target sequence
tcgtcccagcaatctcttaga

SEQ ID NO: 24030 - DNA, 21 bp, Artificial sequence
  SiRNA target sequence
cgtcccagcaatctcttagac

SEQ ID NO: 24031 - DNA, 21 bp, Artificial sequence
  SiRNA target sequence
gtcccagcaatctcttagacg

SEQ ID NO: 24032 - DNA, 21 bp, Artificial sequence
  SiRNA target sequence
tcccagcaatctcttagacgc

SEQ ID NO: 24033 - DNA, 21 bp, Artificial sequence
  SiRNA target sequence
cccagcaatctcttagacgca

SEQ ID NO: 24034 - DNA, 21 bp, Artificial sequence
  SiRNA target sequence
ccagcaatctcttagacgcaa

SEQ ID NO: 24035 - DNA, 21 bp, Artificial sequence
  SiRNA target sequence
cagcaatctcttagacgcaaa

SEQ ID NO: 24036 - DNA, 21 bp, Artificial sequence
  SiRNA target sequence
agcaatctcttagacgcaaaa

SEQ ID NO: 24037 - DNA, 21 bp, Artificial sequence
  SiRNA target sequence
gcaatctcttagacgcaaaaa

SEQ ID NO: 24038 - DNA, 21 bp, Artificial sequence
  SiRNA target sequence
caatctcttagacgcaaaaat

SEQ ID NO: 24039 - DNA, 21 bp, Artificial sequence
  SiRNA target sequence
aatctcttagacgcaaaaatc

SEQ ID NO: 24040 - DNA, 21 bp, Artificial sequence
  SiRNA target sequence
atctcttagacgcaaaaatcg

SEQ ID NO: 24041 - DNA, 21 bp, Artificial sequence
  SiRNA target sequence
tctcttagacgcaaaaatcgt

SEQ ID NO: 24042 - DNA, 21 bp, Artificial sequence
  SiRNA target sequence
ctcttagacgcaaaaatcgta

SEQ ID NO: 24043 - DNA, 21 bp, Artificial sequence
  SiRNA target sequence
tcttagacgcaaaaatcgtat

SEQ ID NO: 24044 - DNA, 21 bp, Artificial sequence
  SiRNA target sequence
cttagacgcaaaaatcgtatt

SEQ ID NO: 24045 - DNA, 21 bp, Artificial sequence
  SiRNA target sequence
ttagacgcaaaaatcgtattc

SEQ ID NO: 24046 - DNA, 21 bp, Artificial sequence
  SiRNA target sequence
tagacgcaaaaatcgtattct

SEQ ID NO: 24047 - DNA, 21 bp, Artificial sequence
  SiRNA target sequence
agacgcaaaaatcgtattctt

SEQ ID NO: 24048 - DNA, 21 bp, Artificial sequence
  SiRNA target sequence
gacgcaaaaatcgtattcttg

SEQ ID NO: 24049 - DNA, 21 bp, Artificial sequence
  SiRNA target sequence
acgcaaaaatcgtattcttgg

SEQ ID NO: 24050 - DNA, 21 bp, Artificial sequence
  SiRNA target sequence
cgcaaaaatcgtattcttggg

SEQ ID NO: 24051 - DNA, 21 bp, Artificial sequence
  SiRNA target sequence
gcaaaaatcgtattcttggga

SEQ ID NO: 24052 - DNA, 21 bp, Artificial sequence
  SiRNA target sequence
caaaaatcgtattcttgggat

SEQ ID NO: 24053 - DNA, 21 bp, Artificial sequence
  SiRNA target sequence
aaaaatcgtattcttgggatg

SEQ ID NO: 24054 - DNA, 21 bp, Artificial sequence
  SiRNA target sequence
aaaatcgtattcttgggatgt

SEQ ID NO: 24055 - DNA, 21 bp, Artificial sequence
  SiRNA target sequence
aaatcgtattcttgggatgta

SEQ ID NO: 24056 - DNA, 21 bp, Artificial sequence
  SiRNA target sequence
aatcgtattcttgggatgtaa

SEQ ID NO: 24057 - DNA, 21 bp, Artificial sequence
  SiRNA target sequence
atcgtattcttgggatgtaat

SEQ ID NO: 24058 - DNA, 21 bp, Artificial sequence
  SiRNA target sequence
tcgtattcttgggatgtaata

SEQ ID NO: 24059 - DNA, 21 bp, Artificial sequence
  SiRNA target sequence
cgtattcttgggatgtaataa

SEQ ID NO: 24060 - DNA, 21 bp, Artificial sequence
  SiRNA target sequence
gtattcttgggatgtaataac

SEQ ID NO: 24061 - DNA, 21 bp, Artificial sequence
  SiRNA target sequence
tattcttgggatgtaataaca

SEQ ID NO: 24062 - DNA, 21 bp, Artificial sequence
  SiRNA target sequence
attcttgggatgtaataacaa

SEQ ID NO: 24063 - DNA, 21 bp, Artificial sequence
  SiRNA target sequence
ttcttgggatgtaataacaag

SEQ ID NO: 24064 - DNA, 21 bp, Artificial sequence
  SiRNA target sequence
tcttgggatgtaataacaagt

SEQ ID NO: 24065 - DNA, 21 bp, Artificial sequence
  SiRNA target sequence
cttgggatgtaataacaagtt

SEQ ID NO: 24066 - DNA, 21 bp, Artificial sequence
  SiRNA target sequence
ttgggatgtaataacaagtta

SEQ ID NO: 24067 - DNA, 21 bp, Artificial sequence
  SiRNA target sequence
tgggatgtaataacaagttag

SEQ ID NO: 24068 - DNA, 21 bp, Artificial sequence
  SiRNA target sequence
gggatgtaataacaagttaga

SEQ ID NO: 24069 - DNA, 21 bp, Artificial sequence
  SiRNA target sequence
ggatgtaataacaagttagac

SEQ ID NO: 24070 - DNA, 21 bp, Artificial sequence
  SiRNA target sequence
gatgtaataacaagttagact

SEQ ID NO: 24071 - DNA, 21 bp, Artificial sequence
  SiRNA target sequence
atgtaataacaagttagactt

SEQ ID NO: 24072 - DNA, 21 bp, Artificial sequence
  SiRNA target sequence
tgtaataacaagttagactta

SEQ ID NO: 24073 - DNA, 21 bp, Artificial sequence
  SiRNA target sequence
gtaataacaagttagacttag

SEQ ID NO: 24074 - DNA, 21 bp, Artificial sequence
  SiRNA target sequence
taataacaagttagacttagc

SEQ ID NO: 24075 - DNA, 21 bp, Artificial sequence
  SiRNA target sequence
aataacaagttagacttagct

SEQ ID NO: 24076 - DNA, 21 bp, Artificial sequence
  SiRNA target sequence
ataacaagttagacttagctt

SEQ ID NO: 24077 - DNA, 21 bp, Artificial sequence
  SiRNA target sequence
taacaagttagacttagcttg

SEQ ID NO: 24078 - DNA, 21 bp, Artificial sequence
  SiRNA target sequence
aacaagttagacttagcttgc

SEQ ID NO: 24079 - DNA, 21 bp, Artificial sequence
  SiRNA target sequence
acaagttagacttagcttgct

SEQ ID NO: 24080 - DNA, 21 bp, Artificial sequence
  SiRNA target sequence
caagttagacttagcttgctc

SEQ ID NO: 24081 - DNA, 21 bp, Artificial sequence
  SiRNA target sequence
aagttagacttagcttgctca

SEQ ID NO: 24082 - DNA, 21 bp, Artificial sequence
  SiRNA target sequence
agttagacttagcttgctcac

SEQ ID NO: 24083 - DNA, 21 bp, Artificial sequence
  SiRNA target sequence
gttagacttagcttgctcacc

SEQ ID NO: 24084 - DNA, 21 bp, Artificial sequence
  SiRNA target sequence
ttagacttagcttgctcacct

SEQ ID NO: 24085 - DNA, 21 bp, Artificial sequence
  SiRNA target sequence
tagacttagcttgctcacctg

SEQ ID NO: 24086 - DNA, 21 bp, Artificial sequence
  SiRNA target sequence
agacttagcttgctcacctgt

SEQ ID NO: 24087 - DNA, 21 bp, Artificial sequence
  SiRNA target sequence
gacttagcttgctcacctgtt

SEQ ID NO: 24088 - DNA, 21 bp, Artificial sequence
  SiRNA target sequence
acttagcttgctcacctgtta

SEQ ID NO: 24089 - DNA, 21 bp, Artificial sequence
  SiRNA target sequence
cttagcttgctcacctgttaa

SEQ ID NO: 24090 - DNA, 21 bp, Artificial sequence
  SiRNA target sequence
ttagcttgctcacctgttaaa

SEQ ID NO: 24091 - DNA, 21 bp, Artificial sequence
  SiRNA target sequence
tagcttgctcacctgttaaaa

SEQ ID NO: 24092 - DNA, 21 bp, Artificial sequence
  SiRNA target sequence
agcttgctcacctgttaaaat

SEQ ID NO: 24093 - DNA, 21 bp, Artificial sequence
  SiRNA target sequence
gcttgctcacctgttaaaatt

SEQ ID NO: 24094 - DNA, 21 bp, Artificial sequence
  SiRNA target sequence
cttgctcacctgttaaaattt

SEQ ID NO: 24095 - DNA, 21 bp, Artificial sequence
  SiRNA target sequence
ttgctcacctgttaaaatttt

SEQ ID NO: 24096 - DNA, 21 bp, Artificial sequence
  SiRNA target sequence
tgctcacctgttaaaatttta

SEQ ID NO: 24097 - DNA, 21 bp, Artificial sequence
  SiRNA target sequence
gctcacctgttaaaattttat

SEQ ID NO: 24098 - DNA, 21 bp, Artificial sequence
  SiRNA target sequence
ctcacctgttaaaattttatc

SEQ ID NO: 24099 - DNA, 21 bp, Artificial sequence
  SiRNA target sequence
tcacctgttaaaattttatct

SEQ ID NO: 24100 - DNA, 21 bp, Artificial sequence
  SiRNA target sequence
cacctgttaaaattttatctt

SEQ ID NO: 24101 - DNA, 21 bp, Artificial sequence
  SiRNA target sequence
acctgttaaaattttatcttt

SEQ ID NO: 24102 - DNA, 21 bp, Artificial sequence
  SiRNA target sequence
cctgttaaaattttatcttta

SEQ ID NO: 24103 - DNA, 21 bp, Artificial sequence
  SiRNA target sequence
ctgttaaaattttatctttaa

SEQ ID NO: 24104 - DNA, 21 bp, Artificial sequence
  SiRNA target sequence
tgttaaaattttatctttaaa

SEQ ID NO: 24105 - DNA, 21 bp, Artificial sequence
  SiRNA target sequence
gttaaaattttatctttaaaa

SEQ ID NO: 24106 - DNA, 21 bp, Artificial sequence
  SiRNA target sequence
ttaaaattttatctttaaaaa

SEQ ID NO: 24107 - DNA, 21 bp, Artificial sequence
  SiRNA target sequence
taaaattttatctttaaaaat

SEQ ID NO: 24108 - DNA, 21 bp, Artificial sequence
  SiRNA target sequence
aaaattttatctttaaaaatt

SEQ ID NO: 24109 - DNA, 21 bp, Artificial sequence
  SiRNA target sequence
aaattttatctttaaaaattg

SEQ ID NO: 24110 - DNA, 21 bp, Artificial sequence
  SiRNA target sequence
aattttatctttaaaaattga

SEQ ID NO: 24111 - DNA, 21 bp, Artificial sequence
  SiRNA target sequence
attttatctttaaaaattgat

SEQ ID NO: 24112 - DNA, 21 bp, Artificial sequence
  SiRNA target sequence
ttttatctttaaaaattgata

SEQ ID NO: 24113 - DNA, 21 bp, Artificial sequence
  SiRNA target sequence
tttatctttaaaaattgatac

SEQ ID NO: 24114 - DNA, 21 bp, Artificial sequence
  SiRNA target sequence
ttatctttaaaaattgatacc

SEQ ID NO: 24115 - DNA, 21 bp, Artificial sequence
  SiRNA target sequence
tatctttaaaaattgatacca

SEQ ID NO: 24116 - DNA, 21 bp, Artificial sequence
  SiRNA target sequence
atctttaaaaattgataccac

SEQ ID NO: 24117 - DNA, 21 bp, Artificial sequence
  SiRNA target sequence
tctttaaaaattgataccacc

SEQ ID NO: 24118 - DNA, 21 bp, Artificial sequence
  SiRNA target sequence
ctttaaaaattgataccaccg

SEQ ID NO: 24119 - DNA, 21 bp, Artificial sequence
  SiRNA target sequence
tttaaaaattgataccaccga

SEQ ID NO: 24120 - DNA, 21 bp, Artificial sequence
  SiRNA target sequence
ttaaaaattgataccaccgat

SEQ ID NO: 24121 - DNA, 21 bp, Artificial sequence
  SiRNA target sequence
taaaaattgataccaccgatg

SEQ ID NO: 24122 - DNA, 21 bp, Artificial sequence
  SiRNA target sequence
aaaaattgataccaccgatgg

SEQ ID NO: 24123 - DNA, 21 bp, Artificial sequence
  SiRNA target sequence
aaaattgataccaccgatggt

SEQ ID NO: 24124 - DNA, 21 bp, Artificial sequence
  SiRNA target sequence
aaattgataccaccgatggtg

SEQ ID NO: 24125 - DNA, 21 bp, Artificial sequence
  SiRNA target sequence
aattgataccaccgatggtgt

SEQ ID NO: 24126 - DNA, 21 bp, Artificial sequence
  SiRNA target sequence
attgataccaccgatggtgta

SEQ ID NO: 24127 - DNA, 21 bp, Artificial sequence
  SiRNA target sequence
ttgataccaccgatggtgtag

SEQ ID NO: 24128 - DNA, 21 bp, Artificial sequence
  SiRNA target sequence
tgataccaccgatggtgtagt

SEQ ID NO: 24129 - DNA, 21 bp, Artificial sequence
  SiRNA target sequence
gataccaccgatggtgtagtt

SEQ ID NO: 24130 - DNA, 21 bp, Artificial sequence
  SiRNA target sequence
ataccaccgatggtgtagttc

SEQ ID NO: 24131 - DNA, 21 bp, Artificial sequence
  SiRNA target sequence
taccaccgatggtgtagttct

SEQ ID NO: 24132 - DNA, 21 bp, Artificial sequence
  SiRNA target sequence
accaccgatggtgtagttcta

SEQ ID NO: 24133 - DNA, 21 bp, Artificial sequence
  SiRNA target sequence
ccaccgatggtgtagttctac

SEQ ID NO: 24134 - DNA, 21 bp, Artificial sequence
  SiRNA target sequence
caccgatggtgtagttctacc

SEQ ID NO: 24135 - DNA, 21 bp, Artificial sequence
  SiRNA target sequence
accgatggtgtagttctacca

SEQ ID NO: 24136 - DNA, 21 bp, Artificial sequence
  SiRNA target sequence
ccgatggtgtagttctaccac

SEQ ID NO: 24137 - DNA, 21 bp, Artificial sequence
  SiRNA target sequence
cgatggtgtagttctaccacc

SEQ ID NO: 24138 - DNA, 21 bp, Artificial sequence
  SiRNA target sequence
gatggtgtagttctaccacct

SEQ ID NO: 24139 - DNA, 21 bp, Artificial sequence
  SiRNA target sequence
atggtgtagttctaccacctt

SEQ ID NO: 24140 - DNA, 21 bp, Artificial sequence
  SiRNA target sequence
tggtgtagttctaccaccttc

SEQ ID NO: 24141 - DNA, 21 bp, Artificial sequence
  SiRNA target sequence
ggtgtagttctaccaccttct

SEQ ID NO: 24142 - DNA, 21 bp, Artificial sequence
  SiRNA target sequence
gtgtagttctaccaccttctt

SEQ ID NO: 24143 - DNA, 21 bp, Artificial sequence
  SiRNA target sequence
tgtagttctaccaccttcttc

SEQ ID NO: 24144 - DNA, 21 bp, Artificial sequence
  SiRNA target sequence
gtagttctaccaccttcttcg

SEQ ID NO: 24145 - DNA, 21 bp, Artificial sequence
  SiRNA target sequence
tagttctaccaccttcttcgt

SEQ ID NO: 24146 - DNA, 21 bp, Artificial sequence
  SiRNA target sequence
agttctaccaccttcttcgtt

SEQ ID NO: 24147 - DNA, 21 bp, Artificial sequence
  SiRNA target sequence
gttctaccaccttcttcgttt

SEQ ID NO: 24148 - DNA, 21 bp, Artificial sequence
  SiRNA target sequence
ttctaccaccttcttcgtttt

SEQ ID NO: 24149 - DNA, 21 bp, Artificial sequence
  SiRNA target sequence
tctaccaccttcttcgttttc

SEQ ID NO: 24150 - DNA, 21 bp, Artificial sequence
  SiRNA target sequence
ctaccaccttcttcgttttca

SEQ ID NO: 24151 - DNA, 21 bp, Artificial sequence
  SiRNA target sequence
taccaccttcttcgttttcaa

SEQ ID NO: 24152 - DNA, 21 bp, Artificial sequence
  SiRNA target sequence
accaccttcttcgttttcaat

SEQ ID NO: 24153 - DNA, 21 bp, Artificial sequence
  SiRNA target sequence
ccaccttcttcgttttcaata

SEQ ID NO: 24154 - DNA, 21 bp, Artificial sequence
  SiRNA target sequence
caccttcttcgttttcaataa

SEQ ID NO: 24155 - DNA, 21 bp, Artificial sequence
  SiRNA target sequence
accttcttcgttttcaataat

SEQ ID NO: 24156 - DNA, 21 bp, Artificial sequence
  SiRNA target sequence
ccttcttcgttttcaataatt

SEQ ID NO: 24157 - DNA, 21 bp, Artificial sequence
  SiRNA target sequence
cttcttcgttttcaataattt

SEQ ID NO: 24158 - DNA, 21 bp, Artificial sequence
  SiRNA target sequence
ttcttcgttttcaataatttg

SEQ ID NO: 24159 - DNA, 21 bp, Artificial sequence
  SiRNA target sequence
tcttcgttttcaataatttgt

SEQ ID NO: 24160 - DNA, 21 bp, Artificial sequence
  SiRNA target sequence
cttcgttttcaataatttgtg

SEQ ID NO: 24161 - DNA, 21 bp, Artificial sequence
  SiRNA target sequence
ttcgttttcaataatttgtgg

SEQ ID NO: 24162 - DNA, 21 bp, Artificial sequence
  SiRNA target sequence
tcgttttcaataatttgtggg

SEQ ID NO: 24163 - DNA, 21 bp, Artificial sequence
  SiRNA target sequence
cgttttcaataatttgtggga

SEQ ID NO: 24164 - DNA, 21 bp, Artificial sequence
  SiRNA target sequence
gttttcaataatttgtgggat

SEQ ID NO: 24165 - DNA, 21 bp, Artificial sequence
  SiRNA target sequence
ttttcaataatttgtgggata

SEQ ID NO: 24166 - DNA, 21 bp, Artificial sequence
  SiRNA target sequence
tttcaataatttgtgggatat

SEQ ID NO: 24167 - DNA, 21 bp, Artificial sequence
  SiRNA target sequence
ttcaataatttgtgggatatt

SEQ ID NO: 24168 - DNA, 21 bp, Artificial sequence
  SiRNA target sequence
tcaataatttgtgggatattg

SEQ ID NO: 24169 - DNA, 21 bp, Artificial sequence
  SiRNA target sequence
caataatttgtgggatattgt

SEQ ID NO: 24170 - DNA, 21 bp, Artificial sequence
  SiRNA target sequence
aataatttgtgggatattgtt

SEQ ID NO: 24171 - DNA, 21 bp, Artificial sequence
  SiRNA target sequence
ataatttgtgggatattgtta

SEQ ID NO: 24172 - DNA, 21 bp, Artificial sequence
  SiRNA target sequence
taatttgtgggatattgttat

SEQ ID NO: 24173 - DNA, 21 bp, Artificial sequence
  SiRNA target sequence
aatttgtgggatattgttatg

SEQ ID NO: 24174 - DNA, 21 bp, Artificial sequence
  SiRNA target sequence
atttgtgggatattgttatgt

SEQ ID NO: 24175 - DNA, 21 bp, Artificial sequence
  SiRNA target sequence
tttgtgggatattgttatgta

SEQ ID NO: 24176 - DNA, 21 bp, Artificial sequence
  SiRNA target sequence
ttgtgggatattgttatgtat

SEQ ID NO: 24177 - DNA, 21 bp, Artificial sequence
  SiRNA target sequence
tgtgggatattgttatgtata

SEQ ID NO: 24178 - DNA, 21 bp, Artificial sequence
  SiRNA target sequence
gtgggatattgttatgtataa

SEQ ID NO: 24179 - DNA, 21 bp, Artificial sequence
  SiRNA target sequence
tgggatattgttatgtataag

SEQ ID NO: 24180 - DNA, 21 bp, Artificial sequence
  SiRNA target sequence
gggatattgttatgtataaga

SEQ ID NO: 24181 - DNA, 21 bp, Artificial sequence
  SiRNA target sequence
ggatattgttatgtataagag

SEQ ID NO: 24182 - DNA, 21 bp, Artificial sequence
  SiRNA target sequence
gatattgttatgtataagaga

SEQ ID NO: 24183 - DNA, 21 bp, Artificial sequence
  SiRNA target sequence
atattgttatgtataagagac

SEQ ID NO: 24184 - DNA, 21 bp, Artificial sequence
  SiRNA target sequence
tattgttatgtataagagaca

SEQ ID NO: 24185 - DNA, 21 bp, Artificial sequence
  SiRNA target sequence
attgttatgtataagagacac

SEQ ID NO: 24186 - DNA, 21 bp, Artificial sequence
  SiRNA target sequence
ttgttatgtataagagacaca

SEQ ID NO: 24187 - DNA, 21 bp, Artificial sequence
  SiRNA target sequence
tgttatgtataagagacacac

SEQ ID NO: 24188 - DNA, 21 bp, Artificial sequence
  SiRNA target sequence
gttatgtataagagacacaca

SEQ ID NO: 24189 - DNA, 21 bp, Artificial sequence
  SiRNA target sequence
ttatgtataagagacacacaa

SEQ ID NO: 24190 - DNA, 21 bp, Artificial sequence
  SiRNA target sequence
tatgtataagagacacacaag

SEQ ID NO: 24191 - DNA, 21 bp, Artificial sequence
  SiRNA target sequence
atgtataagagacacacaaga

SEQ ID NO: 24192 - DNA, 21 bp, Artificial sequence
  SiRNA target sequence
tgtataagagacacacaagaa

SEQ ID NO: 24193 - DNA, 21 bp, Artificial sequence
  SiRNA target sequence
gtataagagacacacaagaat

SEQ ID NO: 24194 - DNA, 21 bp, Artificial sequence
  SiRNA target sequence
tataagagacacacaagaatt

SEQ ID NO: 24195 - DNA, 21 bp, Artificial sequence
  SiRNA target sequence
ataagagacacacaagaattg

SEQ ID NO: 24196 - DNA, 21 bp, Artificial sequence
  SiRNA target sequence
taagagacacacaagaattgg

SEQ ID NO: 24197 - DNA, 21 bp, Artificial sequence
  SiRNA target sequence
aagagacacacaagaattggt

SEQ ID NO: 24198 - DNA, 21 bp, Artificial sequence
  SiRNA target sequence
agagacacacaagaattggtt

SEQ ID NO: 24199 - DNA, 21 bp, Artificial sequence
  SiRNA target sequence
gagacacacaagaattggttg

SEQ ID NO: 24200 - DNA, 21 bp, Artificial sequence
  SiRNA target sequence
agacacacaagaattggttgt

SEQ ID NO: 24201 - DNA, 21 bp, Artificial sequence
  SiRNA target sequence
gacacacaagaattggttgtt

SEQ ID NO: 24202 - DNA, 21 bp, Artificial sequence
  SiRNA target sequence
acacacaagaattggttgttc

SEQ ID NO: 24203 - DNA, 21 bp, Artificial sequence
  SiRNA target sequence
cacacaagaattggttgttcc

SEQ ID NO: 24204 - DNA, 21 bp, Artificial sequence
  SiRNA target sequence
acacaagaattggttgttcct

SEQ ID NO: 24205 - DNA, 21 bp, Artificial sequence
  SiRNA target sequence
cacaagaattggttgttccta

SEQ ID NO: 24206 - DNA, 21 bp, Artificial sequence
  SiRNA target sequence
acaagaattggttgttcctag

SEQ ID NO: 24207 - DNA, 21 bp, Artificial sequence
  SiRNA target sequence
caagaattggttgttcctaga

SEQ ID NO: 24208 - DNA, 21 bp, Artificial sequence
  SiRNA target sequence
aagaattggttgttcctagat

SEQ ID NO: 24209 - DNA, 21 bp, Artificial sequence
  SiRNA target sequence
agaattggttgttcctagatc

SEQ ID NO: 24210 - DNA, 21 bp, Artificial sequence
  SiRNA target sequence
gaattggttgttcctagatca

SEQ ID NO: 24211 - DNA, 21 bp, Artificial sequence
  SiRNA target sequence
aattggttgttcctagatcaa

SEQ ID NO: 24212 - DNA, 21 bp, Artificial sequence
  SiRNA target sequence
attggttgttcctagatcaat

SEQ ID NO: 24213 - DNA, 21 bp, Artificial sequence
  SiRNA target sequence
ttggttgttcctagatcaatt

SEQ ID NO: 24214 - DNA, 21 bp, Artificial sequence
  SiRNA target sequence
tggttgttcctagatcaattc

SEQ ID NO: 24215 - DNA, 21 bp, Artificial sequence
  SiRNA target sequence
ggttgttcctagatcaattcc

SEQ ID NO: 24216 - DNA, 21 bp, Artificial sequence
  SiRNA target sequence
gttgttcctagatcaattcct

SEQ ID NO: 24217 - DNA, 21 bp, Artificial sequence
  SiRNA target sequence
ttgttcctagatcaattccta

SEQ ID NO: 24218 - DNA, 21 bp, Artificial sequence
  SiRNA target sequence
tgttcctagatcaattcctat

SEQ ID NO: 24219 - DNA, 21 bp, Artificial sequence
  SiRNA target sequence
gttcctagatcaattcctatt

SEQ ID NO: 24220 - DNA, 21 bp, Artificial sequence
  SiRNA target sequence
ttcctagatcaattcctatta

SEQ ID NO: 24221 - DNA, 21 bp, Artificial sequence
  SiRNA target sequence
tcctagatcaattcctattat

SEQ ID NO: 24222 - DNA, 21 bp, Artificial sequence
  SiRNA target sequence
cctagatcaattcctattatt

SEQ ID NO: 24223 - DNA, 21 bp, Artificial sequence
  SiRNA target sequence
ctagatcaattcctattattt

SEQ ID NO: 24224 - DNA, 21 bp, Artificial sequence
  SiRNA target sequence
tagatcaattcctattatttt

SEQ ID NO: 24225 - DNA, 21 bp, Artificial sequence
  SiRNA target sequence
agatcaattcctattatttta

SEQ ID NO: 24226 - DNA, 21 bp, Artificial sequence
  SiRNA target sequence
gatcaattcctattattttag

SEQ ID NO: 24227 - DNA, 21 bp, Artificial sequence
  SiRNA target sequence
atcaattcctattattttaga

SEQ ID NO: 24228 - DNA, 21 bp, Artificial sequence
  SiRNA target sequence
tcaattcctattattttagag

SEQ ID NO: 24229 - DNA, 21 bp, Artificial sequence
  SiRNA target sequence
caattcctattattttagagc

SEQ ID NO: 24230 - DNA, 21 bp, Artificial sequence
  SiRNA target sequence
aattcctattattttagagct

SEQ ID NO: 24231 - DNA, 21 bp, Artificial sequence
  SiRNA target sequence
attcctattattttagagcta

SEQ ID NO: 24232 - DNA, 21 bp, Artificial sequence
  SiRNA target sequence
ttcctattattttagagctaa

SEQ ID NO: 24233 - DNA, 21 bp, Artificial sequence
  SiRNA target sequence
tcctattattttagagctaat

SEQ ID NO: 24234 - DNA, 21 bp, Artificial sequence
  SiRNA target sequence
cctattattttagagctaatt

SEQ ID NO: 24235 - DNA, 21 bp, Artificial sequence
  SiRNA target sequence
ctattattttagagctaattt

SEQ ID NO: 24236 - DNA, 21 bp, Artificial sequence
  SiRNA target sequence
tattattttagagctaatttc

SEQ ID NO: 24237 - DNA, 21 bp, Artificial sequence
  SiRNA target sequence
attattttagagctaatttct

SEQ ID NO: 24238 - DNA, 21 bp, Artificial sequence
  SiRNA target sequence
ttattttagagctaatttctt

SEQ ID NO: 24239 - DNA, 21 bp, Artificial sequence
  SiRNA target sequence
tattttagagctaatttcttc

SEQ ID NO: 24240 - DNA, 21 bp, Artificial sequence
  SiRNA target sequence
attttagagctaatttcttct

SEQ ID NO: 24241 - DNA, 21 bp, Artificial sequence
  SiRNA target sequence
ttttagagctaatttcttctt

SEQ ID NO: 24242 - DNA, 21 bp, Artificial sequence
  SiRNA target sequence
tttagagctaatttcttcttt

SEQ ID NO: 24243 - DNA, 21 bp, Artificial sequence
  SiRNA target sequence
ttagagctaatttcttcttta

SEQ ID NO: 24244 - DNA, 21 bp, Artificial sequence
  SiRNA target sequence
tagagctaatttcttctttag

SEQ ID NO: 24245 - DNA, 21 bp, Artificial sequence
  SiRNA target sequence
agagctaatttcttctttaga

SEQ ID NO: 24246 - DNA, 21 bp, Artificial sequence
  SiRNA target sequence
gagctaatttcttctttagac

SEQ ID NO: 24247 - DNA, 21 bp, Artificial sequence
  SiRNA target sequence
agctaatttcttctttagaca

SEQ ID NO: 24248 - DNA, 21 bp, Artificial sequence
  SiRNA target sequence
gctaatttcttctttagacat

SEQ ID NO: 24249 - DNA, 22 bp, Artificial sequence
  SiRNA target sequence
ttaagaatttttcaatattttt

SEQ ID NO: 24250 - DNA, 22 bp, Artificial sequence
  SiRNA target sequence
taagaatttttcaatatttttt

SEQ ID NO: 24251 - DNA, 22 bp, Artificial sequence
  SiRNA target sequence
aagaatttttcaatattttttt

SEQ ID NO: 24252 - DNA, 22 bp, Artificial sequence
  SiRNA target sequence
agaatttttcaatatttttttt

SEQ ID NO: 24253 - DNA, 22 bp, Artificial sequence
  SiRNA target sequence
gaatttttcaatattttttttg

SEQ ID NO: 24254 - DNA, 22 bp, Artificial sequence
  SiRNA target sequence
aatttttcaatattttttttgc

SEQ ID NO: 24255 - DNA, 22 bp, Artificial sequence
  SiRNA target sequence
atttttcaatattttttttgct

SEQ ID NO: 24256 - DNA, 22 bp, Artificial sequence
  SiRNA target sequence
tttttcaatattttttttgctt

SEQ ID NO: 24257 - DNA, 22 bp, Artificial sequence
  SiRNA target sequence
ttttcaatattttttttgcttg

SEQ ID NO: 24258 - DNA, 22 bp, Artificial sequence
  SiRNA target sequence
tttcaatattttttttgcttgt

SEQ ID NO: 24259 - DNA, 22 bp, Artificial sequence
  SiRNA target sequence
ttcaatattttttttgcttgtt

SEQ ID NO: 24260 - DNA, 22 bp, Artificial sequence
  SiRNA target sequence
tcaatattttttttgcttgttc

SEQ ID NO: 24261 - DNA, 22 bp, Artificial sequence
  SiRNA target sequence
caatattttttttgcttgttct

SEQ ID NO: 24262 - DNA, 22 bp, Artificial sequence
  SiRNA target sequence
aatattttttttgcttgttcta

SEQ ID NO: 24263 - DNA, 22 bp, Artificial sequence
  SiRNA target sequence
atattttttttgcttgttctaa

SEQ ID NO: 24264 - DNA, 22 bp, Artificial sequence
  SiRNA target sequence
tattttttttgcttgttctaag

SEQ ID NO: 24265 - DNA, 22 bp, Artificial sequence
  SiRNA target sequence
attttttttgcttgttctaagt

SEQ ID NO: 24266 - DNA, 22 bp, Artificial sequence
  SiRNA target sequence
ttttttttgcttgttctaagtc

SEQ ID NO: 24267 - DNA, 22 bp, Artificial sequence
  SiRNA target sequence
tttttttgcttgttctaagtca

SEQ ID NO: 24268 - DNA, 22 bp, Artificial sequence
  SiRNA target sequence
ttttttgcttgttctaagtcat

SEQ ID NO: 24269 - DNA, 22 bp, Artificial sequence
  SiRNA target sequence
tttttgcttgttctaagtcata

SEQ ID NO: 24270 - DNA, 22 bp, Artificial sequence
  SiRNA target sequence
ttttgcttgttctaagtcataa

SEQ ID NO: 24271 - DNA, 22 bp, Artificial sequence
  SiRNA target sequence
tttgcttgttctaagtcataaa

SEQ ID NO: 24272 - DNA, 22 bp, Artificial sequence
  SiRNA target sequence
ttgcttgttctaagtcataaat

SEQ ID NO: 24273 - DNA, 22 bp, Artificial sequence
  SiRNA target sequence
tgcttgttctaagtcataaatt

SEQ ID NO: 24274 - DNA, 22 bp, Artificial sequence
  SiRNA target sequence
gcttgttctaagtcataaattt

SEQ ID NO: 24275 - DNA, 22 bp, Artificial sequence
  SiRNA target sequence
cttgttctaagtcataaatttt

SEQ ID NO: 24276 - DNA, 22 bp, Artificial sequence
  SiRNA target sequence
ttgttctaagtcataaattttt

SEQ ID NO: 24277 - DNA, 22 bp, Artificial sequence
  SiRNA target sequence
tgttctaagtcataaatttttt

SEQ ID NO: 24278 - DNA, 22 bp, Artificial sequence
  SiRNA target sequence
gttctaagtcataaattttttt

SEQ ID NO: 24279 - DNA, 22 bp, Artificial sequence
  SiRNA target sequence
ttctaagtcataaattttttta

SEQ ID NO: 24280 - DNA, 22 bp, Artificial sequence
  SiRNA target sequence
tctaagtcataaatttttttag

SEQ ID NO: 24281 - DNA, 22 bp, Artificial sequence
  SiRNA target sequence
ctaagtcataaatttttttagt

SEQ ID NO: 24282 - DNA, 22 bp, Artificial sequence
  SiRNA target sequence
taagtcataaatttttttagtc

SEQ ID NO: 24283 - DNA, 22 bp, Artificial sequence
  SiRNA target sequence
aagtcataaatttttttagtca

SEQ ID NO: 24284 - DNA, 22 bp, Artificial sequence
  SiRNA target sequence
agtcataaatttttttagtcaa

SEQ ID NO: 24285 - DNA, 22 bp, Artificial sequence
  SiRNA target sequence
gtcataaatttttttagtcaaa

SEQ ID NO: 24286 - DNA, 22 bp, Artificial sequence
  SiRNA target sequence
tcataaatttttttagtcaaat

SEQ ID NO: 24287 - DNA, 22 bp, Artificial sequence
  SiRNA target sequence
cataaatttttttagtcaaata

SEQ ID NO: 24288 - DNA, 22 bp, Artificial sequence
  SiRNA target sequence
ataaatttttttagtcaaatat

SEQ ID NO: 24289 - DNA, 22 bp, Artificial sequence
  SiRNA target sequence
taaatttttttagtcaaatatg

SEQ ID NO: 24290 - DNA, 22 bp, Artificial sequence
  SiRNA target sequence
aaatttttttagtcaaatatga

SEQ ID NO: 24291 - DNA, 22 bp, Artificial sequence
  SiRNA target sequence
aatttttttagtcaaatatgac

SEQ ID NO: 24292 - DNA, 22 bp, Artificial sequence
  SiRNA target sequence
atttttttagtcaaatatgact

SEQ ID NO: 24293 - DNA, 22 bp, Artificial sequence
  SiRNA target sequence
tttttttagtcaaatatgactt

SEQ ID NO: 24294 - DNA, 22 bp, Artificial sequence
  SiRNA target sequence
ttttttagtcaaatatgacttt

SEQ ID NO: 24295 - DNA, 22 bp, Artificial sequence
  SiRNA target sequence
tttttagtcaaatatgacttta

SEQ ID NO: 24296 - DNA, 22 bp, Artificial sequence
  SiRNA target sequence
ttttagtcaaatatgactttaa

SEQ ID NO: 24297 - DNA, 22 bp, Artificial sequence
  SiRNA target sequence
tttagtcaaatatgactttaaa

SEQ ID NO: 24298 - DNA, 22 bp, Artificial sequence
  SiRNA target sequence
ttagtcaaatatgactttaaaa

SEQ ID NO: 24299 - DNA, 22 bp, Artificial sequence
  SiRNA target sequence
tagtcaaatatgactttaaaat

SEQ ID NO: 24300 - DNA, 22 bp, Artificial sequence
  SiRNA target sequence
agtcaaatatgactttaaaatc

SEQ ID NO: 24301 - DNA, 22 bp, Artificial sequence
  SiRNA target sequence
gtcaaatatgactttaaaatct

SEQ ID NO: 24302 - DNA, 22 bp, Artificial sequence
  SiRNA target sequence
tcaaatatgactttaaaatctc

SEQ ID NO: 24303 - DNA, 22 bp, Artificial sequence
  SiRNA target sequence
caaatatgactttaaaatctct

SEQ ID NO: 24304 - DNA, 22 bp, Artificial sequence
  SiRNA target sequence
aaatatgactttaaaatctctt

SEQ ID NO: 24305 - DNA, 22 bp, Artificial sequence
  SiRNA target sequence
aatatgactttaaaatctcttt

SEQ ID NO: 24306 - DNA, 22 bp, Artificial sequence
  SiRNA target sequence
atatgactttaaaatctctttt

SEQ ID NO: 24307 - DNA, 22 bp, Artificial sequence
  SiRNA target sequence
tatgactttaaaatctcttttg

SEQ ID NO: 24308 - DNA, 22 bp, Artificial sequence
  SiRNA target sequence
atgactttaaaatctcttttgt

SEQ ID NO: 24309 - DNA, 22 bp, Artificial sequence
  SiRNA target sequence
tgactttaaaatctcttttgtt

SEQ ID NO: 24310 - DNA, 22 bp, Artificial sequence
  SiRNA target sequence
gactttaaaatctcttttgttt

SEQ ID NO: 24311 - DNA, 22 bp, Artificial sequence
  SiRNA target sequence
actttaaaatctcttttgtttc

SEQ ID NO: 24312 - DNA, 22 bp, Artificial sequence
  SiRNA target sequence
ctttaaaatctcttttgtttca

SEQ ID NO: 24313 - DNA, 22 bp, Artificial sequence
  SiRNA target sequence
tttaaaatctcttttgtttcat

SEQ ID NO: 24314 - DNA, 22 bp, Artificial sequence
  SiRNA target sequence
ttaaaatctcttttgtttcatc

SEQ ID NO: 24315 - DNA, 22 bp, Artificial sequence
  SiRNA target sequence
taaaatctcttttgtttcatct

SEQ ID NO: 24316 - DNA, 22 bp, Artificial sequence
  SiRNA target sequence
aaaatctcttttgtttcatctg

SEQ ID NO: 24317 - DNA, 22 bp, Artificial sequence
  SiRNA target sequence
aaatctcttttgtttcatctgt

SEQ ID NO: 24318 - DNA, 22 bp, Artificial sequence
  SiRNA target sequence
aatctcttttgtttcatctgtt

SEQ ID NO: 24319 - DNA, 22 bp, Artificial sequence
  SiRNA target sequence
atctcttttgtttcatctgtta

SEQ ID NO: 24320 - DNA, 22 bp, Artificial sequence
  SiRNA target sequence
tctcttttgtttcatctgttac

SEQ ID NO: 24321 - DNA, 22 bp, Artificial sequence
  SiRNA target sequence
ctcttttgtttcatctgttact

SEQ ID NO: 24322 - DNA, 22 bp, Artificial sequence
  SiRNA target sequence
tcttttgtttcatctgttactt

SEQ ID NO: 24323 - DNA, 22 bp, Artificial sequence
  SiRNA target sequence
cttttgtttcatctgttacttg

SEQ ID NO: 24324 - DNA, 22 bp, Artificial sequence
  SiRNA target sequence
ttttgtttcatctgttacttgt

SEQ ID NO: 24325 - DNA, 22 bp, Artificial sequence
  SiRNA target sequence
tttgtttcatctgttacttgtt

SEQ ID NO: 24326 - DNA, 22 bp, Artificial sequence
  SiRNA target sequence
ttgtttcatctgttacttgttt

SEQ ID NO: 24327 - DNA, 22 bp, Artificial sequence
  SiRNA target sequence
tgtttcatctgttacttgtttg

SEQ ID NO: 24328 - DNA, 22 bp, Artificial sequence
  SiRNA target sequence
gtttcatctgttacttgtttgt

SEQ ID NO: 24329 - DNA, 22 bp, Artificial sequence
  SiRNA target sequence
tttcatctgttacttgtttgta

SEQ ID NO: 24330 - DNA, 22 bp, Artificial sequence
  SiRNA target sequence
ttcatctgttacttgtttgtac

SEQ ID NO: 24331 - DNA, 22 bp, Artificial sequence
  SiRNA target sequence
tcatctgttacttgtttgtact

SEQ ID NO: 24332 - DNA, 22 bp, Artificial sequence
  SiRNA target sequence
catctgttacttgtttgtactt

SEQ ID NO: 24333 - DNA, 22 bp, Artificial sequence
  SiRNA target sequence
atctgttacttgtttgtacttt

SEQ ID NO: 24334 - DNA, 22 bp, Artificial sequence
  SiRNA target sequence
tctgttacttgtttgtacttta

SEQ ID NO: 24335 - DNA, 22 bp, Artificial sequence
  SiRNA target sequence
ctgttacttgtttgtactttaa

SEQ ID NO: 24336 - DNA, 22 bp, Artificial sequence
  SiRNA target sequence
tgttacttgtttgtactttaaa

SEQ ID NO: 24337 - DNA, 22 bp, Artificial sequence
  SiRNA target sequence
gttacttgtttgtactttaaaa

SEQ ID NO: 24338 - DNA, 22 bp, Artificial sequence
  SiRNA target sequence
ttacttgtttgtactttaaaaa

SEQ ID NO: 24339 - DNA, 22 bp, Artificial sequence
  SiRNA target sequence
tacttgtttgtactttaaaaat

SEQ ID NO: 24340 - DNA, 22 bp, Artificial sequence
  SiRNA target sequence
acttgtttgtactttaaaaatt

SEQ ID NO: 24341 - DNA, 22 bp, Artificial sequence
  SiRNA target sequence
cttgtttgtactttaaaaattg

SEQ ID NO: 24342 - DNA, 22 bp, Artificial sequence
  SiRNA target sequence
ttgtttgtactttaaaaattgt

SEQ ID NO: 24343 - DNA, 22 bp, Artificial sequence
  SiRNA target sequence
tgtttgtactttaaaaattgtt

SEQ ID NO: 24344 - DNA, 22 bp, Artificial sequence
  SiRNA target sequence
gtttgtactttaaaaattgttg

SEQ ID NO: 24345 - DNA, 22 bp, Artificial sequence
  SiRNA target sequence
tttgtactttaaaaattgttga

SEQ ID NO: 24346 - DNA, 22 bp, Artificial sequence
  SiRNA target sequence
ttgtactttaaaaattgttgaa

SEQ ID NO: 24347 - DNA, 22 bp, Artificial sequence
  SiRNA target sequence
tgtactttaaaaattgttgaat

SEQ ID NO: 24348 - DNA, 22 bp, Artificial sequence
  SiRNA target sequence
gtactttaaaaattgttgaatt

SEQ ID NO: 24349 - DNA, 22 bp, Artificial sequence
  SiRNA target sequence
tactttaaaaattgttgaattt

SEQ ID NO: 24350 - DNA, 22 bp, Artificial sequence
  SiRNA target sequence
actttaaaaattgttgaatttc

SEQ ID NO: 24351 - DNA, 22 bp, Artificial sequence
  SiRNA target sequence
ctttaaaaattgttgaatttca

SEQ ID NO: 24352 - DNA, 22 bp, Artificial sequence
  SiRNA target sequence
tttaaaaattgttgaatttcaa

SEQ ID NO: 24353 - DNA, 22 bp, Artificial sequence
  SiRNA target sequence
ttaaaaattgttgaatttcaat

SEQ ID NO: 24354 - DNA, 22 bp, Artificial sequence
  SiRNA target sequence
taaaaattgttgaatttcaatt

SEQ ID NO: 24355 - DNA, 22 bp, Artificial sequence
  SiRNA target sequence
aaaaattgttgaatttcaattt

SEQ ID NO: 24356 - DNA, 22 bp, Artificial sequence
  SiRNA target sequence
aaaattgttgaatttcaatttt

SEQ ID NO: 24357 - DNA, 22 bp, Artificial sequence
  SiRNA target sequence
aaattgttgaatttcaatttta

SEQ ID NO: 24358 - DNA, 22 bp, Artificial sequence
  SiRNA target sequence
aattgttgaatttcaattttaa

SEQ ID NO: 24359 - DNA, 22 bp, Artificial sequence
  SiRNA target sequence
attgttgaatttcaattttaaa

SEQ ID NO: 24360 - DNA, 22 bp, Artificial sequence
  SiRNA target sequence
ttgttgaatttcaattttaaat

SEQ ID NO: 24361 - DNA, 22 bp, Artificial sequence
  SiRNA target sequence
tgttgaatttcaattttaaatt

SEQ ID NO: 24362 - DNA, 22 bp, Artificial sequence
  SiRNA target sequence
gttgaatttcaattttaaattc

SEQ ID NO: 24363 - DNA, 22 bp, Artificial sequence
  SiRNA target sequence
ttgaatttcaattttaaattcg

SEQ ID NO: 24364 - DNA, 22 bp, Artificial sequence
  SiRNA target sequence
tgaatttcaattttaaattcgg

SEQ ID NO: 24365 - DNA, 22 bp, Artificial sequence
  SiRNA target sequence
gaatttcaattttaaattcggc

SEQ ID NO: 24366 - DNA, 22 bp, Artificial sequence
  SiRNA target sequence
aatttcaattttaaattcggca

SEQ ID NO: 24367 - DNA, 22 bp, Artificial sequence
  SiRNA target sequence
atttcaattttaaattcggcac

SEQ ID NO: 24368 - DNA, 22 bp, Artificial sequence
  SiRNA target sequence
tttcaattttaaattcggcaca

SEQ ID NO: 24369 - DNA, 22 bp, Artificial sequence
  SiRNA target sequence
ttcaattttaaattcggcacaa

SEQ ID NO: 24370 - DNA, 22 bp, Artificial sequence
  SiRNA target sequence
tcaattttaaattcggcacaat

SEQ ID NO: 24371 - DNA, 22 bp, Artificial sequence
  SiRNA target sequence
caattttaaattcggcacaatt

SEQ ID NO: 24372 - DNA, 22 bp, Artificial sequence
  SiRNA target sequence
aattttaaattcggcacaattt

SEQ ID NO: 24373 - DNA, 22 bp, Artificial sequence
  SiRNA target sequence
attttaaattcggcacaatttt

SEQ ID NO: 24374 - DNA, 22 bp, Artificial sequence
  SiRNA target sequence
ttttaaattcggcacaattttt

SEQ ID NO: 24375 - DNA, 22 bp, Artificial sequence
  SiRNA target sequence
tttaaattcggcacaatttttt

SEQ ID NO: 24376 - DNA, 22 bp, Artificial sequence
  SiRNA target sequence
ttaaattcggcacaattttttt

SEQ ID NO: 24377 - DNA, 22 bp, Artificial sequence
  SiRNA target sequence
taaattcggcacaatttttttc

SEQ ID NO: 24378 - DNA, 22 bp, Artificial sequence
  SiRNA target sequence
aaattcggcacaatttttttca

SEQ ID NO: 24379 - DNA, 22 bp, Artificial sequence
  SiRNA target sequence
aattcggcacaatttttttcaa

SEQ ID NO: 24380 - DNA, 22 bp, Artificial sequence
  SiRNA target sequence
attcggcacaatttttttcaat

SEQ ID NO: 24381 - DNA, 22 bp, Artificial sequence
  SiRNA target sequence
ttcggcacaatttttttcaatt

SEQ ID NO: 24382 - DNA, 22 bp, Artificial sequence
  SiRNA target sequence
tcggcacaatttttttcaattt

SEQ ID NO: 24383 - DNA, 22 bp, Artificial sequence
  SiRNA target sequence
cggcacaatttttttcaatttc

SEQ ID NO: 24384 - DNA, 22 bp, Artificial sequence
  SiRNA target sequence
ggcacaatttttttcaatttca

SEQ ID NO: 24385 - DNA, 22 bp, Artificial sequence
  SiRNA target sequence
gcacaatttttttcaatttcat

SEQ ID NO: 24386 - DNA, 22 bp, Artificial sequence
  SiRNA target sequence
cacaatttttttcaatttcatc

SEQ ID NO: 24387 - DNA, 22 bp, Artificial sequence
  SiRNA target sequence
acaatttttttcaatttcatct

SEQ ID NO: 24388 - DNA, 22 bp, Artificial sequence
  SiRNA target sequence
caatttttttcaatttcatctt

SEQ ID NO: 24389 - DNA, 22 bp, Artificial sequence
  SiRNA target sequence
aatttttttcaatttcatcttt

SEQ ID NO: 24390 - DNA, 22 bp, Artificial sequence
  SiRNA target sequence
atttttttcaatttcatctttt

SEQ ID NO: 24391 - DNA, 22 bp, Artificial sequence
  SiRNA target sequence
tttttttcaatttcatcttttt

SEQ ID NO: 24392 - DNA, 22 bp, Artificial sequence
  SiRNA target sequence
ttttttcaatttcatctttttt

SEQ ID NO: 24393 - DNA, 22 bp, Artificial sequence
  SiRNA target sequence
tttttcaatttcatcttttttc

SEQ ID NO: 24394 - DNA, 22 bp, Artificial sequence
  SiRNA target sequence
ttttcaatttcatcttttttcg

SEQ ID NO: 24395 - DNA, 22 bp, Artificial sequence
  SiRNA target sequence
tttcaatttcatcttttttcga

SEQ ID NO: 24396 - DNA, 22 bp, Artificial sequence
  SiRNA target sequence
ttcaatttcatcttttttcgaa

SEQ ID NO: 24397 - DNA, 22 bp, Artificial sequence
  SiRNA target sequence
tcaatttcatcttttttcgaat

SEQ ID NO: 24398 - DNA, 22 bp, Artificial sequence
  SiRNA target sequence
caatttcatcttttttcgaatt

SEQ ID NO: 24399 - DNA, 22 bp, Artificial sequence
  SiRNA target sequence
aatttcatcttttttcgaattt

SEQ ID NO: 24400 - DNA, 22 bp, Artificial sequence
  SiRNA target sequence
atttcatcttttttcgaatttt

SEQ ID NO: 24401 - DNA, 22 bp, Artificial sequence
  SiRNA target sequence
tttcatcttttttcgaattttc

SEQ ID NO: 24402 - DNA, 22 bp, Artificial sequence
  SiRNA target sequence
ttcatcttttttcgaattttct

SEQ ID NO: 24403 - DNA, 22 bp, Artificial sequence
  SiRNA target sequence
tcatcttttttcgaattttctt

SEQ ID NO: 24404 - DNA, 22 bp, Artificial sequence
  SiRNA target sequence
catcttttttcgaattttcttc

SEQ ID NO: 24405 - DNA, 22 bp, Artificial sequence
  SiRNA target sequence
atcttttttcgaattttcttcg

SEQ ID NO: 24406 - DNA, 22 bp, Artificial sequence
  SiRNA target sequence
tcttttttcgaattttcttcgg

SEQ ID NO: 24407 - DNA, 22 bp, Artificial sequence
  SiRNA target sequence
cttttttcgaattttcttcggc

SEQ ID NO: 24408 - DNA, 22 bp, Artificial sequence
  SiRNA target sequence
ttttttcgaattttcttcggct

SEQ ID NO: 24409 - DNA, 22 bp, Artificial sequence
  SiRNA target sequence
tttttcgaattttcttcggctt

SEQ ID NO: 24410 - DNA, 22 bp, Artificial sequence
  SiRNA target sequence
ttttcgaattttcttcggcttc

SEQ ID NO: 24411 - DNA, 22 bp, Artificial sequence
  SiRNA target sequence
tttcgaattttcttcggcttct

SEQ ID NO: 24412 - DNA, 22 bp, Artificial sequence
  SiRNA target sequence
ttcgaattttcttcggcttctc

SEQ ID NO: 24413 - DNA, 22 bp, Artificial sequence
  SiRNA target sequence
tcgaattttcttcggcttctcg

SEQ ID NO: 24414 - DNA, 22 bp, Artificial sequence
  SiRNA target sequence
cgaattttcttcggcttctcgt

SEQ ID NO: 24415 - DNA, 22 bp, Artificial sequence
  SiRNA target sequence
gaattttcttcggcttctcgta

SEQ ID NO: 24416 - DNA, 22 bp, Artificial sequence
  SiRNA target sequence
aattttcttcggcttctcgtat

SEQ ID NO: 24417 - DNA, 22 bp, Artificial sequence
  SiRNA target sequence
attttcttcggcttctcgtatc

SEQ ID NO: 24418 - DNA, 22 bp, Artificial sequence
  SiRNA target sequence
ttttcttcggcttctcgtatca

SEQ ID NO: 24419 - DNA, 22 bp, Artificial sequence
  SiRNA target sequence
tttcttcggcttctcgtatcat

SEQ ID NO: 24420 - DNA, 22 bp, Artificial sequence
  SiRNA target sequence
ttcttcggcttctcgtatcatt

SEQ ID NO: 24421 - DNA, 22 bp, Artificial sequence
  SiRNA target sequence
tcttcggcttctcgtatcattt

SEQ ID NO: 24422 - DNA, 22 bp, Artificial sequence
  SiRNA target sequence
cttcggcttctcgtatcatttg

SEQ ID NO: 24423 - DNA, 22 bp, Artificial sequence
  SiRNA target sequence
ttcggcttctcgtatcatttgc

SEQ ID NO: 24424 - DNA, 22 bp, Artificial sequence
  SiRNA target sequence
tcggcttctcgtatcatttgcg

SEQ ID NO: 24425 - DNA, 22 bp, Artificial sequence
  SiRNA target sequence
cggcttctcgtatcatttgcga

SEQ ID NO: 24426 - DNA, 22 bp, Artificial sequence
  SiRNA target sequence
ggcttctcgtatcatttgcgaa

SEQ ID NO: 24427 - DNA, 22 bp, Artificial sequence
  SiRNA target sequence
gcttctcgtatcatttgcgaaa

SEQ ID NO: 24428 - DNA, 22 bp, Artificial sequence
  SiRNA target sequence
cttctcgtatcatttgcgaaat

SEQ ID NO: 24429 - DNA, 22 bp, Artificial sequence
  SiRNA target sequence
ttctcgtatcatttgcgaaatt

SEQ ID NO: 24430 - DNA, 22 bp, Artificial sequence
  SiRNA target sequence
tctcgtatcatttgcgaaattt

SEQ ID NO: 24431 - DNA, 22 bp, Artificial sequence
  SiRNA target sequence
ctcgtatcatttgcgaaatttc

SEQ ID NO: 24432 - DNA, 22 bp, Artificial sequence
  SiRNA target sequence
tcgtatcatttgcgaaatttca

SEQ ID NO: 24433 - DNA, 22 bp, Artificial sequence
  SiRNA target sequence
cgtatcatttgcgaaatttcac

SEQ ID NO: 24434 - DNA, 22 bp, Artificial sequence
  SiRNA target sequence
gtatcatttgcgaaatttcacc

SEQ ID NO: 24435 - DNA, 22 bp, Artificial sequence
  SiRNA target sequence
tatcatttgcgaaatttcacct

SEQ ID NO: 24436 - DNA, 22 bp, Artificial sequence
  SiRNA target sequence
atcatttgcgaaatttcacctt

SEQ ID NO: 24437 - DNA, 22 bp, Artificial sequence
  SiRNA target sequence
tcatttgcgaaatttcaccttc

SEQ ID NO: 24438 - DNA, 22 bp, Artificial sequence
  SiRNA target sequence
catttgcgaaatttcaccttca

SEQ ID NO: 24439 - DNA, 22 bp, Artificial sequence
  SiRNA target sequence
atttgcgaaatttcaccttcat

SEQ ID NO: 24440 - DNA, 22 bp, Artificial sequence
  SiRNA target sequence
tttgcgaaatttcaccttcatt

SEQ ID NO: 24441 - DNA, 22 bp, Artificial sequence
  SiRNA target sequence
ttgcgaaatttcaccttcattt

SEQ ID NO: 24442 - DNA, 22 bp, Artificial sequence
  SiRNA target sequence
tgcgaaatttcaccttcattta

SEQ ID NO: 24443 - DNA, 22 bp, Artificial sequence
  SiRNA target sequence
gcgaaatttcaccttcatttaa

SEQ ID NO: 24444 - DNA, 22 bp, Artificial sequence
  SiRNA target sequence
cgaaatttcaccttcatttaat

SEQ ID NO: 24445 - DNA, 22 bp, Artificial sequence
  SiRNA target sequence
gaaatttcaccttcatttaatc

SEQ ID NO: 24446 - DNA, 22 bp, Artificial sequence
  SiRNA target sequence
aaatttcaccttcatttaatcc

SEQ ID NO: 24447 - DNA, 22 bp, Artificial sequence
  SiRNA target sequence
aatttcaccttcatttaatcca

SEQ ID NO: 24448 - DNA, 22 bp, Artificial sequence
  SiRNA target sequence
atttcaccttcatttaatccac

SEQ ID NO: 24449 - DNA, 22 bp, Artificial sequence
  SiRNA target sequence
tttcaccttcatttaatccact

SEQ ID NO: 24450 - DNA, 22 bp, Artificial sequence
  SiRNA target sequence
ttcaccttcatttaatccactt

SEQ ID NO: 24451 - DNA, 22 bp, Artificial sequence
  SiRNA target sequence
tcaccttcatttaatccacttg

SEQ ID NO: 24452 - DNA, 22 bp, Artificial sequence
  SiRNA target sequence
caccttcatttaatccacttga

SEQ ID NO: 24453 - DNA, 22 bp, Artificial sequence
  SiRNA target sequence
accttcatttaatccacttgaa

SEQ ID NO: 24454 - DNA, 22 bp, Artificial sequence
  SiRNA target sequence
ccttcatttaatccacttgaag

SEQ ID NO: 24455 - DNA, 22 bp, Artificial sequence
  SiRNA target sequence
cttcatttaatccacttgaagg

SEQ ID NO: 24456 - DNA, 22 bp, Artificial sequence
  SiRNA target sequence
ttcatttaatccacttgaaggc

SEQ ID NO: 24457 - DNA, 22 bp, Artificial sequence
  SiRNA target sequence
tcatttaatccacttgaaggca

SEQ ID NO: 24458 - DNA, 22 bp, Artificial sequence
  SiRNA target sequence
catttaatccacttgaaggcac

SEQ ID NO: 24459 - DNA, 22 bp, Artificial sequence
  SiRNA target sequence
atttaatccacttgaaggcaca

SEQ ID NO: 24460 - DNA, 22 bp, Artificial sequence
  SiRNA target sequence
tttaatccacttgaaggcacaa

SEQ ID NO: 24461 - DNA, 22 bp, Artificial sequence
  SiRNA target sequence
ttaatccacttgaaggcacaat

SEQ ID NO: 24462 - DNA, 22 bp, Artificial sequence
  SiRNA target sequence
taatccacttgaaggcacaatt

SEQ ID NO: 24463 - DNA, 22 bp, Artificial sequence
  SiRNA target sequence
aatccacttgaaggcacaattt

SEQ ID NO: 24464 - DNA, 22 bp, Artificial sequence
  SiRNA target sequence
atccacttgaaggcacaatttc

SEQ ID NO: 24465 - DNA, 22 bp, Artificial sequence
  SiRNA target sequence
tccacttgaaggcacaatttcg

SEQ ID NO: 24466 - DNA, 22 bp, Artificial sequence
  SiRNA target sequence
ccacttgaaggcacaatttcga

SEQ ID NO: 24467 - DNA, 22 bp, Artificial sequence
  SiRNA target sequence
cacttgaaggcacaatttcgat

SEQ ID NO: 24468 - DNA, 22 bp, Artificial sequence
  SiRNA target sequence
acttgaaggcacaatttcgatt

SEQ ID NO: 24469 - DNA, 22 bp, Artificial sequence
  SiRNA target sequence
cttgaaggcacaatttcgattt

SEQ ID NO: 24470 - DNA, 22 bp, Artificial sequence
  SiRNA target sequence
ttgaaggcacaatttcgatttc

SEQ ID NO: 24471 - DNA, 22 bp, Artificial sequence
  SiRNA target sequence
tgaaggcacaatttcgatttct

SEQ ID NO: 24472 - DNA, 22 bp, Artificial sequence
  SiRNA target sequence
gaaggcacaatttcgatttctt

SEQ ID NO: 24473 - DNA, 22 bp, Artificial sequence
  SiRNA target sequence
aaggcacaatttcgatttcttg

SEQ ID NO: 24474 - DNA, 22 bp, Artificial sequence
  SiRNA target sequence
aggcacaatttcgatttcttgc

SEQ ID NO: 24475 - DNA, 22 bp, Artificial sequence
  SiRNA target sequence
ggcacaatttcgatttcttgct

SEQ ID NO: 24476 - DNA, 22 bp, Artificial sequence
  SiRNA target sequence
gcacaatttcgatttcttgctt

SEQ ID NO: 24477 - DNA, 22 bp, Artificial sequence
  SiRNA target sequence
cacaatttcgatttcttgcttt

SEQ ID NO: 24478 - DNA, 22 bp, Artificial sequence
  SiRNA target sequence
acaatttcgatttcttgctttt

SEQ ID NO: 24479 - DNA, 22 bp, Artificial sequence
  SiRNA target sequence
caatttcgatttcttgcttttt

SEQ ID NO: 24480 - DNA, 22 bp, Artificial sequence
  SiRNA target sequence
aatttcgatttcttgctttttt

SEQ ID NO: 24481 - DNA, 22 bp, Artificial sequence
  SiRNA target sequence
atttcgatttcttgcttttttt

SEQ ID NO: 24482 - DNA, 22 bp, Artificial sequence
  SiRNA target sequence
tttcgatttcttgctttttttt

SEQ ID NO: 24483 - DNA, 22 bp, Artificial sequence
  SiRNA target sequence
ttcgatttcttgcttttttttc

SEQ ID NO: 24484 - DNA, 22 bp, Artificial sequence
  SiRNA target sequence
tcgatttcttgcttttttttcg

SEQ ID NO: 24485 - DNA, 22 bp, Artificial sequence
  SiRNA target sequence
cgatttcttgcttttttttcgt

SEQ ID NO: 24486 - DNA, 22 bp, Artificial sequence
  SiRNA target sequence
gatttcttgcttttttttcgtt

SEQ ID NO: 24487 - DNA, 22 bp, Artificial sequence
  SiRNA target sequence
atttcttgcttttttttcgtta

SEQ ID NO: 24488 - DNA, 22 bp, Artificial sequence
  SiRNA target sequence
tttcttgcttttttttcgttat

SEQ ID NO: 24489 - DNA, 22 bp, Artificial sequence
  SiRNA target sequence
ttcttgcttttttttcgttatc

SEQ ID NO: 24490 - DNA, 22 bp, Artificial sequence
  SiRNA target sequence
tcttgcttttttttcgttatcc

SEQ ID NO: 24491 - DNA, 22 bp, Artificial sequence
  SiRNA target sequence
cttgcttttttttcgttatccc

SEQ ID NO: 24492 - DNA, 22 bp, Artificial sequence
  SiRNA target sequence
ttgcttttttttcgttatcccg

SEQ ID NO: 24493 - DNA, 22 bp, Artificial sequence
  SiRNA target sequence
tgcttttttttcgttatcccgt

SEQ ID NO: 24494 - DNA, 22 bp, Artificial sequence
  SiRNA target sequence
gcttttttttcgttatcccgtc

SEQ ID NO: 24495 - DNA, 22 bp, Artificial sequence
  SiRNA target sequence
cttttttttcgttatcccgtct

SEQ ID NO: 24496 - DNA, 22 bp, Artificial sequence
  SiRNA target sequence
ttttttttcgttatcccgtctt

SEQ ID NO: 24497 - DNA, 22 bp, Artificial sequence
  SiRNA target sequence
tttttttcgttatcccgtcttg

SEQ ID NO: 24498 - DNA, 22 bp, Artificial sequence
  SiRNA target sequence
ttttttcgttatcccgtcttgc

SEQ ID NO: 24499 - DNA, 22 bp, Artificial sequence
  SiRNA target sequence
tttttcgttatcccgtcttgcg

SEQ ID NO: 24500 - DNA, 22 bp, Artificial sequence
  SiRNA target sequence
ttttcgttatcccgtcttgcgc

SEQ ID NO: 24501 - DNA, 22 bp, Artificial sequence
  SiRNA target sequence
tttcgttatcccgtcttgcgca

SEQ ID NO: 24502 - DNA, 22 bp, Artificial sequence
  SiRNA target sequence
ttcgttatcccgtcttgcgcag

SEQ ID NO: 24503 - DNA, 22 bp, Artificial sequence
  SiRNA target sequence
tcgttatcccgtcttgcgcaga

SEQ ID NO: 24504 - DNA, 22 bp, Artificial sequence
  SiRNA target sequence
cgttatcccgtcttgcgcagat

SEQ ID NO: 24505 - DNA, 22 bp, Artificial sequence
  SiRNA target sequence
gttatcccgtcttgcgcagata

SEQ ID NO: 24506 - DNA, 22 bp, Artificial sequence
  SiRNA target sequence
ttatcccgtcttgcgcagatac

SEQ ID NO: 24507 - DNA, 22 bp, Artificial sequence
  SiRNA target sequence
tatcccgtcttgcgcagatact

SEQ ID NO: 24508 - DNA, 22 bp, Artificial sequence
  SiRNA target sequence
atcccgtcttgcgcagatactt

SEQ ID NO: 24509 - DNA, 22 bp, Artificial sequence
  SiRNA target sequence
tcccgtcttgcgcagatacttt

SEQ ID NO: 24510 - DNA, 22 bp, Artificial sequence
  SiRNA target sequence
cccgtcttgcgcagatactttg

SEQ ID NO: 24511 - DNA, 22 bp, Artificial sequence
  SiRNA target sequence
ccgtcttgcgcagatactttgt

SEQ ID NO: 24512 - DNA, 22 bp, Artificial sequence
  SiRNA target sequence
cgtcttgcgcagatactttgta

SEQ ID NO: 24513 - DNA, 22 bp, Artificial sequence
  SiRNA target sequence
gtcttgcgcagatactttgtat

SEQ ID NO: 24514 - DNA, 22 bp, Artificial sequence
  SiRNA target sequence
tcttgcgcagatactttgtata

SEQ ID NO: 24515 - DNA, 22 bp, Artificial sequence
  SiRNA target sequence
cttgcgcagatactttgtatat

SEQ ID NO: 24516 - DNA, 22 bp, Artificial sequence
  SiRNA target sequence
ttgcgcagatactttgtatatt

SEQ ID NO: 24517 - DNA, 22 bp, Artificial sequence
  SiRNA target sequence
tgcgcagatactttgtatattc

SEQ ID NO: 24518 - DNA, 22 bp, Artificial sequence
  SiRNA target sequence
gcgcagatactttgtatattcc

SEQ ID NO: 24519 - DNA, 22 bp, Artificial sequence
  SiRNA target sequence
cgcagatactttgtatattccg

SEQ ID NO: 24520 - DNA, 22 bp, Artificial sequence
  SiRNA target sequence
gcagatactttgtatattccgt

SEQ ID NO: 24521 - DNA, 22 bp, Artificial sequence
  SiRNA target sequence
cagatactttgtatattccgtt

SEQ ID NO: 24522 - DNA, 22 bp, Artificial sequence
  SiRNA target sequence
agatactttgtatattccgtta

SEQ ID NO: 24523 - DNA, 22 bp, Artificial sequence
  SiRNA target sequence
gatactttgtatattccgttag

SEQ ID NO: 24524 - DNA, 22 bp, Artificial sequence
  SiRNA target sequence
atactttgtatattccgttagc

SEQ ID NO: 24525 - DNA, 22 bp, Artificial sequence
  SiRNA target sequence
tactttgtatattccgttagca

SEQ ID NO: 24526 - DNA, 22 bp, Artificial sequence
  SiRNA target sequence
actttgtatattccgttagcat

SEQ ID NO: 24527 - DNA, 22 bp, Artificial sequence
  SiRNA target sequence
ctttgtatattccgttagcatc

SEQ ID NO: 24528 - DNA, 22 bp, Artificial sequence
  SiRNA target sequence
tttgtatattccgttagcatcg

SEQ ID NO: 24529 - DNA, 22 bp, Artificial sequence
  SiRNA target sequence
ttgtatattccgttagcatcgg

SEQ ID NO: 24530 - DNA, 22 bp, Artificial sequence
  SiRNA target sequence
tgtatattccgttagcatcggc

SEQ ID NO: 24531 - DNA, 22 bp, Artificial sequence
  SiRNA target sequence
gtatattccgttagcatcggct

SEQ ID NO: 24532 - DNA, 22 bp, Artificial sequence
  SiRNA target sequence
tatattccgttagcatcggctt

SEQ ID NO: 24533 - DNA, 22 bp, Artificial sequence
  SiRNA target sequence
atattccgttagcatcggcttc

SEQ ID NO: 24534 - DNA, 22 bp, Artificial sequence
  SiRNA target sequence
tattccgttagcatcggcttca

SEQ ID NO: 24535 - DNA, 22 bp, Artificial sequence
  SiRNA target sequence
attccgttagcatcggcttcaa

SEQ ID NO: 24536 - DNA, 22 bp, Artificial sequence
  SiRNA target sequence
ttccgttagcatcggcttcaaa

SEQ ID NO: 24537 - DNA, 22 bp, Artificial sequence
  SiRNA target sequence
tccgttagcatcggcttcaaat

SEQ ID NO: 24538 - DNA, 22 bp, Artificial sequence
  SiRNA target sequence
ccgttagcatcggcttcaaatg

SEQ ID NO: 24539 - DNA, 22 bp, Artificial sequence
  SiRNA target sequence
cgttagcatcggcttcaaatgt

SEQ ID NO: 24540 - DNA, 22 bp, Artificial sequence
  SiRNA target sequence
gttagcatcggcttcaaatgta

SEQ ID NO: 24541 - DNA, 22 bp, Artificial sequence
  SiRNA target sequence
ttagcatcggcttcaaatgtaa

SEQ ID NO: 24542 - DNA, 22 bp, Artificial sequence
  SiRNA target sequence
tagcatcggcttcaaatgtaac

SEQ ID NO: 24543 - DNA, 22 bp, Artificial sequence
  SiRNA target sequence
agcatcggcttcaaatgtaaca

SEQ ID NO: 24544 - DNA, 22 bp, Artificial sequence
  SiRNA target sequence
gcatcggcttcaaatgtaacat

SEQ ID NO: 24545 - DNA, 22 bp, Artificial sequence
  SiRNA target sequence
catcggcttcaaatgtaacatc

SEQ ID NO: 24546 - DNA, 22 bp, Artificial sequence
  SiRNA target sequence
atcggcttcaaatgtaacatct

SEQ ID NO: 24547 - DNA, 22 bp, Artificial sequence
  SiRNA target sequence
tcggcttcaaatgtaacatcta

SEQ ID NO: 24548 - DNA, 22 bp, Artificial sequence
  SiRNA target sequence
cggcttcaaatgtaacatctat

SEQ ID NO: 24549 - DNA, 22 bp, Artificial sequence
  SiRNA target sequence
ggcttcaaatgtaacatctatc

SEQ ID NO: 24550 - DNA, 22 bp, Artificial sequence
  SiRNA target sequence
gcttcaaatgtaacatctatct

SEQ ID NO: 24551 - DNA, 22 bp, Artificial sequence
  SiRNA target sequence
cttcaaatgtaacatctatctt

SEQ ID NO: 24552 - DNA, 22 bp, Artificial sequence
  SiRNA target sequence
ttcaaatgtaacatctatcttt

SEQ ID NO: 24553 - DNA, 22 bp, Artificial sequence
  SiRNA target sequence
tcaaatgtaacatctatctttg

SEQ ID NO: 24554 - DNA, 22 bp, Artificial sequence
  SiRNA target sequence
caaatgtaacatctatctttgg

SEQ ID NO: 24555 - DNA, 22 bp, Artificial sequence
  SiRNA target sequence
aaatgtaacatctatctttgga

SEQ ID NO: 24556 - DNA, 22 bp, Artificial sequence
  SiRNA target sequence
aatgtaacatctatctttggaa

SEQ ID NO: 24557 - DNA, 22 bp, Artificial sequence
  SiRNA target sequence
atgtaacatctatctttggaat

SEQ ID NO: 24558 - DNA, 22 bp, Artificial sequence
  SiRNA target sequence
tgtaacatctatctttggaata

SEQ ID NO: 24559 - DNA, 22 bp, Artificial sequence
  SiRNA target sequence
gtaacatctatctttggaatac

SEQ ID NO: 24560 - DNA, 22 bp, Artificial sequence
  SiRNA target sequence
taacatctatctttggaatacc

SEQ ID NO: 24561 - DNA, 22 bp, Artificial sequence
  SiRNA target sequence
aacatctatctttggaatacct

SEQ ID NO: 24562 - DNA, 22 bp, Artificial sequence
  SiRNA target sequence
acatctatctttggaatacctg

SEQ ID NO: 24563 - DNA, 22 bp, Artificial sequence
  SiRNA target sequence
catctatctttggaatacctgc

SEQ ID NO: 24564 - DNA, 22 bp, Artificial sequence
  SiRNA target sequence
atctatctttggaatacctgca

SEQ ID NO: 24565 - DNA, 22 bp, Artificial sequence
  SiRNA target sequence
tctatctttggaatacctgcag

SEQ ID NO: 24566 - DNA, 22 bp, Artificial sequence
  SiRNA target sequence
ctatctttggaatacctgcagg

SEQ ID NO: 24567 - DNA, 22 bp, Artificial sequence
  SiRNA target sequence
tatctttggaatacctgcaggt

SEQ ID NO: 24568 - DNA, 22 bp, Artificial sequence
  SiRNA target sequence
atctttggaatacctgcaggtg

SEQ ID NO: 24569 - DNA, 22 bp, Artificial sequence
  SiRNA target sequence
tctttggaatacctgcaggtgc

SEQ ID NO: 24570 - DNA, 22 bp, Artificial sequence
  SiRNA target sequence
ctttggaatacctgcaggtgct

SEQ ID NO: 24571 - DNA, 22 bp, Artificial sequence
  SiRNA target sequence
tttggaatacctgcaggtgctt

SEQ ID NO: 24572 - DNA, 22 bp, Artificial sequence
  SiRNA target sequence
ttggaatacctgcaggtgcttt

SEQ ID NO: 24573 - DNA, 22 bp, Artificial sequence
  SiRNA target sequence
tggaatacctgcaggtgcttta

SEQ ID NO: 24574 - DNA, 22 bp, Artificial sequence
  SiRNA target sequence
ggaatacctgcaggtgctttag

SEQ ID NO: 24575 - DNA, 22 bp, Artificial sequence
  SiRNA target sequence
gaatacctgcaggtgctttagg

SEQ ID NO: 24576 - DNA, 22 bp, Artificial sequence
  SiRNA target sequence
aatacctgcaggtgctttagga

SEQ ID NO: 24577 - DNA, 22 bp, Artificial sequence
  SiRNA target sequence
atacctgcaggtgctttaggaa

SEQ ID NO: 24578 - DNA, 22 bp, Artificial sequence
  SiRNA target sequence
tacctgcaggtgctttaggaat

SEQ ID NO: 24579 - DNA, 22 bp, Artificial sequence
  SiRNA target sequence
acctgcaggtgctttaggaatg

SEQ ID NO: 24580 - DNA, 22 bp, Artificial sequence
  SiRNA target sequence
cctgcaggtgctttaggaatgt

SEQ ID NO: 24581 - DNA, 22 bp, Artificial sequence
  SiRNA target sequence
ctgcaggtgctttaggaatgtt

SEQ ID NO: 24582 - DNA, 22 bp, Artificial sequence
  SiRNA target sequence
tgcaggtgctttaggaatgttt

SEQ ID NO: 24583 - DNA, 22 bp, Artificial sequence
  SiRNA target sequence
gcaggtgctttaggaatgtttt

SEQ ID NO: 24584 - DNA, 22 bp, Artificial sequence
  SiRNA target sequence
caggtgctttaggaatgttttt

SEQ ID NO: 24585 - DNA, 22 bp, Artificial sequence
  SiRNA target sequence
aggtgctttaggaatgtttttg

SEQ ID NO: 24586 - DNA, 22 bp, Artificial sequence
  SiRNA target sequence
ggtgctttaggaatgtttttga

SEQ ID NO: 24587 - DNA, 22 bp, Artificial sequence
  SiRNA target sequence
gtgctttaggaatgtttttgag

SEQ ID NO: 24588 - DNA, 22 bp, Artificial sequence
  SiRNA target sequence
tgctttaggaatgtttttgagc

SEQ ID NO: 24589 - DNA, 22 bp, Artificial sequence
  SiRNA target sequence
gctttaggaatgtttttgagct

SEQ ID NO: 24590 - DNA, 22 bp, Artificial sequence
  SiRNA target sequence
ctttaggaatgtttttgagctt

SEQ ID NO: 24591 - DNA, 22 bp, Artificial sequence
  SiRNA target sequence
tttaggaatgtttttgagcttt

SEQ ID NO: 24592 - DNA, 22 bp, Artificial sequence
  SiRNA target sequence
ttaggaatgtttttgagcttta

SEQ ID NO: 24593 - DNA, 22 bp, Artificial sequence
  SiRNA target sequence
taggaatgtttttgagctttat

SEQ ID NO: 24594 - DNA, 22 bp, Artificial sequence
  SiRNA target sequence
aggaatgtttttgagctttata

SEQ ID NO: 24595 - DNA, 22 bp, Artificial sequence
  SiRNA target sequence
ggaatgtttttgagctttatag

SEQ ID NO: 24596 - DNA, 22 bp, Artificial sequence
  SiRNA target sequence
gaatgtttttgagctttatagc

SEQ ID NO: 24597 - DNA, 22 bp, Artificial sequence
  SiRNA target sequence
aatgtttttgagctttatagct

SEQ ID NO: 24598 - DNA, 22 bp, Artificial sequence
  SiRNA target sequence
atgtttttgagctttatagctc

SEQ ID NO: 24599 - DNA, 22 bp, Artificial sequence
  SiRNA target sequence
tgtttttgagctttatagctcc

SEQ ID NO: 24600 - DNA, 22 bp, Artificial sequence
  SiRNA target sequence
gtttttgagctttatagctcct

SEQ ID NO: 24601 - DNA, 22 bp, Artificial sequence
  SiRNA target sequence
tttttgagctttatagctccta

SEQ ID NO: 24602 - DNA, 22 bp, Artificial sequence
  SiRNA target sequence
ttttgagctttatagctcctaa

SEQ ID NO: 24603 - DNA, 22 bp, Artificial sequence
  SiRNA target sequence
tttgagctttatagctcctaaa

SEQ ID NO: 24604 - DNA, 22 bp, Artificial sequence
  SiRNA target sequence
ttgagctttatagctcctaaat

SEQ ID NO: 24605 - DNA, 22 bp, Artificial sequence
  SiRNA target sequence
tgagctttatagctcctaaata

SEQ ID NO: 24606 - DNA, 22 bp, Artificial sequence
  SiRNA target sequence
gagctttatagctcctaaatat

SEQ ID NO: 24607 - DNA, 22 bp, Artificial sequence
  SiRNA target sequence
agctttatagctcctaaatatt

SEQ ID NO: 24608 - DNA, 22 bp, Artificial sequence
  SiRNA target sequence
gctttatagctcctaaatattt

SEQ ID NO: 24609 - DNA, 22 bp, Artificial sequence
  SiRNA target sequence
ctttatagctcctaaatattta

SEQ ID NO: 24610 - DNA, 22 bp, Artificial sequence
  SiRNA target sequence
tttatagctcctaaatatttat

SEQ ID NO: 24611 - DNA, 22 bp, Artificial sequence
  SiRNA target sequence
ttatagctcctaaatatttatt

SEQ ID NO: 24612 - DNA, 22 bp, Artificial sequence
  SiRNA target sequence
tatagctcctaaatatttattg

SEQ ID NO: 24613 - DNA, 22 bp, Artificial sequence
  SiRNA target sequence
atagctcctaaatatttattgt

SEQ ID NO: 24614 - DNA, 22 bp, Artificial sequence
  SiRNA target sequence
tagctcctaaatatttattgtc

SEQ ID NO: 24615 - DNA, 22 bp, Artificial sequence
  SiRNA target sequence
agctcctaaatatttattgtct

SEQ ID NO: 24616 - DNA, 22 bp, Artificial sequence
  SiRNA target sequence
gctcctaaatatttattgtctt

SEQ ID NO: 24617 - DNA, 22 bp, Artificial sequence
  SiRNA target sequence
ctcctaaatatttattgtcttt

SEQ ID NO: 24618 - DNA, 22 bp, Artificial sequence
  SiRNA target sequence
tcctaaatatttattgtctttt

SEQ ID NO: 24619 - DNA, 22 bp, Artificial sequence
  SiRNA target sequence
cctaaatatttattgtctttta

SEQ ID NO: 24620 - DNA, 22 bp, Artificial sequence
  SiRNA target sequence
ctaaatatttattgtcttttac

SEQ ID NO: 24621 - DNA, 22 bp, Artificial sequence
  SiRNA target sequence
taaatatttattgtcttttacc

SEQ ID NO: 24622 - DNA, 22 bp, Artificial sequence
  SiRNA target sequence
aaatatttattgtcttttacca

SEQ ID NO: 24623 - DNA, 22 bp, Artificial sequence
  SiRNA target sequence
aatatttattgtcttttaccat

SEQ ID NO: 24624 - DNA, 22 bp, Artificial sequence
  SiRNA target sequence
atatttattgtcttttaccatc

SEQ ID NO: 24625 - DNA, 22 bp, Artificial sequence
  SiRNA target sequence
tatttattgtcttttaccatct

SEQ ID NO: 24626 - DNA, 22 bp, Artificial sequence
  SiRNA target sequence
atttattgtcttttaccatctt

SEQ ID NO: 24627 - DNA, 22 bp, Artificial sequence
  SiRNA target sequence
tttattgtcttttaccatcttt

SEQ ID NO: 24628 - DNA, 22 bp, Artificial sequence
  SiRNA target sequence
ttattgtcttttaccatctttc

SEQ ID NO: 24629 - DNA, 22 bp, Artificial sequence
  SiRNA target sequence
tattgtcttttaccatctttct

SEQ ID NO: 24630 - DNA, 22 bp, Artificial sequence
  SiRNA target sequence
attgtcttttaccatctttctt

SEQ ID NO: 24631 - DNA, 22 bp, Artificial sequence
  SiRNA target sequence
ttgtcttttaccatctttcttt

SEQ ID NO: 24632 - DNA, 22 bp, Artificial sequence
  SiRNA target sequence
tgtcttttaccatctttctttc

SEQ ID NO: 24633 - DNA, 22 bp, Artificial sequence
  SiRNA target sequence
gtcttttaccatctttctttct

SEQ ID NO: 24634 - DNA, 22 bp, Artificial sequence
  SiRNA target sequence
tcttttaccatctttctttctc

SEQ ID NO: 24635 - DNA, 22 bp, Artificial sequence
  SiRNA target sequence
cttttaccatctttctttctcc

SEQ ID NO: 24636 - DNA, 22 bp, Artificial sequence
  SiRNA target sequence
ttttaccatctttctttctcct

SEQ ID NO: 24637 - DNA, 22 bp, Artificial sequence
  SiRNA target sequence
tttaccatctttctttctcctt

SEQ ID NO: 24638 - DNA, 22 bp, Artificial sequence
  SiRNA target sequence
ttaccatctttctttctccttg

SEQ ID NO: 24639 - DNA, 22 bp, Artificial sequence
  SiRNA target sequence
taccatctttctttctccttga

SEQ ID NO: 24640 - DNA, 22 bp, Artificial sequence
  SiRNA target sequence
accatctttctttctccttgat

SEQ ID NO: 24641 - DNA, 22 bp, Artificial sequence
  SiRNA target sequence
ccatctttctttctccttgata

SEQ ID NO: 24642 - DNA, 22 bp, Artificial sequence
  SiRNA target sequence
catctttctttctccttgatat

SEQ ID NO: 24643 - DNA, 22 bp, Artificial sequence
  SiRNA target sequence
atctttctttctccttgatata

SEQ ID NO: 24644 - DNA, 22 bp, Artificial sequence
  SiRNA target sequence
tctttctttctccttgatatat

SEQ ID NO: 24645 - DNA, 22 bp, Artificial sequence
  SiRNA target sequence
ctttctttctccttgatatatt

SEQ ID NO: 24646 - DNA, 22 bp, Artificial sequence
  SiRNA target sequence
tttctttctccttgatatattc

SEQ ID NO: 24647 - DNA, 22 bp, Artificial sequence
  SiRNA target sequence
ttctttctccttgatatattct

SEQ ID NO: 24648 - DNA, 22 bp, Artificial sequence
  SiRNA target sequence
tctttctccttgatatattcta

SEQ ID NO: 24649 - DNA, 22 bp, Artificial sequence
  SiRNA target sequence
ctttctccttgatatattctaa

SEQ ID NO: 24650 - DNA, 22 bp, Artificial sequence
  SiRNA target sequence
tttctccttgatatattctaat

SEQ ID NO: 24651 - DNA, 22 bp, Artificial sequence
  SiRNA target sequence
ttctccttgatatattctaata

SEQ ID NO: 24652 - DNA, 22 bp, Artificial sequence
  SiRNA target sequence
tctccttgatatattctaatat

SEQ ID NO: 24653 - DNA, 22 bp, Artificial sequence
  SiRNA target sequence
ctccttgatatattctaatatc

SEQ ID NO: 24654 - DNA, 22 bp, Artificial sequence
  SiRNA target sequence
tccttgatatattctaatatct

SEQ ID NO: 24655 - DNA, 22 bp, Artificial sequence
  SiRNA target sequence
ccttgatatattctaatatcta

SEQ ID NO: 24656 - DNA, 22 bp, Artificial sequence
  SiRNA target sequence
cttgatatattctaatatctac

SEQ ID NO: 24657 - DNA, 22 bp, Artificial sequence
  SiRNA target sequence
ttgatatattctaatatctact

SEQ ID NO: 24658 - DNA, 22 bp, Artificial sequence
  SiRNA target sequence
tgatatattctaatatctactt

SEQ ID NO: 24659 - DNA, 22 bp, Artificial sequence
  SiRNA target sequence
gatatattctaatatctacttc

SEQ ID NO: 24660 - DNA, 22 bp, Artificial sequence
  SiRNA target sequence
atatattctaatatctacttcg

SEQ ID NO: 24661 - DNA, 22 bp, Artificial sequence
  SiRNA target sequence
tatattctaatatctacttcgg

SEQ ID NO: 24662 - DNA, 22 bp, Artificial sequence
  SiRNA target sequence
atattctaatatctacttcgga

SEQ ID NO: 24663 - DNA, 22 bp, Artificial sequence
  SiRNA target sequence
tattctaatatctacttcggat

SEQ ID NO: 24664 - DNA, 22 bp, Artificial sequence
  SiRNA target sequence
attctaatatctacttcggatt

SEQ ID NO: 24665 - DNA, 22 bp, Artificial sequence
  SiRNA target sequence
ttctaatatctacttcggattg

SEQ ID NO: 24666 - DNA, 22 bp, Artificial sequence
  SiRNA target sequence
tctaatatctacttcggattga

SEQ ID NO: 24667 - DNA, 22 bp, Artificial sequence
  SiRNA target sequence
ctaatatctacttcggattgat

SEQ ID NO: 24668 - DNA, 22 bp, Artificial sequence
  SiRNA target sequence
taatatctacttcggattgatt

SEQ ID NO: 24669 - DNA, 22 bp, Artificial sequence
  SiRNA target sequence
aatatctacttcggattgatta

SEQ ID NO: 24670 - DNA, 22 bp, Artificial sequence
  SiRNA target sequence
atatctacttcggattgattat

SEQ ID NO: 24671 - DNA, 22 bp, Artificial sequence
  SiRNA target sequence
tatctacttcggattgattatc

SEQ ID NO: 24672 - DNA, 22 bp, Artificial sequence
  SiRNA target sequence
atctacttcggattgattatct

SEQ ID NO: 24673 - DNA, 22 bp, Artificial sequence
  SiRNA target sequence
tctacttcggattgattatctt

SEQ ID NO: 24674 - DNA, 22 bp, Artificial sequence
  SiRNA target sequence
ctacttcggattgattatcttc

SEQ ID NO: 24675 - DNA, 22 bp, Artificial sequence
  SiRNA target sequence
tacttcggattgattatcttca

SEQ ID NO: 24676 - DNA, 22 bp, Artificial sequence
  SiRNA target sequence
acttcggattgattatcttcag

SEQ ID NO: 24677 - DNA, 22 bp, Artificial sequence
  SiRNA target sequence
cttcggattgattatcttcaga

SEQ ID NO: 24678 - DNA, 22 bp, Artificial sequence
  SiRNA target sequence
ttcggattgattatcttcagag

SEQ ID NO: 24679 - DNA, 22 bp, Artificial sequence
  SiRNA target sequence
tcggattgattatcttcagagg

SEQ ID NO: 24680 - DNA, 22 bp, Artificial sequence
  SiRNA target sequence
cggattgattatcttcagaggt

SEQ ID NO: 24681 - DNA, 22 bp, Artificial sequence
  SiRNA target sequence
ggattgattatcttcagaggta

SEQ ID NO: 24682 - DNA, 22 bp, Artificial sequence
  SiRNA target sequence
gattgattatcttcagaggtag

SEQ ID NO: 24683 - DNA, 22 bp, Artificial sequence
  SiRNA target sequence
attgattatcttcagaggtaga

SEQ ID NO: 24684 - DNA, 22 bp, Artificial sequence
  SiRNA target sequence
ttgattatcttcagaggtagaa

SEQ ID NO: 24685 - DNA, 22 bp, Artificial sequence
  SiRNA target sequence
tgattatcttcagaggtagaaa

SEQ ID NO: 24686 - DNA, 22 bp, Artificial sequence
  SiRNA target sequence
gattatcttcagaggtagaaaa

SEQ ID NO: 24687 - DNA, 22 bp, Artificial sequence
  SiRNA target sequence
attatcttcagaggtagaaaaa

SEQ ID NO: 24688 - DNA, 22 bp, Artificial sequence
  SiRNA target sequence
ttatcttcagaggtagaaaaac

SEQ ID NO: 24689 - DNA, 22 bp, Artificial sequence
  SiRNA target sequence
tatcttcagaggtagaaaaact

SEQ ID NO: 24690 - DNA, 22 bp, Artificial sequence
  SiRNA target sequence
atcttcagaggtagaaaaactg

SEQ ID NO: 24691 - DNA, 22 bp, Artificial sequence
  SiRNA target sequence
tcttcagaggtagaaaaactgt

SEQ ID NO: 24692 - DNA, 22 bp, Artificial sequence
  SiRNA target sequence
cttcagaggtagaaaaactgtg

SEQ ID NO: 24693 - DNA, 22 bp, Artificial sequence
  SiRNA target sequence
ttcagaggtagaaaaactgtgt

SEQ ID NO: 24694 - DNA, 22 bp, Artificial sequence
  SiRNA target sequence
tcagaggtagaaaaactgtgtg

SEQ ID NO: 24695 - DNA, 22 bp, Artificial sequence
  SiRNA target sequence
cagaggtagaaaaactgtgtgt

SEQ ID NO: 24696 - DNA, 22 bp, Artificial sequence
  SiRNA target sequence
agaggtagaaaaactgtgtgtt

SEQ ID NO: 24697 - DNA, 22 bp, Artificial sequence
  SiRNA target sequence
gaggtagaaaaactgtgtgttt

SEQ ID NO: 24698 - DNA, 22 bp, Artificial sequence
  SiRNA target sequence
aggtagaaaaactgtgtgtttc

SEQ ID NO: 24699 - DNA, 22 bp, Artificial sequence
  SiRNA target sequence
ggtagaaaaactgtgtgtttcc

SEQ ID NO: 24700 - DNA, 22 bp, Artificial sequence
  SiRNA target sequence
gtagaaaaactgtgtgtttcct

SEQ ID NO: 24701 - DNA, 22 bp, Artificial sequence
  SiRNA target sequence
tagaaaaactgtgtgtttcctt

SEQ ID NO: 24702 - DNA, 22 bp, Artificial sequence
  SiRNA target sequence
agaaaaactgtgtgtttcctta

SEQ ID NO: 24703 - DNA, 22 bp, Artificial sequence
  SiRNA target sequence
gaaaaactgtgtgtttccttaa

SEQ ID NO: 24704 - DNA, 22 bp, Artificial sequence
  SiRNA target sequence
aaaaactgtgtgtttccttaaa

SEQ ID NO: 24705 - DNA, 22 bp, Artificial sequence
  SiRNA target sequence
aaaactgtgtgtttccttaaat

SEQ ID NO: 24706 - DNA, 22 bp, Artificial sequence
  SiRNA target sequence
aaactgtgtgtttccttaaatg

SEQ ID NO: 24707 - DNA, 22 bp, Artificial sequence
  SiRNA target sequence
aactgtgtgtttccttaaatgg

SEQ ID NO: 24708 - DNA, 22 bp, Artificial sequence
  SiRNA target sequence
actgtgtgtttccttaaatgga

SEQ ID NO: 24709 - DNA, 22 bp, Artificial sequence
  SiRNA target sequence
ctgtgtgtttccttaaatggaa

SEQ ID NO: 24710 - DNA, 22 bp, Artificial sequence
  SiRNA target sequence
tgtgtgtttccttaaatggaat

SEQ ID NO: 24711 - DNA, 22 bp, Artificial sequence
  SiRNA target sequence
gtgtgtttccttaaatggaata

SEQ ID NO: 24712 - DNA, 22 bp, Artificial sequence
  SiRNA target sequence
tgtgtttccttaaatggaatag

SEQ ID NO: 24713 - DNA, 22 bp, Artificial sequence
  SiRNA target sequence
gtgtttccttaaatggaatagt

SEQ ID NO: 24714 - DNA, 22 bp, Artificial sequence
  SiRNA target sequence
tgtttccttaaatggaatagta

SEQ ID NO: 24715 - DNA, 22 bp, Artificial sequence
  SiRNA target sequence
gtttccttaaatggaatagtag

SEQ ID NO: 24716 - DNA, 22 bp, Artificial sequence
  SiRNA target sequence
tttccttaaatggaatagtaga

SEQ ID NO: 24717 - DNA, 22 bp, Artificial sequence
  SiRNA target sequence
ttccttaaatggaatagtagaa

SEQ ID NO: 24718 - DNA, 22 bp, Artificial sequence
  SiRNA target sequence
tccttaaatggaatagtagaat

SEQ ID NO: 24719 - DNA, 22 bp, Artificial sequence
  SiRNA target sequence
ccttaaatggaatagtagaatt

SEQ ID NO: 24720 - DNA, 22 bp, Artificial sequence
  SiRNA target sequence
cttaaatggaatagtagaattt

SEQ ID NO: 24721 - DNA, 22 bp, Artificial sequence
  SiRNA target sequence
ttaaatggaatagtagaatttc

SEQ ID NO: 24722 - DNA, 22 bp, Artificial sequence
  SiRNA target sequence
taaatggaatagtagaatttct

SEQ ID NO: 24723 - DNA, 22 bp, Artificial sequence
  SiRNA target sequence
aaatggaatagtagaatttcta

SEQ ID NO: 24724 - DNA, 22 bp, Artificial sequence
  SiRNA target sequence
aatggaatagtagaatttctat

SEQ ID NO: 24725 - DNA, 22 bp, Artificial sequence
  SiRNA target sequence
atggaatagtagaatttctatg

SEQ ID NO: 24726 - DNA, 22 bp, Artificial sequence
  SiRNA target sequence
tggaatagtagaatttctatga

SEQ ID NO: 24727 - DNA, 22 bp, Artificial sequence
  SiRNA target sequence
ggaatagtagaatttctatgaa

SEQ ID NO: 24728 - DNA, 22 bp, Artificial sequence
  SiRNA target sequence
gaatagtagaatttctatgaat

SEQ ID NO: 24729 - DNA, 22 bp, Artificial sequence
  SiRNA target sequence
aatagtagaatttctatgaatt

SEQ ID NO: 24730 - DNA, 22 bp, Artificial sequence
  SiRNA target sequence
atagtagaatttctatgaatta

SEQ ID NO: 24731 - DNA, 22 bp, Artificial sequence
  SiRNA target sequence
tagtagaatttctatgaattat

SEQ ID NO: 24732 - DNA, 22 bp, Artificial sequence
  SiRNA target sequence
agtagaatttctatgaattatc

SEQ ID NO: 24733 - DNA, 22 bp, Artificial sequence
  SiRNA target sequence
gtagaatttctatgaattatct

SEQ ID NO: 24734 - DNA, 22 bp, Artificial sequence
  SiRNA target sequence
tagaatttctatgaattatctt

SEQ ID NO: 24735 - DNA, 22 bp, Artificial sequence
  SiRNA target sequence
agaatttctatgaattatctta

SEQ ID NO: 24736 - DNA, 22 bp, Artificial sequence
  SiRNA target sequence
gaatttctatgaattatcttat

SEQ ID NO: 24737 - DNA, 22 bp, Artificial sequence
  SiRNA target sequence
aatttctatgaattatcttatt

SEQ ID NO: 24738 - DNA, 22 bp, Artificial sequence
  SiRNA target sequence
atttctatgaattatcttatta

SEQ ID NO: 24739 - DNA, 22 bp, Artificial sequence
  SiRNA target sequence
tttctatgaattatcttattaa

SEQ ID NO: 24740 - DNA, 22 bp, Artificial sequence
  SiRNA target sequence
ttctatgaattatcttattaaa

SEQ ID NO: 24741 - DNA, 22 bp, Artificial sequence
  SiRNA target sequence
tctatgaattatcttattaaaa

SEQ ID NO: 24742 - DNA, 22 bp, Artificial sequence
  SiRNA target sequence
ctatgaattatcttattaaaaa

SEQ ID NO: 24743 - DNA, 22 bp, Artificial sequence
  SiRNA target sequence
tatgaattatcttattaaaaat

SEQ ID NO: 24744 - DNA, 22 bp, Artificial sequence
  SiRNA target sequence
atgaattatcttattaaaaatc

SEQ ID NO: 24745 - DNA, 22 bp, Artificial sequence
  SiRNA target sequence
tgaattatcttattaaaaatcc

SEQ ID NO: 24746 - DNA, 22 bp, Artificial sequence
  SiRNA target sequence
gaattatcttattaaaaatccc

SEQ ID NO: 24747 - DNA, 22 bp, Artificial sequence
  SiRNA target sequence
aattatcttattaaaaatcccg

SEQ ID NO: 24748 - DNA, 22 bp, Artificial sequence
  SiRNA target sequence
attatcttattaaaaatcccgc

SEQ ID NO: 24749 - DNA, 22 bp, Artificial sequence
  SiRNA target sequence
ttatcttattaaaaatcccgcc

SEQ ID NO: 24750 - DNA, 22 bp, Artificial sequence
  SiRNA target sequence
tatcttattaaaaatcccgccc

SEQ ID NO: 24751 - DNA, 22 bp, Artificial sequence
  SiRNA target sequence
atcttattaaaaatcccgccca

SEQ ID NO: 24752 - DNA, 22 bp, Artificial sequence
  SiRNA target sequence
tcttattaaaaatcccgcccaa

SEQ ID NO: 24753 - DNA, 22 bp, Artificial sequence
  SiRNA target sequence
cttattaaaaatcccgcccaaa

SEQ ID NO: 24754 - DNA, 22 bp, Artificial sequence
  SiRNA target sequence
ttattaaaaatcccgcccaaaa

SEQ ID NO: 24755 - DNA, 22 bp, Artificial sequence
  SiRNA target sequence
tattaaaaatcccgcccaaaag

SEQ ID NO: 24756 - DNA, 22 bp, Artificial sequence
  SiRNA target sequence
attaaaaatcccgcccaaaagc

SEQ ID NO: 24757 - DNA, 22 bp, Artificial sequence
  SiRNA target sequence
ttaaaaatcccgcccaaaagct

SEQ ID NO: 24758 - DNA, 22 bp, Artificial sequence
  SiRNA target sequence
taaaaatcccgcccaaaagctc

SEQ ID NO: 24759 - DNA, 22 bp, Artificial sequence
  SiRNA target sequence
aaaaatcccgcccaaaagctct

SEQ ID NO: 24760 - DNA, 22 bp, Artificial sequence
  SiRNA target sequence
aaaatcccgcccaaaagctcta

SEQ ID NO: 24761 - DNA, 22 bp, Artificial sequence
  SiRNA target sequence
aaatcccgcccaaaagctctat

SEQ ID NO: 24762 - DNA, 22 bp, Artificial sequence
  SiRNA target sequence
aatcccgcccaaaagctctata

SEQ ID NO: 24763 - DNA, 22 bp, Artificial sequence
  SiRNA target sequence
atcccgcccaaaagctctatac

SEQ ID NO: 24764 - DNA, 22 bp, Artificial sequence
  SiRNA target sequence
tcccgcccaaaagctctatacc

SEQ ID NO: 24765 - DNA, 22 bp, Artificial sequence
  SiRNA target sequence
cccgcccaaaagctctatacct

SEQ ID NO: 24766 - DNA, 22 bp, Artificial sequence
  SiRNA target sequence
ccgcccaaaagctctataccta

SEQ ID NO: 24767 - DNA, 22 bp, Artificial sequence
  SiRNA target sequence
cgcccaaaagctctatacctaa

SEQ ID NO: 24768 - DNA, 22 bp, Artificial sequence
  SiRNA target sequence
gcccaaaagctctatacctaaa

SEQ ID NO: 24769 - DNA, 22 bp, Artificial sequence
  SiRNA target sequence
cccaaaagctctatacctaaac

SEQ ID NO: 24770 - DNA, 22 bp, Artificial sequence
  SiRNA target sequence
ccaaaagctctatacctaaact

SEQ ID NO: 24771 - DNA, 22 bp, Artificial sequence
  SiRNA target sequence
caaaagctctatacctaaactc

SEQ ID NO: 24772 - DNA, 22 bp, Artificial sequence
  SiRNA target sequence
aaaagctctatacctaaactca

SEQ ID NO: 24773 - DNA, 22 bp, Artificial sequence
  SiRNA target sequence
aaagctctatacctaaactcaa

SEQ ID NO: 24774 - DNA, 22 bp, Artificial sequence
  SiRNA target sequence
aagctctatacctaaactcaat

SEQ ID NO: 24775 - DNA, 22 bp, Artificial sequence
  SiRNA target sequence
agctctatacctaaactcaatg

SEQ ID NO: 24776 - DNA, 22 bp, Artificial sequence
  SiRNA target sequence
gctctatacctaaactcaatgg

SEQ ID NO: 24777 - DNA, 22 bp, Artificial sequence
  SiRNA target sequence
ctctatacctaaactcaatggt

SEQ ID NO: 24778 - DNA, 22 bp, Artificial sequence
  SiRNA target sequence
tctatacctaaactcaatggta

SEQ ID NO: 24779 - DNA, 22 bp, Artificial sequence
  SiRNA target sequence
ctatacctaaactcaatggtac

SEQ ID NO: 24780 - DNA, 22 bp, Artificial sequence
  SiRNA target sequence
tatacctaaactcaatggtact

SEQ ID NO: 24781 - DNA, 22 bp, Artificial sequence
  SiRNA target sequence
atacctaaactcaatggtacta

SEQ ID NO: 24782 - DNA, 22 bp, Artificial sequence
  SiRNA target sequence
tacctaaactcaatggtactac

SEQ ID NO: 24783 - DNA, 22 bp, Artificial sequence
  SiRNA target sequence
acctaaactcaatggtactaca

SEQ ID NO: 24784 - DNA, 22 bp, Artificial sequence
  SiRNA target sequence
cctaaactcaatggtactacat

SEQ ID NO: 24785 - DNA, 22 bp, Artificial sequence
  SiRNA target sequence
ctaaactcaatggtactacatc

SEQ ID NO: 24786 - DNA, 22 bp, Artificial sequence
  SiRNA target sequence
taaactcaatggtactacatcc

SEQ ID NO: 24787 - DNA, 22 bp, Artificial sequence
  SiRNA target sequence
aaactcaatggtactacatcca

SEQ ID NO: 24788 - DNA, 22 bp, Artificial sequence
  SiRNA target sequence
aactcaatggtactacatccaa

SEQ ID NO: 24789 - DNA, 22 bp, Artificial sequence
  SiRNA target sequence
actcaatggtactacatccaat

SEQ ID NO: 24790 - DNA, 22 bp, Artificial sequence
  SiRNA target sequence
ctcaatggtactacatccaata

SEQ ID NO: 24791 - DNA, 22 bp, Artificial sequence
  SiRNA target sequence
tcaatggtactacatccaataa

SEQ ID NO: 24792 - DNA, 22 bp, Artificial sequence
  SiRNA target sequence
caatggtactacatccaataat

SEQ ID NO: 24793 - DNA, 22 bp, Artificial sequence
  SiRNA target sequence
aatggtactacatccaataata

SEQ ID NO: 24794 - DNA, 22 bp, Artificial sequence
  SiRNA target sequence
atggtactacatccaataatag

SEQ ID NO: 24795 - DNA, 22 bp, Artificial sequence
  SiRNA target sequence
tggtactacatccaataatagg

SEQ ID NO: 24796 - DNA, 22 bp, Artificial sequence
  SiRNA target sequence
ggtactacatccaataatagga

SEQ ID NO: 24797 - DNA, 22 bp, Artificial sequence
  SiRNA target sequence
gtactacatccaataataggac

SEQ ID NO: 24798 - DNA, 22 bp, Artificial sequence
  SiRNA target sequence
tactacatccaataataggaca

SEQ ID NO: 24799 - DNA, 22 bp, Artificial sequence
  SiRNA target sequence
actacatccaataataggacat

SEQ ID NO: 24800 - DNA, 22 bp, Artificial sequence
  SiRNA target sequence
ctacatccaataataggacatc

SEQ ID NO: 24801 - DNA, 22 bp, Artificial sequence
  SiRNA target sequence
tacatccaataataggacatct

SEQ ID NO: 24802 - DNA, 22 bp, Artificial sequence
  SiRNA target sequence
acatccaataataggacatctt

SEQ ID NO: 24803 - DNA, 22 bp, Artificial sequence
  SiRNA target sequence
catccaataataggacatcttt

SEQ ID NO: 24804 - DNA, 22 bp, Artificial sequence
  SiRNA target sequence
atccaataataggacatctttt

SEQ ID NO: 24805 - DNA, 22 bp, Artificial sequence
  SiRNA target sequence
tccaataataggacatctttta

SEQ ID NO: 24806 - DNA, 22 bp, Artificial sequence
  SiRNA target sequence
ccaataataggacatcttttat

SEQ ID NO: 24807 - DNA, 22 bp, Artificial sequence
  SiRNA target sequence
caataataggacatcttttatt

SEQ ID NO: 24808 - DNA, 22 bp, Artificial sequence
  SiRNA target sequence
aataataggacatcttttattt

SEQ ID NO: 24809 - DNA, 22 bp, Artificial sequence
  SiRNA target sequence
ataataggacatcttttatttt

SEQ ID NO: 24810 - DNA, 22 bp, Artificial sequence
  SiRNA target sequence
taataggacatcttttattttt

SEQ ID NO: 24811 - DNA, 22 bp, Artificial sequence
  SiRNA target sequence
aataggacatcttttatttttc

SEQ ID NO: 24812 - DNA, 22 bp, Artificial sequence
  SiRNA target sequence
ataggacatcttttatttttcc

SEQ ID NO: 24813 - DNA, 22 bp, Artificial sequence
  SiRNA target sequence
taggacatcttttatttttcct

SEQ ID NO: 24814 - DNA, 22 bp, Artificial sequence
  SiRNA target sequence
aggacatcttttatttttcctt

SEQ ID NO: 24815 - DNA, 22 bp, Artificial sequence
  SiRNA target sequence
ggacatcttttatttttccttc

SEQ ID NO: 24816 - DNA, 22 bp, Artificial sequence
  SiRNA target sequence
gacatcttttatttttccttct

SEQ ID NO: 24817 - DNA, 22 bp, Artificial sequence
  SiRNA target sequence
acatcttttatttttccttcta

SEQ ID NO: 24818 - DNA, 22 bp, Artificial sequence
  SiRNA target sequence
catcttttatttttccttctaa

SEQ ID NO: 24819 - DNA, 22 bp, Artificial sequence
  SiRNA target sequence
atcttttatttttccttctaac

SEQ ID NO: 24820 - DNA, 22 bp, Artificial sequence
  SiRNA target sequence
tcttttatttttccttctaaca

SEQ ID NO: 24821 - DNA, 22 bp, Artificial sequence
  SiRNA target sequence
cttttatttttccttctaacac

SEQ ID NO: 24822 - DNA, 22 bp, Artificial sequence
  SiRNA target sequence
ttttatttttccttctaacacg

SEQ ID NO: 24823 - DNA, 22 bp, Artificial sequence
  SiRNA target sequence
tttatttttccttctaacacgc

SEQ ID NO: 24824 - DNA, 22 bp, Artificial sequence
  SiRNA target sequence
ttatttttccttctaacacgcc

SEQ ID NO: 24825 - DNA, 22 bp, Artificial sequence
  SiRNA target sequence
tatttttccttctaacacgcct

SEQ ID NO: 24826 - DNA, 22 bp, Artificial sequence
  SiRNA target sequence
atttttccttctaacacgcctg

SEQ ID NO: 24827 - DNA, 22 bp, Artificial sequence
  SiRNA target sequence
tttttccttctaacacgcctgc

SEQ ID NO: 24828 - DNA, 22 bp, Artificial sequence
  SiRNA target sequence
ttttccttctaacacgcctgct

SEQ ID NO: 24829 - DNA, 22 bp, Artificial sequence
  SiRNA target sequence
tttccttctaacacgcctgctt

SEQ ID NO: 24830 - DNA, 22 bp, Artificial sequence
  SiRNA target sequence
ttccttctaacacgcctgcttg

SEQ ID NO: 24831 - DNA, 22 bp, Artificial sequence
  SiRNA target sequence
tccttctaacacgcctgcttgt

SEQ ID NO: 24832 - DNA, 22 bp, Artificial sequence
  SiRNA target sequence
ccttctaacacgcctgcttgta

SEQ ID NO: 24833 - DNA, 22 bp, Artificial sequence
  SiRNA target sequence
cttctaacacgcctgcttgtag

SEQ ID NO: 24834 - DNA, 22 bp, Artificial sequence
  SiRNA target sequence
ttctaacacgcctgcttgtaga

SEQ ID NO: 24835 - DNA, 22 bp, Artificial sequence
  SiRNA target sequence
tctaacacgcctgcttgtagag

SEQ ID NO: 24836 - DNA, 22 bp, Artificial sequence
  SiRNA target sequence
ctaacacgcctgcttgtagagc

SEQ ID NO: 24837 - DNA, 22 bp, Artificial sequence
  SiRNA target sequence
taacacgcctgcttgtagagcg

SEQ ID NO: 24838 - DNA, 22 bp, Artificial sequence
  SiRNA target sequence
aacacgcctgcttgtagagcgg

SEQ ID NO: 24839 - DNA, 22 bp, Artificial sequence
  SiRNA target sequence
acacgcctgcttgtagagcggc

SEQ ID NO: 24840 - DNA, 22 bp, Artificial sequence
  SiRNA target sequence
cacgcctgcttgtagagcggcc

SEQ ID NO: 24841 - DNA, 22 bp, Artificial sequence
  SiRNA target sequence
acgcctgcttgtagagcggccc

SEQ ID NO: 24842 - DNA, 22 bp, Artificial sequence
  SiRNA target sequence
cgcctgcttgtagagcggcccc

SEQ ID NO: 24843 - DNA, 22 bp, Artificial sequence
  SiRNA target sequence
gcctgcttgtagagcggcccct

SEQ ID NO: 24844 - DNA, 22 bp, Artificial sequence
  SiRNA target sequence
cctgcttgtagagcggcccctt

SEQ ID NO: 24845 - DNA, 22 bp, Artificial sequence
  SiRNA target sequence
ctgcttgtagagcggccccttt

SEQ ID NO: 24846 - DNA, 22 bp, Artificial sequence
  SiRNA target sequence
tgcttgtagagcggccccttta

SEQ ID NO: 24847 - DNA, 22 bp, Artificial sequence
  SiRNA target sequence
gcttgtagagcggcccctttag

SEQ ID NO: 24848 - DNA, 22 bp, Artificial sequence
  SiRNA target sequence
cttgtagagcggcccctttagc

SEQ ID NO: 24849 - DNA, 22 bp, Artificial sequence
  SiRNA target sequence
ttgtagagcggcccctttagca

SEQ ID NO: 24850 - DNA, 22 bp, Artificial sequence
  SiRNA target sequence
tgtagagcggcccctttagcaa

SEQ ID NO: 24851 - DNA, 22 bp, Artificial sequence
  SiRNA target sequence
gtagagcggcccctttagcaac

SEQ ID NO: 24852 - DNA, 22 bp, Artificial sequence
  SiRNA target sequence
tagagcggcccctttagcaaca

SEQ ID NO: 24853 - DNA, 22 bp, Artificial sequence
  SiRNA target sequence
agagcggcccctttagcaacag

SEQ ID NO: 24854 - DNA, 22 bp, Artificial sequence
  SiRNA target sequence
gagcggcccctttagcaacagc

SEQ ID NO: 24855 - DNA, 22 bp, Artificial sequence
  SiRNA target sequence
agcggcccctttagcaacagct

SEQ ID NO: 24856 - DNA, 22 bp, Artificial sequence
  SiRNA target sequence
gcggcccctttagcaacagctt

SEQ ID NO: 24857 - DNA, 22 bp, Artificial sequence
  SiRNA target sequence
cggcccctttagcaacagcttc

SEQ ID NO: 24858 - DNA, 22 bp, Artificial sequence
  SiRNA target sequence
ggcccctttagcaacagcttca

SEQ ID NO: 24859 - DNA, 22 bp, Artificial sequence
  SiRNA target sequence
gcccctttagcaacagcttcat

SEQ ID NO: 24860 - DNA, 22 bp, Artificial sequence
  SiRNA target sequence
cccctttagcaacagcttcatc

SEQ ID NO: 24861 - DNA, 22 bp, Artificial sequence
  SiRNA target sequence
ccctttagcaacagcttcatct

SEQ ID NO: 24862 - DNA, 22 bp, Artificial sequence
  SiRNA target sequence
cctttagcaacagcttcatctg

SEQ ID NO: 24863 - DNA, 22 bp, Artificial sequence
  SiRNA target sequence
ctttagcaacagcttcatctgg

SEQ ID NO: 24864 - DNA, 22 bp, Artificial sequence
  SiRNA target sequence
tttagcaacagcttcatctgga

SEQ ID NO: 24865 - DNA, 22 bp, Artificial sequence
  SiRNA target sequence
ttagcaacagcttcatctggat

SEQ ID NO: 24866 - DNA, 22 bp, Artificial sequence
  SiRNA target sequence
tagcaacagcttcatctggatt

SEQ ID NO: 24867 - DNA, 22 bp, Artificial sequence
  SiRNA target sequence
agcaacagcttcatctggatta

SEQ ID NO: 24868 - DNA, 22 bp, Artificial sequence
  SiRNA target sequence
gcaacagcttcatctggattaa

SEQ ID NO: 24869 - DNA, 22 bp, Artificial sequence
  SiRNA target sequence
caacagcttcatctggattaat

SEQ ID NO: 24870 - DNA, 22 bp, Artificial sequence
  SiRNA target sequence
aacagcttcatctggattaata

SEQ ID NO: 24871 - DNA, 22 bp, Artificial sequence
  SiRNA target sequence
acagcttcatctggattaatat

SEQ ID NO: 24872 - DNA, 22 bp, Artificial sequence
  SiRNA target sequence
cagcttcatctggattaatatt

SEQ ID NO: 24873 - DNA, 22 bp, Artificial sequence
  SiRNA target sequence
agcttcatctggattaatattt

SEQ ID NO: 24874 - DNA, 22 bp, Artificial sequence
  SiRNA target sequence
gcttcatctggattaatatttg

SEQ ID NO: 24875 - DNA, 22 bp, Artificial sequence
  SiRNA target sequence
cttcatctggattaatatttgt

SEQ ID NO: 24876 - DNA, 22 bp, Artificial sequence
  SiRNA target sequence
ttcatctggattaatatttgta

SEQ ID NO: 24877 - DNA, 22 bp, Artificial sequence
  SiRNA target sequence
tcatctggattaatatttgtag

SEQ ID NO: 24878 - DNA, 22 bp, Artificial sequence
  SiRNA target sequence
catctggattaatatttgtaga

SEQ ID NO: 24879 - DNA, 22 bp, Artificial sequence
  SiRNA target sequence
atctggattaatatttgtagaa

SEQ ID NO: 24880 - DNA, 22 bp, Artificial sequence
  SiRNA target sequence
tctggattaatatttgtagaag

SEQ ID NO: 24881 - DNA, 22 bp, Artificial sequence
  SiRNA target sequence
ctggattaatatttgtagaagg

SEQ ID NO: 24882 - DNA, 22 bp, Artificial sequence
  SiRNA target sequence
tggattaatatttgtagaaggc

SEQ ID NO: 24883 - DNA, 22 bp, Artificial sequence
  SiRNA target sequence
ggattaatatttgtagaaggct

SEQ ID NO: 24884 - DNA, 22 bp, Artificial sequence
  SiRNA target sequence
gattaatatttgtagaaggctc

SEQ ID NO: 24885 - DNA, 22 bp, Artificial sequence
  SiRNA target sequence
attaatatttgtagaaggctcg

SEQ ID NO: 24886 - DNA, 22 bp, Artificial sequence
  SiRNA target sequence
ttaatatttgtagaaggctcga

SEQ ID NO: 24887 - DNA, 22 bp, Artificial sequence
  SiRNA target sequence
taatatttgtagaaggctcgat

SEQ ID NO: 24888 - DNA, 22 bp, Artificial sequence
  SiRNA target sequence
aatatttgtagaaggctcgata

SEQ ID NO: 24889 - DNA, 22 bp, Artificial sequence
  SiRNA target sequence
atatttgtagaaggctcgatac

SEQ ID NO: 24890 - DNA, 22 bp, Artificial sequence
  SiRNA target sequence
tatttgtagaaggctcgatacc

SEQ ID NO: 24891 - DNA, 22 bp, Artificial sequence
  SiRNA target sequence
atttgtagaaggctcgatacca

SEQ ID NO: 24892 - DNA, 22 bp, Artificial sequence
  SiRNA target sequence
tttgtagaaggctcgataccaa

SEQ ID NO: 24893 - DNA, 22 bp, Artificial sequence
  SiRNA target sequence
ttgtagaaggctcgataccaaa

SEQ ID NO: 24894 - DNA, 22 bp, Artificial sequence
  SiRNA target sequence
tgtagaaggctcgataccaaaa

SEQ ID NO: 24895 - DNA, 22 bp, Artificial sequence
  SiRNA target sequence
gtagaaggctcgataccaaaaa

SEQ ID NO: 24896 - DNA, 22 bp, Artificial sequence
  SiRNA target sequence
tagaaggctcgataccaaaaat

SEQ ID NO: 24897 - DNA, 22 bp, Artificial sequence
  SiRNA target sequence
agaaggctcgataccaaaaatc

SEQ ID NO: 24898 - DNA, 22 bp, Artificial sequence
  SiRNA target sequence
gaaggctcgataccaaaaatct

SEQ ID NO: 24899 - DNA, 22 bp, Artificial sequence
  SiRNA target sequence
aaggctcgataccaaaaatctt

SEQ ID NO: 24900 - DNA, 22 bp, Artificial sequence
  SiRNA target sequence
aggctcgataccaaaaatcttc

SEQ ID NO: 24901 - DNA, 22 bp, Artificial sequence
  SiRNA target sequence
ggctcgataccaaaaatcttct

SEQ ID NO: 24902 - DNA, 22 bp, Artificial sequence
  SiRNA target sequence
gctcgataccaaaaatcttctt

SEQ ID NO: 24903 - DNA, 22 bp, Artificial sequence
  SiRNA target sequence
ctcgataccaaaaatcttctta

SEQ ID NO: 24904 - DNA, 22 bp, Artificial sequence
  SiRNA target sequence
tcgataccaaaaatcttcttaa

SEQ ID NO: 24905 - DNA, 22 bp, Artificial sequence
  SiRNA target sequence
cgataccaaaaatcttcttaac

SEQ ID NO: 24906 - DNA, 22 bp, Artificial sequence
  SiRNA target sequence
gataccaaaaatcttcttaaca

SEQ ID NO: 24907 - DNA, 22 bp, Artificial sequence
  SiRNA target sequence
ataccaaaaatcttcttaacaa

SEQ ID NO: 24908 - DNA, 22 bp, Artificial sequence
  SiRNA target sequence
taccaaaaatcttcttaacaag

SEQ ID NO: 24909 - DNA, 22 bp, Artificial sequence
  SiRNA target sequence
accaaaaatcttcttaacaagt

SEQ ID NO: 24910 - DNA, 22 bp, Artificial sequence
  SiRNA target sequence
ccaaaaatcttcttaacaagtt

SEQ ID NO: 24911 - DNA, 22 bp, Artificial sequence
  SiRNA target sequence
caaaaatcttcttaacaagttt

SEQ ID NO: 24912 - DNA, 22 bp, Artificial sequence
  SiRNA target sequence
aaaaatcttcttaacaagtttt

SEQ ID NO: 24913 - DNA, 22 bp, Artificial sequence
  SiRNA target sequence
aaaatcttcttaacaagttttc

SEQ ID NO: 24914 - DNA, 22 bp, Artificial sequence
  SiRNA target sequence
aaatcttcttaacaagttttct

SEQ ID NO: 24915 - DNA, 22 bp, Artificial sequence
  SiRNA target sequence
aatcttcttaacaagttttcta

SEQ ID NO: 24916 - DNA, 22 bp, Artificial sequence
  SiRNA target sequence
atcttcttaacaagttttctaa

SEQ ID NO: 24917 - DNA, 22 bp, Artificial sequence
  SiRNA target sequence
tcttcttaacaagttttctaac

SEQ ID NO: 24918 - DNA, 22 bp, Artificial sequence
  SiRNA target sequence
cttcttaacaagttttctaaca

SEQ ID NO: 24919 - DNA, 22 bp, Artificial sequence
  SiRNA target sequence
ttcttaacaagttttctaacat

SEQ ID NO: 24920 - DNA, 22 bp, Artificial sequence
  SiRNA target sequence
tcttaacaagttttctaacata

SEQ ID NO: 24921 - DNA, 22 bp, Artificial sequence
  SiRNA target sequence
cttaacaagttttctaacatac

SEQ ID NO: 24922 - DNA, 22 bp, Artificial sequence
  SiRNA target sequence
ttaacaagttttctaacatacg

SEQ ID NO: 24923 - DNA, 22 bp, Artificial sequence
  SiRNA target sequence
taacaagttttctaacatacgg

SEQ ID NO: 24924 - DNA, 22 bp, Artificial sequence
  SiRNA target sequence
aacaagttttctaacatacggc

SEQ ID NO: 24925 - DNA, 22 bp, Artificial sequence
  SiRNA target sequence
acaagttttctaacatacggca

SEQ ID NO: 24926 - DNA, 22 bp, Artificial sequence
  SiRNA target sequence
caagttttctaacatacggcat

SEQ ID NO: 24927 - DNA, 22 bp, Artificial sequence
  SiRNA target sequence
aagttttctaacatacggcatt

SEQ ID NO: 24928 - DNA, 22 bp, Artificial sequence
  SiRNA target sequence
agttttctaacatacggcattc

SEQ ID NO: 24929 - DNA, 22 bp, Artificial sequence
  SiRNA target sequence
gttttctaacatacggcattcg

SEQ ID NO: 24930 - DNA, 22 bp, Artificial sequence
  SiRNA target sequence
ttttctaacatacggcattcgt

SEQ ID NO: 24931 - DNA, 22 bp, Artificial sequence
  SiRNA target sequence
tttctaacatacggcattcgtg

SEQ ID NO: 24932 - DNA, 22 bp, Artificial sequence
  SiRNA target sequence
ttctaacatacggcattcgtgt

SEQ ID NO: 24933 - DNA, 22 bp, Artificial sequence
  SiRNA target sequence
tctaacatacggcattcgtgtc

SEQ ID NO: 24934 - DNA, 22 bp, Artificial sequence
  SiRNA target sequence
ctaacatacggcattcgtgtca

SEQ ID NO: 24935 - DNA, 22 bp, Artificial sequence
  SiRNA target sequence
taacatacggcattcgtgtcat

SEQ ID NO: 24936 - DNA, 22 bp, Artificial sequence
  SiRNA target sequence
aacatacggcattcgtgtcatt

SEQ ID NO: 24937 - DNA, 22 bp, Artificial sequence
  SiRNA target sequence
acatacggcattcgtgtcattc

SEQ ID NO: 24938 - DNA, 22 bp, Artificial sequence
  SiRNA target sequence
catacggcattcgtgtcattcc

SEQ ID NO: 24939 - DNA, 22 bp, Artificial sequence
  SiRNA target sequence
atacggcattcgtgtcattcca

SEQ ID NO: 24940 - DNA, 22 bp, Artificial sequence
  SiRNA target sequence
tacggcattcgtgtcattccac

SEQ ID NO: 24941 - DNA, 22 bp, Artificial sequence
  SiRNA target sequence
acggcattcgtgtcattccacc

SEQ ID NO: 24942 - DNA, 22 bp, Artificial sequence
  SiRNA target sequence
cggcattcgtgtcattccaccc

SEQ ID NO: 24943 - DNA, 22 bp, Artificial sequence
  SiRNA target sequence
ggcattcgtgtcattccaccca

SEQ ID NO: 24944 - DNA, 22 bp, Artificial sequence
  SiRNA target sequence
gcattcgtgtcattccacccac

SEQ ID NO: 24945 - DNA, 22 bp, Artificial sequence
  SiRNA target sequence
cattcgtgtcattccacccaca

SEQ ID NO: 24946 - DNA, 22 bp, Artificial sequence
  SiRNA target sequence
attcgtgtcattccacccacaa

SEQ ID NO: 24947 - DNA, 22 bp, Artificial sequence
  SiRNA target sequence
ttcgtgtcattccacccacaag

SEQ ID NO: 24948 - DNA, 22 bp, Artificial sequence
  SiRNA target sequence
tcgtgtcattccacccacaagt

SEQ ID NO: 24949 - DNA, 22 bp, Artificial sequence
  SiRNA target sequence
cgtgtcattccacccacaagta

SEQ ID NO: 24950 - DNA, 22 bp, Artificial sequence
  SiRNA target sequence
gtgtcattccacccacaagtat

SEQ ID NO: 24951 - DNA, 22 bp, Artificial sequence
  SiRNA target sequence
tgtcattccacccacaagtata

SEQ ID NO: 24952 - DNA, 22 bp, Artificial sequence
  SiRNA target sequence
gtcattccacccacaagtataa

SEQ ID NO: 24953 - DNA, 22 bp, Artificial sequence
  SiRNA target sequence
tcattccacccacaagtataac

SEQ ID NO: 24954 - DNA, 22 bp, Artificial sequence
  SiRNA target sequence
cattccacccacaagtataacg

SEQ ID NO: 24955 - DNA, 22 bp, Artificial sequence
  SiRNA target sequence
attccacccacaagtataacgt

SEQ ID NO: 24956 - DNA, 22 bp, Artificial sequence
  SiRNA target sequence
ttccacccacaagtataacgtg

SEQ ID NO: 24957 - DNA, 22 bp, Artificial sequence
  SiRNA target sequence
tccacccacaagtataacgtgt

SEQ ID NO: 24958 - DNA, 22 bp, Artificial sequence
  SiRNA target sequence
ccacccacaagtataacgtgtt

SEQ ID NO: 24959 - DNA, 22 bp, Artificial sequence
  SiRNA target sequence
cacccacaagtataacgtgttt

SEQ ID NO: 24960 - DNA, 22 bp, Artificial sequence
  SiRNA target sequence
acccacaagtataacgtgttta

SEQ ID NO: 24961 - DNA, 22 bp, Artificial sequence
  SiRNA target sequence
cccacaagtataacgtgtttaa

SEQ ID NO: 24962 - DNA, 22 bp, Artificial sequence
  SiRNA target sequence
ccacaagtataacgtgtttaat

SEQ ID NO: 24963 - DNA, 22 bp, Artificial sequence
  SiRNA target sequence
cacaagtataacgtgtttaata

SEQ ID NO: 24964 - DNA, 22 bp, Artificial sequence
  SiRNA target sequence
acaagtataacgtgtttaatat

SEQ ID NO: 24965 - DNA, 22 bp, Artificial sequence
  SiRNA target sequence
caagtataacgtgtttaatatc

SEQ ID NO: 24966 - DNA, 22 bp, Artificial sequence
  SiRNA target sequence
aagtataacgtgtttaatatca

SEQ ID NO: 24967 - DNA, 22 bp, Artificial sequence
  SiRNA target sequence
agtataacgtgtttaatatcac

SEQ ID NO: 24968 - DNA, 22 bp, Artificial sequence
  SiRNA target sequence
gtataacgtgtttaatatcact

SEQ ID NO: 24969 - DNA, 22 bp, Artificial sequence
  SiRNA target sequence
tataacgtgtttaatatcactt

SEQ ID NO: 24970 - DNA, 22 bp, Artificial sequence
  SiRNA target sequence
ataacgtgtttaatatcacttt

SEQ ID NO: 24971 - DNA, 22 bp, Artificial sequence
  SiRNA target sequence
taacgtgtttaatatcactttt

SEQ ID NO: 24972 - DNA, 22 bp, Artificial sequence
  SiRNA target sequence
aacgtgtttaatatcactttta

SEQ ID NO: 24973 - DNA, 22 bp, Artificial sequence
  SiRNA target sequence
acgtgtttaatatcacttttag

SEQ ID NO: 24974 - DNA, 22 bp, Artificial sequence
  SiRNA target sequence
cgtgtttaatatcacttttagt

SEQ ID NO: 24975 - DNA, 22 bp, Artificial sequence
  SiRNA target sequence
gtgtttaatatcacttttagtt

SEQ ID NO: 24976 - DNA, 22 bp, Artificial sequence
  SiRNA target sequence
tgtttaatatcacttttagtta

SEQ ID NO: 24977 - DNA, 22 bp, Artificial sequence
  SiRNA target sequence
gtttaatatcacttttagttat

SEQ ID NO: 24978 - DNA, 22 bp, Artificial sequence
  SiRNA target sequence
tttaatatcacttttagttata

SEQ ID NO: 24979 - DNA, 22 bp, Artificial sequence
  SiRNA target sequence
ttaatatcacttttagttatat

SEQ ID NO: 24980 - DNA, 22 bp, Artificial sequence
  SiRNA target sequence
taatatcacttttagttatatt

SEQ ID NO: 24981 - DNA, 22 bp, Artificial sequence
  SiRNA target sequence
aatatcacttttagttatattg

SEQ ID NO: 24982 - DNA, 22 bp, Artificial sequence
  SiRNA target sequence
atatcacttttagttatattgg

SEQ ID NO: 24983 - DNA, 22 bp, Artificial sequence
  SiRNA target sequence
tatcacttttagttatattggc

SEQ ID NO: 24984 - DNA, 22 bp, Artificial sequence
  SiRNA target sequence
atcacttttagttatattggca

SEQ ID NO: 24985 - DNA, 22 bp, Artificial sequence
  SiRNA target sequence
tcacttttagttatattggcat

SEQ ID NO: 24986 - DNA, 22 bp, Artificial sequence
  SiRNA target sequence
cacttttagttatattggcatc

SEQ ID NO: 24987 - DNA, 22 bp, Artificial sequence
  SiRNA target sequence
acttttagttatattggcatct

SEQ ID NO: 24988 - DNA, 22 bp, Artificial sequence
  SiRNA target sequence
cttttagttatattggcatctc

SEQ ID NO: 24989 - DNA, 22 bp, Artificial sequence
  SiRNA target sequence
ttttagttatattggcatctct

SEQ ID NO: 24990 - DNA, 22 bp, Artificial sequence
  SiRNA target sequence
tttagttatattggcatctcta

SEQ ID NO: 24991 - DNA, 22 bp, Artificial sequence
  SiRNA target sequence
ttagttatattggcatctctaa

SEQ ID NO: 24992 - DNA, 22 bp, Artificial sequence
  SiRNA target sequence
tagttatattggcatctctaat

SEQ ID NO: 24993 - DNA, 22 bp, Artificial sequence
  SiRNA target sequence
agttatattggcatctctaata

SEQ ID NO: 24994 - DNA, 22 bp, Artificial sequence
  SiRNA target sequence
gttatattggcatctctaatag

SEQ ID NO: 24995 - DNA, 22 bp, Artificial sequence
  SiRNA target sequence
ttatattggcatctctaatagc

SEQ ID NO: 24996 - DNA, 22 bp, Artificial sequence
  SiRNA target sequence
tatattggcatctctaatagct

SEQ ID NO: 24997 - DNA, 22 bp, Artificial sequence
  SiRNA target sequence
atattggcatctctaatagctt

SEQ ID NO: 24998 - DNA, 22 bp, Artificial sequence
  SiRNA target sequence
tattggcatctctaatagcttt

SEQ ID NO: 24999 - DNA, 22 bp, Artificial sequence
  SiRNA target sequence
attggcatctctaatagcttta

SEQ ID NO: 25000 - DNA, 22 bp, Artificial sequence
  SiRNA target sequence
ttggcatctctaatagctttaa

SEQ ID NO: 25001 - DNA, 22 bp, Artificial sequence
  SiRNA target sequence
tggcatctctaatagctttaag

SEQ ID NO: 25002 - DNA, 22 bp, Artificial sequence
  SiRNA target sequence
ggcatctctaatagctttaaga

SEQ ID NO: 25003 - DNA, 22 bp, Artificial sequence
  SiRNA target sequence
gcatctctaatagctttaagac

SEQ ID NO: 25004 - DNA, 22 bp, Artificial sequence
  SiRNA target sequence
catctctaatagctttaagaca

SEQ ID NO: 25005 - DNA, 22 bp, Artificial sequence
  SiRNA target sequence
atctctaatagctttaagacag

SEQ ID NO: 25006 - DNA, 22 bp, Artificial sequence
  SiRNA target sequence
tctctaatagctttaagacagg

SEQ ID NO: 25007 - DNA, 22 bp, Artificial sequence
  SiRNA target sequence
ctctaatagctttaagacaggg

SEQ ID NO: 25008 - DNA, 22 bp, Artificial sequence
  SiRNA target sequence
tctaatagctttaagacagggg

SEQ ID NO: 25009 - DNA, 22 bp, Artificial sequence
  SiRNA target sequence
ctaatagctttaagacaggggt

SEQ ID NO: 25010 - DNA, 22 bp, Artificial sequence
  SiRNA target sequence
taatagctttaagacaggggtt

SEQ ID NO: 25011 - DNA, 22 bp, Artificial sequence
  SiRNA target sequence
aatagctttaagacaggggttt

SEQ ID NO: 25012 - DNA, 22 bp, Artificial sequence
  SiRNA target sequence
atagctttaagacaggggttta

SEQ ID NO: 25013 - DNA, 22 bp, Artificial sequence
  SiRNA target sequence
tagctttaagacaggggtttat

SEQ ID NO: 25014 - DNA, 22 bp, Artificial sequence
  SiRNA target sequence
agctttaagacaggggtttatt

SEQ ID NO: 25015 - DNA, 22 bp, Artificial sequence
  SiRNA target sequence
gctttaagacaggggtttattg

SEQ ID NO: 25016 - DNA, 22 bp, Artificial sequence
  SiRNA target sequence
ctttaagacaggggtttattgt

SEQ ID NO: 25017 - DNA, 22 bp, Artificial sequence
  SiRNA target sequence
tttaagacaggggtttattgtt

SEQ ID NO: 25018 - DNA, 22 bp, Artificial sequence
  SiRNA target sequence
ttaagacaggggtttattgttt

SEQ ID NO: 25019 - DNA, 22 bp, Artificial sequence
  SiRNA target sequence
taagacaggggtttattgtttt

SEQ ID NO: 25020 - DNA, 22 bp, Artificial sequence
  SiRNA target sequence
aagacaggggtttattgttttg

SEQ ID NO: 25021 - DNA, 22 bp, Artificial sequence
  SiRNA target sequence
agacaggggtttattgttttgt

SEQ ID NO: 25022 - DNA, 22 bp, Artificial sequence
  SiRNA target sequence
gacaggggtttattgttttgtc

SEQ ID NO: 25023 - DNA, 22 bp, Artificial sequence
  SiRNA target sequence
acaggggtttattgttttgtct

SEQ ID NO: 25024 - DNA, 22 bp, Artificial sequence
  SiRNA target sequence
caggggtttattgttttgtcta

SEQ ID NO: 25025 - DNA, 22 bp, Artificial sequence
  SiRNA target sequence
aggggtttattgttttgtctat

SEQ ID NO: 25026 - DNA, 22 bp, Artificial sequence
  SiRNA target sequence
ggggtttattgttttgtctatt

SEQ ID NO: 25027 - DNA, 22 bp, Artificial sequence
  SiRNA target sequence
gggtttattgttttgtctatta

SEQ ID NO: 25028 - DNA, 22 bp, Artificial sequence
  SiRNA target sequence
ggtttattgttttgtctattaa

SEQ ID NO: 25029 - DNA, 22 bp, Artificial sequence
  SiRNA target sequence
gtttattgttttgtctattaac

SEQ ID NO: 25030 - DNA, 22 bp, Artificial sequence
  SiRNA target sequence
tttattgttttgtctattaact

SEQ ID NO: 25031 - DNA, 22 bp, Artificial sequence
  SiRNA target sequence
ttattgttttgtctattaactt

SEQ ID NO: 25032 - DNA, 22 bp, Artificial sequence
  SiRNA target sequence
tattgttttgtctattaacttt

SEQ ID NO: 25033 - DNA, 22 bp, Artificial sequence
  SiRNA target sequence
attgttttgtctattaactttt

SEQ ID NO: 25034 - DNA, 22 bp, Artificial sequence
  SiRNA target sequence
ttgttttgtctattaacttttt

SEQ ID NO: 25035 - DNA, 22 bp, Artificial sequence
  SiRNA target sequence
tgttttgtctattaactttttt

SEQ ID NO: 25036 - DNA, 22 bp, Artificial sequence
  SiRNA target sequence
gttttgtctattaacttttttg

SEQ ID NO: 25037 - DNA, 22 bp, Artificial sequence
  SiRNA target sequence
ttttgtctattaacttttttgt

SEQ ID NO: 25038 - DNA, 22 bp, Artificial sequence
  SiRNA target sequence
tttgtctattaacttttttgta

SEQ ID NO: 25039 - DNA, 22 bp, Artificial sequence
  SiRNA target sequence
ttgtctattaacttttttgtaa

SEQ ID NO: 25040 - DNA, 22 bp, Artificial sequence
  SiRNA target sequence
tgtctattaacttttttgtaat

SEQ ID NO: 25041 - DNA, 22 bp, Artificial sequence
  SiRNA target sequence
gtctattaacttttttgtaatt

SEQ ID NO: 25042 - DNA, 22 bp, Artificial sequence
  SiRNA target sequence
tctattaacttttttgtaattt

SEQ ID NO: 25043 - DNA, 22 bp, Artificial sequence
  SiRNA target sequence
ctattaacttttttgtaatttt

SEQ ID NO: 25044 - DNA, 22 bp, Artificial sequence
  SiRNA target sequence
tattaacttttttgtaattttt

SEQ ID NO: 25045 - DNA, 22 bp, Artificial sequence
  SiRNA target sequence
attaacttttttgtaatttttt

SEQ ID NO: 25046 - DNA, 22 bp, Artificial sequence
  SiRNA target sequence
ttaacttttttgtaattttttc

SEQ ID NO: 25047 - DNA, 22 bp, Artificial sequence
  SiRNA target sequence
taacttttttgtaattttttca

SEQ ID NO: 25048 - DNA, 22 bp, Artificial sequence
  SiRNA target sequence
aacttttttgtaattttttcaa

SEQ ID NO: 25049 - DNA, 22 bp, Artificial sequence
  SiRNA target sequence
acttttttgtaattttttcaaa

SEQ ID NO: 25050 - DNA, 22 bp, Artificial sequence
  SiRNA target sequence
cttttttgtaattttttcaaat

SEQ ID NO: 25051 - DNA, 22 bp, Artificial sequence
  SiRNA target sequence
ttttttgtaattttttcaaatt

SEQ ID NO: 25052 - DNA, 22 bp, Artificial sequence
  SiRNA target sequence
tttttgtaattttttcaaattc

SEQ ID NO: 25053 - DNA, 22 bp, Artificial sequence
  SiRNA target sequence
ttttgtaattttttcaaattcg

SEQ ID NO: 25054 - DNA, 22 bp, Artificial sequence
  SiRNA target sequence
tttgtaattttttcaaattcgt

SEQ ID NO: 25055 - DNA, 22 bp, Artificial sequence
  SiRNA target sequence
ttgtaattttttcaaattcgtc

SEQ ID NO: 25056 - DNA, 22 bp, Artificial sequence
  SiRNA target sequence
tgtaattttttcaaattcgtcg

SEQ ID NO: 25057 - DNA, 22 bp, Artificial sequence
  SiRNA target sequence
gtaattttttcaaattcgtcgc

SEQ ID NO: 25058 - DNA, 22 bp, Artificial sequence
  SiRNA target sequence
taattttttcaaattcgtcgcg

SEQ ID NO: 25059 - DNA, 22 bp, Artificial sequence
  SiRNA target sequence
aattttttcaaattcgtcgcgt

SEQ ID NO: 25060 - DNA, 22 bp, Artificial sequence
  SiRNA target sequence
attttttcaaattcgtcgcgtg

SEQ ID NO: 25061 - DNA, 22 bp, Artificial sequence
  SiRNA target sequence
ttttttcaaattcgtcgcgtgt

SEQ ID NO: 25062 - DNA, 22 bp, Artificial sequence
  SiRNA target sequence
tttttcaaattcgtcgcgtgta

SEQ ID NO: 25063 - DNA, 22 bp, Artificial sequence
  SiRNA target sequence
ttttcaaattcgtcgcgtgtaa

SEQ ID NO: 25064 - DNA, 22 bp, Artificial sequence
  SiRNA target sequence
tttcaaattcgtcgcgtgtaat

SEQ ID NO: 25065 - DNA, 22 bp, Artificial sequence
  SiRNA target sequence
ttcaaattcgtcgcgtgtaatt

SEQ ID NO: 25066 - DNA, 22 bp, Artificial sequence
  SiRNA target sequence
tcaaattcgtcgcgtgtaatta

SEQ ID NO: 25067 - DNA, 22 bp, Artificial sequence
  SiRNA target sequence
caaattcgtcgcgtgtaattac

SEQ ID NO: 25068 - DNA, 22 bp, Artificial sequence
  SiRNA target sequence
aaattcgtcgcgtgtaattacc

SEQ ID NO: 25069 - DNA, 22 bp, Artificial sequence
  SiRNA target sequence
aattcgtcgcgtgtaattacct

SEQ ID NO: 25070 - DNA, 22 bp, Artificial sequence
  SiRNA target sequence
attcgtcgcgtgtaattacctc

SEQ ID NO: 25071 - DNA, 22 bp, Artificial sequence
  SiRNA target sequence
ttcgtcgcgtgtaattacctct

SEQ ID NO: 25072 - DNA, 22 bp, Artificial sequence
  SiRNA target sequence
tcgtcgcgtgtaattacctctt

SEQ ID NO: 25073 - DNA, 22 bp, Artificial sequence
  SiRNA target sequence
cgtcgcgtgtaattacctcttt

SEQ ID NO: 25074 - DNA, 22 bp, Artificial sequence
  SiRNA target sequence
gtcgcgtgtaattacctctttt

SEQ ID NO: 25075 - DNA, 22 bp, Artificial sequence
  SiRNA target sequence
tcgcgtgtaattacctctttta

SEQ ID NO: 25076 - DNA, 22 bp, Artificial sequence
  SiRNA target sequence
cgcgtgtaattacctcttttaa

SEQ ID NO: 25077 - DNA, 22 bp, Artificial sequence
  SiRNA target sequence
gcgtgtaattacctcttttaag

SEQ ID NO: 25078 - DNA, 22 bp, Artificial sequence
  SiRNA target sequence
cgtgtaattacctcttttaagt

SEQ ID NO: 25079 - DNA, 22 bp, Artificial sequence
  SiRNA target sequence
gtgtaattacctcttttaagtg

SEQ ID NO: 25080 - DNA, 22 bp, Artificial sequence
  SiRNA target sequence
tgtaattacctcttttaagtga

SEQ ID NO: 25081 - DNA, 22 bp, Artificial sequence
  SiRNA target sequence
gtaattacctcttttaagtgat

SEQ ID NO: 25082 - DNA, 22 bp, Artificial sequence
  SiRNA target sequence
taattacctcttttaagtgata

SEQ ID NO: 25083 - DNA, 22 bp, Artificial sequence
  SiRNA target sequence
aattacctcttttaagtgataa

SEQ ID NO: 25084 - DNA, 22 bp, Artificial sequence
  SiRNA target sequence
attacctcttttaagtgataat

SEQ ID NO: 25085 - DNA, 22 bp, Artificial sequence
  SiRNA target sequence
ttacctcttttaagtgataatt

SEQ ID NO: 25086 - DNA, 22 bp, Artificial sequence
  SiRNA target sequence
tacctcttttaagtgataattc

SEQ ID NO: 25087 - DNA, 22 bp, Artificial sequence
  SiRNA target sequence
acctcttttaagtgataattct

SEQ ID NO: 25088 - DNA, 22 bp, Artificial sequence
  SiRNA target sequence
cctcttttaagtgataattctt

SEQ ID NO: 25089 - DNA, 22 bp, Artificial sequence
  SiRNA target sequence
ctcttttaagtgataattcttt

SEQ ID NO: 25090 - DNA, 22 bp, Artificial sequence
  SiRNA target sequence
tcttttaagtgataattctttt

SEQ ID NO: 25091 - DNA, 22 bp, Artificial sequence
  SiRNA target sequence
cttttaagtgataattcttttt

SEQ ID NO: 25092 - DNA, 22 bp, Artificial sequence
  SiRNA target sequence
ttttaagtgataattcttttta

SEQ ID NO: 25093 - DNA, 22 bp, Artificial sequence
  SiRNA target sequence
tttaagtgataattctttttac

SEQ ID NO: 25094 - DNA, 22 bp, Artificial sequence
  SiRNA target sequence
ttaagtgataattctttttact

SEQ ID NO: 25095 - DNA, 22 bp, Artificial sequence
  SiRNA target sequence
taagtgataattctttttacta

SEQ ID NO: 25096 - DNA, 22 bp, Artificial sequence
  SiRNA target sequence
aagtgataattctttttactat

SEQ ID NO: 25097 - DNA, 22 bp, Artificial sequence
  SiRNA target sequence
agtgataattctttttactatc

SEQ ID NO: 25098 - DNA, 22 bp, Artificial sequence
  SiRNA target sequence
gtgataattctttttactatcg

SEQ ID NO: 25099 - DNA, 22 bp, Artificial sequence
  SiRNA target sequence
tgataattctttttactatcgt

SEQ ID NO: 25100 - DNA, 22 bp, Artificial sequence
  SiRNA target sequence
gataattctttttactatcgtt

SEQ ID NO: 25101 - DNA, 22 bp, Artificial sequence
  SiRNA target sequence
ataattctttttactatcgtta

SEQ ID NO: 25102 - DNA, 22 bp, Artificial sequence
  SiRNA target sequence
taattctttttactatcgttat

SEQ ID NO: 25103 - DNA, 22 bp, Artificial sequence
  SiRNA target sequence
aattctttttactatcgttata

SEQ ID NO: 25104 - DNA, 22 bp, Artificial sequence
  SiRNA target sequence
attctttttactatcgttataa

SEQ ID NO: 25105 - DNA, 22 bp, Artificial sequence
  SiRNA target sequence
ttctttttactatcgttataaa

SEQ ID NO: 25106 - DNA, 22 bp, Artificial sequence
  SiRNA target sequence
tctttttactatcgttataaat

SEQ ID NO: 25107 - DNA, 22 bp, Artificial sequence
  SiRNA target sequence
ctttttactatcgttataaata

SEQ ID NO: 25108 - DNA, 22 bp, Artificial sequence
  SiRNA target sequence
tttttactatcgttataaatat

SEQ ID NO: 25109 - DNA, 22 bp, Artificial sequence
  SiRNA target sequence
ttttactatcgttataaatata

SEQ ID NO: 25110 - DNA, 22 bp, Artificial sequence
  SiRNA target sequence
tttactatcgttataaatatac

SEQ ID NO: 25111 - DNA, 22 bp, Artificial sequence
  SiRNA target sequence
ttactatcgttataaatatacg

SEQ ID NO: 25112 - DNA, 22 bp, Artificial sequence
  SiRNA target sequence
tactatcgttataaatatacgg

SEQ ID NO: 25113 - DNA, 22 bp, Artificial sequence
  SiRNA target sequence
actatcgttataaatatacgga

SEQ ID NO: 25114 - DNA, 22 bp, Artificial sequence
  SiRNA target sequence
ctatcgttataaatatacggaa

SEQ ID NO: 25115 - DNA, 22 bp, Artificial sequence
  SiRNA target sequence
tatcgttataaatatacggaat

SEQ ID NO: 25116 - DNA, 22 bp, Artificial sequence
  SiRNA target sequence
atcgttataaatatacggaata

SEQ ID NO: 25117 - DNA, 22 bp, Artificial sequence
  SiRNA target sequence
tcgttataaatatacggaatat

SEQ ID NO: 25118 - DNA, 22 bp, Artificial sequence
  SiRNA target sequence
cgttataaatatacggaatatt

SEQ ID NO: 25119 - DNA, 22 bp, Artificial sequence
  SiRNA target sequence
gttataaatatacggaatatta

SEQ ID NO: 25120 - DNA, 22 bp, Artificial sequence
  SiRNA target sequence
ttataaatatacggaatattaa

SEQ ID NO: 25121 - DNA, 22 bp, Artificial sequence
  SiRNA target sequence
tataaatatacggaatattaat

SEQ ID NO: 25122 - DNA, 22 bp, Artificial sequence
  SiRNA target sequence
ataaatatacggaatattaatt

SEQ ID NO: 25123 - DNA, 22 bp, Artificial sequence
  SiRNA target sequence
taaatatacggaatattaattt

SEQ ID NO: 25124 - DNA, 22 bp, Artificial sequence
  SiRNA target sequence
aaatatacggaatattaatttc

SEQ ID NO: 25125 - DNA, 22 bp, Artificial sequence
  SiRNA target sequence
aatatacggaatattaatttca

SEQ ID NO: 25126 - DNA, 22 bp, Artificial sequence
  SiRNA target sequence
atatacggaatattaatttcag

SEQ ID NO: 25127 - DNA, 22 bp, Artificial sequence
  SiRNA target sequence
tatacggaatattaatttcaga

SEQ ID NO: 25128 - DNA, 22 bp, Artificial sequence
  SiRNA target sequence
atacggaatattaatttcagac

SEQ ID NO: 25129 - DNA, 22 bp, Artificial sequence
  SiRNA target sequence
tacggaatattaatttcagacg

SEQ ID NO: 25130 - DNA, 22 bp, Artificial sequence
  SiRNA target sequence
acggaatattaatttcagacga

SEQ ID NO: 25131 - DNA, 22 bp, Artificial sequence
  SiRNA target sequence
cggaatattaatttcagacgaa

SEQ ID NO: 25132 - DNA, 22 bp, Artificial sequence
  SiRNA target sequence
ggaatattaatttcagacgaaa

SEQ ID NO: 25133 - DNA, 22 bp, Artificial sequence
  SiRNA target sequence
gaatattaatttcagacgaaag

SEQ ID NO: 25134 - DNA, 22 bp, Artificial sequence
  SiRNA target sequence
aatattaatttcagacgaaaga

SEQ ID NO: 25135 - DNA, 22 bp, Artificial sequence
  SiRNA target sequence
atattaatttcagacgaaagat

SEQ ID NO: 25136 - DNA, 22 bp, Artificial sequence
  SiRNA target sequence
tattaatttcagacgaaagatt

SEQ ID NO: 25137 - DNA, 22 bp, Artificial sequence
  SiRNA target sequence
attaatttcagacgaaagatta

SEQ ID NO: 25138 - DNA, 22 bp, Artificial sequence
  SiRNA target sequence
ttaatttcagacgaaagattag

SEQ ID NO: 25139 - DNA, 22 bp, Artificial sequence
  SiRNA target sequence
taatttcagacgaaagattaga

SEQ ID NO: 25140 - DNA, 22 bp, Artificial sequence
  SiRNA target sequence
aatttcagacgaaagattagac

SEQ ID NO: 25141 - DNA, 22 bp, Artificial sequence
  SiRNA target sequence
atttcagacgaaagattagacg

SEQ ID NO: 25142 - DNA, 22 bp, Artificial sequence
  SiRNA target sequence
tttcagacgaaagattagacga

SEQ ID NO: 25143 - DNA, 22 bp, Artificial sequence
  SiRNA target sequence
ttcagacgaaagattagacgac

SEQ ID NO: 25144 - DNA, 22 bp, Artificial sequence
  SiRNA target sequence
tcagacgaaagattagacgaca

SEQ ID NO: 25145 - DNA, 22 bp, Artificial sequence
  SiRNA target sequence
cagacgaaagattagacgacag

SEQ ID NO: 25146 - DNA, 22 bp, Artificial sequence
  SiRNA target sequence
agacgaaagattagacgacagt

SEQ ID NO: 25147 - DNA, 22 bp, Artificial sequence
  SiRNA target sequence
gacgaaagattagacgacagtt

SEQ ID NO: 25148 - DNA, 22 bp, Artificial sequence
  SiRNA target sequence
acgaaagattagacgacagttc

SEQ ID NO: 25149 - DNA, 22 bp, Artificial sequence
  SiRNA target sequence
cgaaagattagacgacagttct

SEQ ID NO: 25150 - DNA, 22 bp, Artificial sequence
  SiRNA target sequence
gaaagattagacgacagttctt

SEQ ID NO: 25151 - DNA, 22 bp, Artificial sequence
  SiRNA target sequence
aaagattagacgacagttcttt

SEQ ID NO: 25152 - DNA, 22 bp, Artificial sequence
  SiRNA target sequence
aagattagacgacagttctttt

SEQ ID NO: 25153 - DNA, 22 bp, Artificial sequence
  SiRNA target sequence
agattagacgacagttcttttt

SEQ ID NO: 25154 - DNA, 22 bp, Artificial sequence
  SiRNA target sequence
gattagacgacagttctttttt

SEQ ID NO: 25155 - DNA, 22 bp, Artificial sequence
  SiRNA target sequence
attagacgacagttcttttttc

SEQ ID NO: 25156 - DNA, 22 bp, Artificial sequence
  SiRNA target sequence
ttagacgacagttcttttttca

SEQ ID NO: 25157 - DNA, 22 bp, Artificial sequence
  SiRNA target sequence
tagacgacagttcttttttcat

SEQ ID NO: 25158 - DNA, 22 bp, Artificial sequence
  SiRNA target sequence
agacgacagttcttttttcatt

SEQ ID NO: 25159 - DNA, 22 bp, Artificial sequence
  SiRNA target sequence
gacgacagttcttttttcattt

SEQ ID NO: 25160 - DNA, 22 bp, Artificial sequence
  SiRNA target sequence
acgacagttcttttttcatttt

SEQ ID NO: 25161 - DNA, 22 bp, Artificial sequence
  SiRNA target sequence
cgacagttcttttttcattttt

SEQ ID NO: 25162 - DNA, 22 bp, Artificial sequence
  SiRNA target sequence
gacagttcttttttcatttttt

SEQ ID NO: 25163 - DNA, 22 bp, Artificial sequence
  SiRNA target sequence
acagttcttttttcattttttc

SEQ ID NO: 25164 - DNA, 22 bp, Artificial sequence
  SiRNA target sequence
cagttcttttttcattttttcc

SEQ ID NO: 25165 - DNA, 22 bp, Artificial sequence
  SiRNA target sequence
agttcttttttcattttttccg

SEQ ID NO: 25166 - DNA, 22 bp, Artificial sequence
  SiRNA target sequence
gttcttttttcattttttccgc

SEQ ID NO: 25167 - DNA, 22 bp, Artificial sequence
  SiRNA target sequence
ttcttttttcattttttccgct

SEQ ID NO: 25168 - DNA, 22 bp, Artificial sequence
  SiRNA target sequence
tcttttttcattttttccgctg

SEQ ID NO: 25169 - DNA, 22 bp, Artificial sequence
  SiRNA target sequence
cttttttcattttttccgctgc

SEQ ID NO: 25170 - DNA, 22 bp, Artificial sequence
  SiRNA target sequence
ttttttcattttttccgctgct

SEQ ID NO: 25171 - DNA, 22 bp, Artificial sequence
  SiRNA target sequence
tttttcattttttccgctgctt

SEQ ID NO: 25172 - DNA, 22 bp, Artificial sequence
  SiRNA target sequence
ttttcattttttccgctgcttc

SEQ ID NO: 25173 - DNA, 22 bp, Artificial sequence
  SiRNA target sequence
tttcattttttccgctgcttct

SEQ ID NO: 25174 - DNA, 22 bp, Artificial sequence
  SiRNA target sequence
ttcattttttccgctgcttctt

SEQ ID NO: 25175 - DNA, 22 bp, Artificial sequence
  SiRNA target sequence
tcattttttccgctgcttcttt

SEQ ID NO: 25176 - DNA, 22 bp, Artificial sequence
  SiRNA target sequence
cattttttccgctgcttcttta

SEQ ID NO: 25177 - DNA, 22 bp, Artificial sequence
  SiRNA target sequence
attttttccgctgcttctttaa

SEQ ID NO: 25178 - DNA, 22 bp, Artificial sequence
  SiRNA target sequence
ttttttccgctgcttctttaat

SEQ ID NO: 25179 - DNA, 22 bp, Artificial sequence
  SiRNA target sequence
tttttccgctgcttctttaatt

SEQ ID NO: 25180 - DNA, 22 bp, Artificial sequence
  SiRNA target sequence
ttttccgctgcttctttaattc

SEQ ID NO: 25181 - DNA, 22 bp, Artificial sequence
  SiRNA target sequence
tttccgctgcttctttaattct

SEQ ID NO: 25182 - DNA, 22 bp, Artificial sequence
  SiRNA target sequence
ttccgctgcttctttaattcta

SEQ ID NO: 25183 - DNA, 22 bp, Artificial sequence
  SiRNA target sequence
tccgctgcttctttaattctat

SEQ ID NO: 25184 - DNA, 22 bp, Artificial sequence
  SiRNA target sequence
ccgctgcttctttaattctatt

SEQ ID NO: 25185 - DNA, 22 bp, Artificial sequence
  SiRNA target sequence
cgctgcttctttaattctatta

SEQ ID NO: 25186 - DNA, 22 bp, Artificial sequence
  SiRNA target sequence
gctgcttctttaattctattat

SEQ ID NO: 25187 - DNA, 22 bp, Artificial sequence
  SiRNA target sequence
ctgcttctttaattctattata

SEQ ID NO: 25188 - DNA, 22 bp, Artificial sequence
  SiRNA target sequence
tgcttctttaattctattataa

SEQ ID NO: 25189 - DNA, 22 bp, Artificial sequence
  SiRNA target sequence
gcttctttaattctattataac

SEQ ID NO: 25190 - DNA, 22 bp, Artificial sequence
  SiRNA target sequence
cttctttaattctattataaca

SEQ ID NO: 25191 - DNA, 22 bp, Artificial sequence
  SiRNA target sequence
ttctttaattctattataacaa

SEQ ID NO: 25192 - DNA, 22 bp, Artificial sequence
  SiRNA target sequence
tctttaattctattataacaag

SEQ ID NO: 25193 - DNA, 22 bp, Artificial sequence
  SiRNA target sequence
ctttaattctattataacaaga

SEQ ID NO: 25194 - DNA, 22 bp, Artificial sequence
  SiRNA target sequence
tttaattctattataacaagaa

SEQ ID NO: 25195 - DNA, 22 bp, Artificial sequence
  SiRNA target sequence
ttaattctattataacaagaat

SEQ ID NO: 25196 - DNA, 22 bp, Artificial sequence
  SiRNA target sequence
taattctattataacaagaatc

SEQ ID NO: 25197 - DNA, 22 bp, Artificial sequence
  SiRNA target sequence
aattctattataacaagaatcg

SEQ ID NO: 25198 - DNA, 22 bp, Artificial sequence
  SiRNA target sequence
attctattataacaagaatcgt

SEQ ID NO: 25199 - DNA, 22 bp, Artificial sequence
  SiRNA target sequence
ttctattataacaagaatcgtg

SEQ ID NO: 25200 - DNA, 22 bp, Artificial sequence
  SiRNA target sequence
tctattataacaagaatcgtgt

SEQ ID NO: 25201 - DNA, 22 bp, Artificial sequence
  SiRNA target sequence
ctattataacaagaatcgtgtt

SEQ ID NO: 25202 - DNA, 22 bp, Artificial sequence
  SiRNA target sequence
tattataacaagaatcgtgttt

SEQ ID NO: 25203 - DNA, 22 bp, Artificial sequence
  SiRNA target sequence
attataacaagaatcgtgttta

SEQ ID NO: 25204 - DNA, 22 bp, Artificial sequence
  SiRNA target sequence
ttataacaagaatcgtgtttaa

SEQ ID NO: 25205 - DNA, 22 bp, Artificial sequence
  SiRNA target sequence
tataacaagaatcgtgtttaag

SEQ ID NO: 25206 - DNA, 22 bp, Artificial sequence
  SiRNA target sequence
ataacaagaatcgtgtttaagt

SEQ ID NO: 25207 - DNA, 22 bp, Artificial sequence
  SiRNA target sequence
taacaagaatcgtgtttaagta

SEQ ID NO: 25208 - DNA, 22 bp, Artificial sequence
  SiRNA target sequence
aacaagaatcgtgtttaagtaa

SEQ ID NO: 25209 - DNA, 22 bp, Artificial sequence
  SiRNA target sequence
acaagaatcgtgtttaagtaaa

SEQ ID NO: 25210 - DNA, 22 bp, Artificial sequence
  SiRNA target sequence
caagaatcgtgtttaagtaaat

SEQ ID NO: 25211 - DNA, 22 bp, Artificial sequence
  SiRNA target sequence
aagaatcgtgtttaagtaaatc

SEQ ID NO: 25212 - DNA, 22 bp, Artificial sequence
  SiRNA target sequence
agaatcgtgtttaagtaaatca

SEQ ID NO: 25213 - DNA, 22 bp, Artificial sequence
  SiRNA target sequence
gaatcgtgtttaagtaaatcaa

SEQ ID NO: 25214 - DNA, 22 bp, Artificial sequence
  SiRNA target sequence
aatcgtgtttaagtaaatcaat

SEQ ID NO: 25215 - DNA, 22 bp, Artificial sequence
  SiRNA target sequence
atcgtgtttaagtaaatcaatt

SEQ ID NO: 25216 - DNA, 22 bp, Artificial sequence
  SiRNA target sequence
tcgtgtttaagtaaatcaattc

SEQ ID NO: 25217 - DNA, 22 bp, Artificial sequence
  SiRNA target sequence
cgtgtttaagtaaatcaattcc

SEQ ID NO: 25218 - DNA, 22 bp, Artificial sequence
  SiRNA target sequence
gtgtttaagtaaatcaattcct

SEQ ID NO: 25219 - DNA, 22 bp, Artificial sequence
  SiRNA target sequence
tgtttaagtaaatcaattcctg

SEQ ID NO: 25220 - DNA, 22 bp, Artificial sequence
  SiRNA target sequence
gtttaagtaaatcaattcctgt

SEQ ID NO: 25221 - DNA, 22 bp, Artificial sequence
  SiRNA target sequence
tttaagtaaatcaattcctgtt

SEQ ID NO: 25222 - DNA, 22 bp, Artificial sequence
  SiRNA target sequence
ttaagtaaatcaattcctgttc

SEQ ID NO: 25223 - DNA, 22 bp, Artificial sequence
  SiRNA target sequence
taagtaaatcaattcctgttct

SEQ ID NO: 25224 - DNA, 22 bp, Artificial sequence
  SiRNA target sequence
aagtaaatcaattcctgttcta

SEQ ID NO: 25225 - DNA, 22 bp, Artificial sequence
  SiRNA target sequence
agtaaatcaattcctgttctac

SEQ ID NO: 25226 - DNA, 22 bp, Artificial sequence
  SiRNA target sequence
gtaaatcaattcctgttctact

SEQ ID NO: 25227 - DNA, 22 bp, Artificial sequence
  SiRNA target sequence
taaatcaattcctgttctactt

SEQ ID NO: 25228 - DNA, 22 bp, Artificial sequence
  SiRNA target sequence
aaatcaattcctgttctacttt

SEQ ID NO: 25229 - DNA, 22 bp, Artificial sequence
  SiRNA target sequence
aatcaattcctgttctactttt

SEQ ID NO: 25230 - DNA, 22 bp, Artificial sequence
  SiRNA target sequence
atcaattcctgttctactttta

SEQ ID NO: 25231 - DNA, 22 bp, Artificial sequence
  SiRNA target sequence
tcaattcctgttctacttttaa

SEQ ID NO: 25232 - DNA, 22 bp, Artificial sequence
  SiRNA target sequence
caattcctgttctacttttaaa

SEQ ID NO: 25233 - DNA, 22 bp, Artificial sequence
  SiRNA target sequence
aattcctgttctacttttaaat

SEQ ID NO: 25234 - DNA, 22 bp, Artificial sequence
  SiRNA target sequence
attcctgttctacttttaaatt

SEQ ID NO: 25235 - DNA, 22 bp, Artificial sequence
  SiRNA target sequence
ttcctgttctacttttaaattt

SEQ ID NO: 25236 - DNA, 22 bp, Artificial sequence
  SiRNA target sequence
tcctgttctacttttaaatttt

SEQ ID NO: 25237 - DNA, 22 bp, Artificial sequence
  SiRNA target sequence
cctgttctacttttaaattttt

SEQ ID NO: 25238 - DNA, 22 bp, Artificial sequence
  SiRNA target sequence
ctgttctacttttaaatttttc

SEQ ID NO: 25239 - DNA, 22 bp, Artificial sequence
  SiRNA target sequence
tgttctacttttaaatttttca

SEQ ID NO: 25240 - DNA, 22 bp, Artificial sequence
  SiRNA target sequence
gttctacttttaaatttttcat

SEQ ID NO: 25241 - DNA, 22 bp, Artificial sequence
  SiRNA target sequence
ttctacttttaaatttttcatt

SEQ ID NO: 25242 - DNA, 22 bp, Artificial sequence
  SiRNA target sequence
tctacttttaaatttttcatta

SEQ ID NO: 25243 - DNA, 22 bp, Artificial sequence
  SiRNA target sequence
ctacttttaaatttttcattaa

SEQ ID NO: 25244 - DNA, 22 bp, Artificial sequence
  SiRNA target sequence
tacttttaaatttttcattaat

SEQ ID NO: 25245 - DNA, 22 bp, Artificial sequence
  SiRNA target sequence
acttttaaatttttcattaata

SEQ ID NO: 25246 - DNA, 22 bp, Artificial sequence
  SiRNA target sequence
cttttaaatttttcattaatat

SEQ ID NO: 25247 - DNA, 22 bp, Artificial sequence
  SiRNA target sequence
ttttaaatttttcattaatata

SEQ ID NO: 25248 - DNA, 22 bp, Artificial sequence
  SiRNA target sequence
tttaaatttttcattaatataa

SEQ ID NO: 25249 - DNA, 22 bp, Artificial sequence
  SiRNA target sequence
ttaaatttttcattaatataat

SEQ ID NO: 25250 - DNA, 22 bp, Artificial sequence
  SiRNA target sequence
taaatttttcattaatataatc

SEQ ID NO: 25251 - DNA, 22 bp, Artificial sequence
  SiRNA target sequence
aaatttttcattaatataatct

SEQ ID NO: 25252 - DNA, 22 bp, Artificial sequence
  SiRNA target sequence
aatttttcattaatataatcta

SEQ ID NO: 25253 - DNA, 22 bp, Artificial sequence
  SiRNA target sequence
atttttcattaatataatctac

SEQ ID NO: 25254 - DNA, 22 bp, Artificial sequence
  SiRNA target sequence
tttttcattaatataatctact

SEQ ID NO: 25255 - DNA, 22 bp, Artificial sequence
  SiRNA target sequence
ttttcattaatataatctacta

SEQ ID NO: 25256 - DNA, 22 bp, Artificial sequence
  SiRNA target sequence
tttcattaatataatctactaa

SEQ ID NO: 25257 - DNA, 22 bp, Artificial sequence
  SiRNA target sequence
ttcattaatataatctactaaa

SEQ ID NO: 25258 - DNA, 22 bp, Artificial sequence
  SiRNA target sequence
tcattaatataatctactaaag

SEQ ID NO: 25259 - DNA, 22 bp, Artificial sequence
  SiRNA target sequence
cattaatataatctactaaagt

SEQ ID NO: 25260 - DNA, 22 bp, Artificial sequence
  SiRNA target sequence
attaatataatctactaaagta

SEQ ID NO: 25261 - DNA, 22 bp, Artificial sequence
  SiRNA target sequence
ttaatataatctactaaagtat

SEQ ID NO: 25262 - DNA, 22 bp, Artificial sequence
  SiRNA target sequence
taatataatctactaaagtatt

SEQ ID NO: 25263 - DNA, 22 bp, Artificial sequence
  SiRNA target sequence
aatataatctactaaagtatta

SEQ ID NO: 25264 - DNA, 22 bp, Artificial sequence
  SiRNA target sequence
atataatctactaaagtattat

SEQ ID NO: 25265 - DNA, 22 bp, Artificial sequence
  SiRNA target sequence
tataatctactaaagtattatc

SEQ ID NO: 25266 - DNA, 22 bp, Artificial sequence
  SiRNA target sequence
ataatctactaaagtattatcc

SEQ ID NO: 25267 - DNA, 22 bp, Artificial sequence
  SiRNA target sequence
taatctactaaagtattatcca

SEQ ID NO: 25268 - DNA, 22 bp, Artificial sequence
  SiRNA target sequence
aatctactaaagtattatccaa

SEQ ID NO: 25269 - DNA, 22 bp, Artificial sequence
  SiRNA target sequence
atctactaaagtattatccaaa

SEQ ID NO: 25270 - DNA, 22 bp, Artificial sequence
  SiRNA target sequence
tctactaaagtattatccaaat

SEQ ID NO: 25271 - DNA, 22 bp, Artificial sequence
  SiRNA target sequence
ctactaaagtattatccaaatc

SEQ ID NO: 25272 - DNA, 22 bp, Artificial sequence
  SiRNA target sequence
tactaaagtattatccaaatct

SEQ ID NO: 25273 - DNA, 22 bp, Artificial sequence
  SiRNA target sequence
actaaagtattatccaaatctt

SEQ ID NO: 25274 - DNA, 22 bp, Artificial sequence
  SiRNA target sequence
ctaaagtattatccaaatcttc

SEQ ID NO: 25275 - DNA, 22 bp, Artificial sequence
  SiRNA target sequence
taaagtattatccaaatcttct

SEQ ID NO: 25276 - DNA, 22 bp, Artificial sequence
  SiRNA target sequence
aaagtattatccaaatcttctc

SEQ ID NO: 25277 - DNA, 22 bp, Artificial sequence
  SiRNA target sequence
aagtattatccaaatcttctcc

SEQ ID NO: 25278 - DNA, 22 bp, Artificial sequence
  SiRNA target sequence
agtattatccaaatcttctcct

SEQ ID NO: 25279 - DNA, 22 bp, Artificial sequence
  SiRNA target sequence
gtattatccaaatcttctcctc

SEQ ID NO: 25280 - DNA, 22 bp, Artificial sequence
  SiRNA target sequence
tattatccaaatcttctcctcc

SEQ ID NO: 25281 - DNA, 22 bp, Artificial sequence
  SiRNA target sequence
attatccaaatcttctcctcct

SEQ ID NO: 25282 - DNA, 22 bp, Artificial sequence
  SiRNA target sequence
ttatccaaatcttctcctccta

SEQ ID NO: 25283 - DNA, 22 bp, Artificial sequence
  SiRNA target sequence
tatccaaatcttctcctcctaa

SEQ ID NO: 25284 - DNA, 22 bp, Artificial sequence
  SiRNA target sequence
atccaaatcttctcctcctaaa

SEQ ID NO: 25285 - DNA, 22 bp, Artificial sequence
  SiRNA target sequence
tccaaatcttctcctcctaaaa

SEQ ID NO: 25286 - DNA, 22 bp, Artificial sequence
  SiRNA target sequence
ccaaatcttctcctcctaaaaa

SEQ ID NO: 25287 - DNA, 22 bp, Artificial sequence
  SiRNA target sequence
caaatcttctcctcctaaaaaa

SEQ ID NO: 25288 - DNA, 22 bp, Artificial sequence
  SiRNA target sequence
aaatcttctcctcctaaaaaag

SEQ ID NO: 25289 - DNA, 22 bp, Artificial sequence
  SiRNA target sequence
aatcttctcctcctaaaaaagt

SEQ ID NO: 25290 - DNA, 22 bp, Artificial sequence
  SiRNA target sequence
atcttctcctcctaaaaaagta

SEQ ID NO: 25291 - DNA, 22 bp, Artificial sequence
  SiRNA target sequence
tcttctcctcctaaaaaagtat

SEQ ID NO: 25292 - DNA, 22 bp, Artificial sequence
  SiRNA target sequence
cttctcctcctaaaaaagtatt

SEQ ID NO: 25293 - DNA, 22 bp, Artificial sequence
  SiRNA target sequence
ttctcctcctaaaaaagtattt

SEQ ID NO: 25294 - DNA, 22 bp, Artificial sequence
  SiRNA target sequence
tctcctcctaaaaaagtatttc

SEQ ID NO: 25295 - DNA, 22 bp, Artificial sequence
  SiRNA target sequence
ctcctcctaaaaaagtatttcc

SEQ ID NO: 25296 - DNA, 22 bp, Artificial sequence
  SiRNA target sequence
tcctcctaaaaaagtatttccg

SEQ ID NO: 25297 - DNA, 22 bp, Artificial sequence
  SiRNA target sequence
cctcctaaaaaagtatttccgt

SEQ ID NO: 25298 - DNA, 22 bp, Artificial sequence
  SiRNA target sequence
ctcctaaaaaagtatttccgtt

SEQ ID NO: 25299 - DNA, 22 bp, Artificial sequence
  SiRNA target sequence
tcctaaaaaagtatttccgtta

SEQ ID NO: 25300 - DNA, 22 bp, Artificial sequence
  SiRNA target sequence
cctaaaaaagtatttccgttag

SEQ ID NO: 25301 - DNA, 22 bp, Artificial sequence
  SiRNA target sequence
ctaaaaaagtatttccgttagt

SEQ ID NO: 25302 - DNA, 22 bp, Artificial sequence
  SiRNA target sequence
taaaaaagtatttccgttagta

SEQ ID NO: 25303 - DNA, 22 bp, Artificial sequence
  SiRNA target sequence
aaaaaagtatttccgttagtag

SEQ ID NO: 25304 - DNA, 22 bp, Artificial sequence
  SiRNA target sequence
aaaaagtatttccgttagtaga

SEQ ID NO: 25305 - DNA, 22 bp, Artificial sequence
  SiRNA target sequence
aaaagtatttccgttagtagat

SEQ ID NO: 25306 - DNA, 22 bp, Artificial sequence
  SiRNA target sequence
aaagtatttccgttagtagatt

SEQ ID NO: 25307 - DNA, 22 bp, Artificial sequence
  SiRNA target sequence
aagtatttccgttagtagattt

SEQ ID NO: 25308 - DNA, 22 bp, Artificial sequence
  SiRNA target sequence
agtatttccgttagtagatttt

SEQ ID NO: 25309 - DNA, 22 bp, Artificial sequence
  SiRNA target sequence
gtatttccgttagtagatttta

SEQ ID NO: 25310 - DNA, 22 bp, Artificial sequence
  SiRNA target sequence
tatttccgttagtagattttac

SEQ ID NO: 25311 - DNA, 22 bp, Artificial sequence
  SiRNA target sequence
atttccgttagtagattttaca

SEQ ID NO: 25312 - DNA, 22 bp, Artificial sequence
  SiRNA target sequence
tttccgttagtagattttacat

SEQ ID NO: 25313 - DNA, 22 bp, Artificial sequence
  SiRNA target sequence
ttccgttagtagattttacatg

SEQ ID NO: 25314 - DNA, 22 bp, Artificial sequence
  SiRNA target sequence
tccgttagtagattttacatga

SEQ ID NO: 25315 - DNA, 22 bp, Artificial sequence
  SiRNA target sequence
ccgttagtagattttacatgaa

SEQ ID NO: 25316 - DNA, 22 bp, Artificial sequence
  SiRNA target sequence
cgttagtagattttacatgaaa

SEQ ID NO: 25317 - DNA, 22 bp, Artificial sequence
  SiRNA target sequence
gttagtagattttacatgaaaa

SEQ ID NO: 25318 - DNA, 22 bp, Artificial sequence
  SiRNA target sequence
ttagtagattttacatgaaaaa

SEQ ID NO: 25319 - DNA, 22 bp, Artificial sequence
  SiRNA target sequence
tagtagattttacatgaaaaat

SEQ ID NO: 25320 - DNA, 22 bp, Artificial sequence
  SiRNA target sequence
agtagattttacatgaaaaata

SEQ ID NO: 25321 - DNA, 22 bp, Artificial sequence
  SiRNA target sequence
gtagattttacatgaaaaatac

SEQ ID NO: 25322 - DNA, 22 bp, Artificial sequence
  SiRNA target sequence
tagattttacatgaaaaatacc

SEQ ID NO: 25323 - DNA, 22 bp, Artificial sequence
  SiRNA target sequence
agattttacatgaaaaatacca

SEQ ID NO: 25324 - DNA, 22 bp, Artificial sequence
  SiRNA target sequence
gattttacatgaaaaataccat

SEQ ID NO: 25325 - DNA, 22 bp, Artificial sequence
  SiRNA target sequence
attttacatgaaaaataccatt

SEQ ID NO: 25326 - DNA, 22 bp, Artificial sequence
  SiRNA target sequence
ttttacatgaaaaataccatta

SEQ ID NO: 25327 - DNA, 22 bp, Artificial sequence
  SiRNA target sequence
tttacatgaaaaataccattat

SEQ ID NO: 25328 - DNA, 22 bp, Artificial sequence
  SiRNA target sequence
ttacatgaaaaataccattatc

SEQ ID NO: 25329 - DNA, 22 bp, Artificial sequence
  SiRNA target sequence
tacatgaaaaataccattatct

SEQ ID NO: 25330 - DNA, 22 bp, Artificial sequence
  SiRNA target sequence
acatgaaaaataccattatcta

SEQ ID NO: 25331 - DNA, 22 bp, Artificial sequence
  SiRNA target sequence
catgaaaaataccattatctaa

SEQ ID NO: 25332 - DNA, 22 bp, Artificial sequence
  SiRNA target sequence
atgaaaaataccattatctaat

SEQ ID NO: 25333 - DNA, 22 bp, Artificial sequence
  SiRNA target sequence
tgaaaaataccattatctaatt

SEQ ID NO: 25334 - DNA, 22 bp, Artificial sequence
  SiRNA target sequence
gaaaaataccattatctaattc

SEQ ID NO: 25335 - DNA, 22 bp, Artificial sequence
  SiRNA target sequence
aaaaataccattatctaattct

SEQ ID NO: 25336 - DNA, 22 bp, Artificial sequence
  SiRNA target sequence
aaaataccattatctaattcta

SEQ ID NO: 25337 - DNA, 22 bp, Artificial sequence
  SiRNA target sequence
aaataccattatctaattctaa

SEQ ID NO: 25338 - DNA, 22 bp, Artificial sequence
  SiRNA target sequence
aataccattatctaattctaat

SEQ ID NO: 25339 - DNA, 22 bp, Artificial sequence
  SiRNA target sequence
ataccattatctaattctaata

SEQ ID NO: 25340 - DNA, 22 bp, Artificial sequence
  SiRNA target sequence
taccattatctaattctaatat

SEQ ID NO: 25341 - DNA, 22 bp, Artificial sequence
  SiRNA target sequence
accattatctaattctaatata

SEQ ID NO: 25342 - DNA, 22 bp, Artificial sequence
  SiRNA target sequence
ccattatctaattctaatatac

SEQ ID NO: 25343 - DNA, 22 bp, Artificial sequence
  SiRNA target sequence
cattatctaattctaatatact

SEQ ID NO: 25344 - DNA, 22 bp, Artificial sequence
  SiRNA target sequence
attatctaattctaatatacta

SEQ ID NO: 25345 - DNA, 22 bp, Artificial sequence
  SiRNA target sequence
ttatctaattctaatatactaa

SEQ ID NO: 25346 - DNA, 22 bp, Artificial sequence
  SiRNA target sequence
tatctaattctaatatactaat

SEQ ID NO: 25347 - DNA, 22 bp, Artificial sequence
  SiRNA target sequence
atctaattctaatatactaatg

SEQ ID NO: 25348 - DNA, 22 bp, Artificial sequence
  SiRNA target sequence
tctaattctaatatactaatgt

SEQ ID NO: 25349 - DNA, 22 bp, Artificial sequence
  SiRNA target sequence
ctaattctaatatactaatgtc

SEQ ID NO: 25350 - DNA, 22 bp, Artificial sequence
  SiRNA target sequence
taattctaatatactaatgtca

SEQ ID NO: 25351 - DNA, 22 bp, Artificial sequence
  SiRNA target sequence
aattctaatatactaatgtcaa

SEQ ID NO: 25352 - DNA, 22 bp, Artificial sequence
  SiRNA target sequence
attctaatatactaatgtcaaa

SEQ ID NO: 25353 - DNA, 22 bp, Artificial sequence
  SiRNA target sequence
ttctaatatactaatgtcaaaa

SEQ ID NO: 25354 - DNA, 22 bp, Artificial sequence
  SiRNA target sequence
tctaatatactaatgtcaaaag

SEQ ID NO: 25355 - DNA, 22 bp, Artificial sequence
  SiRNA target sequence
ctaatatactaatgtcaaaagt

SEQ ID NO: 25356 - DNA, 22 bp, Artificial sequence
  SiRNA target sequence
taatatactaatgtcaaaagtt

SEQ ID NO: 25357 - DNA, 22 bp, Artificial sequence
  SiRNA target sequence
aatatactaatgtcaaaagttc

SEQ ID NO: 25358 - DNA, 22 bp, Artificial sequence
  SiRNA target sequence
atatactaatgtcaaaagttcc

SEQ ID NO: 25359 - DNA, 22 bp, Artificial sequence
  SiRNA target sequence
tatactaatgtcaaaagttcct

SEQ ID NO: 25360 - DNA, 22 bp, Artificial sequence
  SiRNA target sequence
atactaatgtcaaaagttcctc

SEQ ID NO: 25361 - DNA, 22 bp, Artificial sequence
  SiRNA target sequence
tactaatgtcaaaagttcctcc

SEQ ID NO: 25362 - DNA, 22 bp, Artificial sequence
  SiRNA target sequence
actaatgtcaaaagttcctcct

SEQ ID NO: 25363 - DNA, 22 bp, Artificial sequence
  SiRNA target sequence
ctaatgtcaaaagttcctcctc

SEQ ID NO: 25364 - DNA, 22 bp, Artificial sequence
  SiRNA target sequence
taatgtcaaaagttcctcctcc

SEQ ID NO: 25365 - DNA, 22 bp, Artificial sequence
  SiRNA target sequence
aatgtcaaaagttcctcctccc

SEQ ID NO: 25366 - DNA, 22 bp, Artificial sequence
  SiRNA target sequence
atgtcaaaagttcctcctccca

SEQ ID NO: 25367 - DNA, 22 bp, Artificial sequence
  SiRNA target sequence
tgtcaaaagttcctcctcccag

SEQ ID NO: 25368 - DNA, 22 bp, Artificial sequence
  SiRNA target sequence
gtcaaaagttcctcctcccaga

SEQ ID NO: 25369 - DNA, 22 bp, Artificial sequence
  SiRNA target sequence
tcaaaagttcctcctcccagat

SEQ ID NO: 25370 - DNA, 22 bp, Artificial sequence
  SiRNA target sequence
caaaagttcctcctcccagatc

SEQ ID NO: 25371 - DNA, 22 bp, Artificial sequence
  SiRNA target sequence
aaaagttcctcctcccagatca

SEQ ID NO: 25372 - DNA, 22 bp, Artificial sequence
  SiRNA target sequence
aaagttcctcctcccagatcat

SEQ ID NO: 25373 - DNA, 22 bp, Artificial sequence
  SiRNA target sequence
aagttcctcctcccagatcata

SEQ ID NO: 25374 - DNA, 22 bp, Artificial sequence
  SiRNA target sequence
agttcctcctcccagatcataa

SEQ ID NO: 25375 - DNA, 22 bp, Artificial sequence
  SiRNA target sequence
gttcctcctcccagatcataaa

SEQ ID NO: 25376 - DNA, 22 bp, Artificial sequence
  SiRNA target sequence
ttcctcctcccagatcataaac

SEQ ID NO: 25377 - DNA, 22 bp, Artificial sequence
  SiRNA target sequence
tcctcctcccagatcataaaca

SEQ ID NO: 25378 - DNA, 22 bp, Artificial sequence
  SiRNA target sequence
cctcctcccagatcataaacag

SEQ ID NO: 25379 - DNA, 22 bp, Artificial sequence
  SiRNA target sequence
ctcctcccagatcataaacagc

SEQ ID NO: 25380 - DNA, 22 bp, Artificial sequence
  SiRNA target sequence
tcctcccagatcataaacagct

SEQ ID NO: 25381 - DNA, 22 bp, Artificial sequence
  SiRNA target sequence
cctcccagatcataaacagcta

SEQ ID NO: 25382 - DNA, 22 bp, Artificial sequence
  SiRNA target sequence
ctcccagatcataaacagctat

SEQ ID NO: 25383 - DNA, 22 bp, Artificial sequence
  SiRNA target sequence
tcccagatcataaacagctata

SEQ ID NO: 25384 - DNA, 22 bp, Artificial sequence
  SiRNA target sequence
cccagatcataaacagctataa

SEQ ID NO: 25385 - DNA, 22 bp, Artificial sequence
  SiRNA target sequence
ccagatcataaacagctataat

SEQ ID NO: 25386 - DNA, 22 bp, Artificial sequence
  SiRNA target sequence
cagatcataaacagctataata

SEQ ID NO: 25387 - DNA, 22 bp, Artificial sequence
  SiRNA target sequence
agatcataaacagctataatac

SEQ ID NO: 25388 - DNA, 22 bp, Artificial sequence
  SiRNA target sequence
gatcataaacagctataatacc

SEQ ID NO: 25389 - DNA, 22 bp, Artificial sequence
  SiRNA target sequence
atcataaacagctataataccc

SEQ ID NO: 25390 - DNA, 22 bp, Artificial sequence
  SiRNA target sequence
tcataaacagctataataccct

SEQ ID NO: 25391 - DNA, 22 bp, Artificial sequence
  SiRNA target sequence
cataaacagctataataccctg

SEQ ID NO: 25392 - DNA, 22 bp, Artificial sequence
  SiRNA target sequence
ataaacagctataataccctgt

SEQ ID NO: 25393 - DNA, 22 bp, Artificial sequence
  SiRNA target sequence
taaacagctataataccctgtg

SEQ ID NO: 25394 - DNA, 22 bp, Artificial sequence
  SiRNA target sequence
aaacagctataataccctgtgc

SEQ ID NO: 25395 - DNA, 22 bp, Artificial sequence
  SiRNA target sequence
aacagctataataccctgtgca

SEQ ID NO: 25396 - DNA, 22 bp, Artificial sequence
  SiRNA target sequence
acagctataataccctgtgcag

SEQ ID NO: 25397 - DNA, 22 bp, Artificial sequence
  SiRNA target sequence
cagctataataccctgtgcaga

SEQ ID NO: 25398 - DNA, 22 bp, Artificial sequence
  SiRNA target sequence
agctataataccctgtgcagac

SEQ ID NO: 25399 - DNA, 22 bp, Artificial sequence
  SiRNA target sequence
gctataataccctgtgcagact

SEQ ID NO: 25400 - DNA, 22 bp, Artificial sequence
  SiRNA target sequence
ctataataccctgtgcagactt

SEQ ID NO: 25401 - DNA, 22 bp, Artificial sequence
  SiRNA target sequence
tataataccctgtgcagacttg

SEQ ID NO: 25402 - DNA, 22 bp, Artificial sequence
  SiRNA target sequence
ataataccctgtgcagacttgt

SEQ ID NO: 25403 - DNA, 22 bp, Artificial sequence
  SiRNA target sequence
taataccctgtgcagacttgtc

SEQ ID NO: 25404 - DNA, 22 bp, Artificial sequence
  SiRNA target sequence
aataccctgtgcagacttgtca

SEQ ID NO: 25405 - DNA, 22 bp, Artificial sequence
  SiRNA target sequence
ataccctgtgcagacttgtcaa

SEQ ID NO: 25406 - DNA, 22 bp, Artificial sequence
  SiRNA target sequence
taccctgtgcagacttgtcaag

SEQ ID NO: 25407 - DNA, 22 bp, Artificial sequence
  SiRNA target sequence
accctgtgcagacttgtcaagc

SEQ ID NO: 25408 - DNA, 22 bp, Artificial sequence
  SiRNA target sequence
ccctgtgcagacttgtcaagcc

SEQ ID NO: 25409 - DNA, 22 bp, Artificial sequence
  SiRNA target sequence
cctgtgcagacttgtcaagccc

SEQ ID NO: 25410 - DNA, 22 bp, Artificial sequence
  SiRNA target sequence
ctgtgcagacttgtcaagccca

SEQ ID NO: 25411 - DNA, 22 bp, Artificial sequence
  SiRNA target sequence
tgtgcagacttgtcaagcccat

SEQ ID NO: 25412 - DNA, 22 bp, Artificial sequence
  SiRNA target sequence
gtgcagacttgtcaagcccata

SEQ ID NO: 25413 - DNA, 22 bp, Artificial sequence
  SiRNA target sequence
tgcagacttgtcaagcccataa

SEQ ID NO: 25414 - DNA, 22 bp, Artificial sequence
  SiRNA target sequence
gcagacttgtcaagcccataag

SEQ ID NO: 25415 - DNA, 22 bp, Artificial sequence
  SiRNA target sequence
cagacttgtcaagcccataagc

SEQ ID NO: 25416 - DNA, 22 bp, Artificial sequence
  SiRNA target sequence
agacttgtcaagcccataagca

SEQ ID NO: 25417 - DNA, 22 bp, Artificial sequence
  SiRNA target sequence
gacttgtcaagcccataagcaa

SEQ ID NO: 25418 - DNA, 22 bp, Artificial sequence
  SiRNA target sequence
acttgtcaagcccataagcaag

SEQ ID NO: 25419 - DNA, 22 bp, Artificial sequence
  SiRNA target sequence
cttgtcaagcccataagcaagt

SEQ ID NO: 25420 - DNA, 22 bp, Artificial sequence
  SiRNA target sequence
ttgtcaagcccataagcaagtg

SEQ ID NO: 25421 - DNA, 22 bp, Artificial sequence
  SiRNA target sequence
tgtcaagcccataagcaagtgc

SEQ ID NO: 25422 - DNA, 22 bp, Artificial sequence
  SiRNA target sequence
gtcaagcccataagcaagtgct

SEQ ID NO: 25423 - DNA, 22 bp, Artificial sequence
  SiRNA target sequence
tcaagcccataagcaagtgctg

SEQ ID NO: 25424 - DNA, 22 bp, Artificial sequence
  SiRNA target sequence
caagcccataagcaagtgctgc

SEQ ID NO: 25425 - DNA, 22 bp, Artificial sequence
  SiRNA target sequence
aagcccataagcaagtgctgcc

SEQ ID NO: 25426 - DNA, 22 bp, Artificial sequence
  SiRNA target sequence
agcccataagcaagtgctgccg

SEQ ID NO: 25427 - DNA, 22 bp, Artificial sequence
  SiRNA target sequence
gcccataagcaagtgctgccgc

SEQ ID NO: 25428 - DNA, 22 bp, Artificial sequence
  SiRNA target sequence
cccataagcaagtgctgccgca

SEQ ID NO: 25429 - DNA, 22 bp, Artificial sequence
  SiRNA target sequence
ccataagcaagtgctgccgcag

SEQ ID NO: 25430 - DNA, 22 bp, Artificial sequence
  SiRNA target sequence
cataagcaagtgctgccgcagt

SEQ ID NO: 25431 - DNA, 22 bp, Artificial sequence
  SiRNA target sequence
ataagcaagtgctgccgcagta

SEQ ID NO: 25432 - DNA, 22 bp, Artificial sequence
  SiRNA target sequence
taagcaagtgctgccgcagtag

SEQ ID NO: 25433 - DNA, 22 bp, Artificial sequence
  SiRNA target sequence
aagcaagtgctgccgcagtagg

SEQ ID NO: 25434 - DNA, 22 bp, Artificial sequence
  SiRNA target sequence
agcaagtgctgccgcagtaggc

SEQ ID NO: 25435 - DNA, 22 bp, Artificial sequence
  SiRNA target sequence
gcaagtgctgccgcagtaggct

SEQ ID NO: 25436 - DNA, 22 bp, Artificial sequence
  SiRNA target sequence
caagtgctgccgcagtaggctc

SEQ ID NO: 25437 - DNA, 22 bp, Artificial sequence
  SiRNA target sequence
aagtgctgccgcagtaggctca

SEQ ID NO: 25438 - DNA, 22 bp, Artificial sequence
  SiRNA target sequence
agtgctgccgcagtaggctcat

SEQ ID NO: 25439 - DNA, 22 bp, Artificial sequence
  SiRNA target sequence
gtgctgccgcagtaggctcatt

SEQ ID NO: 25440 - DNA, 22 bp, Artificial sequence
  SiRNA target sequence
tgctgccgcagtaggctcatta

SEQ ID NO: 25441 - DNA, 22 bp, Artificial sequence
  SiRNA target sequence
gctgccgcagtaggctcattaa

SEQ ID NO: 25442 - DNA, 22 bp, Artificial sequence
  SiRNA target sequence
ctgccgcagtaggctcattaat

SEQ ID NO: 25443 - DNA, 22 bp, Artificial sequence
  SiRNA target sequence
tgccgcagtaggctcattaatc

SEQ ID NO: 25444 - DNA, 22 bp, Artificial sequence
  SiRNA target sequence
gccgcagtaggctcattaatca

SEQ ID NO: 25445 - DNA, 22 bp, Artificial sequence
  SiRNA target sequence
ccgcagtaggctcattaatcac

SEQ ID NO: 25446 - DNA, 22 bp, Artificial sequence
  SiRNA target sequence
cgcagtaggctcattaatcact

SEQ ID NO: 25447 - DNA, 22 bp, Artificial sequence
  SiRNA target sequence
gcagtaggctcattaatcactc

SEQ ID NO: 25448 - DNA, 22 bp, Artificial sequence
  SiRNA target sequence
cagtaggctcattaatcactct

SEQ ID NO: 25449 - DNA, 22 bp, Artificial sequence
  SiRNA target sequence
agtaggctcattaatcactcta

SEQ ID NO: 25450 - DNA, 22 bp, Artificial sequence
  SiRNA target sequence
gtaggctcattaatcactctaa

SEQ ID NO: 25451 - DNA, 22 bp, Artificial sequence
  SiRNA target sequence
taggctcattaatcactctaag

SEQ ID NO: 25452 - DNA, 22 bp, Artificial sequence
  SiRNA target sequence
aggctcattaatcactctaagc

SEQ ID NO: 25453 - DNA, 22 bp, Artificial sequence
  SiRNA target sequence
ggctcattaatcactctaagca

SEQ ID NO: 25454 - DNA, 22 bp, Artificial sequence
  SiRNA target sequence
gctcattaatcactctaagcac

SEQ ID NO: 25455 - DNA, 22 bp, Artificial sequence
  SiRNA target sequence
ctcattaatcactctaagcact

SEQ ID NO: 25456 - DNA, 22 bp, Artificial sequence
  SiRNA target sequence
tcattaatcactctaagcactt

SEQ ID NO: 25457 - DNA, 22 bp, Artificial sequence
  SiRNA target sequence
cattaatcactctaagcacttg

SEQ ID NO: 25458 - DNA, 22 bp, Artificial sequence
  SiRNA target sequence
attaatcactctaagcacttgt

SEQ ID NO: 25459 - DNA, 22 bp, Artificial sequence
  SiRNA target sequence
ttaatcactctaagcacttgta

SEQ ID NO: 25460 - DNA, 22 bp, Artificial sequence
  SiRNA target sequence
taatcactctaagcacttgtaa

SEQ ID NO: 25461 - DNA, 22 bp, Artificial sequence
  SiRNA target sequence
aatcactctaagcacttgtaat

SEQ ID NO: 25462 - DNA, 22 bp, Artificial sequence
  SiRNA target sequence
atcactctaagcacttgtaatc

SEQ ID NO: 25463 - DNA, 22 bp, Artificial sequence
  SiRNA target sequence
tcactctaagcacttgtaatcc

SEQ ID NO: 25464 - DNA, 22 bp, Artificial sequence
  SiRNA target sequence
cactctaagcacttgtaatccc

SEQ ID NO: 25465 - DNA, 22 bp, Artificial sequence
  SiRNA target sequence
actctaagcacttgtaatcccg

SEQ ID NO: 25466 - DNA, 22 bp, Artificial sequence
  SiRNA target sequence
ctctaagcacttgtaatcccgc

SEQ ID NO: 25467 - DNA, 22 bp, Artificial sequence
  SiRNA target sequence
tctaagcacttgtaatcccgca

SEQ ID NO: 25468 - DNA, 22 bp, Artificial sequence
  SiRNA target sequence
ctaagcacttgtaatcccgcaa

SEQ ID NO: 25469 - DNA, 22 bp, Artificial sequence
  SiRNA target sequence
taagcacttgtaatcccgcaat

SEQ ID NO: 25470 - DNA, 22 bp, Artificial sequence
  SiRNA target sequence
aagcacttgtaatcccgcaatc

SEQ ID NO: 25471 - DNA, 22 bp, Artificial sequence
  SiRNA target sequence
agcacttgtaatcccgcaatcc

SEQ ID NO: 25472 - DNA, 22 bp, Artificial sequence
  SiRNA target sequence
gcacttgtaatcccgcaatcct

SEQ ID NO: 25473 - DNA, 22 bp, Artificial sequence
  SiRNA target sequence
cacttgtaatcccgcaatcctt

SEQ ID NO: 25474 - DNA, 22 bp, Artificial sequence
  SiRNA target sequence
acttgtaatcccgcaatccttc

SEQ ID NO: 25475 - DNA, 22 bp, Artificial sequence
  SiRNA target sequence
cttgtaatcccgcaatccttcc

SEQ ID NO: 25476 - DNA, 22 bp, Artificial sequence
  SiRNA target sequence
ttgtaatcccgcaatccttccc

SEQ ID NO: 25477 - DNA, 22 bp, Artificial sequence
  SiRNA target sequence
tgtaatcccgcaatccttcccg

SEQ ID NO: 25478 - DNA, 22 bp, Artificial sequence
  SiRNA target sequence
gtaatcccgcaatccttcccgc

SEQ ID NO: 25479 - DNA, 22 bp, Artificial sequence
  SiRNA target sequence
taatcccgcaatccttcccgca

SEQ ID NO: 25480 - DNA, 22 bp, Artificial sequence
  SiRNA target sequence
aatcccgcaatccttcccgcat

SEQ ID NO: 25481 - DNA, 22 bp, Artificial sequence
  SiRNA target sequence
atcccgcaatccttcccgcatc

SEQ ID NO: 25482 - DNA, 22 bp, Artificial sequence
  SiRNA target sequence
tcccgcaatccttcccgcatct

SEQ ID NO: 25483 - DNA, 22 bp, Artificial sequence
  SiRNA target sequence
cccgcaatccttcccgcatctt

SEQ ID NO: 25484 - DNA, 22 bp, Artificial sequence
  SiRNA target sequence
ccgcaatccttcccgcatcttt

SEQ ID NO: 25485 - DNA, 22 bp, Artificial sequence
  SiRNA target sequence
cgcaatccttcccgcatcttta

SEQ ID NO: 25486 - DNA, 22 bp, Artificial sequence
  SiRNA target sequence
gcaatccttcccgcatctttag

SEQ ID NO: 25487 - DNA, 22 bp, Artificial sequence
  SiRNA target sequence
caatccttcccgcatctttagt

SEQ ID NO: 25488 - DNA, 22 bp, Artificial sequence
  SiRNA target sequence
aatccttcccgcatctttagta

SEQ ID NO: 25489 - DNA, 22 bp, Artificial sequence
  SiRNA target sequence
atccttcccgcatctttagtag

SEQ ID NO: 25490 - DNA, 22 bp, Artificial sequence
  SiRNA target sequence
tccttcccgcatctttagtagc

SEQ ID NO: 25491 - DNA, 22 bp, Artificial sequence
  SiRNA target sequence
ccttcccgcatctttagtagct

SEQ ID NO: 25492 - DNA, 22 bp, Artificial sequence
  SiRNA target sequence
cttcccgcatctttagtagctt

SEQ ID NO: 25493 - DNA, 22 bp, Artificial sequence
  SiRNA target sequence
ttcccgcatctttagtagcttg

SEQ ID NO: 25494 - DNA, 22 bp, Artificial sequence
  SiRNA target sequence
tcccgcatctttagtagcttgc

SEQ ID NO: 25495 - DNA, 22 bp, Artificial sequence
  SiRNA target sequence
cccgcatctttagtagcttgcc

SEQ ID NO: 25496 - DNA, 22 bp, Artificial sequence
  SiRNA target sequence
ccgcatctttagtagcttgcct

SEQ ID NO: 25497 - DNA, 22 bp, Artificial sequence
  SiRNA target sequence
cgcatctttagtagcttgcctt

SEQ ID NO: 25498 - DNA, 22 bp, Artificial sequence
  SiRNA target sequence
gcatctttagtagcttgccttt

SEQ ID NO: 25499 - DNA, 22 bp, Artificial sequence
  SiRNA target sequence
catctttagtagcttgcctttg

SEQ ID NO: 25500 - DNA, 22 bp, Artificial sequence
  SiRNA target sequence
atctttagtagcttgcctttgc

SEQ ID NO: 25501 - DNA, 22 bp, Artificial sequence
  SiRNA target sequence
tctttagtagcttgcctttgca

SEQ ID NO: 25502 - DNA, 22 bp, Artificial sequence
  SiRNA target sequence
ctttagtagcttgcctttgcat

SEQ ID NO: 25503 - DNA, 22 bp, Artificial sequence
  SiRNA target sequence
tttagtagcttgcctttgcatg

SEQ ID NO: 25504 - DNA, 22 bp, Artificial sequence
  SiRNA target sequence
ttagtagcttgcctttgcatgt

SEQ ID NO: 25505 - DNA, 22 bp, Artificial sequence
  SiRNA target sequence
tagtagcttgcctttgcatgtc

SEQ ID NO: 25506 - DNA, 22 bp, Artificial sequence
  SiRNA target sequence
agtagcttgcctttgcatgtca

SEQ ID NO: 25507 - DNA, 22 bp, Artificial sequence
  SiRNA target sequence
gtagcttgcctttgcatgtcat

SEQ ID NO: 25508 - DNA, 22 bp, Artificial sequence
  SiRNA target sequence
tagcttgcctttgcatgtcatc

SEQ ID NO: 25509 - DNA, 22 bp, Artificial sequence
  SiRNA target sequence
agcttgcctttgcatgtcatca

SEQ ID NO: 25510 - DNA, 22 bp, Artificial sequence
  SiRNA target sequence
gcttgcctttgcatgtcatcaa

SEQ ID NO: 25511 - DNA, 22 bp, Artificial sequence
  SiRNA target sequence
cttgcctttgcatgtcatcaaa

SEQ ID NO: 25512 - DNA, 22 bp, Artificial sequence
  SiRNA target sequence
ttgcctttgcatgtcatcaaaa

SEQ ID NO: 25513 - DNA, 22 bp, Artificial sequence
  SiRNA target sequence
tgcctttgcatgtcatcaaaat

SEQ ID NO: 25514 - DNA, 22 bp, Artificial sequence
  SiRNA target sequence
gcctttgcatgtcatcaaaata

SEQ ID NO: 25515 - DNA, 22 bp, Artificial sequence
  SiRNA target sequence
cctttgcatgtcatcaaaatat

SEQ ID NO: 25516 - DNA, 22 bp, Artificial sequence
  SiRNA target sequence
ctttgcatgtcatcaaaatatg

SEQ ID NO: 25517 - DNA, 22 bp, Artificial sequence
  SiRNA target sequence
tttgcatgtcatcaaaatatgc

SEQ ID NO: 25518 - DNA, 22 bp, Artificial sequence
  SiRNA target sequence
ttgcatgtcatcaaaatatgcg

SEQ ID NO: 25519 - DNA, 22 bp, Artificial sequence
  SiRNA target sequence
tgcatgtcatcaaaatatgcgg

SEQ ID NO: 25520 - DNA, 22 bp, Artificial sequence
  SiRNA target sequence
gcatgtcatcaaaatatgcggg

SEQ ID NO: 25521 - DNA, 22 bp, Artificial sequence
  SiRNA target sequence
catgtcatcaaaatatgcgggc

SEQ ID NO: 25522 - DNA, 22 bp, Artificial sequence
  SiRNA target sequence
atgtcatcaaaatatgcgggca

SEQ ID NO: 25523 - DNA, 22 bp, Artificial sequence
  SiRNA target sequence
tgtcatcaaaatatgcgggcac

SEQ ID NO: 25524 - DNA, 22 bp, Artificial sequence
  SiRNA target sequence
gtcatcaaaatatgcgggcact

SEQ ID NO: 25525 - DNA, 22 bp, Artificial sequence
  SiRNA target sequence
tcatcaaaatatgcgggcactg

SEQ ID NO: 25526 - DNA, 22 bp, Artificial sequence
  SiRNA target sequence
catcaaaatatgcgggcactgt

SEQ ID NO: 25527 - DNA, 22 bp, Artificial sequence
  SiRNA target sequence
atcaaaatatgcgggcactgtt

SEQ ID NO: 25528 - DNA, 22 bp, Artificial sequence
  SiRNA target sequence
tcaaaatatgcgggcactgtta

SEQ ID NO: 25529 - DNA, 22 bp, Artificial sequence
  SiRNA target sequence
caaaatatgcgggcactgttat

SEQ ID NO: 25530 - DNA, 22 bp, Artificial sequence
  SiRNA target sequence
aaaatatgcgggcactgttata

SEQ ID NO: 25531 - DNA, 22 bp, Artificial sequence
  SiRNA target sequence
aaatatgcgggcactgttataa

SEQ ID NO: 25532 - DNA, 22 bp, Artificial sequence
  SiRNA target sequence
aatatgcgggcactgttataac

SEQ ID NO: 25533 - DNA, 22 bp, Artificial sequence
  SiRNA target sequence
atatgcgggcactgttataaca

SEQ ID NO: 25534 - DNA, 22 bp, Artificial sequence
  SiRNA target sequence
tatgcgggcactgttataacag

SEQ ID NO: 25535 - DNA, 22 bp, Artificial sequence
  SiRNA target sequence
atgcgggcactgttataacaga

SEQ ID NO: 25536 - DNA, 22 bp, Artificial sequence
  SiRNA target sequence
tgcgggcactgttataacagat

SEQ ID NO: 25537 - DNA, 22 bp, Artificial sequence
  SiRNA target sequence
gcgggcactgttataacagatc

SEQ ID NO: 25538 - DNA, 22 bp, Artificial sequence
  SiRNA target sequence
cgggcactgttataacagatct

SEQ ID NO: 25539 - DNA, 22 bp, Artificial sequence
  SiRNA target sequence
gggcactgttataacagatctt

SEQ ID NO: 25540 - DNA, 22 bp, Artificial sequence
  SiRNA target sequence
ggcactgttataacagatctta

SEQ ID NO: 25541 - DNA, 22 bp, Artificial sequence
  SiRNA target sequence
gcactgttataacagatcttaa

SEQ ID NO: 25542 - DNA, 22 bp, Artificial sequence
  SiRNA target sequence
cactgttataacagatcttaat

SEQ ID NO: 25543 - DNA, 22 bp, Artificial sequence
  SiRNA target sequence
actgttataacagatcttaata

SEQ ID NO: 25544 - DNA, 22 bp, Artificial sequence
  SiRNA target sequence
ctgttataacagatcttaatac

SEQ ID NO: 25545 - DNA, 22 bp, Artificial sequence
  SiRNA target sequence
tgttataacagatcttaatact

SEQ ID NO: 25546 - DNA, 22 bp, Artificial sequence
  SiRNA target sequence
gttataacagatcttaatactt

SEQ ID NO: 25547 - DNA, 22 bp, Artificial sequence
  SiRNA target sequence
ttataacagatcttaatacttt

SEQ ID NO: 25548 - DNA, 22 bp, Artificial sequence
  SiRNA target sequence
tataacagatcttaatacttta

SEQ ID NO: 25549 - DNA, 22 bp, Artificial sequence
  SiRNA target sequence
ataacagatcttaatactttag

SEQ ID NO: 25550 - DNA, 22 bp, Artificial sequence
  SiRNA target sequence
taacagatcttaatactttaga

SEQ ID NO: 25551 - DNA, 22 bp, Artificial sequence
  SiRNA target sequence
aacagatcttaatactttagaa

SEQ ID NO: 25552 - DNA, 22 bp, Artificial sequence
  SiRNA target sequence
acagatcttaatactttagaat

SEQ ID NO: 25553 - DNA, 22 bp, Artificial sequence
  SiRNA target sequence
cagatcttaatactttagaatt

SEQ ID NO: 25554 - DNA, 22 bp, Artificial sequence
  SiRNA target sequence
agatcttaatactttagaattt

SEQ ID NO: 25555 - DNA, 22 bp, Artificial sequence
  SiRNA target sequence
gatcttaatactttagaattta

SEQ ID NO: 25556 - DNA, 22 bp, Artificial sequence
  SiRNA target sequence
atcttaatactttagaatttaa

SEQ ID NO: 25557 - DNA, 22 bp, Artificial sequence
  SiRNA target sequence
tcttaatactttagaatttaaa

SEQ ID NO: 25558 - DNA, 22 bp, Artificial sequence
  SiRNA target sequence
cttaatactttagaatttaaaa

SEQ ID NO: 25559 - DNA, 22 bp, Artificial sequence
  SiRNA target sequence
ttaatactttagaatttaaaaa

SEQ ID NO: 25560 - DNA, 22 bp, Artificial sequence
  SiRNA target sequence
taatactttagaatttaaaaaa

SEQ ID NO: 25561 - DNA, 22 bp, Artificial sequence
  SiRNA target sequence
aatactttagaatttaaaaaat

SEQ ID NO: 25562 - DNA, 22 bp, Artificial sequence
  SiRNA target sequence
atactttagaatttaaaaaatt

SEQ ID NO: 25563 - DNA, 22 bp, Artificial sequence
  SiRNA target sequence
tactttagaatttaaaaaattc

SEQ ID NO: 25564 - DNA, 22 bp, Artificial sequence
  SiRNA target sequence
actttagaatttaaaaaattct

SEQ ID NO: 25565 - DNA, 22 bp, Artificial sequence
  SiRNA target sequence
ctttagaatttaaaaaattctc

SEQ ID NO: 25566 - DNA, 22 bp, Artificial sequence
  SiRNA target sequence
tttagaatttaaaaaattctct

SEQ ID NO: 25567 - DNA, 22 bp, Artificial sequence
  SiRNA target sequence
ttagaatttaaaaaattctctg

SEQ ID NO: 25568 - DNA, 22 bp, Artificial sequence
  SiRNA target sequence
tagaatttaaaaaattctctgc

SEQ ID NO: 25569 - DNA, 22 bp, Artificial sequence
  SiRNA target sequence
agaatttaaaaaattctctgcg

SEQ ID NO: 25570 - DNA, 22 bp, Artificial sequence
  SiRNA target sequence
gaatttaaaaaattctctgcgg

SEQ ID NO: 25571 - DNA, 22 bp, Artificial sequence
  SiRNA target sequence
aatttaaaaaattctctgcggc

SEQ ID NO: 25572 - DNA, 22 bp, Artificial sequence
  SiRNA target sequence
atttaaaaaattctctgcggca

SEQ ID NO: 25573 - DNA, 22 bp, Artificial sequence
  SiRNA target sequence
tttaaaaaattctctgcggcat

SEQ ID NO: 25574 - DNA, 22 bp, Artificial sequence
  SiRNA target sequence
ttaaaaaattctctgcggcatt

SEQ ID NO: 25575 - DNA, 22 bp, Artificial sequence
  SiRNA target sequence
taaaaaattctctgcggcattt

SEQ ID NO: 25576 - DNA, 22 bp, Artificial sequence
  SiRNA target sequence
aaaaaattctctgcggcatttt

SEQ ID NO: 25577 - DNA, 22 bp, Artificial sequence
  SiRNA target sequence
aaaaattctctgcggcattttt

SEQ ID NO: 25578 - DNA, 22 bp, Artificial sequence
  SiRNA target sequence
aaaattctctgcggcatttttc

SEQ ID NO: 25579 - DNA, 22 bp, Artificial sequence
  SiRNA target sequence
aaattctctgcggcatttttca

SEQ ID NO: 25580 - DNA, 22 bp, Artificial sequence
  SiRNA target sequence
aattctctgcggcatttttcat

SEQ ID NO: 25581 - DNA, 22 bp, Artificial sequence
  SiRNA target sequence
attctctgcggcatttttcatt

SEQ ID NO: 25582 - DNA, 22 bp, Artificial sequence
  SiRNA target sequence
ttctctgcggcatttttcattt

SEQ ID NO: 25583 - DNA, 22 bp, Artificial sequence
  SiRNA target sequence
tctctgcggcatttttcatttt

SEQ ID NO: 25584 - DNA, 22 bp, Artificial sequence
  SiRNA target sequence
ctctgcggcatttttcattttt

SEQ ID NO: 25585 - DNA, 22 bp, Artificial sequence
  SiRNA target sequence
tctgcggcatttttcatttttg

SEQ ID NO: 25586 - DNA, 22 bp, Artificial sequence
  SiRNA target sequence
ctgcggcatttttcatttttga

SEQ ID NO: 25587 - DNA, 22 bp, Artificial sequence
  SiRNA target sequence
tgcggcatttttcatttttgac

SEQ ID NO: 25588 - DNA, 22 bp, Artificial sequence
  SiRNA target sequence
gcggcatttttcatttttgaca

SEQ ID NO: 25589 - DNA, 22 bp, Artificial sequence
  SiRNA target sequence
cggcatttttcatttttgacaa

SEQ ID NO: 25590 - DNA, 22 bp, Artificial sequence
  SiRNA target sequence
ggcatttttcatttttgacaaa

SEQ ID NO: 25591 - DNA, 22 bp, Artificial sequence
  SiRNA target sequence
gcatttttcatttttgacaaaa

SEQ ID NO: 25592 - DNA, 22 bp, Artificial sequence
  SiRNA target sequence
catttttcatttttgacaaaat

SEQ ID NO: 25593 - DNA, 22 bp, Artificial sequence
  SiRNA target sequence
atttttcatttttgacaaaata

SEQ ID NO: 25594 - DNA, 22 bp, Artificial sequence
  SiRNA target sequence
tttttcatttttgacaaaataa

SEQ ID NO: 25595 - DNA, 22 bp, Artificial sequence
  SiRNA target sequence
ttttcatttttgacaaaataaa

SEQ ID NO: 25596 - DNA, 22 bp, Artificial sequence
  SiRNA target sequence
tttcatttttgacaaaataaat

SEQ ID NO: 25597 - DNA, 22 bp, Artificial sequence
  SiRNA target sequence
ttcatttttgacaaaataaatg

SEQ ID NO: 25598 - DNA, 22 bp, Artificial sequence
  SiRNA target sequence
tcatttttgacaaaataaatgc

SEQ ID NO: 25599 - DNA, 22 bp, Artificial sequence
  SiRNA target sequence
catttttgacaaaataaatgca

SEQ ID NO: 25600 - DNA, 22 bp, Artificial sequence
  SiRNA target sequence
atttttgacaaaataaatgcac

SEQ ID NO: 25601 - DNA, 22 bp, Artificial sequence
  SiRNA target sequence
tttttgacaaaataaatgcacc

SEQ ID NO: 25602 - DNA, 22 bp, Artificial sequence
  SiRNA target sequence
ttttgacaaaataaatgcacca

SEQ ID NO: 25603 - DNA, 22 bp, Artificial sequence
  SiRNA target sequence
tttgacaaaataaatgcaccaa

SEQ ID NO: 25604 - DNA, 22 bp, Artificial sequence
  SiRNA target sequence
ttgacaaaataaatgcaccaat

SEQ ID NO: 25605 - DNA, 22 bp, Artificial sequence
  SiRNA target sequence
tgacaaaataaatgcaccaatt

SEQ ID NO: 25606 - DNA, 22 bp, Artificial sequence
  SiRNA target sequence
gacaaaataaatgcaccaattt

SEQ ID NO: 25607 - DNA, 22 bp, Artificial sequence
  SiRNA target sequence
acaaaataaatgcaccaatttg

SEQ ID NO: 25608 - DNA, 22 bp, Artificial sequence
  SiRNA target sequence
caaaataaatgcaccaatttgt

SEQ ID NO: 25609 - DNA, 22 bp, Artificial sequence
  SiRNA target sequence
aaaataaatgcaccaatttgtg

SEQ ID NO: 25610 - DNA, 22 bp, Artificial sequence
  SiRNA target sequence
aaataaatgcaccaatttgtgc

SEQ ID NO: 25611 - DNA, 22 bp, Artificial sequence
  SiRNA target sequence
aataaatgcaccaatttgtgca

SEQ ID NO: 25612 - DNA, 22 bp, Artificial sequence
  SiRNA target sequence
ataaatgcaccaatttgtgcag

SEQ ID NO: 25613 - DNA, 22 bp, Artificial sequence
  SiRNA target sequence
taaatgcaccaatttgtgcagg

SEQ ID NO: 25614 - DNA, 22 bp, Artificial sequence
  SiRNA target sequence
aaatgcaccaatttgtgcagga

SEQ ID NO: 25615 - DNA, 22 bp, Artificial sequence
  SiRNA target sequence
aatgcaccaatttgtgcaggag

SEQ ID NO: 25616 - DNA, 22 bp, Artificial sequence
  SiRNA target sequence
atgcaccaatttgtgcaggaga

SEQ ID NO: 25617 - DNA, 22 bp, Artificial sequence
  SiRNA target sequence
tgcaccaatttgtgcaggagaa

SEQ ID NO: 25618 - DNA, 22 bp, Artificial sequence
  SiRNA target sequence
gcaccaatttgtgcaggagaat

SEQ ID NO: 25619 - DNA, 22 bp, Artificial sequence
  SiRNA target sequence
caccaatttgtgcaggagaata

SEQ ID NO: 25620 - DNA, 22 bp, Artificial sequence
  SiRNA target sequence
accaatttgtgcaggagaatat

SEQ ID NO: 25621 - DNA, 22 bp, Artificial sequence
  SiRNA target sequence
ccaatttgtgcaggagaatatt

SEQ ID NO: 25622 - DNA, 22 bp, Artificial sequence
  SiRNA target sequence
caatttgtgcaggagaatattt

SEQ ID NO: 25623 - DNA, 22 bp, Artificial sequence
  SiRNA target sequence
aatttgtgcaggagaatatttc

SEQ ID NO: 25624 - DNA, 22 bp, Artificial sequence
  SiRNA target sequence
atttgtgcaggagaatatttct

SEQ ID NO: 25625 - DNA, 22 bp, Artificial sequence
  SiRNA target sequence
tttgtgcaggagaatatttctt

SEQ ID NO: 25626 - DNA, 22 bp, Artificial sequence
  SiRNA target sequence
ttgtgcaggagaatatttctta

SEQ ID NO: 25627 - DNA, 22 bp, Artificial sequence
  SiRNA target sequence
tgtgcaggagaatatttcttat

SEQ ID NO: 25628 - DNA, 22 bp, Artificial sequence
  SiRNA target sequence
gtgcaggagaatatttcttatt

SEQ ID NO: 25629 - DNA, 22 bp, Artificial sequence
  SiRNA target sequence
tgcaggagaatatttcttattg

SEQ ID NO: 25630 - DNA, 22 bp, Artificial sequence
  SiRNA target sequence
gcaggagaatatttcttattgt

SEQ ID NO: 25631 - DNA, 22 bp, Artificial sequence
  SiRNA target sequence
caggagaatatttcttattgtc

SEQ ID NO: 25632 - DNA, 22 bp, Artificial sequence
  SiRNA target sequence
aggagaatatttcttattgtca

SEQ ID NO: 25633 - DNA, 22 bp, Artificial sequence
  SiRNA target sequence
ggagaatatttcttattgtcaa

SEQ ID NO: 25634 - DNA, 22 bp, Artificial sequence
  SiRNA target sequence
gagaatatttcttattgtcaat

SEQ ID NO: 25635 - DNA, 22 bp, Artificial sequence
  SiRNA target sequence
agaatatttcttattgtcaatt

SEQ ID NO: 25636 - DNA, 22 bp, Artificial sequence
  SiRNA target sequence
gaatatttcttattgtcaattt

SEQ ID NO: 25637 - DNA, 22 bp, Artificial sequence
  SiRNA target sequence
aatatttcttattgtcaatttt

SEQ ID NO: 25638 - DNA, 22 bp, Artificial sequence
  SiRNA target sequence
atatttcttattgtcaattttt

SEQ ID NO: 25639 - DNA, 22 bp, Artificial sequence
  SiRNA target sequence
tatttcttattgtcaattttta

SEQ ID NO: 25640 - DNA, 22 bp, Artificial sequence
  SiRNA target sequence
atttcttattgtcaatttttat

SEQ ID NO: 25641 - DNA, 22 bp, Artificial sequence
  SiRNA target sequence
tttcttattgtcaatttttatc

SEQ ID NO: 25642 - DNA, 22 bp, Artificial sequence
  SiRNA target sequence
ttcttattgtcaatttttatcc

SEQ ID NO: 25643 - DNA, 22 bp, Artificial sequence
  SiRNA target sequence
tcttattgtcaatttttatcca

SEQ ID NO: 25644 - DNA, 22 bp, Artificial sequence
  SiRNA target sequence
cttattgtcaatttttatccaa

SEQ ID NO: 25645 - DNA, 22 bp, Artificial sequence
  SiRNA target sequence
ttattgtcaatttttatccaaa

SEQ ID NO: 25646 - DNA, 22 bp, Artificial sequence
  SiRNA target sequence
tattgtcaatttttatccaaat

SEQ ID NO: 25647 - DNA, 22 bp, Artificial sequence
  SiRNA target sequence
attgtcaatttttatccaaata

SEQ ID NO: 25648 - DNA, 22 bp, Artificial sequence
  SiRNA target sequence
ttgtcaatttttatccaaatat

SEQ ID NO: 25649 - DNA, 22 bp, Artificial sequence
  SiRNA target sequence
tgtcaatttttatccaaatatc

SEQ ID NO: 25650 - DNA, 22 bp, Artificial sequence
  SiRNA target sequence
gtcaatttttatccaaatatcg

SEQ ID NO: 25651 - DNA, 22 bp, Artificial sequence
  SiRNA target sequence
tcaatttttatccaaatatcgc

SEQ ID NO: 25652 - DNA, 22 bp, Artificial sequence
  SiRNA target sequence
caatttttatccaaatatcgcc

SEQ ID NO: 25653 - DNA, 22 bp, Artificial sequence
  SiRNA target sequence
aatttttatccaaatatcgccg

SEQ ID NO: 25654 - DNA, 22 bp, Artificial sequence
  SiRNA target sequence
atttttatccaaatatcgccgt

SEQ ID NO: 25655 - DNA, 22 bp, Artificial sequence
  SiRNA target sequence
tttttatccaaatatcgccgtt

SEQ ID NO: 25656 - DNA, 22 bp, Artificial sequence
  SiRNA target sequence
ttttatccaaatatcgccgtta

SEQ ID NO: 25657 - DNA, 22 bp, Artificial sequence
  SiRNA target sequence
tttatccaaatatcgccgttac

SEQ ID NO: 25658 - DNA, 22 bp, Artificial sequence
  SiRNA target sequence
ttatccaaatatcgccgttaca

SEQ ID NO: 25659 - DNA, 22 bp, Artificial sequence
  SiRNA target sequence
tatccaaatatcgccgttacaa

SEQ ID NO: 25660 - DNA, 22 bp, Artificial sequence
  SiRNA target sequence
atccaaatatcgccgttacaat

SEQ ID NO: 25661 - DNA, 22 bp, Artificial sequence
  SiRNA target sequence
tccaaatatcgccgttacaatg

SEQ ID NO: 25662 - DNA, 22 bp, Artificial sequence
  SiRNA target sequence
ccaaatatcgccgttacaatgc

SEQ ID NO: 25663 - DNA, 22 bp, Artificial sequence
  SiRNA target sequence
caaatatcgccgttacaatgct

SEQ ID NO: 25664 - DNA, 22 bp, Artificial sequence
  SiRNA target sequence
aaatatcgccgttacaatgctt

SEQ ID NO: 25665 - DNA, 22 bp, Artificial sequence
  SiRNA target sequence
aatatcgccgttacaatgctta

SEQ ID NO: 25666 - DNA, 22 bp, Artificial sequence
  SiRNA target sequence
atatcgccgttacaatgcttag

SEQ ID NO: 25667 - DNA, 22 bp, Artificial sequence
  SiRNA target sequence
tatcgccgttacaatgcttagt

SEQ ID NO: 25668 - DNA, 22 bp, Artificial sequence
  SiRNA target sequence
atcgccgttacaatgcttagta

SEQ ID NO: 25669 - DNA, 22 bp, Artificial sequence
  SiRNA target sequence
tcgccgttacaatgcttagtag

SEQ ID NO: 25670 - DNA, 22 bp, Artificial sequence
  SiRNA target sequence
cgccgttacaatgcttagtagt

SEQ ID NO: 25671 - DNA, 22 bp, Artificial sequence
  SiRNA target sequence
gccgttacaatgcttagtagtg

SEQ ID NO: 25672 - DNA, 22 bp, Artificial sequence
  SiRNA target sequence
ccgttacaatgcttagtagtgt

SEQ ID NO: 25673 - DNA, 22 bp, Artificial sequence
  SiRNA target sequence
cgttacaatgcttagtagtgtc

SEQ ID NO: 25674 - DNA, 22 bp, Artificial sequence
  SiRNA target sequence
gttacaatgcttagtagtgtca

SEQ ID NO: 25675 - DNA, 22 bp, Artificial sequence
  SiRNA target sequence
ttacaatgcttagtagtgtcat

SEQ ID NO: 25676 - DNA, 22 bp, Artificial sequence
  SiRNA target sequence
tacaatgcttagtagtgtcata

SEQ ID NO: 25677 - DNA, 22 bp, Artificial sequence
  SiRNA target sequence
acaatgcttagtagtgtcatat

SEQ ID NO: 25678 - DNA, 22 bp, Artificial sequence
  SiRNA target sequence
caatgcttagtagtgtcatatg

SEQ ID NO: 25679 - DNA, 22 bp, Artificial sequence
  SiRNA target sequence
aatgcttagtagtgtcatatgg

SEQ ID NO: 25680 - DNA, 22 bp, Artificial sequence
  SiRNA target sequence
atgcttagtagtgtcatatggt

SEQ ID NO: 25681 - DNA, 22 bp, Artificial sequence
  SiRNA target sequence
tgcttagtagtgtcatatggta

SEQ ID NO: 25682 - DNA, 22 bp, Artificial sequence
  SiRNA target sequence
gcttagtagtgtcatatggtaa

SEQ ID NO: 25683 - DNA, 22 bp, Artificial sequence
  SiRNA target sequence
cttagtagtgtcatatggtaag

SEQ ID NO: 25684 - DNA, 22 bp, Artificial sequence
  SiRNA target sequence
ttagtagtgtcatatggtaagc

SEQ ID NO: 25685 - DNA, 22 bp, Artificial sequence
  SiRNA target sequence
tagtagtgtcatatggtaagct

SEQ ID NO: 25686 - DNA, 22 bp, Artificial sequence
  SiRNA target sequence
agtagtgtcatatggtaagctt

SEQ ID NO: 25687 - DNA, 22 bp, Artificial sequence
  SiRNA target sequence
gtagtgtcatatggtaagcttt

SEQ ID NO: 25688 - DNA, 22 bp, Artificial sequence
  SiRNA target sequence
tagtgtcatatggtaagctttt

SEQ ID NO: 25689 - DNA, 22 bp, Artificial sequence
  SiRNA target sequence
agtgtcatatggtaagcttttt

SEQ ID NO: 25690 - DNA, 22 bp, Artificial sequence
  SiRNA target sequence
gtgtcatatggtaagcttttta

SEQ ID NO: 25691 - DNA, 22 bp, Artificial sequence
  SiRNA target sequence
tgtcatatggtaagctttttaa

SEQ ID NO: 25692 - DNA, 22 bp, Artificial sequence
  SiRNA target sequence
gtcatatggtaagctttttaaa

SEQ ID NO: 25693 - DNA, 22 bp, Artificial sequence
  SiRNA target sequence
tcatatggtaagctttttaaat

SEQ ID NO: 25694 - DNA, 22 bp, Artificial sequence
  SiRNA target sequence
catatggtaagctttttaaata

SEQ ID NO: 25695 - DNA, 22 bp, Artificial sequence
  SiRNA target sequence
atatggtaagctttttaaataa

SEQ ID NO: 25696 - DNA, 22 bp, Artificial sequence
  SiRNA target sequence
tatggtaagctttttaaataat

SEQ ID NO: 25697 - DNA, 22 bp, Artificial sequence
  SiRNA target sequence
atggtaagctttttaaataatc

SEQ ID NO: 25698 - DNA, 22 bp, Artificial sequence
  SiRNA target sequence
tggtaagctttttaaataatct

SEQ ID NO: 25699 - DNA, 22 bp, Artificial sequence
  SiRNA target sequence
ggtaagctttttaaataatctt

SEQ ID NO: 25700 - DNA, 22 bp, Artificial sequence
  SiRNA target sequence
gtaagctttttaaataatcttt

SEQ ID NO: 25701 - DNA, 22 bp, Artificial sequence
  SiRNA target sequence
taagctttttaaataatctttt

SEQ ID NO: 25702 - DNA, 22 bp, Artificial sequence
  SiRNA target sequence
aagctttttaaataatctttta

SEQ ID NO: 25703 - DNA, 22 bp, Artificial sequence
  SiRNA target sequence
agctttttaaataatcttttaa

SEQ ID NO: 25704 - DNA, 22 bp, Artificial sequence
  SiRNA target sequence
gctttttaaataatcttttaat

SEQ ID NO: 25705 - DNA, 22 bp, Artificial sequence
  SiRNA target sequence
ctttttaaataatcttttaatt

SEQ ID NO: 25706 - DNA, 22 bp, Artificial sequence
  SiRNA target sequence
tttttaaataatcttttaattc

SEQ ID NO: 25707 - DNA, 22 bp, Artificial sequence
  SiRNA target sequence
ttttaaataatcttttaattct

SEQ ID NO: 25708 - DNA, 22 bp, Artificial sequence
  SiRNA target sequence
tttaaataatcttttaattcta

SEQ ID NO: 25709 - DNA, 22 bp, Artificial sequence
  SiRNA target sequence
ttaaataatcttttaattctac

SEQ ID NO: 25710 - DNA, 22 bp, Artificial sequence
  SiRNA target sequence
taaataatcttttaattctaca

SEQ ID NO: 25711 - DNA, 22 bp, Artificial sequence
  SiRNA target sequence
aaataatcttttaattctacat

SEQ ID NO: 25712 - DNA, 22 bp, Artificial sequence
  SiRNA target sequence
aataatcttttaattctacatc

SEQ ID NO: 25713 - DNA, 22 bp, Artificial sequence
  SiRNA target sequence
ataatcttttaattctacatca

SEQ ID NO: 25714 - DNA, 22 bp, Artificial sequence
  SiRNA target sequence
taatcttttaattctacatcat

SEQ ID NO: 25715 - DNA, 22 bp, Artificial sequence
  SiRNA target sequence
aatcttttaattctacatcatc

SEQ ID NO: 25716 - DNA, 22 bp, Artificial sequence
  SiRNA target sequence
atcttttaattctacatcatca

SEQ ID NO: 25717 - DNA, 22 bp, Artificial sequence
  SiRNA target sequence
tcttttaattctacatcatcaa

SEQ ID NO: 25718 - DNA, 22 bp, Artificial sequence
  SiRNA target sequence
cttttaattctacatcatcaaa

SEQ ID NO: 25719 - DNA, 22 bp, Artificial sequence
  SiRNA target sequence
ttttaattctacatcatcaaat

SEQ ID NO: 25720 - DNA, 22 bp, Artificial sequence
  SiRNA target sequence
tttaattctacatcatcaaatt

SEQ ID NO: 25721 - DNA, 22 bp, Artificial sequence
  SiRNA target sequence
ttaattctacatcatcaaattt

SEQ ID NO: 25722 - DNA, 22 bp, Artificial sequence
  SiRNA target sequence
taattctacatcatcaaatttt

SEQ ID NO: 25723 - DNA, 22 bp, Artificial sequence
  SiRNA target sequence
aattctacatcatcaaattttc

SEQ ID NO: 25724 - DNA, 22 bp, Artificial sequence
  SiRNA target sequence
attctacatcatcaaattttcg

SEQ ID NO: 25725 - DNA, 22 bp, Artificial sequence
  SiRNA target sequence
ttctacatcatcaaattttcgt

SEQ ID NO: 25726 - DNA, 22 bp, Artificial sequence
  SiRNA target sequence
tctacatcatcaaattttcgtc

SEQ ID NO: 25727 - DNA, 22 bp, Artificial sequence
  SiRNA target sequence
ctacatcatcaaattttcgtcc

SEQ ID NO: 25728 - DNA, 22 bp, Artificial sequence
  SiRNA target sequence
tacatcatcaaattttcgtccc

SEQ ID NO: 25729 - DNA, 22 bp, Artificial sequence
  SiRNA target sequence
acatcatcaaattttcgtccca

SEQ ID NO: 25730 - DNA, 22 bp, Artificial sequence
  SiRNA target sequence
catcatcaaattttcgtcccag

SEQ ID NO: 25731 - DNA, 22 bp, Artificial sequence
  SiRNA target sequence
atcatcaaattttcgtcccagc

SEQ ID NO: 25732 - DNA, 22 bp, Artificial sequence
  SiRNA target sequence
tcatcaaattttcgtcccagca

SEQ ID NO: 25733 - DNA, 22 bp, Artificial sequence
  SiRNA target sequence
catcaaattttcgtcccagcaa

SEQ ID NO: 25734 - DNA, 22 bp, Artificial sequence
  SiRNA target sequence
atcaaattttcgtcccagcaat

SEQ ID NO: 25735 - DNA, 22 bp, Artificial sequence
  SiRNA target sequence
tcaaattttcgtcccagcaatc

SEQ ID NO: 25736 - DNA, 22 bp, Artificial sequence
  SiRNA target sequence
caaattttcgtcccagcaatct

SEQ ID NO: 25737 - DNA, 22 bp, Artificial sequence
  SiRNA target sequence
aaattttcgtcccagcaatctc

SEQ ID NO: 25738 - DNA, 22 bp, Artificial sequence
  SiRNA target sequence
aattttcgtcccagcaatctct

SEQ ID NO: 25739 - DNA, 22 bp, Artificial sequence
  SiRNA target sequence
attttcgtcccagcaatctctt

SEQ ID NO: 25740 - DNA, 22 bp, Artificial sequence
  SiRNA target sequence
ttttcgtcccagcaatctctta

SEQ ID NO: 25741 - DNA, 22 bp, Artificial sequence
  SiRNA target sequence
tttcgtcccagcaatctcttag

SEQ ID NO: 25742 - DNA, 22 bp, Artificial sequence
  SiRNA target sequence
ttcgtcccagcaatctcttaga

SEQ ID NO: 25743 - DNA, 22 bp, Artificial sequence
  SiRNA target sequence
tcgtcccagcaatctcttagac

SEQ ID NO: 25744 - DNA, 22 bp, Artificial sequence
  SiRNA target sequence
cgtcccagcaatctcttagacg

SEQ ID NO: 25745 - DNA, 22 bp, Artificial sequence
  SiRNA target sequence
gtcccagcaatctcttagacgc

SEQ ID NO: 25746 - DNA, 22 bp, Artificial sequence
  SiRNA target sequence
tcccagcaatctcttagacgca

SEQ ID NO: 25747 - DNA, 22 bp, Artificial sequence
  SiRNA target sequence
cccagcaatctcttagacgcaa

SEQ ID NO: 25748 - DNA, 22 bp, Artificial sequence
  SiRNA target sequence
ccagcaatctcttagacgcaaa

SEQ ID NO: 25749 - DNA, 22 bp, Artificial sequence
  SiRNA target sequence
cagcaatctcttagacgcaaaa

SEQ ID NO: 25750 - DNA, 22 bp, Artificial sequence
  SiRNA target sequence
agcaatctcttagacgcaaaaa

SEQ ID NO: 25751 - DNA, 22 bp, Artificial sequence
  SiRNA target sequence
gcaatctcttagacgcaaaaat

SEQ ID NO: 25752 - DNA, 22 bp, Artificial sequence
  SiRNA target sequence
caatctcttagacgcaaaaatc

SEQ ID NO: 25753 - DNA, 22 bp, Artificial sequence
  SiRNA target sequence
aatctcttagacgcaaaaatcg

SEQ ID NO: 25754 - DNA, 22 bp, Artificial sequence
  SiRNA target sequence
atctcttagacgcaaaaatcgt

SEQ ID NO: 25755 - DNA, 22 bp, Artificial sequence
  SiRNA target sequence
tctcttagacgcaaaaatcgta

SEQ ID NO: 25756 - DNA, 22 bp, Artificial sequence
  SiRNA target sequence
ctcttagacgcaaaaatcgtat

SEQ ID NO: 25757 - DNA, 22 bp, Artificial sequence
  SiRNA target sequence
tcttagacgcaaaaatcgtatt

SEQ ID NO: 25758 - DNA, 22 bp, Artificial sequence
  SiRNA target sequence
cttagacgcaaaaatcgtattc

SEQ ID NO: 25759 - DNA, 22 bp, Artificial sequence
  SiRNA target sequence
ttagacgcaaaaatcgtattct

SEQ ID NO: 25760 - DNA, 22 bp, Artificial sequence
  SiRNA target sequence
tagacgcaaaaatcgtattctt

SEQ ID NO: 25761 - DNA, 22 bp, Artificial sequence
  SiRNA target sequence
agacgcaaaaatcgtattcttg

SEQ ID NO: 25762 - DNA, 22 bp, Artificial sequence
  SiRNA target sequence
gacgcaaaaatcgtattcttgg

SEQ ID NO: 25763 - DNA, 22 bp, Artificial sequence
  SiRNA target sequence
acgcaaaaatcgtattcttggg

SEQ ID NO: 25764 - DNA, 22 bp, Artificial sequence
  SiRNA target sequence
cgcaaaaatcgtattcttggga

SEQ ID NO: 25765 - DNA, 22 bp, Artificial sequence
  SiRNA target sequence
gcaaaaatcgtattcttgggat

SEQ ID NO: 25766 - DNA, 22 bp, Artificial sequence
  SiRNA target sequence
caaaaatcgtattcttgggatg

SEQ ID NO: 25767 - DNA, 22 bp, Artificial sequence
  SiRNA target sequence
aaaaatcgtattcttgggatgt

SEQ ID NO: 25768 - DNA, 22 bp, Artificial sequence
  SiRNA target sequence
aaaatcgtattcttgggatgta

SEQ ID NO: 25769 - DNA, 22 bp, Artificial sequence
  SiRNA target sequence
aaatcgtattcttgggatgtaa

SEQ ID NO: 25770 - DNA, 22 bp, Artificial sequence
  SiRNA target sequence
aatcgtattcttgggatgtaat

SEQ ID NO: 25771 - DNA, 22 bp, Artificial sequence
  SiRNA target sequence
atcgtattcttgggatgtaata

SEQ ID NO: 25772 - DNA, 22 bp, Artificial sequence
  SiRNA target sequence
tcgtattcttgggatgtaataa

SEQ ID NO: 25773 - DNA, 22 bp, Artificial sequence
  SiRNA target sequence
cgtattcttgggatgtaataac

SEQ ID NO: 25774 - DNA, 22 bp, Artificial sequence
  SiRNA target sequence
gtattcttgggatgtaataaca

SEQ ID NO: 25775 - DNA, 22 bp, Artificial sequence
  SiRNA target sequence
tattcttgggatgtaataacaa

SEQ ID NO: 25776 - DNA, 22 bp, Artificial sequence
  SiRNA target sequence
attcttgggatgtaataacaag

SEQ ID NO: 25777 - DNA, 22 bp, Artificial sequence
  SiRNA target sequence
ttcttgggatgtaataacaagt

SEQ ID NO: 25778 - DNA, 22 bp, Artificial sequence
  SiRNA target sequence
tcttgggatgtaataacaagtt

SEQ ID NO: 25779 - DNA, 22 bp, Artificial sequence
  SiRNA target sequence
cttgggatgtaataacaagtta

SEQ ID NO: 25780 - DNA, 22 bp, Artificial sequence
  SiRNA target sequence
ttgggatgtaataacaagttag

SEQ ID NO: 25781 - DNA, 22 bp, Artificial sequence
  SiRNA target sequence
tgggatgtaataacaagttaga

SEQ ID NO: 25782 - DNA, 22 bp, Artificial sequence
  SiRNA target sequence
gggatgtaataacaagttagac

SEQ ID NO: 25783 - DNA, 22 bp, Artificial sequence
  SiRNA target sequence
ggatgtaataacaagttagact

SEQ ID NO: 25784 - DNA, 22 bp, Artificial sequence
  SiRNA target sequence
gatgtaataacaagttagactt

SEQ ID NO: 25785 - DNA, 22 bp, Artificial sequence
  SiRNA target sequence
atgtaataacaagttagactta

SEQ ID NO: 25786 - DNA, 22 bp, Artificial sequence
  SiRNA target sequence
tgtaataacaagttagacttag

SEQ ID NO: 25787 - DNA, 22 bp, Artificial sequence
  SiRNA target sequence
gtaataacaagttagacttagc

SEQ ID NO: 25788 - DNA, 22 bp, Artificial sequence
  SiRNA target sequence
taataacaagttagacttagct

SEQ ID NO: 25789 - DNA, 22 bp, Artificial sequence
  SiRNA target sequence
aataacaagttagacttagctt

SEQ ID NO: 25790 - DNA, 22 bp, Artificial sequence
  SiRNA target sequence
ataacaagttagacttagcttg

SEQ ID NO: 25791 - DNA, 22 bp, Artificial sequence
  SiRNA target sequence
taacaagttagacttagcttgc

SEQ ID NO: 25792 - DNA, 22 bp, Artificial sequence
  SiRNA target sequence
aacaagttagacttagcttgct

SEQ ID NO: 25793 - DNA, 22 bp, Artificial sequence
  SiRNA target sequence
acaagttagacttagcttgctc

SEQ ID NO: 25794 - DNA, 22 bp, Artificial sequence
  SiRNA target sequence
caagttagacttagcttgctca

SEQ ID NO: 25795 - DNA, 22 bp, Artificial sequence
  SiRNA target sequence
aagttagacttagcttgctcac

SEQ ID NO: 25796 - DNA, 22 bp, Artificial sequence
  SiRNA target sequence
agttagacttagcttgctcacc

SEQ ID NO: 25797 - DNA, 22 bp, Artificial sequence
  SiRNA target sequence
gttagacttagcttgctcacct

SEQ ID NO: 25798 - DNA, 22 bp, Artificial sequence
  SiRNA target sequence
ttagacttagcttgctcacctg

SEQ ID NO: 25799 - DNA, 22 bp, Artificial sequence
  SiRNA target sequence
tagacttagcttgctcacctgt

SEQ ID NO: 25800 - DNA, 22 bp, Artificial sequence
  SiRNA target sequence
agacttagcttgctcacctgtt

SEQ ID NO: 25801 - DNA, 22 bp, Artificial sequence
  SiRNA target sequence
gacttagcttgctcacctgtta

SEQ ID NO: 25802 - DNA, 22 bp, Artificial sequence
  SiRNA target sequence
acttagcttgctcacctgttaa

SEQ ID NO: 25803 - DNA, 22 bp, Artificial sequence
  SiRNA target sequence
cttagcttgctcacctgttaaa

SEQ ID NO: 25804 - DNA, 22 bp, Artificial sequence
  SiRNA target sequence
ttagcttgctcacctgttaaaa

SEQ ID NO: 25805 - DNA, 22 bp, Artificial sequence
  SiRNA target sequence
tagcttgctcacctgttaaaat

SEQ ID NO: 25806 - DNA, 22 bp, Artificial sequence
  SiRNA target sequence
agcttgctcacctgttaaaatt

SEQ ID NO: 25807 - DNA, 22 bp, Artificial sequence
  SiRNA target sequence
gcttgctcacctgttaaaattt

SEQ ID NO: 25808 - DNA, 22 bp, Artificial sequence
  SiRNA target sequence
cttgctcacctgttaaaatttt

SEQ ID NO: 25809 - DNA, 22 bp, Artificial sequence
  SiRNA target sequence
ttgctcacctgttaaaatttta

SEQ ID NO: 25810 - DNA, 22 bp, Artificial sequence
  SiRNA target sequence
tgctcacctgttaaaattttat

SEQ ID NO: 25811 - DNA, 22 bp, Artificial sequence
  SiRNA target sequence
gctcacctgttaaaattttatc

SEQ ID NO: 25812 - DNA, 22 bp, Artificial sequence
  SiRNA target sequence
ctcacctgttaaaattttatct

SEQ ID NO: 25813 - DNA, 22 bp, Artificial sequence
  SiRNA target sequence
tcacctgttaaaattttatctt

SEQ ID NO: 25814 - DNA, 22 bp, Artificial sequence
  SiRNA target sequence
cacctgttaaaattttatcttt

SEQ ID NO: 25815 - DNA, 22 bp, Artificial sequence
  SiRNA target sequence
acctgttaaaattttatcttta

SEQ ID NO: 25816 - DNA, 22 bp, Artificial sequence
  SiRNA target sequence
cctgttaaaattttatctttaa

SEQ ID NO: 25817 - DNA, 22 bp, Artificial sequence
  SiRNA target sequence
ctgttaaaattttatctttaaa

SEQ ID NO: 25818 - DNA, 22 bp, Artificial sequence
  SiRNA target sequence
tgttaaaattttatctttaaaa

SEQ ID NO: 25819 - DNA, 22 bp, Artificial sequence
  SiRNA target sequence
gttaaaattttatctttaaaaa

SEQ ID NO: 25820 - DNA, 22 bp, Artificial sequence
  SiRNA target sequence
ttaaaattttatctttaaaaat

SEQ ID NO: 25821 - DNA, 22 bp, Artificial sequence
  SiRNA target sequence
taaaattttatctttaaaaatt

SEQ ID NO: 25822 - DNA, 22 bp, Artificial sequence
  SiRNA target sequence
aaaattttatctttaaaaattg

SEQ ID NO: 25823 - DNA, 22 bp, Artificial sequence
  SiRNA target sequence
aaattttatctttaaaaattga

SEQ ID NO: 25824 - DNA, 22 bp, Artificial sequence
  SiRNA target sequence
aattttatctttaaaaattgat

SEQ ID NO: 25825 - DNA, 22 bp, Artificial sequence
  SiRNA target sequence
attttatctttaaaaattgata

SEQ ID NO: 25826 - DNA, 22 bp, Artificial sequence
  SiRNA target sequence
ttttatctttaaaaattgatac

SEQ ID NO: 25827 - DNA, 22 bp, Artificial sequence
  SiRNA target sequence
tttatctttaaaaattgatacc

SEQ ID NO: 25828 - DNA, 22 bp, Artificial sequence
  SiRNA target sequence
ttatctttaaaaattgatacca

SEQ ID NO: 25829 - DNA, 22 bp, Artificial sequence
  SiRNA target sequence
tatctttaaaaattgataccac

SEQ ID NO: 25830 - DNA, 22 bp, Artificial sequence
  SiRNA target sequence
atctttaaaaattgataccacc

SEQ ID NO: 25831 - DNA, 22 bp, Artificial sequence
  SiRNA target sequence
tctttaaaaattgataccaccg

SEQ ID NO: 25832 - DNA, 22 bp, Artificial sequence
  SiRNA target sequence
ctttaaaaattgataccaccga

SEQ ID NO: 25833 - DNA, 22 bp, Artificial sequence
  SiRNA target sequence
tttaaaaattgataccaccgat

SEQ ID NO: 25834 - DNA, 22 bp, Artificial sequence
  SiRNA target sequence
ttaaaaattgataccaccgatg

SEQ ID NO: 25835 - DNA, 22 bp, Artificial sequence
  SiRNA target sequence
taaaaattgataccaccgatgg

SEQ ID NO: 25836 - DNA, 22 bp, Artificial sequence
  SiRNA target sequence
aaaaattgataccaccgatggt

SEQ ID NO: 25837 - DNA, 22 bp, Artificial sequence
  SiRNA target sequence
aaaattgataccaccgatggtg

SEQ ID NO: 25838 - DNA, 22 bp, Artificial sequence
  SiRNA target sequence
aaattgataccaccgatggtgt

SEQ ID NO: 25839 - DNA, 22 bp, Artificial sequence
  SiRNA target sequence
aattgataccaccgatggtgta

SEQ ID NO: 25840 - DNA, 22 bp, Artificial sequence
  SiRNA target sequence
attgataccaccgatggtgtag

SEQ ID NO: 25841 - DNA, 22 bp, Artificial sequence
  SiRNA target sequence
ttgataccaccgatggtgtagt

SEQ ID NO: 25842 - DNA, 22 bp, Artificial sequence
  SiRNA target sequence
tgataccaccgatggtgtagtt

SEQ ID NO: 25843 - DNA, 22 bp, Artificial sequence
  SiRNA target sequence
gataccaccgatggtgtagttc

SEQ ID NO: 25844 - DNA, 22 bp, Artificial sequence
  SiRNA target sequence
ataccaccgatggtgtagttct

SEQ ID NO: 25845 - DNA, 22 bp, Artificial sequence
  SiRNA target sequence
taccaccgatggtgtagttcta

SEQ ID NO: 25846 - DNA, 22 bp, Artificial sequence
  SiRNA target sequence
accaccgatggtgtagttctac

SEQ ID NO: 25847 - DNA, 22 bp, Artificial sequence
  SiRNA target sequence
ccaccgatggtgtagttctacc

SEQ ID NO: 25848 - DNA, 22 bp, Artificial sequence
  SiRNA target sequence
caccgatggtgtagttctacca

SEQ ID NO: 25849 - DNA, 22 bp, Artificial sequence
  SiRNA target sequence
accgatggtgtagttctaccac

SEQ ID NO: 25850 - DNA, 22 bp, Artificial sequence
  SiRNA target sequence
ccgatggtgtagttctaccacc

SEQ ID NO: 25851 - DNA, 22 bp, Artificial sequence
  SiRNA target sequence
cgatggtgtagttctaccacct

SEQ ID NO: 25852 - DNA, 22 bp, Artificial sequence
  SiRNA target sequence
gatggtgtagttctaccacctt

SEQ ID NO: 25853 - DNA, 22 bp, Artificial sequence
  SiRNA target sequence
atggtgtagttctaccaccttc

SEQ ID NO: 25854 - DNA, 22 bp, Artificial sequence
  SiRNA target sequence
tggtgtagttctaccaccttct

SEQ ID NO: 25855 - DNA, 22 bp, Artificial sequence
  SiRNA target sequence
ggtgtagttctaccaccttctt

SEQ ID NO: 25856 - DNA, 22 bp, Artificial sequence
  SiRNA target sequence
gtgtagttctaccaccttcttc

SEQ ID NO: 25857 - DNA, 22 bp, Artificial sequence
  SiRNA target sequence
tgtagttctaccaccttcttcg

SEQ ID NO: 25858 - DNA, 22 bp, Artificial sequence
  SiRNA target sequence
gtagttctaccaccttcttcgt

SEQ ID NO: 25859 - DNA, 22 bp, Artificial sequence
  SiRNA target sequence
tagttctaccaccttcttcgtt

SEQ ID NO: 25860 - DNA, 22 bp, Artificial sequence
  SiRNA target sequence
agttctaccaccttcttcgttt

SEQ ID NO: 25861 - DNA, 22 bp, Artificial sequence
  SiRNA target sequence
gttctaccaccttcttcgtttt

SEQ ID NO: 25862 - DNA, 22 bp, Artificial sequence
  SiRNA target sequence
ttctaccaccttcttcgttttc

SEQ ID NO: 25863 - DNA, 22 bp, Artificial sequence
  SiRNA target sequence
tctaccaccttcttcgttttca

SEQ ID NO: 25864 - DNA, 22 bp, Artificial sequence
  SiRNA target sequence
ctaccaccttcttcgttttcaa

SEQ ID NO: 25865 - DNA, 22 bp, Artificial sequence
  SiRNA target sequence
taccaccttcttcgttttcaat

SEQ ID NO: 25866 - DNA, 22 bp, Artificial sequence
  SiRNA target sequence
accaccttcttcgttttcaata

SEQ ID NO: 25867 - DNA, 22 bp, Artificial sequence
  SiRNA target sequence
ccaccttcttcgttttcaataa

SEQ ID NO: 25868 - DNA, 22 bp, Artificial sequence
  SiRNA target sequence
caccttcttcgttttcaataat

SEQ ID NO: 25869 - DNA, 22 bp, Artificial sequence
  SiRNA target sequence
accttcttcgttttcaataatt

SEQ ID NO: 25870 - DNA, 22 bp, Artificial sequence
  SiRNA target sequence
ccttcttcgttttcaataattt

SEQ ID NO: 25871 - DNA, 22 bp, Artificial sequence
  SiRNA target sequence
cttcttcgttttcaataatttg

SEQ ID NO: 25872 - DNA, 22 bp, Artificial sequence
  SiRNA target sequence
ttcttcgttttcaataatttgt

SEQ ID NO: 25873 - DNA, 22 bp, Artificial sequence
  SiRNA target sequence
tcttcgttttcaataatttgtg

SEQ ID NO: 25874 - DNA, 22 bp, Artificial sequence
  SiRNA target sequence
cttcgttttcaataatttgtgg

SEQ ID NO: 25875 - DNA, 22 bp, Artificial sequence
  SiRNA target sequence
ttcgttttcaataatttgtggg

SEQ ID NO: 25876 - DNA, 22 bp, Artificial sequence
  SiRNA target sequence
tcgttttcaataatttgtggga

SEQ ID NO: 25877 - DNA, 22 bp, Artificial sequence
  SiRNA target sequence
cgttttcaataatttgtgggat

SEQ ID NO: 25878 - DNA, 22 bp, Artificial sequence
  SiRNA target sequence
gttttcaataatttgtgggata

SEQ ID NO: 25879 - DNA, 22 bp, Artificial sequence
  SiRNA target sequence
ttttcaataatttgtgggatat

SEQ ID NO: 25880 - DNA, 22 bp, Artificial sequence
  SiRNA target sequence
tttcaataatttgtgggatatt

SEQ ID NO: 25881 - DNA, 22 bp, Artificial sequence
  SiRNA target sequence
ttcaataatttgtgggatattg

SEQ ID NO: 25882 - DNA, 22 bp, Artificial sequence
  SiRNA target sequence
tcaataatttgtgggatattgt

SEQ ID NO: 25883 - DNA, 22 bp, Artificial sequence
  SiRNA target sequence
caataatttgtgggatattgtt

SEQ ID NO: 25884 - DNA, 22 bp, Artificial sequence
  SiRNA target sequence
aataatttgtgggatattgtta

SEQ ID NO: 25885 - DNA, 22 bp, Artificial sequence
  SiRNA target sequence
ataatttgtgggatattgttat

SEQ ID NO: 25886 - DNA, 22 bp, Artificial sequence
  SiRNA target sequence
taatttgtgggatattgttatg

SEQ ID NO: 25887 - DNA, 22 bp, Artificial sequence
  SiRNA target sequence
aatttgtgggatattgttatgt

SEQ ID NO: 25888 - DNA, 22 bp, Artificial sequence
  SiRNA target sequence
atttgtgggatattgttatgta

SEQ ID NO: 25889 - DNA, 22 bp, Artificial sequence
  SiRNA target sequence
tttgtgggatattgttatgtat

SEQ ID NO: 25890 - DNA, 22 bp, Artificial sequence
  SiRNA target sequence
ttgtgggatattgttatgtata

SEQ ID NO: 25891 - DNA, 22 bp, Artificial sequence
  SiRNA target sequence
tgtgggatattgttatgtataa

SEQ ID NO: 25892 - DNA, 22 bp, Artificial sequence
  SiRNA target sequence
gtgggatattgttatgtataag

SEQ ID NO: 25893 - DNA, 22 bp, Artificial sequence
  SiRNA target sequence
tgggatattgttatgtataaga

SEQ ID NO: 25894 - DNA, 22 bp, Artificial sequence
  SiRNA target sequence
gggatattgttatgtataagag

SEQ ID NO: 25895 - DNA, 22 bp, Artificial sequence
  SiRNA target sequence
ggatattgttatgtataagaga

SEQ ID NO: 25896 - DNA, 22 bp, Artificial sequence
  SiRNA target sequence
gatattgttatgtataagagac

SEQ ID NO: 25897 - DNA, 22 bp, Artificial sequence
  SiRNA target sequence
atattgttatgtataagagaca

SEQ ID NO: 25898 - DNA, 22 bp, Artificial sequence
  SiRNA target sequence
tattgttatgtataagagacac

SEQ ID NO: 25899 - DNA, 22 bp, Artificial sequence
  SiRNA target sequence
attgttatgtataagagacaca

SEQ ID NO: 25900 - DNA, 22 bp, Artificial sequence
  SiRNA target sequence
ttgttatgtataagagacacac

SEQ ID NO: 25901 - DNA, 22 bp, Artificial sequence
  SiRNA target sequence
tgttatgtataagagacacaca

SEQ ID NO: 25902 - DNA, 22 bp, Artificial sequence
  SiRNA target sequence
gttatgtataagagacacacaa

SEQ ID NO: 25903 - DNA, 22 bp, Artificial sequence
  SiRNA target sequence
ttatgtataagagacacacaag

SEQ ID NO: 25904 - DNA, 22 bp, Artificial sequence
  SiRNA target sequence
tatgtataagagacacacaaga

SEQ ID NO: 25905 - DNA, 22 bp, Artificial sequence
  SiRNA target sequence
atgtataagagacacacaagaa

SEQ ID NO: 25906 - DNA, 22 bp, Artificial sequence
  SiRNA target sequence
tgtataagagacacacaagaat

SEQ ID NO: 25907 - DNA, 22 bp, Artificial sequence
  SiRNA target sequence
gtataagagacacacaagaatt

SEQ ID NO: 25908 - DNA, 22 bp, Artificial sequence
  SiRNA target sequence
tataagagacacacaagaattg

SEQ ID NO: 25909 - DNA, 22 bp, Artificial sequence
  SiRNA target sequence
ataagagacacacaagaattgg

SEQ ID NO: 25910 - DNA, 22 bp, Artificial sequence
  SiRNA target sequence
taagagacacacaagaattggt

SEQ ID NO: 25911 - DNA, 22 bp, Artificial sequence
  SiRNA target sequence
aagagacacacaagaattggtt

SEQ ID NO: 25912 - DNA, 22 bp, Artificial sequence
  SiRNA target sequence
agagacacacaagaattggttg

SEQ ID NO: 25913 - DNA, 22 bp, Artificial sequence
  SiRNA target sequence
gagacacacaagaattggttgt

SEQ ID NO: 25914 - DNA, 22 bp, Artificial sequence
  SiRNA target sequence
agacacacaagaattggttgtt

SEQ ID NO: 25915 - DNA, 22 bp, Artificial sequence
  SiRNA target sequence
gacacacaagaattggttgttc

SEQ ID NO: 25916 - DNA, 22 bp, Artificial sequence
  SiRNA target sequence
acacacaagaattggttgttcc

SEQ ID NO: 25917 - DNA, 22 bp, Artificial sequence
  SiRNA target sequence
cacacaagaattggttgttcct

SEQ ID NO: 25918 - DNA, 22 bp, Artificial sequence
  SiRNA target sequence
acacaagaattggttgttccta

SEQ ID NO: 25919 - DNA, 22 bp, Artificial sequence
  SiRNA target sequence
cacaagaattggttgttcctag

SEQ ID NO: 25920 - DNA, 22 bp, Artificial sequence
  SiRNA target sequence
acaagaattggttgttcctaga

SEQ ID NO: 25921 - DNA, 22 bp, Artificial sequence
  SiRNA target sequence
caagaattggttgttcctagat

SEQ ID NO: 25922 - DNA, 22 bp, Artificial sequence
  SiRNA target sequence
aagaattggttgttcctagatc

SEQ ID NO: 25923 - DNA, 22 bp, Artificial sequence
  SiRNA target sequence
agaattggttgttcctagatca

SEQ ID NO: 25924 - DNA, 22 bp, Artificial sequence
  SiRNA target sequence
gaattggttgttcctagatcaa

SEQ ID NO: 25925 - DNA, 22 bp, Artificial sequence
  SiRNA target sequence
aattggttgttcctagatcaat

SEQ ID NO: 25926 - DNA, 22 bp, Artificial sequence
  SiRNA target sequence
attggttgttcctagatcaatt

SEQ ID NO: 25927 - DNA, 22 bp, Artificial sequence
  SiRNA target sequence
ttggttgttcctagatcaattc

SEQ ID NO: 25928 - DNA, 22 bp, Artificial sequence
  SiRNA target sequence
tggttgttcctagatcaattcc

SEQ ID NO: 25929 - DNA, 22 bp, Artificial sequence
  SiRNA target sequence
ggttgttcctagatcaattcct

SEQ ID NO: 25930 - DNA, 22 bp, Artificial sequence
  SiRNA target sequence
gttgttcctagatcaattccta

SEQ ID NO: 25931 - DNA, 22 bp, Artificial sequence
  SiRNA target sequence
ttgttcctagatcaattcctat

SEQ ID NO: 25932 - DNA, 22 bp, Artificial sequence
  SiRNA target sequence
tgttcctagatcaattcctatt

SEQ ID NO: 25933 - DNA, 22 bp, Artificial sequence
  SiRNA target sequence
gttcctagatcaattcctatta

SEQ ID NO: 25934 - DNA, 22 bp, Artificial sequence
  SiRNA target sequence
ttcctagatcaattcctattat

SEQ ID NO: 25935 - DNA, 22 bp, Artificial sequence
  SiRNA target sequence
tcctagatcaattcctattatt

SEQ ID NO: 25936 - DNA, 22 bp, Artificial sequence
  SiRNA target sequence
cctagatcaattcctattattt

SEQ ID NO: 25937 - DNA, 22 bp, Artificial sequence
  SiRNA target sequence
ctagatcaattcctattatttt

SEQ ID NO: 25938 - DNA, 22 bp, Artificial sequence
  SiRNA target sequence
tagatcaattcctattatttta

SEQ ID NO: 25939 - DNA, 22 bp, Artificial sequence
  SiRNA target sequence
agatcaattcctattattttag

SEQ ID NO: 25940 - DNA, 22 bp, Artificial sequence
  SiRNA target sequence
gatcaattcctattattttaga

SEQ ID NO: 25941 - DNA, 22 bp, Artificial sequence
  SiRNA target sequence
atcaattcctattattttagag

SEQ ID NO: 25942 - DNA, 22 bp, Artificial sequence
  SiRNA target sequence
tcaattcctattattttagagc

SEQ ID NO: 25943 - DNA, 22 bp, Artificial sequence
  SiRNA target sequence
caattcctattattttagagct

SEQ ID NO: 25944 - DNA, 22 bp, Artificial sequence
  SiRNA target sequence
aattcctattattttagagcta

SEQ ID NO: 25945 - DNA, 22 bp, Artificial sequence
  SiRNA target sequence
attcctattattttagagctaa

SEQ ID NO: 25946 - DNA, 22 bp, Artificial sequence
  SiRNA target sequence
ttcctattattttagagctaat

SEQ ID NO: 25947 - DNA, 22 bp, Artificial sequence
  SiRNA target sequence
tcctattattttagagctaatt

SEQ ID NO: 25948 - DNA, 22 bp, Artificial sequence
  SiRNA target sequence
cctattattttagagctaattt

SEQ ID NO: 25949 - DNA, 22 bp, Artificial sequence
  SiRNA target sequence
ctattattttagagctaatttc

SEQ ID NO: 25950 - DNA, 22 bp, Artificial sequence
  SiRNA target sequence
tattattttagagctaatttct

SEQ ID NO: 25951 - DNA, 22 bp, Artificial sequence
  SiRNA target sequence
attattttagagctaatttctt

SEQ ID NO: 25952 - DNA, 22 bp, Artificial sequence
  SiRNA target sequence
ttattttagagctaatttcttc

SEQ ID NO: 25953 - DNA, 22 bp, Artificial sequence
  SiRNA target sequence
tattttagagctaatttcttct

SEQ ID NO: 25954 - DNA, 22 bp, Artificial sequence
  SiRNA target sequence
attttagagctaatttcttctt

SEQ ID NO: 25955 - DNA, 22 bp, Artificial sequence
  SiRNA target sequence
ttttagagctaatttcttcttt

SEQ ID NO: 25956 - DNA, 22 bp, Artificial sequence
  SiRNA target sequence
tttagagctaatttcttcttta

SEQ ID NO: 25957 - DNA, 22 bp, Artificial sequence
  SiRNA target sequence
ttagagctaatttcttctttag

SEQ ID NO: 25958 - DNA, 22 bp, Artificial sequence
  SiRNA target sequence
tagagctaatttcttctttaga

SEQ ID NO: 25959 - DNA, 22 bp, Artificial sequence
  SiRNA target sequence
agagctaatttcttctttagac

SEQ ID NO: 25960 - DNA, 22 bp, Artificial sequence
  SiRNA target sequence
gagctaatttcttctttagaca

SEQ ID NO: 25961 - DNA, 22 bp, Artificial sequence
  SiRNA target sequence
agctaatttcttctttagacat

SEQ ID NO: 25962 - DNA, 23 bp, Artificial sequence
  SiRNA target sequence
ttaagaatttttcaatatttttt

SEQ ID NO: 25963 - DNA, 23 bp, Artificial sequence
  SiRNA target sequence
taagaatttttcaatattttttt

SEQ ID NO: 25964 - DNA, 23 bp, Artificial sequence
  SiRNA target sequence
aagaatttttcaatatttttttt

SEQ ID NO: 25965 - DNA, 23 bp, Artificial sequence
  SiRNA target sequence
agaatttttcaatattttttttg

SEQ ID NO: 25966 - DNA, 23 bp, Artificial sequence
  SiRNA target sequence
gaatttttcaatattttttttgc

SEQ ID NO: 25967 - DNA, 23 bp, Artificial sequence
  SiRNA target sequence
aatttttcaatattttttttgct

SEQ ID NO: 25968 - DNA, 23 bp, Artificial sequence
  SiRNA target sequence
atttttcaatattttttttgctt

SEQ ID NO: 25969 - DNA, 23 bp, Artificial sequence
  SiRNA target sequence
tttttcaatattttttttgcttg

SEQ ID NO: 25970 - DNA, 23 bp, Artificial sequence
  SiRNA target sequence
ttttcaatattttttttgcttgt

SEQ ID NO: 25971 - DNA, 23 bp, Artificial sequence
  SiRNA target sequence
tttcaatattttttttgcttgtt

SEQ ID NO: 25972 - DNA, 23 bp, Artificial sequence
  SiRNA target sequence
ttcaatattttttttgcttgttc

SEQ ID NO: 25973 - DNA, 23 bp, Artificial sequence
  SiRNA target sequence
tcaatattttttttgcttgttct

SEQ ID NO: 25974 - DNA, 23 bp, Artificial sequence
  SiRNA target sequence
caatattttttttgcttgttcta

SEQ ID NO: 25975 - DNA, 23 bp, Artificial sequence
  SiRNA target sequence
aatattttttttgcttgttctaa

SEQ ID NO: 25976 - DNA, 23 bp, Artificial sequence
  SiRNA target sequence
atattttttttgcttgttctaag

SEQ ID NO: 25977 - DNA, 23 bp, Artificial sequence
  SiRNA target sequence
tattttttttgcttgttctaagt

SEQ ID NO: 25978 - DNA, 23 bp, Artificial sequence
  SiRNA target sequence
attttttttgcttgttctaagtc

SEQ ID NO: 25979 - DNA, 23 bp, Artificial sequence
  SiRNA target sequence
ttttttttgcttgttctaagtca

SEQ ID NO: 25980 - DNA, 23 bp, Artificial sequence
  SiRNA target sequence
tttttttgcttgttctaagtcat

SEQ ID NO: 25981 - DNA, 23 bp, Artificial sequence
  SiRNA target sequence
ttttttgcttgttctaagtcata

SEQ ID NO: 25982 - DNA, 23 bp, Artificial sequence
  SiRNA target sequence
tttttgcttgttctaagtcataa

SEQ ID NO: 25983 - DNA, 23 bp, Artificial sequence
  SiRNA target sequence
ttttgcttgttctaagtcataaa

SEQ ID NO: 25984 - DNA, 23 bp, Artificial sequence
  SiRNA target sequence
tttgcttgttctaagtcataaat

SEQ ID NO: 25985 - DNA, 23 bp, Artificial sequence
  SiRNA target sequence
ttgcttgttctaagtcataaatt

SEQ ID NO: 25986 - DNA, 23 bp, Artificial sequence
  SiRNA target sequence
tgcttgttctaagtcataaattt

SEQ ID NO: 25987 - DNA, 23 bp, Artificial sequence
  SiRNA target sequence
gcttgttctaagtcataaatttt

SEQ ID NO: 25988 - DNA, 23 bp, Artificial sequence
  SiRNA target sequence
cttgttctaagtcataaattttt

SEQ ID NO: 25989 - DNA, 23 bp, Artificial sequence
  SiRNA target sequence
ttgttctaagtcataaatttttt

SEQ ID NO: 25990 - DNA, 23 bp, Artificial sequence
  SiRNA target sequence
tgttctaagtcataaattttttt

SEQ ID NO: 25991 - DNA, 23 bp, Artificial sequence
  SiRNA target sequence
gttctaagtcataaattttttta

SEQ ID NO: 25992 - DNA, 23 bp, Artificial sequence
  SiRNA target sequence
ttctaagtcataaatttttttag

SEQ ID NO: 25993 - DNA, 23 bp, Artificial sequence
  SiRNA target sequence
tctaagtcataaatttttttagt

SEQ ID NO: 25994 - DNA, 23 bp, Artificial sequence
  SiRNA target sequence
ctaagtcataaatttttttagtc

SEQ ID NO: 25995 - DNA, 23 bp, Artificial sequence
  SiRNA target sequence
taagtcataaatttttttagtca

SEQ ID NO: 25996 - DNA, 23 bp, Artificial sequence
  SiRNA target sequence
aagtcataaatttttttagtcaa

SEQ ID NO: 25997 - DNA, 23 bp, Artificial sequence
  SiRNA target sequence
agtcataaatttttttagtcaaa

SEQ ID NO: 25998 - DNA, 23 bp, Artificial sequence
  SiRNA target sequence
gtcataaatttttttagtcaaat

SEQ ID NO: 25999 - DNA, 23 bp, Artificial sequence
  SiRNA target sequence
tcataaatttttttagtcaaata

SEQ ID NO: 26000 - DNA, 23 bp, Artificial sequence
  SiRNA target sequence
cataaatttttttagtcaaatat

SEQ ID NO: 26001 - DNA, 23 bp, Artificial sequence
  SiRNA target sequence
ataaatttttttagtcaaatatg

SEQ ID NO: 26002 - DNA, 23 bp, Artificial sequence
  SiRNA target sequence
taaatttttttagtcaaatatga

SEQ ID NO: 26003 - DNA, 23 bp, Artificial sequence
  SiRNA target sequence
aaatttttttagtcaaatatgac

SEQ ID NO: 26004 - DNA, 23 bp, Artificial sequence
  SiRNA target sequence
aatttttttagtcaaatatgact

SEQ ID NO: 26005 - DNA, 23 bp, Artificial sequence
  SiRNA target sequence
atttttttagtcaaatatgactt

SEQ ID NO: 26006 - DNA, 23 bp, Artificial sequence
  SiRNA target sequence
tttttttagtcaaatatgacttt

SEQ ID NO: 26007 - DNA, 23 bp, Artificial sequence
  SiRNA target sequence
ttttttagtcaaatatgacttta

SEQ ID NO: 26008 - DNA, 23 bp, Artificial sequence
  SiRNA target sequence
tttttagtcaaatatgactttaa

SEQ ID NO: 26009 - DNA, 23 bp, Artificial sequence
  SiRNA target sequence
ttttagtcaaatatgactttaaa

SEQ ID NO: 26010 - DNA, 23 bp, Artificial sequence
  SiRNA target sequence
tttagtcaaatatgactttaaaa

SEQ ID NO: 26011 - DNA, 23 bp, Artificial sequence
  SiRNA target sequence
ttagtcaaatatgactttaaaat

SEQ ID NO: 26012 - DNA, 23 bp, Artificial sequence
  SiRNA target sequence
tagtcaaatatgactttaaaatc

SEQ ID NO: 26013 - DNA, 23 bp, Artificial sequence
  SiRNA target sequence
agtcaaatatgactttaaaatct

SEQ ID NO: 26014 - DNA, 23 bp, Artificial sequence
  SiRNA target sequence
gtcaaatatgactttaaaatctc

SEQ ID NO: 26015 - DNA, 23 bp, Artificial sequence
  SiRNA target sequence
tcaaatatgactttaaaatctct

SEQ ID NO: 26016 - DNA, 23 bp, Artificial sequence
  SiRNA target sequence
caaatatgactttaaaatctctt

SEQ ID NO: 26017 - DNA, 23 bp, Artificial sequence
  SiRNA target sequence
aaatatgactttaaaatctcttt

SEQ ID NO: 26018 - DNA, 23 bp, Artificial sequence
  SiRNA target sequence
aatatgactttaaaatctctttt

SEQ ID NO: 26019 - DNA, 23 bp, Artificial sequence
  SiRNA target sequence
atatgactttaaaatctcttttg

SEQ ID NO: 26020 - DNA, 23 bp, Artificial sequence
  SiRNA target sequence
tatgactttaaaatctcttttgt

SEQ ID NO: 26021 - DNA, 23 bp, Artificial sequence
  SiRNA target sequence
atgactttaaaatctcttttgtt

SEQ ID NO: 26022 - DNA, 23 bp, Artificial sequence
  SiRNA target sequence
tgactttaaaatctcttttgttt

SEQ ID NO: 26023 - DNA, 23 bp, Artificial sequence
  SiRNA target sequence
gactttaaaatctcttttgtttc

SEQ ID NO: 26024 - DNA, 23 bp, Artificial sequence
  SiRNA target sequence
actttaaaatctcttttgtttca

SEQ ID NO: 26025 - DNA, 23 bp, Artificial sequence
  SiRNA target sequence
ctttaaaatctcttttgtttcat

SEQ ID NO: 26026 - DNA, 23 bp, Artificial sequence
  SiRNA target sequence
tttaaaatctcttttgtttcatc

SEQ ID NO: 26027 - DNA, 23 bp, Artificial sequence
  SiRNA target sequence
ttaaaatctcttttgtttcatct

SEQ ID NO: 26028 - DNA, 23 bp, Artificial sequence
  SiRNA target sequence
taaaatctcttttgtttcatctg

SEQ ID NO: 26029 - DNA, 23 bp, Artificial sequence
  SiRNA target sequence
aaaatctcttttgtttcatctgt

SEQ ID NO: 26030 - DNA, 23 bp, Artificial sequence
  SiRNA target sequence
aaatctcttttgtttcatctgtt

SEQ ID NO: 26031 - DNA, 23 bp, Artificial sequence
  SiRNA target sequence
aatctcttttgtttcatctgtta

SEQ ID NO: 26032 - DNA, 23 bp, Artificial sequence
  SiRNA target sequence
atctcttttgtttcatctgttac

SEQ ID NO: 26033 - DNA, 23 bp, Artificial sequence
  SiRNA target sequence
tctcttttgtttcatctgttact

SEQ ID NO: 26034 - DNA, 23 bp, Artificial sequence
  SiRNA target sequence
ctcttttgtttcatctgttactt

SEQ ID NO: 26035 - DNA, 23 bp, Artificial sequence
  SiRNA target sequence
tcttttgtttcatctgttacttg

SEQ ID NO: 26036 - DNA, 23 bp, Artificial sequence
  SiRNA target sequence
cttttgtttcatctgttacttgt

SEQ ID NO: 26037 - DNA, 23 bp, Artificial sequence
  SiRNA target sequence
ttttgtttcatctgttacttgtt

SEQ ID NO: 26038 - DNA, 23 bp, Artificial sequence
  SiRNA target sequence
tttgtttcatctgttacttgttt

SEQ ID NO: 26039 - DNA, 23 bp, Artificial sequence
  SiRNA target sequence
ttgtttcatctgttacttgtttg

SEQ ID NO: 26040 - DNA, 23 bp, Artificial sequence
  SiRNA target sequence
tgtttcatctgttacttgtttgt

SEQ ID NO: 26041 - DNA, 23 bp, Artificial sequence
  SiRNA target sequence
gtttcatctgttacttgtttgta

SEQ ID NO: 26042 - DNA, 23 bp, Artificial sequence
  SiRNA target sequence
tttcatctgttacttgtttgtac

SEQ ID NO: 26043 - DNA, 23 bp, Artificial sequence
  SiRNA target sequence
ttcatctgttacttgtttgtact

SEQ ID NO: 26044 - DNA, 23 bp, Artificial sequence
  SiRNA target sequence
tcatctgttacttgtttgtactt

SEQ ID NO: 26045 - DNA, 23 bp, Artificial sequence
  SiRNA target sequence
catctgttacttgtttgtacttt

SEQ ID NO: 26046 - DNA, 23 bp, Artificial sequence
  SiRNA target sequence
atctgttacttgtttgtacttta

SEQ ID NO: 26047 - DNA, 23 bp, Artificial sequence
  SiRNA target sequence
tctgttacttgtttgtactttaa

SEQ ID NO: 26048 - DNA, 23 bp, Artificial sequence
  SiRNA target sequence
ctgttacttgtttgtactttaaa

SEQ ID NO: 26049 - DNA, 23 bp, Artificial sequence
  SiRNA target sequence
tgttacttgtttgtactttaaaa

SEQ ID NO: 26050 - DNA, 23 bp, Artificial sequence
  SiRNA target sequence
gttacttgtttgtactttaaaaa

SEQ ID NO: 26051 - DNA, 23 bp, Artificial sequence
  SiRNA target sequence
ttacttgtttgtactttaaaaat

SEQ ID NO: 26052 - DNA, 23 bp, Artificial sequence
  SiRNA target sequence
tacttgtttgtactttaaaaatt

SEQ ID NO: 26053 - DNA, 23 bp, Artificial sequence
  SiRNA target sequence
acttgtttgtactttaaaaattg

SEQ ID NO: 26054 - DNA, 23 bp, Artificial sequence
  SiRNA target sequence
cttgtttgtactttaaaaattgt

SEQ ID NO: 26055 - DNA, 23 bp, Artificial sequence
  SiRNA target sequence
ttgtttgtactttaaaaattgtt

SEQ ID NO: 26056 - DNA, 23 bp, Artificial sequence
  SiRNA target sequence
tgtttgtactttaaaaattgttg

SEQ ID NO: 26057 - DNA, 23 bp, Artificial sequence
  SiRNA target sequence
gtttgtactttaaaaattgttga

SEQ ID NO: 26058 - DNA, 23 bp, Artificial sequence
  SiRNA target sequence
tttgtactttaaaaattgttgaa

SEQ ID NO: 26059 - DNA, 23 bp, Artificial sequence
  SiRNA target sequence
ttgtactttaaaaattgttgaat

SEQ ID NO: 26060 - DNA, 23 bp, Artificial sequence
  SiRNA target sequence
tgtactttaaaaattgttgaatt

SEQ ID NO: 26061 - DNA, 23 bp, Artificial sequence
  SiRNA target sequence
gtactttaaaaattgttgaattt

SEQ ID NO: 26062 - DNA, 23 bp, Artificial sequence
  SiRNA target sequence
tactttaaaaattgttgaatttc

SEQ ID NO: 26063 - DNA, 23 bp, Artificial sequence
  SiRNA target sequence
actttaaaaattgttgaatttca

SEQ ID NO: 26064 - DNA, 23 bp, Artificial sequence
  SiRNA target sequence
ctttaaaaattgttgaatttcaa

SEQ ID NO: 26065 - DNA, 23 bp, Artificial sequence
  SiRNA target sequence
tttaaaaattgttgaatttcaat

SEQ ID NO: 26066 - DNA, 23 bp, Artificial sequence
  SiRNA target sequence
ttaaaaattgttgaatttcaatt

SEQ ID NO: 26067 - DNA, 23 bp, Artificial sequence
  SiRNA target sequence
taaaaattgttgaatttcaattt

SEQ ID NO: 26068 - DNA, 23 bp, Artificial sequence
  SiRNA target sequence
aaaaattgttgaatttcaatttt

SEQ ID NO: 26069 - DNA, 23 bp, Artificial sequence
  SiRNA target sequence
aaaattgttgaatttcaatttta

SEQ ID NO: 26070 - DNA, 23 bp, Artificial sequence
  SiRNA target sequence
aaattgttgaatttcaattttaa

SEQ ID NO: 26071 - DNA, 23 bp, Artificial sequence
  SiRNA target sequence
aattgttgaatttcaattttaaa

SEQ ID NO: 26072 - DNA, 23 bp, Artificial sequence
  SiRNA target sequence
attgttgaatttcaattttaaat

SEQ ID NO: 26073 - DNA, 23 bp, Artificial sequence
  SiRNA target sequence
ttgttgaatttcaattttaaatt

SEQ ID NO: 26074 - DNA, 23 bp, Artificial sequence
  SiRNA target sequence
tgttgaatttcaattttaaattc

SEQ ID NO: 26075 - DNA, 23 bp, Artificial sequence
  SiRNA target sequence
gttgaatttcaattttaaattcg

SEQ ID NO: 26076 - DNA, 23 bp, Artificial sequence
  SiRNA target sequence
ttgaatttcaattttaaattcgg

SEQ ID NO: 26077 - DNA, 23 bp, Artificial sequence
  SiRNA target sequence
tgaatttcaattttaaattcggc

SEQ ID NO: 26078 - DNA, 23 bp, Artificial sequence
  SiRNA target sequence
gaatttcaattttaaattcggca

SEQ ID NO: 26079 - DNA, 23 bp, Artificial sequence
  SiRNA target sequence
aatttcaattttaaattcggcac

SEQ ID NO: 26080 - DNA, 23 bp, Artificial sequence
  SiRNA target sequence
atttcaattttaaattcggcaca

SEQ ID NO: 26081 - DNA, 23 bp, Artificial sequence
  SiRNA target sequence
tttcaattttaaattcggcacaa

SEQ ID NO: 26082 - DNA, 23 bp, Artificial sequence
  SiRNA target sequence
ttcaattttaaattcggcacaat

SEQ ID NO: 26083 - DNA, 23 bp, Artificial sequence
  SiRNA target sequence
tcaattttaaattcggcacaatt

SEQ ID NO: 26084 - DNA, 23 bp, Artificial sequence
  SiRNA target sequence
caattttaaattcggcacaattt

SEQ ID NO: 26085 - DNA, 23 bp, Artificial sequence
  SiRNA target sequence
aattttaaattcggcacaatttt

SEQ ID NO: 26086 - DNA, 23 bp, Artificial sequence
  SiRNA target sequence
attttaaattcggcacaattttt

SEQ ID NO: 26087 - DNA, 23 bp, Artificial sequence
  SiRNA target sequence
ttttaaattcggcacaatttttt

SEQ ID NO: 26088 - DNA, 23 bp, Artificial sequence
  SiRNA target sequence
tttaaattcggcacaattttttt

SEQ ID NO: 26089 - DNA, 23 bp, Artificial sequence
  SiRNA target sequence
ttaaattcggcacaatttttttc

SEQ ID NO: 26090 - DNA, 23 bp, Artificial sequence
  SiRNA target sequence
taaattcggcacaatttttttca

SEQ ID NO: 26091 - DNA, 23 bp, Artificial sequence
  SiRNA target sequence
aaattcggcacaatttttttcaa

SEQ ID NO: 26092 - DNA, 23 bp, Artificial sequence
  SiRNA target sequence
aattcggcacaatttttttcaat

SEQ ID NO: 26093 - DNA, 23 bp, Artificial sequence
  SiRNA target sequence
attcggcacaatttttttcaatt

SEQ ID NO: 26094 - DNA, 23 bp, Artificial sequence
  SiRNA target sequence
ttcggcacaatttttttcaattt

SEQ ID NO: 26095 - DNA, 23 bp, Artificial sequence
  SiRNA target sequence
tcggcacaatttttttcaatttc

SEQ ID NO: 26096 - DNA, 23 bp, Artificial sequence
  SiRNA target sequence
cggcacaatttttttcaatttca

SEQ ID NO: 26097 - DNA, 23 bp, Artificial sequence
  SiRNA target sequence
ggcacaatttttttcaatttcat

SEQ ID NO: 26098 - DNA, 23 bp, Artificial sequence
  SiRNA target sequence
gcacaatttttttcaatttcatc

SEQ ID NO: 26099 - DNA, 23 bp, Artificial sequence
  SiRNA target sequence
cacaatttttttcaatttcatct

SEQ ID NO: 26100 - DNA, 23 bp, Artificial sequence
  SiRNA target sequence
acaatttttttcaatttcatctt

SEQ ID NO: 26101 - DNA, 23 bp, Artificial sequence
  SiRNA target sequence
caatttttttcaatttcatcttt

SEQ ID NO: 26102 - DNA, 23 bp, Artificial sequence
  SiRNA target sequence
aatttttttcaatttcatctttt

SEQ ID NO: 26103 - DNA, 23 bp, Artificial sequence
  SiRNA target sequence
atttttttcaatttcatcttttt

SEQ ID NO: 26104 - DNA, 23 bp, Artificial sequence
  SiRNA target sequence
tttttttcaatttcatctttttt

SEQ ID NO: 26105 - DNA, 23 bp, Artificial sequence
  SiRNA target sequence
ttttttcaatttcatcttttttc

SEQ ID NO: 26106 - DNA, 23 bp, Artificial sequence
  SiRNA target sequence
tttttcaatttcatcttttttcg

SEQ ID NO: 26107 - DNA, 23 bp, Artificial sequence
  SiRNA target sequence
ttttcaatttcatcttttttcga

SEQ ID NO: 26108 - DNA, 23 bp, Artificial sequence
  SiRNA target sequence
tttcaatttcatcttttttcgaa

SEQ ID NO: 26109 - DNA, 23 bp, Artificial sequence
  SiRNA target sequence
ttcaatttcatcttttttcgaat

SEQ ID NO: 26110 - DNA, 23 bp, Artificial sequence
  SiRNA target sequence
tcaatttcatcttttttcgaatt

SEQ ID NO: 26111 - DNA, 23 bp, Artificial sequence
  SiRNA target sequence
caatttcatcttttttcgaattt

SEQ ID NO: 26112 - DNA, 23 bp, Artificial sequence
  SiRNA target sequence
aatttcatcttttttcgaatttt

SEQ ID NO: 26113 - DNA, 23 bp, Artificial sequence
  SiRNA target sequence
atttcatcttttttcgaattttc

SEQ ID NO: 26114 - DNA, 23 bp, Artificial sequence
  SiRNA target sequence
tttcatcttttttcgaattttct

SEQ ID NO: 26115 - DNA, 23 bp, Artificial sequence
  SiRNA target sequence
ttcatcttttttcgaattttctt

SEQ ID NO: 26116 - DNA, 23 bp, Artificial sequence
  SiRNA target sequence
tcatcttttttcgaattttcttc

SEQ ID NO: 26117 - DNA, 23 bp, Artificial sequence
  SiRNA target sequence
catcttttttcgaattttcttcg

SEQ ID NO: 26118 - DNA, 23 bp, Artificial sequence
  SiRNA target sequence
atcttttttcgaattttcttcgg

SEQ ID NO: 26119 - DNA, 23 bp, Artificial sequence
  SiRNA target sequence
tcttttttcgaattttcttcggc

SEQ ID NO: 26120 - DNA, 23 bp, Artificial sequence
  SiRNA target sequence
cttttttcgaattttcttcggct

SEQ ID NO: 26121 - DNA, 23 bp, Artificial sequence
  SiRNA target sequence
ttttttcgaattttcttcggctt

SEQ ID NO: 26122 - DNA, 23 bp, Artificial sequence
  SiRNA target sequence
tttttcgaattttcttcggcttc

SEQ ID NO: 26123 - DNA, 23 bp, Artificial sequence
  SiRNA target sequence
ttttcgaattttcttcggcttct

SEQ ID NO: 26124 - DNA, 23 bp, Artificial sequence
  SiRNA target sequence
tttcgaattttcttcggcttctc

SEQ ID NO: 26125 - DNA, 23 bp, Artificial sequence
  SiRNA target sequence
ttcgaattttcttcggcttctcg

SEQ ID NO: 26126 - DNA, 23 bp, Artificial sequence
  SiRNA target sequence
tcgaattttcttcggcttctcgt

SEQ ID NO: 26127 - DNA, 23 bp, Artificial sequence
  SiRNA target sequence
cgaattttcttcggcttctcgta

SEQ ID NO: 26128 - DNA, 23 bp, Artificial sequence
  SiRNA target sequence
gaattttcttcggcttctcgtat

SEQ ID NO: 26129 - DNA, 23 bp, Artificial sequence
  SiRNA target sequence
aattttcttcggcttctcgtatc

SEQ ID NO: 26130 - DNA, 23 bp, Artificial sequence
  SiRNA target sequence
attttcttcggcttctcgtatca

SEQ ID NO: 26131 - DNA, 23 bp, Artificial sequence
  SiRNA target sequence
ttttcttcggcttctcgtatcat

SEQ ID NO: 26132 - DNA, 23 bp, Artificial sequence
  SiRNA target sequence
tttcttcggcttctcgtatcatt

SEQ ID NO: 26133 - DNA, 23 bp, Artificial sequence
  SiRNA target sequence
ttcttcggcttctcgtatcattt

SEQ ID NO: 26134 - DNA, 23 bp, Artificial sequence
  SiRNA target sequence
tcttcggcttctcgtatcatttg

SEQ ID NO: 26135 - DNA, 23 bp, Artificial sequence
  SiRNA target sequence
cttcggcttctcgtatcatttgc

SEQ ID NO: 26136 - DNA, 23 bp, Artificial sequence
  SiRNA target sequence
ttcggcttctcgtatcatttgcg

SEQ ID NO: 26137 - DNA, 23 bp, Artificial sequence
  SiRNA target sequence
tcggcttctcgtatcatttgcga

SEQ ID NO: 26138 - DNA, 23 bp, Artificial sequence
  SiRNA target sequence
cggcttctcgtatcatttgcgaa

SEQ ID NO: 26139 - DNA, 23 bp, Artificial sequence
  SiRNA target sequence
ggcttctcgtatcatttgcgaaa

SEQ ID NO: 26140 - DNA, 23 bp, Artificial sequence
  SiRNA target sequence
gcttctcgtatcatttgcgaaat

SEQ ID NO: 26141 - DNA, 23 bp, Artificial sequence
  SiRNA target sequence
cttctcgtatcatttgcgaaatt

SEQ ID NO: 26142 - DNA, 23 bp, Artificial sequence
  SiRNA target sequence
ttctcgtatcatttgcgaaattt

SEQ ID NO: 26143 - DNA, 23 bp, Artificial sequence
  SiRNA target sequence
tctcgtatcatttgcgaaatttc

SEQ ID NO: 26144 - DNA, 23 bp, Artificial sequence
  SiRNA target sequence
ctcgtatcatttgcgaaatttca

SEQ ID NO: 26145 - DNA, 23 bp, Artificial sequence
  SiRNA target sequence
tcgtatcatttgcgaaatttcac

SEQ ID NO: 26146 - DNA, 23 bp, Artificial sequence
  SiRNA target sequence
cgtatcatttgcgaaatttcacc

SEQ ID NO: 26147 - DNA, 23 bp, Artificial sequence
  SiRNA target sequence
gtatcatttgcgaaatttcacct

SEQ ID NO: 26148 - DNA, 23 bp, Artificial sequence
  SiRNA target sequence
tatcatttgcgaaatttcacctt

SEQ ID NO: 26149 - DNA, 23 bp, Artificial sequence
  SiRNA target sequence
atcatttgcgaaatttcaccttc

SEQ ID NO: 26150 - DNA, 23 bp, Artificial sequence
  SiRNA target sequence
tcatttgcgaaatttcaccttca

SEQ ID NO: 26151 - DNA, 23 bp, Artificial sequence
  SiRNA target sequence
catttgcgaaatttcaccttcat

SEQ ID NO: 26152 - DNA, 23 bp, Artificial sequence
  SiRNA target sequence
atttgcgaaatttcaccttcatt

SEQ ID NO: 26153 - DNA, 23 bp, Artificial sequence
  SiRNA target sequence
tttgcgaaatttcaccttcattt

SEQ ID NO: 26154 - DNA, 23 bp, Artificial sequence
  SiRNA target sequence
ttgcgaaatttcaccttcattta

SEQ ID NO: 26155 - DNA, 23 bp, Artificial sequence
  SiRNA target sequence
tgcgaaatttcaccttcatttaa

SEQ ID NO: 26156 - DNA, 23 bp, Artificial sequence
  SiRNA target sequence
gcgaaatttcaccttcatttaat

SEQ ID NO: 26157 - DNA, 23 bp, Artificial sequence
  SiRNA target sequence
cgaaatttcaccttcatttaatc

SEQ ID NO: 26158 - DNA, 23 bp, Artificial sequence
  SiRNA target sequence
gaaatttcaccttcatttaatcc

SEQ ID NO: 26159 - DNA, 23 bp, Artificial sequence
  SiRNA target sequence
aaatttcaccttcatttaatcca

SEQ ID NO: 26160 - DNA, 23 bp, Artificial sequence
  SiRNA target sequence
aatttcaccttcatttaatccac

SEQ ID NO: 26161 - DNA, 23 bp, Artificial sequence
  SiRNA target sequence
atttcaccttcatttaatccact

SEQ ID NO: 26162 - DNA, 23 bp, Artificial sequence
  SiRNA target sequence
tttcaccttcatttaatccactt

SEQ ID NO: 26163 - DNA, 23 bp, Artificial sequence
  SiRNA target sequence
ttcaccttcatttaatccacttg

SEQ ID NO: 26164 - DNA, 23 bp, Artificial sequence
  SiRNA target sequence
tcaccttcatttaatccacttga

SEQ ID NO: 26165 - DNA, 23 bp, Artificial sequence
  SiRNA target sequence
caccttcatttaatccacttgaa

SEQ ID NO: 26166 - DNA, 23 bp, Artificial sequence
  SiRNA target sequence
accttcatttaatccacttgaag

SEQ ID NO: 26167 - DNA, 23 bp, Artificial sequence
  SiRNA target sequence
ccttcatttaatccacttgaagg

SEQ ID NO: 26168 - DNA, 23 bp, Artificial sequence
  SiRNA target sequence
cttcatttaatccacttgaaggc

SEQ ID NO: 26169 - DNA, 23 bp, Artificial sequence
  SiRNA target sequence
ttcatttaatccacttgaaggca

SEQ ID NO: 26170 - DNA, 23 bp, Artificial sequence
  SiRNA target sequence
tcatttaatccacttgaaggcac

SEQ ID NO: 26171 - DNA, 23 bp, Artificial sequence
  SiRNA target sequence
catttaatccacttgaaggcaca

SEQ ID NO: 26172 - DNA, 23 bp, Artificial sequence
  SiRNA target sequence
atttaatccacttgaaggcacaa

SEQ ID NO: 26173 - DNA, 23 bp, Artificial sequence
  SiRNA target sequence
tttaatccacttgaaggcacaat

SEQ ID NO: 26174 - DNA, 23 bp, Artificial sequence
  SiRNA target sequence
ttaatccacttgaaggcacaatt

SEQ ID NO: 26175 - DNA, 23 bp, Artificial sequence
  SiRNA target sequence
taatccacttgaaggcacaattt

SEQ ID NO: 26176 - DNA, 23 bp, Artificial sequence
  SiRNA target sequence
aatccacttgaaggcacaatttc

SEQ ID NO: 26177 - DNA, 23 bp, Artificial sequence
  SiRNA target sequence
atccacttgaaggcacaatttcg

SEQ ID NO: 26178 - DNA, 23 bp, Artificial sequence
  SiRNA target sequence
tccacttgaaggcacaatttcga

SEQ ID NO: 26179 - DNA, 23 bp, Artificial sequence
  SiRNA target sequence
ccacttgaaggcacaatttcgat

SEQ ID NO: 26180 - DNA, 23 bp, Artificial sequence
  SiRNA target sequence
cacttgaaggcacaatttcgatt

SEQ ID NO: 26181 - DNA, 23 bp, Artificial sequence
  SiRNA target sequence
acttgaaggcacaatttcgattt

SEQ ID NO: 26182 - DNA, 23 bp, Artificial sequence
  SiRNA target sequence
cttgaaggcacaatttcgatttc

SEQ ID NO: 26183 - DNA, 23 bp, Artificial sequence
  SiRNA target sequence
ttgaaggcacaatttcgatttct

SEQ ID NO: 26184 - DNA, 23 bp, Artificial sequence
  SiRNA target sequence
tgaaggcacaatttcgatttctt

SEQ ID NO: 26185 - DNA, 23 bp, Artificial sequence
  SiRNA target sequence
gaaggcacaatttcgatttcttg

SEQ ID NO: 26186 - DNA, 23 bp, Artificial sequence
  SiRNA target sequence
aaggcacaatttcgatttcttgc

SEQ ID NO: 26187 - DNA, 23 bp, Artificial sequence
  SiRNA target sequence
aggcacaatttcgatttcttgct

SEQ ID NO: 26188 - DNA, 23 bp, Artificial sequence
  SiRNA target sequence
ggcacaatttcgatttcttgctt

SEQ ID NO: 26189 - DNA, 23 bp, Artificial sequence
  SiRNA target sequence
gcacaatttcgatttcttgcttt

SEQ ID NO: 26190 - DNA, 23 bp, Artificial sequence
  SiRNA target sequence
cacaatttcgatttcttgctttt

SEQ ID NO: 26191 - DNA, 23 bp, Artificial sequence
  SiRNA target sequence
acaatttcgatttcttgcttttt

SEQ ID NO: 26192 - DNA, 23 bp, Artificial sequence
  SiRNA target sequence
caatttcgatttcttgctttttt

SEQ ID NO: 26193 - DNA, 23 bp, Artificial sequence
  SiRNA target sequence
aatttcgatttcttgcttttttt

SEQ ID NO: 26194 - DNA, 23 bp, Artificial sequence
  SiRNA target sequence
atttcgatttcttgctttttttt

SEQ ID NO: 26195 - DNA, 23 bp, Artificial sequence
  SiRNA target sequence
tttcgatttcttgcttttttttc

SEQ ID NO: 26196 - DNA, 23 bp, Artificial sequence
  SiRNA target sequence
ttcgatttcttgcttttttttcg

SEQ ID NO: 26197 - DNA, 23 bp, Artificial sequence
  SiRNA target sequence
tcgatttcttgcttttttttcgt

SEQ ID NO: 26198 - DNA, 23 bp, Artificial sequence
  SiRNA target sequence
cgatttcttgcttttttttcgtt

SEQ ID NO: 26199 - DNA, 23 bp, Artificial sequence
  SiRNA target sequence
gatttcttgcttttttttcgtta

SEQ ID NO: 26200 - DNA, 23 bp, Artificial sequence
  SiRNA target sequence
atttcttgcttttttttcgttat

SEQ ID NO: 26201 - DNA, 23 bp, Artificial sequence
  SiRNA target sequence
tttcttgcttttttttcgttatc

SEQ ID NO: 26202 - DNA, 23 bp, Artificial sequence
  SiRNA target sequence
ttcttgcttttttttcgttatcc

SEQ ID NO: 26203 - DNA, 23 bp, Artificial sequence
  SiRNA target sequence
tcttgcttttttttcgttatccc

SEQ ID NO: 26204 - DNA, 23 bp, Artificial sequence
  SiRNA target sequence
cttgcttttttttcgttatcccg

SEQ ID NO: 26205 - DNA, 23 bp, Artificial sequence
  SiRNA target sequence
ttgcttttttttcgttatcccgt

SEQ ID NO: 26206 - DNA, 23 bp, Artificial sequence
  SiRNA target sequence
tgcttttttttcgttatcccgtc

SEQ ID NO: 26207 - DNA, 23 bp, Artificial sequence
  SiRNA target sequence
gcttttttttcgttatcccgtct

SEQ ID NO: 26208 - DNA, 23 bp, Artificial sequence
  SiRNA target sequence
cttttttttcgttatcccgtctt

SEQ ID NO: 26209 - DNA, 23 bp, Artificial sequence
  SiRNA target sequence
ttttttttcgttatcccgtcttg

SEQ ID NO: 26210 - DNA, 23 bp, Artificial sequence
  SiRNA target sequence
tttttttcgttatcccgtcttgc

SEQ ID NO: 26211 - DNA, 23 bp, Artificial sequence
  SiRNA target sequence
ttttttcgttatcccgtcttgcg

SEQ ID NO: 26212 - DNA, 23 bp, Artificial sequence
  SiRNA target sequence
tttttcgttatcccgtcttgcgc

SEQ ID NO: 26213 - DNA, 23 bp, Artificial sequence
  SiRNA target sequence
ttttcgttatcccgtcttgcgca

SEQ ID NO: 26214 - DNA, 23 bp, Artificial sequence
  SiRNA target sequence
tttcgttatcccgtcttgcgcag

SEQ ID NO: 26215 - DNA, 23 bp, Artificial sequence
  SiRNA target sequence
ttcgttatcccgtcttgcgcaga

SEQ ID NO: 26216 - DNA, 23 bp, Artificial sequence
  SiRNA target sequence
tcgttatcccgtcttgcgcagat

SEQ ID NO: 26217 - DNA, 23 bp, Artificial sequence
  SiRNA target sequence
cgttatcccgtcttgcgcagata

SEQ ID NO: 26218 - DNA, 23 bp, Artificial sequence
  SiRNA target sequence
gttatcccgtcttgcgcagatac

SEQ ID NO: 26219 - DNA, 23 bp, Artificial sequence
  SiRNA target sequence
ttatcccgtcttgcgcagatact

SEQ ID NO: 26220 - DNA, 23 bp, Artificial sequence
  SiRNA target sequence
tatcccgtcttgcgcagatactt

SEQ ID NO: 26221 - DNA, 23 bp, Artificial sequence
  SiRNA target sequence
atcccgtcttgcgcagatacttt

SEQ ID NO: 26222 - DNA, 23 bp, Artificial sequence
  SiRNA target sequence
tcccgtcttgcgcagatactttg

SEQ ID NO: 26223 - DNA, 23 bp, Artificial sequence
  SiRNA target sequence
cccgtcttgcgcagatactttgt

SEQ ID NO: 26224 - DNA, 23 bp, Artificial sequence
  SiRNA target sequence
ccgtcttgcgcagatactttgta

SEQ ID NO: 26225 - DNA, 23 bp, Artificial sequence
  SiRNA target sequence
cgtcttgcgcagatactttgtat

SEQ ID NO: 26226 - DNA, 23 bp, Artificial sequence
  SiRNA target sequence
gtcttgcgcagatactttgtata

SEQ ID NO: 26227 - DNA, 23 bp, Artificial sequence
  SiRNA target sequence
tcttgcgcagatactttgtatat

SEQ ID NO: 26228 - DNA, 23 bp, Artificial sequence
  SiRNA target sequence
cttgcgcagatactttgtatatt

SEQ ID NO: 26229 - DNA, 23 bp, Artificial sequence
  SiRNA target sequence
ttgcgcagatactttgtatattc

SEQ ID NO: 26230 - DNA, 23 bp, Artificial sequence
  SiRNA target sequence
tgcgcagatactttgtatattcc

SEQ ID NO: 26231 - DNA, 23 bp, Artificial sequence
  SiRNA target sequence
gcgcagatactttgtatattccg

SEQ ID NO: 26232 - DNA, 23 bp, Artificial sequence
  SiRNA target sequence
cgcagatactttgtatattccgt

SEQ ID NO: 26233 - DNA, 23 bp, Artificial sequence
  SiRNA target sequence
gcagatactttgtatattccgtt

SEQ ID NO: 26234 - DNA, 23 bp, Artificial sequence
  SiRNA target sequence
cagatactttgtatattccgtta

SEQ ID NO: 26235 - DNA, 23 bp, Artificial sequence
  SiRNA target sequence
agatactttgtatattccgttag

SEQ ID NO: 26236 - DNA, 23 bp, Artificial sequence
  SiRNA target sequence
gatactttgtatattccgttagc

SEQ ID NO: 26237 - DNA, 23 bp, Artificial sequence
  SiRNA target sequence
atactttgtatattccgttagca

SEQ ID NO: 26238 - DNA, 23 bp, Artificial sequence
  SiRNA target sequence
tactttgtatattccgttagcat

SEQ ID NO: 26239 - DNA, 23 bp, Artificial sequence
  SiRNA target sequence
actttgtatattccgttagcatc

SEQ ID NO: 26240 - DNA, 23 bp, Artificial sequence
  SiRNA target sequence
ctttgtatattccgttagcatcg

SEQ ID NO: 26241 - DNA, 23 bp, Artificial sequence
  SiRNA target sequence
tttgtatattccgttagcatcgg

SEQ ID NO: 26242 - DNA, 23 bp, Artificial sequence
  SiRNA target sequence
ttgtatattccgttagcatcggc

SEQ ID NO: 26243 - DNA, 23 bp, Artificial sequence
  SiRNA target sequence
tgtatattccgttagcatcggct

SEQ ID NO: 26244 - DNA, 23 bp, Artificial sequence
  SiRNA target sequence
gtatattccgttagcatcggctt

SEQ ID NO: 26245 - DNA, 23 bp, Artificial sequence
  SiRNA target sequence
tatattccgttagcatcggcttc

SEQ ID NO: 26246 - DNA, 23 bp, Artificial sequence
  SiRNA target sequence
atattccgttagcatcggcttca

SEQ ID NO: 26247 - DNA, 23 bp, Artificial sequence
  SiRNA target sequence
tattccgttagcatcggcttcaa

SEQ ID NO: 26248 - DNA, 23 bp, Artificial sequence
  SiRNA target sequence
attccgttagcatcggcttcaaa

SEQ ID NO: 26249 - DNA, 23 bp, Artificial sequence
  SiRNA target sequence
ttccgttagcatcggcttcaaat

SEQ ID NO: 26250 - DNA, 23 bp, Artificial sequence
  SiRNA target sequence
tccgttagcatcggcttcaaatg

SEQ ID NO: 26251 - DNA, 23 bp, Artificial sequence
  SiRNA target sequence
ccgttagcatcggcttcaaatgt

SEQ ID NO: 26252 - DNA, 23 bp, Artificial sequence
  SiRNA target sequence
cgttagcatcggcttcaaatgta

SEQ ID NO: 26253 - DNA, 23 bp, Artificial sequence
  SiRNA target sequence
gttagcatcggcttcaaatgtaa

SEQ ID NO: 26254 - DNA, 23 bp, Artificial sequence
  SiRNA target sequence
ttagcatcggcttcaaatgtaac

SEQ ID NO: 26255 - DNA, 23 bp, Artificial sequence
  SiRNA target sequence
tagcatcggcttcaaatgtaaca

SEQ ID NO: 26256 - DNA, 23 bp, Artificial sequence
  SiRNA target sequence
agcatcggcttcaaatgtaacat

SEQ ID NO: 26257 - DNA, 23 bp, Artificial sequence
  SiRNA target sequence
gcatcggcttcaaatgtaacatc

SEQ ID NO: 26258 - DNA, 23 bp, Artificial sequence
  SiRNA target sequence
catcggcttcaaatgtaacatct

SEQ ID NO: 26259 - DNA, 23 bp, Artificial sequence
  SiRNA target sequence
atcggcttcaaatgtaacatcta

SEQ ID NO: 26260 - DNA, 23 bp, Artificial sequence
  SiRNA target sequence
tcggcttcaaatgtaacatctat

SEQ ID NO: 26261 - DNA, 23 bp, Artificial sequence
  SiRNA target sequence
cggcttcaaatgtaacatctatc

SEQ ID NO: 26262 - DNA, 23 bp, Artificial sequence
  SiRNA target sequence
ggcttcaaatgtaacatctatct

SEQ ID NO: 26263 - DNA, 23 bp, Artificial sequence
  SiRNA target sequence
gcttcaaatgtaacatctatctt

SEQ ID NO: 26264 - DNA, 23 bp, Artificial sequence
  SiRNA target sequence
cttcaaatgtaacatctatcttt

SEQ ID NO: 26265 - DNA, 23 bp, Artificial sequence
  SiRNA target sequence
ttcaaatgtaacatctatctttg

SEQ ID NO: 26266 - DNA, 23 bp, Artificial sequence
  SiRNA target sequence
tcaaatgtaacatctatctttgg

SEQ ID NO: 26267 - DNA, 23 bp, Artificial sequence
  SiRNA target sequence
caaatgtaacatctatctttgga

SEQ ID NO: 26268 - DNA, 23 bp, Artificial sequence
  SiRNA target sequence
aaatgtaacatctatctttggaa

SEQ ID NO: 26269 - DNA, 23 bp, Artificial sequence
  SiRNA target sequence
aatgtaacatctatctttggaat

SEQ ID NO: 26270 - DNA, 23 bp, Artificial sequence
  SiRNA target sequence
atgtaacatctatctttggaata

SEQ ID NO: 26271 - DNA, 23 bp, Artificial sequence
  SiRNA target sequence
tgtaacatctatctttggaatac

SEQ ID NO: 26272 - DNA, 23 bp, Artificial sequence
  SiRNA target sequence
gtaacatctatctttggaatacc

SEQ ID NO: 26273 - DNA, 23 bp, Artificial sequence
  SiRNA target sequence
taacatctatctttggaatacct

SEQ ID NO: 26274 - DNA, 23 bp, Artificial sequence
  SiRNA target sequence
aacatctatctttggaatacctg

SEQ ID NO: 26275 - DNA, 23 bp, Artificial sequence
  SiRNA target sequence
acatctatctttggaatacctgc

SEQ ID NO: 26276 - DNA, 23 bp, Artificial sequence
  SiRNA target sequence
catctatctttggaatacctgca

SEQ ID NO: 26277 - DNA, 23 bp, Artificial sequence
  SiRNA target sequence
atctatctttggaatacctgcag

SEQ ID NO: 26278 - DNA, 23 bp, Artificial sequence
  SiRNA target sequence
tctatctttggaatacctgcagg

SEQ ID NO: 26279 - DNA, 23 bp, Artificial sequence
  SiRNA target sequence
ctatctttggaatacctgcaggt

SEQ ID NO: 26280 - DNA, 23 bp, Artificial sequence
  SiRNA target sequence
tatctttggaatacctgcaggtg

SEQ ID NO: 26281 - DNA, 23 bp, Artificial sequence
  SiRNA target sequence
atctttggaatacctgcaggtgc

SEQ ID NO: 26282 - DNA, 23 bp, Artificial sequence
  SiRNA target sequence
tctttggaatacctgcaggtgct

SEQ ID NO: 26283 - DNA, 23 bp, Artificial sequence
  SiRNA target sequence
ctttggaatacctgcaggtgctt

SEQ ID NO: 26284 - DNA, 23 bp, Artificial sequence
  SiRNA target sequence
tttggaatacctgcaggtgcttt

SEQ ID NO: 26285 - DNA, 23 bp, Artificial sequence
  SiRNA target sequence
ttggaatacctgcaggtgcttta

SEQ ID NO: 26286 - DNA, 23 bp, Artificial sequence
  SiRNA target sequence
tggaatacctgcaggtgctttag

SEQ ID NO: 26287 - DNA, 23 bp, Artificial sequence
  SiRNA target sequence
ggaatacctgcaggtgctttagg

SEQ ID NO: 26288 - DNA, 23 bp, Artificial sequence
  SiRNA target sequence
gaatacctgcaggtgctttagga

SEQ ID NO: 26289 - DNA, 23 bp, Artificial sequence
  SiRNA target sequence
aatacctgcaggtgctttaggaa

SEQ ID NO: 26290 - DNA, 23 bp, Artificial sequence
  SiRNA target sequence
atacctgcaggtgctttaggaat

SEQ ID NO: 26291 - DNA, 23 bp, Artificial sequence
  SiRNA target sequence
tacctgcaggtgctttaggaatg

SEQ ID NO: 26292 - DNA, 23 bp, Artificial sequence
  SiRNA target sequence
acctgcaggtgctttaggaatgt

SEQ ID NO: 26293 - DNA, 23 bp, Artificial sequence
  SiRNA target sequence
cctgcaggtgctttaggaatgtt

SEQ ID NO: 26294 - DNA, 23 bp, Artificial sequence
  SiRNA target sequence
ctgcaggtgctttaggaatgttt

SEQ ID NO: 26295 - DNA, 23 bp, Artificial sequence
  SiRNA target sequence
tgcaggtgctttaggaatgtttt

SEQ ID NO: 26296 - DNA, 23 bp, Artificial sequence
  SiRNA target sequence
gcaggtgctttaggaatgttttt

SEQ ID NO: 26297 - DNA, 23 bp, Artificial sequence
  SiRNA target sequence
caggtgctttaggaatgtttttg

SEQ ID NO: 26298 - DNA, 23 bp, Artificial sequence
  SiRNA target sequence
aggtgctttaggaatgtttttga

SEQ ID NO: 26299 - DNA, 23 bp, Artificial sequence
  SiRNA target sequence
ggtgctttaggaatgtttttgag

SEQ ID NO: 26300 - DNA, 23 bp, Artificial sequence
  SiRNA target sequence
gtgctttaggaatgtttttgagc

SEQ ID NO: 26301 - DNA, 23 bp, Artificial sequence
  SiRNA target sequence
tgctttaggaatgtttttgagct

SEQ ID NO: 26302 - DNA, 23 bp, Artificial sequence
  SiRNA target sequence
gctttaggaatgtttttgagctt

SEQ ID NO: 26303 - DNA, 23 bp, Artificial sequence
  SiRNA target sequence
ctttaggaatgtttttgagcttt

SEQ ID NO: 26304 - DNA, 23 bp, Artificial sequence
  SiRNA target sequence
tttaggaatgtttttgagcttta

SEQ ID NO: 26305 - DNA, 23 bp, Artificial sequence
  SiRNA target sequence
ttaggaatgtttttgagctttat

SEQ ID NO: 26306 - DNA, 23 bp, Artificial sequence
  SiRNA target sequence
taggaatgtttttgagctttata

SEQ ID NO: 26307 - DNA, 23 bp, Artificial sequence
  SiRNA target sequence
aggaatgtttttgagctttatag

SEQ ID NO: 26308 - DNA, 23 bp, Artificial sequence
  SiRNA target sequence
ggaatgtttttgagctttatagc

SEQ ID NO: 26309 - DNA, 23 bp, Artificial sequence
  SiRNA target sequence
gaatgtttttgagctttatagct

SEQ ID NO: 26310 - DNA, 23 bp, Artificial sequence
  SiRNA target sequence
aatgtttttgagctttatagctc

SEQ ID NO: 26311 - DNA, 23 bp, Artificial sequence
  SiRNA target sequence
atgtttttgagctttatagctcc

SEQ ID NO: 26312 - DNA, 23 bp, Artificial sequence
  SiRNA target sequence
tgtttttgagctttatagctcct

SEQ ID NO: 26313 - DNA, 23 bp, Artificial sequence
  SiRNA target sequence
gtttttgagctttatagctccta

SEQ ID NO: 26314 - DNA, 23 bp, Artificial sequence
  SiRNA target sequence
tttttgagctttatagctcctaa

SEQ ID NO: 26315 - DNA, 23 bp, Artificial sequence
  SiRNA target sequence
ttttgagctttatagctcctaaa

SEQ ID NO: 26316 - DNA, 23 bp, Artificial sequence
  SiRNA target sequence
tttgagctttatagctcctaaat

SEQ ID NO: 26317 - DNA, 23 bp, Artificial sequence
  SiRNA target sequence
ttgagctttatagctcctaaata

SEQ ID NO: 26318 - DNA, 23 bp, Artificial sequence
  SiRNA target sequence
tgagctttatagctcctaaatat

SEQ ID NO: 26319 - DNA, 23 bp, Artificial sequence
  SiRNA target sequence
gagctttatagctcctaaatatt

SEQ ID NO: 26320 - DNA, 23 bp, Artificial sequence
  SiRNA target sequence
agctttatagctcctaaatattt

SEQ ID NO: 26321 - DNA, 23 bp, Artificial sequence
  SiRNA target sequence
gctttatagctcctaaatattta

SEQ ID NO: 26322 - DNA, 23 bp, Artificial sequence
  SiRNA target sequence
ctttatagctcctaaatatttat

SEQ ID NO: 26323 - DNA, 23 bp, Artificial sequence
  SiRNA target sequence
tttatagctcctaaatatttatt

SEQ ID NO: 26324 - DNA, 23 bp, Artificial sequence
  SiRNA target sequence
ttatagctcctaaatatttattg

SEQ ID NO: 26325 - DNA, 23 bp, Artificial sequence
  SiRNA target sequence
tatagctcctaaatatttattgt

SEQ ID NO: 26326 - DNA, 23 bp, Artificial sequence
  SiRNA target sequence
atagctcctaaatatttattgtc

SEQ ID NO: 26327 - DNA, 23 bp, Artificial sequence
  SiRNA target sequence
tagctcctaaatatttattgtct

SEQ ID NO: 26328 - DNA, 23 bp, Artificial sequence
  SiRNA target sequence
agctcctaaatatttattgtctt

SEQ ID NO: 26329 - DNA, 23 bp, Artificial sequence
  SiRNA target sequence
gctcctaaatatttattgtcttt

SEQ ID NO: 26330 - DNA, 23 bp, Artificial sequence
  SiRNA target sequence
ctcctaaatatttattgtctttt

SEQ ID NO: 26331 - DNA, 23 bp, Artificial sequence
  SiRNA target sequence
tcctaaatatttattgtctttta

SEQ ID NO: 26332 - DNA, 23 bp, Artificial sequence
  SiRNA target sequence
cctaaatatttattgtcttttac

SEQ ID NO: 26333 - DNA, 23 bp, Artificial sequence
  SiRNA target sequence
ctaaatatttattgtcttttacc

SEQ ID NO: 26334 - DNA, 23 bp, Artificial sequence
  SiRNA target sequence
taaatatttattgtcttttacca

SEQ ID NO: 26335 - DNA, 23 bp, Artificial sequence
  SiRNA target sequence
aaatatttattgtcttttaccat

SEQ ID NO: 26336 - DNA, 23 bp, Artificial sequence
  SiRNA target sequence
aatatttattgtcttttaccatc

SEQ ID NO: 26337 - DNA, 23 bp, Artificial sequence
  SiRNA target sequence
atatttattgtcttttaccatct

SEQ ID NO: 26338 - DNA, 23 bp, Artificial sequence
  SiRNA target sequence
tatttattgtcttttaccatctt

SEQ ID NO: 26339 - DNA, 23 bp, Artificial sequence
  SiRNA target sequence
atttattgtcttttaccatcttt

SEQ ID NO: 26340 - DNA, 23 bp, Artificial sequence
  SiRNA target sequence
tttattgtcttttaccatctttc

SEQ ID NO: 26341 - DNA, 23 bp, Artificial sequence
  SiRNA target sequence
ttattgtcttttaccatctttct

SEQ ID NO: 26342 - DNA, 23 bp, Artificial sequence
  SiRNA target sequence
tattgtcttttaccatctttctt

SEQ ID NO: 26343 - DNA, 23 bp, Artificial sequence
  SiRNA target sequence
attgtcttttaccatctttcttt

SEQ ID NO: 26344 - DNA, 23 bp, Artificial sequence
  SiRNA target sequence
ttgtcttttaccatctttctttc

SEQ ID NO: 26345 - DNA, 23 bp, Artificial sequence
  SiRNA target sequence
tgtcttttaccatctttctttct

SEQ ID NO: 26346 - DNA, 23 bp, Artificial sequence
  SiRNA target sequence
gtcttttaccatctttctttctc

SEQ ID NO: 26347 - DNA, 23 bp, Artificial sequence
  SiRNA target sequence
tcttttaccatctttctttctcc

SEQ ID NO: 26348 - DNA, 23 bp, Artificial sequence
  SiRNA target sequence
cttttaccatctttctttctcct

SEQ ID NO: 26349 - DNA, 23 bp, Artificial sequence
  SiRNA target sequence
ttttaccatctttctttctcctt

SEQ ID NO: 26350 - DNA, 23 bp, Artificial sequence
  SiRNA target sequence
tttaccatctttctttctccttg

SEQ ID NO: 26351 - DNA, 23 bp, Artificial sequence
  SiRNA target sequence
ttaccatctttctttctccttga

SEQ ID NO: 26352 - DNA, 23 bp, Artificial sequence
  SiRNA target sequence
taccatctttctttctccttgat

SEQ ID NO: 26353 - DNA, 23 bp, Artificial sequence
  SiRNA target sequence
accatctttctttctccttgata

SEQ ID NO: 26354 - DNA, 23 bp, Artificial sequence
  SiRNA target sequence
ccatctttctttctccttgatat

SEQ ID NO: 26355 - DNA, 23 bp, Artificial sequence
  SiRNA target sequence
catctttctttctccttgatata

SEQ ID NO: 26356 - DNA, 23 bp, Artificial sequence
  SiRNA target sequence
atctttctttctccttgatatat

SEQ ID NO: 26357 - DNA, 23 bp, Artificial sequence
  SiRNA target sequence
tctttctttctccttgatatatt

SEQ ID NO: 26358 - DNA, 23 bp, Artificial sequence
  SiRNA target sequence
ctttctttctccttgatatattc

SEQ ID NO: 26359 - DNA, 23 bp, Artificial sequence
  SiRNA target sequence
tttctttctccttgatatattct

SEQ ID NO: 26360 - DNA, 23 bp, Artificial sequence
  SiRNA target sequence
ttctttctccttgatatattcta

SEQ ID NO: 26361 - DNA, 23 bp, Artificial sequence
  SiRNA target sequence
tctttctccttgatatattctaa

SEQ ID NO: 26362 - DNA, 23 bp, Artificial sequence
  SiRNA target sequence
ctttctccttgatatattctaat

SEQ ID NO: 26363 - DNA, 23 bp, Artificial sequence
  SiRNA target sequence
tttctccttgatatattctaata

SEQ ID NO: 26364 - DNA, 23 bp, Artificial sequence
  SiRNA target sequence
ttctccttgatatattctaatat

SEQ ID NO: 26365 - DNA, 23 bp, Artificial sequence
  SiRNA target sequence
tctccttgatatattctaatatc

SEQ ID NO: 26366 - DNA, 23 bp, Artificial sequence
  SiRNA target sequence
ctccttgatatattctaatatct

SEQ ID NO: 26367 - DNA, 23 bp, Artificial sequence
  SiRNA target sequence
tccttgatatattctaatatcta

SEQ ID NO: 26368 - DNA, 23 bp, Artificial sequence
  SiRNA target sequence
ccttgatatattctaatatctac

SEQ ID NO: 26369 - DNA, 23 bp, Artificial sequence
  SiRNA target sequence
cttgatatattctaatatctact

SEQ ID NO: 26370 - DNA, 23 bp, Artificial sequence
  SiRNA target sequence
ttgatatattctaatatctactt

SEQ ID NO: 26371 - DNA, 23 bp, Artificial sequence
  SiRNA target sequence
tgatatattctaatatctacttc

SEQ ID NO: 26372 - DNA, 23 bp, Artificial sequence
  SiRNA target sequence
gatatattctaatatctacttcg

SEQ ID NO: 26373 - DNA, 23 bp, Artificial sequence
  SiRNA target sequence
atatattctaatatctacttcgg

SEQ ID NO: 26374 - DNA, 23 bp, Artificial sequence
  SiRNA target sequence
tatattctaatatctacttcgga

SEQ ID NO: 26375 - DNA, 23 bp, Artificial sequence
  SiRNA target sequence
atattctaatatctacttcggat

SEQ ID NO: 26376 - DNA, 23 bp, Artificial sequence
  SiRNA target sequence
tattctaatatctacttcggatt

SEQ ID NO: 26377 - DNA, 23 bp, Artificial sequence
  SiRNA target sequence
attctaatatctacttcggattg

SEQ ID NO: 26378 - DNA, 23 bp, Artificial sequence
  SiRNA target sequence
ttctaatatctacttcggattga

SEQ ID NO: 26379 - DNA, 23 bp, Artificial sequence
  SiRNA target sequence
tctaatatctacttcggattgat

SEQ ID NO: 26380 - DNA, 23 bp, Artificial sequence
  SiRNA target sequence
ctaatatctacttcggattgatt

SEQ ID NO: 26381 - DNA, 23 bp, Artificial sequence
  SiRNA target sequence
taatatctacttcggattgatta

SEQ ID NO: 26382 - DNA, 23 bp, Artificial sequence
  SiRNA target sequence
aatatctacttcggattgattat

SEQ ID NO: 26383 - DNA, 23 bp, Artificial sequence
  SiRNA target sequence
atatctacttcggattgattatc

SEQ ID NO: 26384 - DNA, 23 bp, Artificial sequence
  SiRNA target sequence
tatctacttcggattgattatct

SEQ ID NO: 26385 - DNA, 23 bp, Artificial sequence
  SiRNA target sequence
atctacttcggattgattatctt

SEQ ID NO: 26386 - DNA, 23 bp, Artificial sequence
  SiRNA target sequence
tctacttcggattgattatcttc

SEQ ID NO: 26387 - DNA, 23 bp, Artificial sequence
  SiRNA target sequence
ctacttcggattgattatcttca

SEQ ID NO: 26388 - DNA, 23 bp, Artificial sequence
  SiRNA target sequence
tacttcggattgattatcttcag

SEQ ID NO: 26389 - DNA, 23 bp, Artificial sequence
  SiRNA target sequence
acttcggattgattatcttcaga

SEQ ID NO: 26390 - DNA, 23 bp, Artificial sequence
  SiRNA target sequence
cttcggattgattatcttcagag

SEQ ID NO: 26391 - DNA, 23 bp, Artificial sequence
  SiRNA target sequence
ttcggattgattatcttcagagg

SEQ ID NO: 26392 - DNA, 23 bp, Artificial sequence
  SiRNA target sequence
tcggattgattatcttcagaggt

SEQ ID NO: 26393 - DNA, 23 bp, Artificial sequence
  SiRNA target sequence
cggattgattatcttcagaggta

SEQ ID NO: 26394 - DNA, 23 bp, Artificial sequence
  SiRNA target sequence
ggattgattatcttcagaggtag

SEQ ID NO: 26395 - DNA, 23 bp, Artificial sequence
  SiRNA target sequence
gattgattatcttcagaggtaga

SEQ ID NO: 26396 - DNA, 23 bp, Artificial sequence
  SiRNA target sequence
attgattatcttcagaggtagaa

SEQ ID NO: 26397 - DNA, 23 bp, Artificial sequence
  SiRNA target sequence
ttgattatcttcagaggtagaaa

SEQ ID NO: 26398 - DNA, 23 bp, Artificial sequence
  SiRNA target sequence
tgattatcttcagaggtagaaaa

SEQ ID NO: 26399 - DNA, 23 bp, Artificial sequence
  SiRNA target sequence
gattatcttcagaggtagaaaaa

SEQ ID NO: 26400 - DNA, 23 bp, Artificial sequence
  SiRNA target sequence
attatcttcagaggtagaaaaac

SEQ ID NO: 26401 - DNA, 23 bp, Artificial sequence
  SiRNA target sequence
ttatcttcagaggtagaaaaact

SEQ ID NO: 26402 - DNA, 23 bp, Artificial sequence
  SiRNA target sequence
tatcttcagaggtagaaaaactg

SEQ ID NO: 26403 - DNA, 23 bp, Artificial sequence
  SiRNA target sequence
atcttcagaggtagaaaaactgt

SEQ ID NO: 26404 - DNA, 23 bp, Artificial sequence
  SiRNA target sequence
tcttcagaggtagaaaaactgtg

SEQ ID NO: 26405 - DNA, 23 bp, Artificial sequence
  SiRNA target sequence
cttcagaggtagaaaaactgtgt

SEQ ID NO: 26406 - DNA, 23 bp, Artificial sequence
  SiRNA target sequence
ttcagaggtagaaaaactgtgtg

SEQ ID NO: 26407 - DNA, 23 bp, Artificial sequence
  SiRNA target sequence
tcagaggtagaaaaactgtgtgt

SEQ ID NO: 26408 - DNA, 23 bp, Artificial sequence
  SiRNA target sequence
cagaggtagaaaaactgtgtgtt

SEQ ID NO: 26409 - DNA, 23 bp, Artificial sequence
  SiRNA target sequence
agaggtagaaaaactgtgtgttt

SEQ ID NO: 26410 - DNA, 23 bp, Artificial sequence
  SiRNA target sequence
gaggtagaaaaactgtgtgtttc

SEQ ID NO: 26411 - DNA, 23 bp, Artificial sequence
  SiRNA target sequence
aggtagaaaaactgtgtgtttcc

SEQ ID NO: 26412 - DNA, 23 bp, Artificial sequence
  SiRNA target sequence
ggtagaaaaactgtgtgtttcct

SEQ ID NO: 26413 - DNA, 23 bp, Artificial sequence
  SiRNA target sequence
gtagaaaaactgtgtgtttcctt

SEQ ID NO: 26414 - DNA, 23 bp, Artificial sequence
  SiRNA target sequence
tagaaaaactgtgtgtttcctta

SEQ ID NO: 26415 - DNA, 23 bp, Artificial sequence
  SiRNA target sequence
agaaaaactgtgtgtttccttaa

SEQ ID NO: 26416 - DNA, 23 bp, Artificial sequence
  SiRNA target sequence
gaaaaactgtgtgtttccttaaa

SEQ ID NO: 26417 - DNA, 23 bp, Artificial sequence
  SiRNA target sequence
aaaaactgtgtgtttccttaaat

SEQ ID NO: 26418 - DNA, 23 bp, Artificial sequence
  SiRNA target sequence
aaaactgtgtgtttccttaaatg

SEQ ID NO: 26419 - DNA, 23 bp, Artificial sequence
  SiRNA target sequence
aaactgtgtgtttccttaaatgg

SEQ ID NO: 26420 - DNA, 23 bp, Artificial sequence
  SiRNA target sequence
aactgtgtgtttccttaaatgga

SEQ ID NO: 26421 - DNA, 23 bp, Artificial sequence
  SiRNA target sequence
actgtgtgtttccttaaatggaa

SEQ ID NO: 26422 - DNA, 23 bp, Artificial sequence
  SiRNA target sequence
ctgtgtgtttccttaaatggaat

SEQ ID NO: 26423 - DNA, 23 bp, Artificial sequence
  SiRNA target sequence
tgtgtgtttccttaaatggaata

SEQ ID NO: 26424 - DNA, 23 bp, Artificial sequence
  SiRNA target sequence
gtgtgtttccttaaatggaatag

SEQ ID NO: 26425 - DNA, 23 bp, Artificial sequence
  SiRNA target sequence
tgtgtttccttaaatggaatagt

SEQ ID NO: 26426 - DNA, 23 bp, Artificial sequence
  SiRNA target sequence
gtgtttccttaaatggaatagta

SEQ ID NO: 26427 - DNA, 23 bp, Artificial sequence
  SiRNA target sequence
tgtttccttaaatggaatagtag

SEQ ID NO: 26428 - DNA, 23 bp, Artificial sequence
  SiRNA target sequence
gtttccttaaatggaatagtaga

SEQ ID NO: 26429 - DNA, 23 bp, Artificial sequence
  SiRNA target sequence
tttccttaaatggaatagtagaa

SEQ ID NO: 26430 - DNA, 23 bp, Artificial sequence
  SiRNA target sequence
ttccttaaatggaatagtagaat

SEQ ID NO: 26431 - DNA, 23 bp, Artificial sequence
  SiRNA target sequence
tccttaaatggaatagtagaatt

SEQ ID NO: 26432 - DNA, 23 bp, Artificial sequence
  SiRNA target sequence
ccttaaatggaatagtagaattt

SEQ ID NO: 26433 - DNA, 23 bp, Artificial sequence
  SiRNA target sequence
cttaaatggaatagtagaatttc

SEQ ID NO: 26434 - DNA, 23 bp, Artificial sequence
  SiRNA target sequence
ttaaatggaatagtagaatttct

SEQ ID NO: 26435 - DNA, 23 bp, Artificial sequence
  SiRNA target sequence
taaatggaatagtagaatttcta

SEQ ID NO: 26436 - DNA, 23 bp, Artificial sequence
  SiRNA target sequence
aaatggaatagtagaatttctat

SEQ ID NO: 26437 - DNA, 23 bp, Artificial sequence
  SiRNA target sequence
aatggaatagtagaatttctatg

SEQ ID NO: 26438 - DNA, 23 bp, Artificial sequence
  SiRNA target sequence
atggaatagtagaatttctatga

SEQ ID NO: 26439 - DNA, 23 bp, Artificial sequence
  SiRNA target sequence
tggaatagtagaatttctatgaa

SEQ ID NO: 26440 - DNA, 23 bp, Artificial sequence
  SiRNA target sequence
ggaatagtagaatttctatgaat

SEQ ID NO: 26441 - DNA, 23 bp, Artificial sequence
  SiRNA target sequence
gaatagtagaatttctatgaatt

SEQ ID NO: 26442 - DNA, 23 bp, Artificial sequence
  SiRNA target sequence
aatagtagaatttctatgaatta

SEQ ID NO: 26443 - DNA, 23 bp, Artificial sequence
  SiRNA target sequence
atagtagaatttctatgaattat

SEQ ID NO: 26444 - DNA, 23 bp, Artificial sequence
  SiRNA target sequence
tagtagaatttctatgaattatc

SEQ ID NO: 26445 - DNA, 23 bp, Artificial sequence
  SiRNA target sequence
agtagaatttctatgaattatct

SEQ ID NO: 26446 - DNA, 23 bp, Artificial sequence
  SiRNA target sequence
gtagaatttctatgaattatctt

SEQ ID NO: 26447 - DNA, 23 bp, Artificial sequence
  SiRNA target sequence
tagaatttctatgaattatctta

SEQ ID NO: 26448 - DNA, 23 bp, Artificial sequence
  SiRNA target sequence
agaatttctatgaattatcttat

SEQ ID NO: 26449 - DNA, 23 bp, Artificial sequence
  SiRNA target sequence
gaatttctatgaattatcttatt

SEQ ID NO: 26450 - DNA, 23 bp, Artificial sequence
  SiRNA target sequence
aatttctatgaattatcttatta

SEQ ID NO: 26451 - DNA, 23 bp, Artificial sequence
  SiRNA target sequence
atttctatgaattatcttattaa

SEQ ID NO: 26452 - DNA, 23 bp, Artificial sequence
  SiRNA target sequence
tttctatgaattatcttattaaa

SEQ ID NO: 26453 - DNA, 23 bp, Artificial sequence
  SiRNA target sequence
ttctatgaattatcttattaaaa

SEQ ID NO: 26454 - DNA, 23 bp, Artificial sequence
  SiRNA target sequence
tctatgaattatcttattaaaaa

SEQ ID NO: 26455 - DNA, 23 bp, Artificial sequence
  SiRNA target sequence
ctatgaattatcttattaaaaat

SEQ ID NO: 26456 - DNA, 23 bp, Artificial sequence
  SiRNA target sequence
tatgaattatcttattaaaaatc

SEQ ID NO: 26457 - DNA, 23 bp, Artificial sequence
  SiRNA target sequence
atgaattatcttattaaaaatcc

SEQ ID NO: 26458 - DNA, 23 bp, Artificial sequence
  SiRNA target sequence
tgaattatcttattaaaaatccc

SEQ ID NO: 26459 - DNA, 23 bp, Artificial sequence
  SiRNA target sequence
gaattatcttattaaaaatcccg

SEQ ID NO: 26460 - DNA, 23 bp, Artificial sequence
  SiRNA target sequence
aattatcttattaaaaatcccgc

SEQ ID NO: 26461 - DNA, 23 bp, Artificial sequence
  SiRNA target sequence
attatcttattaaaaatcccgcc

SEQ ID NO: 26462 - DNA, 23 bp, Artificial sequence
  SiRNA target sequence
ttatcttattaaaaatcccgccc

SEQ ID NO: 26463 - DNA, 23 bp, Artificial sequence
  SiRNA target sequence
tatcttattaaaaatcccgccca

SEQ ID NO: 26464 - DNA, 23 bp, Artificial sequence
  SiRNA target sequence
atcttattaaaaatcccgcccaa

SEQ ID NO: 26465 - DNA, 23 bp, Artificial sequence
  SiRNA target sequence
tcttattaaaaatcccgcccaaa

SEQ ID NO: 26466 - DNA, 23 bp, Artificial sequence
  SiRNA target sequence
cttattaaaaatcccgcccaaaa

SEQ ID NO: 26467 - DNA, 23 bp, Artificial sequence
  SiRNA target sequence
ttattaaaaatcccgcccaaaag

SEQ ID NO: 26468 - DNA, 23 bp, Artificial sequence
  SiRNA target sequence
tattaaaaatcccgcccaaaagc

SEQ ID NO: 26469 - DNA, 23 bp, Artificial sequence
  SiRNA target sequence
attaaaaatcccgcccaaaagct

SEQ ID NO: 26470 - DNA, 23 bp, Artificial sequence
  SiRNA target sequence
ttaaaaatcccgcccaaaagctc

SEQ ID NO: 26471 - DNA, 23 bp, Artificial sequence
  SiRNA target sequence
taaaaatcccgcccaaaagctct

SEQ ID NO: 26472 - DNA, 23 bp, Artificial sequence
  SiRNA target sequence
aaaaatcccgcccaaaagctcta

SEQ ID NO: 26473 - DNA, 23 bp, Artificial sequence
  SiRNA target sequence
aaaatcccgcccaaaagctctat

SEQ ID NO: 26474 - DNA, 23 bp, Artificial sequence
  SiRNA target sequence
aaatcccgcccaaaagctctata

SEQ ID NO: 26475 - DNA, 23 bp, Artificial sequence
  SiRNA target sequence
aatcccgcccaaaagctctatac

SEQ ID NO: 26476 - DNA, 23 bp, Artificial sequence
  SiRNA target sequence
atcccgcccaaaagctctatacc

SEQ ID NO: 26477 - DNA, 23 bp, Artificial sequence
  SiRNA target sequence
tcccgcccaaaagctctatacct

SEQ ID NO: 26478 - DNA, 23 bp, Artificial sequence
  SiRNA target sequence
cccgcccaaaagctctataccta

SEQ ID NO: 26479 - DNA, 23 bp, Artificial sequence
  SiRNA target sequence
ccgcccaaaagctctatacctaa

SEQ ID NO: 26480 - DNA, 23 bp, Artificial sequence
  SiRNA target sequence
cgcccaaaagctctatacctaaa

SEQ ID NO: 26481 - DNA, 23 bp, Artificial sequence
  SiRNA target sequence
gcccaaaagctctatacctaaac

SEQ ID NO: 26482 - DNA, 23 bp, Artificial sequence
  SiRNA target sequence
cccaaaagctctatacctaaact

SEQ ID NO: 26483 - DNA, 23 bp, Artificial sequence
  SiRNA target sequence
ccaaaagctctatacctaaactc

SEQ ID NO: 26484 - DNA, 23 bp, Artificial sequence
  SiRNA target sequence
caaaagctctatacctaaactca

SEQ ID NO: 26485 - DNA, 23 bp, Artificial sequence
  SiRNA target sequence
aaaagctctatacctaaactcaa

SEQ ID NO: 26486 - DNA, 23 bp, Artificial sequence
  SiRNA target sequence
aaagctctatacctaaactcaat

SEQ ID NO: 26487 - DNA, 23 bp, Artificial sequence
  SiRNA target sequence
aagctctatacctaaactcaatg

SEQ ID NO: 26488 - DNA, 23 bp, Artificial sequence
  SiRNA target sequence
agctctatacctaaactcaatgg

SEQ ID NO: 26489 - DNA, 23 bp, Artificial sequence
  SiRNA target sequence
gctctatacctaaactcaatggt

SEQ ID NO: 26490 - DNA, 23 bp, Artificial sequence
  SiRNA target sequence
ctctatacctaaactcaatggta

SEQ ID NO: 26491 - DNA, 23 bp, Artificial sequence
  SiRNA target sequence
tctatacctaaactcaatggtac

SEQ ID NO: 26492 - DNA, 23 bp, Artificial sequence
  SiRNA target sequence
ctatacctaaactcaatggtact

SEQ ID NO: 26493 - DNA, 23 bp, Artificial sequence
  SiRNA target sequence
tatacctaaactcaatggtacta

SEQ ID NO: 26494 - DNA, 23 bp, Artificial sequence
  SiRNA target sequence
atacctaaactcaatggtactac

SEQ ID NO: 26495 - DNA, 23 bp, Artificial sequence
  SiRNA target sequence
tacctaaactcaatggtactaca

SEQ ID NO: 26496 - DNA, 23 bp, Artificial sequence
  SiRNA target sequence
acctaaactcaatggtactacat

SEQ ID NO: 26497 - DNA, 23 bp, Artificial sequence
  SiRNA target sequence
cctaaactcaatggtactacatc

SEQ ID NO: 26498 - DNA, 23 bp, Artificial sequence
  SiRNA target sequence
ctaaactcaatggtactacatcc

SEQ ID NO: 26499 - DNA, 23 bp, Artificial sequence
  SiRNA target sequence
taaactcaatggtactacatcca

SEQ ID NO: 26500 - DNA, 23 bp, Artificial sequence
  SiRNA target sequence
aaactcaatggtactacatccaa

SEQ ID NO: 26501 - DNA, 23 bp, Artificial sequence
  SiRNA target sequence
aactcaatggtactacatccaat

SEQ ID NO: 26502 - DNA, 23 bp, Artificial sequence
  SiRNA target sequence
actcaatggtactacatccaata

SEQ ID NO: 26503 - DNA, 23 bp, Artificial sequence
  SiRNA target sequence
ctcaatggtactacatccaataa

SEQ ID NO: 26504 - DNA, 23 bp, Artificial sequence
  SiRNA target sequence
tcaatggtactacatccaataat

SEQ ID NO: 26505 - DNA, 23 bp, Artificial sequence
  SiRNA target sequence
caatggtactacatccaataata

SEQ ID NO: 26506 - DNA, 23 bp, Artificial sequence
  SiRNA target sequence
aatggtactacatccaataatag

SEQ ID NO: 26507 - DNA, 23 bp, Artificial sequence
  SiRNA target sequence
atggtactacatccaataatagg

SEQ ID NO: 26508 - DNA, 23 bp, Artificial sequence
  SiRNA target sequence
tggtactacatccaataatagga

SEQ ID NO: 26509 - DNA, 23 bp, Artificial sequence
  SiRNA target sequence
ggtactacatccaataataggac

SEQ ID NO: 26510 - DNA, 23 bp, Artificial sequence
  SiRNA target sequence
gtactacatccaataataggaca

SEQ ID NO: 26511 - DNA, 23 bp, Artificial sequence
  SiRNA target sequence
tactacatccaataataggacat

SEQ ID NO: 26512 - DNA, 23 bp, Artificial sequence
  SiRNA target sequence
actacatccaataataggacatc

SEQ ID NO: 26513 - DNA, 23 bp, Artificial sequence
  SiRNA target sequence
ctacatccaataataggacatct

SEQ ID NO: 26514 - DNA, 23 bp, Artificial sequence
  SiRNA target sequence
tacatccaataataggacatctt

SEQ ID NO: 26515 - DNA, 23 bp, Artificial sequence
  SiRNA target sequence
acatccaataataggacatcttt

SEQ ID NO: 26516 - DNA, 23 bp, Artificial sequence
  SiRNA target sequence
catccaataataggacatctttt

SEQ ID NO: 26517 - DNA, 23 bp, Artificial sequence
  SiRNA target sequence
atccaataataggacatctttta

SEQ ID NO: 26518 - DNA, 23 bp, Artificial sequence
  SiRNA target sequence
tccaataataggacatcttttat

SEQ ID NO: 26519 - DNA, 23 bp, Artificial sequence
  SiRNA target sequence
ccaataataggacatcttttatt

SEQ ID NO: 26520 - DNA, 23 bp, Artificial sequence
  SiRNA target sequence
caataataggacatcttttattt

SEQ ID NO: 26521 - DNA, 23 bp, Artificial sequence
  SiRNA target sequence
aataataggacatcttttatttt

SEQ ID NO: 26522 - DNA, 23 bp, Artificial sequence
  SiRNA target sequence
ataataggacatcttttattttt

SEQ ID NO: 26523 - DNA, 23 bp, Artificial sequence
  SiRNA target sequence
taataggacatcttttatttttc

SEQ ID NO: 26524 - DNA, 23 bp, Artificial sequence
  SiRNA target sequence
aataggacatcttttatttttcc

SEQ ID NO: 26525 - DNA, 23 bp, Artificial sequence
  SiRNA target sequence
ataggacatcttttatttttcct

SEQ ID NO: 26526 - DNA, 23 bp, Artificial sequence
  SiRNA target sequence
taggacatcttttatttttcctt

SEQ ID NO: 26527 - DNA, 23 bp, Artificial sequence
  SiRNA target sequence
aggacatcttttatttttccttc

SEQ ID NO: 26528 - DNA, 23 bp, Artificial sequence
  SiRNA target sequence
ggacatcttttatttttccttct

SEQ ID NO: 26529 - DNA, 23 bp, Artificial sequence
  SiRNA target sequence
gacatcttttatttttccttcta

SEQ ID NO: 26530 - DNA, 23 bp, Artificial sequence
  SiRNA target sequence
acatcttttatttttccttctaa

SEQ ID NO: 26531 - DNA, 23 bp, Artificial sequence
  SiRNA target sequence
catcttttatttttccttctaac

SEQ ID NO: 26532 - DNA, 23 bp, Artificial sequence
  SiRNA target sequence
atcttttatttttccttctaaca

SEQ ID NO: 26533 - DNA, 23 bp, Artificial sequence
  SiRNA target sequence
tcttttatttttccttctaacac

SEQ ID NO: 26534 - DNA, 23 bp, Artificial sequence
  SiRNA target sequence
cttttatttttccttctaacacg

SEQ ID NO: 26535 - DNA, 23 bp, Artificial sequence
  SiRNA target sequence
ttttatttttccttctaacacgc

SEQ ID NO: 26536 - DNA, 23 bp, Artificial sequence
  SiRNA target sequence
tttatttttccttctaacacgcc

SEQ ID NO: 26537 - DNA, 23 bp, Artificial sequence
  SiRNA target sequence
ttatttttccttctaacacgcct

SEQ ID NO: 26538 - DNA, 23 bp, Artificial sequence
  SiRNA target sequence
tatttttccttctaacacgcctg

SEQ ID NO: 26539 - DNA, 23 bp, Artificial sequence
  SiRNA target sequence
atttttccttctaacacgcctgc

SEQ ID NO: 26540 - DNA, 23 bp, Artificial sequence
  SiRNA target sequence
tttttccttctaacacgcctgct

SEQ ID NO: 26541 - DNA, 23 bp, Artificial sequence
  SiRNA target sequence
ttttccttctaacacgcctgctt

SEQ ID NO: 26542 - DNA, 23 bp, Artificial sequence
  SiRNA target sequence
tttccttctaacacgcctgcttg

SEQ ID NO: 26543 - DNA, 23 bp, Artificial sequence
  SiRNA target sequence
ttccttctaacacgcctgcttgt

SEQ ID NO: 26544 - DNA, 23 bp, Artificial sequence
  SiRNA target sequence
tccttctaacacgcctgcttgta

SEQ ID NO: 26545 - DNA, 23 bp, Artificial sequence
  SiRNA target sequence
ccttctaacacgcctgcttgtag

SEQ ID NO: 26546 - DNA, 23 bp, Artificial sequence
  SiRNA target sequence
cttctaacacgcctgcttgtaga

SEQ ID NO: 26547 - DNA, 23 bp, Artificial sequence
  SiRNA target sequence
ttctaacacgcctgcttgtagag

SEQ ID NO: 26548 - DNA, 23 bp, Artificial sequence
  SiRNA target sequence
tctaacacgcctgcttgtagagc

SEQ ID NO: 26549 - DNA, 23 bp, Artificial sequence
  SiRNA target sequence
ctaacacgcctgcttgtagagcg

SEQ ID NO: 26550 - DNA, 23 bp, Artificial sequence
  SiRNA target sequence
taacacgcctgcttgtagagcgg

SEQ ID NO: 26551 - DNA, 23 bp, Artificial sequence
  SiRNA target sequence
aacacgcctgcttgtagagcggc

SEQ ID NO: 26552 - DNA, 23 bp, Artificial sequence
  SiRNA target sequence
acacgcctgcttgtagagcggcc

SEQ ID NO: 26553 - DNA, 23 bp, Artificial sequence
  SiRNA target sequence
cacgcctgcttgtagagcggccc

SEQ ID NO: 26554 - DNA, 23 bp, Artificial sequence
  SiRNA target sequence
acgcctgcttgtagagcggcccc

SEQ ID NO: 26555 - DNA, 23 bp, Artificial sequence
  SiRNA target sequence
cgcctgcttgtagagcggcccct

SEQ ID NO: 26556 - DNA, 23 bp, Artificial sequence
  SiRNA target sequence
gcctgcttgtagagcggcccctt

SEQ ID NO: 26557 - DNA, 23 bp, Artificial sequence
  SiRNA target sequence
cctgcttgtagagcggccccttt

SEQ ID NO: 26558 - DNA, 23 bp, Artificial sequence
  SiRNA target sequence
ctgcttgtagagcggccccttta

SEQ ID NO: 26559 - DNA, 23 bp, Artificial sequence
  SiRNA target sequence
tgcttgtagagcggcccctttag

SEQ ID NO: 26560 - DNA, 23 bp, Artificial sequence
  SiRNA target sequence
gcttgtagagcggcccctttagc

SEQ ID NO: 26561 - DNA, 23 bp, Artificial sequence
  SiRNA target sequence
cttgtagagcggcccctttagca

SEQ ID NO: 26562 - DNA, 23 bp, Artificial sequence
  SiRNA target sequence
ttgtagagcggcccctttagcaa

SEQ ID NO: 26563 - DNA, 23 bp, Artificial sequence
  SiRNA target sequence
tgtagagcggcccctttagcaac

SEQ ID NO: 26564 - DNA, 23 bp, Artificial sequence
  SiRNA target sequence
gtagagcggcccctttagcaaca

SEQ ID NO: 26565 - DNA, 23 bp, Artificial sequence
  SiRNA target sequence
tagagcggcccctttagcaacag

SEQ ID NO: 26566 - DNA, 23 bp, Artificial sequence
  SiRNA target sequence
agagcggcccctttagcaacagc

SEQ ID NO: 26567 - DNA, 23 bp, Artificial sequence
  SiRNA target sequence
gagcggcccctttagcaacagct

SEQ ID NO: 26568 - DNA, 23 bp, Artificial sequence
  SiRNA target sequence
agcggcccctttagcaacagctt

SEQ ID NO: 26569 - DNA, 23 bp, Artificial sequence
  SiRNA target sequence
gcggcccctttagcaacagcttc

SEQ ID NO: 26570 - DNA, 23 bp, Artificial sequence
  SiRNA target sequence
cggcccctttagcaacagcttca

SEQ ID NO: 26571 - DNA, 23 bp, Artificial sequence
  SiRNA target sequence
ggcccctttagcaacagcttcat

SEQ ID NO: 26572 - DNA, 23 bp, Artificial sequence
  SiRNA target sequence
gcccctttagcaacagcttcatc

SEQ ID NO: 26573 - DNA, 23 bp, Artificial sequence
  SiRNA target sequence
cccctttagcaacagcttcatct

SEQ ID NO: 26574 - DNA, 23 bp, Artificial sequence
  SiRNA target sequence
ccctttagcaacagcttcatctg

SEQ ID NO: 26575 - DNA, 23 bp, Artificial sequence
  SiRNA target sequence
cctttagcaacagcttcatctgg

SEQ ID NO: 26576 - DNA, 23 bp, Artificial sequence
  SiRNA target sequence
ctttagcaacagcttcatctgga

SEQ ID NO: 26577 - DNA, 23 bp, Artificial sequence
  SiRNA target sequence
tttagcaacagcttcatctggat

SEQ ID NO: 26578 - DNA, 23 bp, Artificial sequence
  SiRNA target sequence
ttagcaacagcttcatctggatt

SEQ ID NO: 26579 - DNA, 23 bp, Artificial sequence
  SiRNA target sequence
tagcaacagcttcatctggatta

SEQ ID NO: 26580 - DNA, 23 bp, Artificial sequence
  SiRNA target sequence
agcaacagcttcatctggattaa

SEQ ID NO: 26581 - DNA, 23 bp, Artificial sequence
  SiRNA target sequence
gcaacagcttcatctggattaat

SEQ ID NO: 26582 - DNA, 23 bp, Artificial sequence
  SiRNA target sequence
caacagcttcatctggattaata

SEQ ID NO: 26583 - DNA, 23 bp, Artificial sequence
  SiRNA target sequence
aacagcttcatctggattaatat

SEQ ID NO: 26584 - DNA, 23 bp, Artificial sequence
  SiRNA target sequence
acagcttcatctggattaatatt

SEQ ID NO: 26585 - DNA, 23 bp, Artificial sequence
  SiRNA target sequence
cagcttcatctggattaatattt

SEQ ID NO: 26586 - DNA, 23 bp, Artificial sequence
  SiRNA target sequence
agcttcatctggattaatatttg

SEQ ID NO: 26587 - DNA, 23 bp, Artificial sequence
  SiRNA target sequence
gcttcatctggattaatatttgt

SEQ ID NO: 26588 - DNA, 23 bp, Artificial sequence
  SiRNA target sequence
cttcatctggattaatatttgta

SEQ ID NO: 26589 - DNA, 23 bp, Artificial sequence
  SiRNA target sequence
ttcatctggattaatatttgtag

SEQ ID NO: 26590 - DNA, 23 bp, Artificial sequence
  SiRNA target sequence
tcatctggattaatatttgtaga

SEQ ID NO: 26591 - DNA, 23 bp, Artificial sequence
  SiRNA target sequence
catctggattaatatttgtagaa

SEQ ID NO: 26592 - DNA, 23 bp, Artificial sequence
  SiRNA target sequence
atctggattaatatttgtagaag

SEQ ID NO: 26593 - DNA, 23 bp, Artificial sequence
  SiRNA target sequence
tctggattaatatttgtagaagg

SEQ ID NO: 26594 - DNA, 23 bp, Artificial sequence
  SiRNA target sequence
ctggattaatatttgtagaaggc

SEQ ID NO: 26595 - DNA, 23 bp, Artificial sequence
  SiRNA target sequence
tggattaatatttgtagaaggct

SEQ ID NO: 26596 - DNA, 23 bp, Artificial sequence
  SiRNA target sequence
ggattaatatttgtagaaggctc

SEQ ID NO: 26597 - DNA, 23 bp, Artificial sequence
  SiRNA target sequence
gattaatatttgtagaaggctcg

SEQ ID NO: 26598 - DNA, 23 bp, Artificial sequence
  SiRNA target sequence
attaatatttgtagaaggctcga

SEQ ID NO: 26599 - DNA, 23 bp, Artificial sequence
  SiRNA target sequence
ttaatatttgtagaaggctcgat

SEQ ID NO: 26600 - DNA, 23 bp, Artificial sequence
  SiRNA target sequence
taatatttgtagaaggctcgata

SEQ ID NO: 26601 - DNA, 23 bp, Artificial sequence
  SiRNA target sequence
aatatttgtagaaggctcgatac

SEQ ID NO: 26602 - DNA, 23 bp, Artificial sequence
  SiRNA target sequence
atatttgtagaaggctcgatacc

SEQ ID NO: 26603 - DNA, 23 bp, Artificial sequence
  SiRNA target sequence
tatttgtagaaggctcgatacca

SEQ ID NO: 26604 - DNA, 23 bp, Artificial sequence
  SiRNA target sequence
atttgtagaaggctcgataccaa

SEQ ID NO: 26605 - DNA, 23 bp, Artificial sequence
  SiRNA target sequence
tttgtagaaggctcgataccaaa

SEQ ID NO: 26606 - DNA, 23 bp, Artificial sequence
  SiRNA target sequence
ttgtagaaggctcgataccaaaa

SEQ ID NO: 26607 - DNA, 23 bp, Artificial sequence
  SiRNA target sequence
tgtagaaggctcgataccaaaaa

SEQ ID NO: 26608 - DNA, 23 bp, Artificial sequence
  SiRNA target sequence
gtagaaggctcgataccaaaaat

SEQ ID NO: 26609 - DNA, 23 bp, Artificial sequence
  SiRNA target sequence
tagaaggctcgataccaaaaatc

SEQ ID NO: 26610 - DNA, 23 bp, Artificial sequence
  SiRNA target sequence
agaaggctcgataccaaaaatct

SEQ ID NO: 26611 - DNA, 23 bp, Artificial sequence
  SiRNA target sequence
gaaggctcgataccaaaaatctt

SEQ ID NO: 26612 - DNA, 23 bp, Artificial sequence
  SiRNA target sequence
aaggctcgataccaaaaatcttc

SEQ ID NO: 26613 - DNA, 23 bp, Artificial sequence
  SiRNA target sequence
aggctcgataccaaaaatcttct

SEQ ID NO: 26614 - DNA, 23 bp, Artificial sequence
  SiRNA target sequence
ggctcgataccaaaaatcttctt

SEQ ID NO: 26615 - DNA, 23 bp, Artificial sequence
  SiRNA target sequence
gctcgataccaaaaatcttctta

SEQ ID NO: 26616 - DNA, 23 bp, Artificial sequence
  SiRNA target sequence
ctcgataccaaaaatcttcttaa

SEQ ID NO: 26617 - DNA, 23 bp, Artificial sequence
  SiRNA target sequence
tcgataccaaaaatcttcttaac

SEQ ID NO: 26618 - DNA, 23 bp, Artificial sequence
  SiRNA target sequence
cgataccaaaaatcttcttaaca

SEQ ID NO: 26619 - DNA, 23 bp, Artificial sequence
  SiRNA target sequence
gataccaaaaatcttcttaacaa

SEQ ID NO: 26620 - DNA, 23 bp, Artificial sequence
  SiRNA target sequence
ataccaaaaatcttcttaacaag

SEQ ID NO: 26621 - DNA, 23 bp, Artificial sequence
  SiRNA target sequence
taccaaaaatcttcttaacaagt

SEQ ID NO: 26622 - DNA, 23 bp, Artificial sequence
  SiRNA target sequence
accaaaaatcttcttaacaagtt

SEQ ID NO: 26623 - DNA, 23 bp, Artificial sequence
  SiRNA target sequence
ccaaaaatcttcttaacaagttt

SEQ ID NO: 26624 - DNA, 23 bp, Artificial sequence
  SiRNA target sequence
caaaaatcttcttaacaagtttt

SEQ ID NO: 26625 - DNA, 23 bp, Artificial sequence
  SiRNA target sequence
aaaaatcttcttaacaagttttc

SEQ ID NO: 26626 - DNA, 23 bp, Artificial sequence
  SiRNA target sequence
aaaatcttcttaacaagttttct

SEQ ID NO: 26627 - DNA, 23 bp, Artificial sequence
  SiRNA target sequence
aaatcttcttaacaagttttcta

SEQ ID NO: 26628 - DNA, 23 bp, Artificial sequence
  SiRNA target sequence
aatcttcttaacaagttttctaa

SEQ ID NO: 26629 - DNA, 23 bp, Artificial sequence
  SiRNA target sequence
atcttcttaacaagttttctaac

SEQ ID NO: 26630 - DNA, 23 bp, Artificial sequence
  SiRNA target sequence
tcttcttaacaagttttctaaca

SEQ ID NO: 26631 - DNA, 23 bp, Artificial sequence
  SiRNA target sequence
cttcttaacaagttttctaacat

SEQ ID NO: 26632 - DNA, 23 bp, Artificial sequence
  SiRNA target sequence
ttcttaacaagttttctaacata

SEQ ID NO: 26633 - DNA, 23 bp, Artificial sequence
  SiRNA target sequence
tcttaacaagttttctaacatac

SEQ ID NO: 26634 - DNA, 23 bp, Artificial sequence
  SiRNA target sequence
cttaacaagttttctaacatacg

SEQ ID NO: 26635 - DNA, 23 bp, Artificial sequence
  SiRNA target sequence
ttaacaagttttctaacatacgg

SEQ ID NO: 26636 - DNA, 23 bp, Artificial sequence
  SiRNA target sequence
taacaagttttctaacatacggc

SEQ ID NO: 26637 - DNA, 23 bp, Artificial sequence
  SiRNA target sequence
aacaagttttctaacatacggca

SEQ ID NO: 26638 - DNA, 23 bp, Artificial sequence
  SiRNA target sequence
acaagttttctaacatacggcat

SEQ ID NO: 26639 - DNA, 23 bp, Artificial sequence
  SiRNA target sequence
caagttttctaacatacggcatt

SEQ ID NO: 26640 - DNA, 23 bp, Artificial sequence
  SiRNA target sequence
aagttttctaacatacggcattc

SEQ ID NO: 26641 - DNA, 23 bp, Artificial sequence
  SiRNA target sequence
agttttctaacatacggcattcg

SEQ ID NO: 26642 - DNA, 23 bp, Artificial sequence
  SiRNA target sequence
gttttctaacatacggcattcgt

SEQ ID NO: 26643 - DNA, 23 bp, Artificial sequence
  SiRNA target sequence
ttttctaacatacggcattcgtg

SEQ ID NO: 26644 - DNA, 23 bp, Artificial sequence
  SiRNA target sequence
tttctaacatacggcattcgtgt

SEQ ID NO: 26645 - DNA, 23 bp, Artificial sequence
  SiRNA target sequence
ttctaacatacggcattcgtgtc

SEQ ID NO: 26646 - DNA, 23 bp, Artificial sequence
  SiRNA target sequence
tctaacatacggcattcgtgtca

SEQ ID NO: 26647 - DNA, 23 bp, Artificial sequence
  SiRNA target sequence
ctaacatacggcattcgtgtcat

SEQ ID NO: 26648 - DNA, 23 bp, Artificial sequence
  SiRNA target sequence
taacatacggcattcgtgtcatt

SEQ ID NO: 26649 - DNA, 23 bp, Artificial sequence
  SiRNA target sequence
aacatacggcattcgtgtcattc

SEQ ID NO: 26650 - DNA, 23 bp, Artificial sequence
  SiRNA target sequence
acatacggcattcgtgtcattcc

SEQ ID NO: 26651 - DNA, 23 bp, Artificial sequence
  SiRNA target sequence
catacggcattcgtgtcattcca

SEQ ID NO: 26652 - DNA, 23 bp, Artificial sequence
  SiRNA target sequence
atacggcattcgtgtcattccac

SEQ ID NO: 26653 - DNA, 23 bp, Artificial sequence
  SiRNA target sequence
tacggcattcgtgtcattccacc

SEQ ID NO: 26654 - DNA, 23 bp, Artificial sequence
  SiRNA target sequence
acggcattcgtgtcattccaccc

SEQ ID NO: 26655 - DNA, 23 bp, Artificial sequence
  SiRNA target sequence
cggcattcgtgtcattccaccca

SEQ ID NO: 26656 - DNA, 23 bp, Artificial sequence
  SiRNA target sequence
ggcattcgtgtcattccacccac

SEQ ID NO: 26657 - DNA, 23 bp, Artificial sequence
  SiRNA target sequence
gcattcgtgtcattccacccaca

SEQ ID NO: 26658 - DNA, 23 bp, Artificial sequence
  SiRNA target sequence
cattcgtgtcattccacccacaa

SEQ ID NO: 26659 - DNA, 23 bp, Artificial sequence
  SiRNA target sequence
attcgtgtcattccacccacaag

SEQ ID NO: 26660 - DNA, 23 bp, Artificial sequence
  SiRNA target sequence
ttcgtgtcattccacccacaagt

SEQ ID NO: 26661 - DNA, 23 bp, Artificial sequence
  SiRNA target sequence
tcgtgtcattccacccacaagta

SEQ ID NO: 26662 - DNA, 23 bp, Artificial sequence
  SiRNA target sequence
cgtgtcattccacccacaagtat

SEQ ID NO: 26663 - DNA, 23 bp, Artificial sequence
  SiRNA target sequence
gtgtcattccacccacaagtata

SEQ ID NO: 26664 - DNA, 23 bp, Artificial sequence
  SiRNA target sequence
tgtcattccacccacaagtataa

SEQ ID NO: 26665 - DNA, 23 bp, Artificial sequence
  SiRNA target sequence
gtcattccacccacaagtataac

SEQ ID NO: 26666 - DNA, 23 bp, Artificial sequence
  SiRNA target sequence
tcattccacccacaagtataacg

SEQ ID NO: 26667 - DNA, 23 bp, Artificial sequence
  SiRNA target sequence
cattccacccacaagtataacgt

SEQ ID NO: 26668 - DNA, 23 bp, Artificial sequence
  SiRNA target sequence
attccacccacaagtataacgtg

SEQ ID NO: 26669 - DNA, 23 bp, Artificial sequence
  SiRNA target sequence
ttccacccacaagtataacgtgt

SEQ ID NO: 26670 - DNA, 23 bp, Artificial sequence
  SiRNA target sequence
tccacccacaagtataacgtgtt

SEQ ID NO: 26671 - DNA, 23 bp, Artificial sequence
  SiRNA target sequence
ccacccacaagtataacgtgttt

SEQ ID NO: 26672 - DNA, 23 bp, Artificial sequence
  SiRNA target sequence
cacccacaagtataacgtgttta

SEQ ID NO: 26673 - DNA, 23 bp, Artificial sequence
  SiRNA target sequence
acccacaagtataacgtgtttaa

SEQ ID NO: 26674 - DNA, 23 bp, Artificial sequence
  SiRNA target sequence
cccacaagtataacgtgtttaat

SEQ ID NO: 26675 - DNA, 23 bp, Artificial sequence
  SiRNA target sequence
ccacaagtataacgtgtttaata

SEQ ID NO: 26676 - DNA, 23 bp, Artificial sequence
  SiRNA target sequence
cacaagtataacgtgtttaatat

SEQ ID NO: 26677 - DNA, 23 bp, Artificial sequence
  SiRNA target sequence
acaagtataacgtgtttaatatc

SEQ ID NO: 26678 - DNA, 23 bp, Artificial sequence
  SiRNA target sequence
caagtataacgtgtttaatatca

SEQ ID NO: 26679 - DNA, 23 bp, Artificial sequence
  SiRNA target sequence
aagtataacgtgtttaatatcac

SEQ ID NO: 26680 - DNA, 23 bp, Artificial sequence
  SiRNA target sequence
agtataacgtgtttaatatcact

SEQ ID NO: 26681 - DNA, 23 bp, Artificial sequence
  SiRNA target sequence
gtataacgtgtttaatatcactt

SEQ ID NO: 26682 - DNA, 23 bp, Artificial sequence
  SiRNA target sequence
tataacgtgtttaatatcacttt

SEQ ID NO: 26683 - DNA, 23 bp, Artificial sequence
  SiRNA target sequence
ataacgtgtttaatatcactttt

SEQ ID NO: 26684 - DNA, 23 bp, Artificial sequence
  SiRNA target sequence
taacgtgtttaatatcactttta

SEQ ID NO: 26685 - DNA, 23 bp, Artificial sequence
  SiRNA target sequence
aacgtgtttaatatcacttttag

SEQ ID NO: 26686 - DNA, 23 bp, Artificial sequence
  SiRNA target sequence
acgtgtttaatatcacttttagt

SEQ ID NO: 26687 - DNA, 23 bp, Artificial sequence
  SiRNA target sequence
cgtgtttaatatcacttttagtt

SEQ ID NO: 26688 - DNA, 23 bp, Artificial sequence
  SiRNA target sequence
gtgtttaatatcacttttagtta

SEQ ID NO: 26689 - DNA, 23 bp, Artificial sequence
  SiRNA target sequence
tgtttaatatcacttttagttat

SEQ ID NO: 26690 - DNA, 23 bp, Artificial sequence
  SiRNA target sequence
gtttaatatcacttttagttata

SEQ ID NO: 26691 - DNA, 23 bp, Artificial sequence
  SiRNA target sequence
tttaatatcacttttagttatat

SEQ ID NO: 26692 - DNA, 23 bp, Artificial sequence
  SiRNA target sequence
ttaatatcacttttagttatatt

SEQ ID NO: 26693 - DNA, 23 bp, Artificial sequence
  SiRNA target sequence
taatatcacttttagttatattg

SEQ ID NO: 26694 - DNA, 23 bp, Artificial sequence
  SiRNA target sequence
aatatcacttttagttatattgg

SEQ ID NO: 26695 - DNA, 23 bp, Artificial sequence
  SiRNA target sequence
atatcacttttagttatattggc

SEQ ID NO: 26696 - DNA, 23 bp, Artificial sequence
  SiRNA target sequence
tatcacttttagttatattggca

SEQ ID NO: 26697 - DNA, 23 bp, Artificial sequence
  SiRNA target sequence
atcacttttagttatattggcat

SEQ ID NO: 26698 - DNA, 23 bp, Artificial sequence
  SiRNA target sequence
tcacttttagttatattggcatc

SEQ ID NO: 26699 - DNA, 23 bp, Artificial sequence
  SiRNA target sequence
cacttttagttatattggcatct

SEQ ID NO: 26700 - DNA, 23 bp, Artificial sequence
  SiRNA target sequence
acttttagttatattggcatctc

SEQ ID NO: 26701 - DNA, 23 bp, Artificial sequence
  SiRNA target sequence
cttttagttatattggcatctct

SEQ ID NO: 26702 - DNA, 23 bp, Artificial sequence
  SiRNA target sequence
ttttagttatattggcatctcta

SEQ ID NO: 26703 - DNA, 23 bp, Artificial sequence
  SiRNA target sequence
tttagttatattggcatctctaa

SEQ ID NO: 26704 - DNA, 23 bp, Artificial sequence
  SiRNA target sequence
ttagttatattggcatctctaat

SEQ ID NO: 26705 - DNA, 23 bp, Artificial sequence
  SiRNA target sequence
tagttatattggcatctctaata

SEQ ID NO: 26706 - DNA, 23 bp, Artificial sequence
  SiRNA target sequence
agttatattggcatctctaatag

SEQ ID NO: 26707 - DNA, 23 bp, Artificial sequence
  SiRNA target sequence
gttatattggcatctctaatagc

SEQ ID NO: 26708 - DNA, 23 bp, Artificial sequence
  SiRNA target sequence
ttatattggcatctctaatagct

SEQ ID NO: 26709 - DNA, 23 bp, Artificial sequence
  SiRNA target sequence
tatattggcatctctaatagctt

SEQ ID NO: 26710 - DNA, 23 bp, Artificial sequence
  SiRNA target sequence
atattggcatctctaatagcttt

SEQ ID NO: 26711 - DNA, 23 bp, Artificial sequence
  SiRNA target sequence
tattggcatctctaatagcttta

SEQ ID NO: 26712 - DNA, 23 bp, Artificial sequence
  SiRNA target sequence
attggcatctctaatagctttaa

SEQ ID NO: 26713 - DNA, 23 bp, Artificial sequence
  SiRNA target sequence
ttggcatctctaatagctttaag

SEQ ID NO: 26714 - DNA, 23 bp, Artificial sequence
  SiRNA target sequence
tggcatctctaatagctttaaga

SEQ ID NO: 26715 - DNA, 23 bp, Artificial sequence
  SiRNA target sequence
ggcatctctaatagctttaagac

SEQ ID NO: 26716 - DNA, 23 bp, Artificial sequence
  SiRNA target sequence
gcatctctaatagctttaagaca

SEQ ID NO: 26717 - DNA, 23 bp, Artificial sequence
  SiRNA target sequence
catctctaatagctttaagacag

SEQ ID NO: 26718 - DNA, 23 bp, Artificial sequence
  SiRNA target sequence
atctctaatagctttaagacagg

SEQ ID NO: 26719 - DNA, 23 bp, Artificial sequence
  SiRNA target sequence
tctctaatagctttaagacaggg

SEQ ID NO: 26720 - DNA, 23 bp, Artificial sequence
  SiRNA target sequence
ctctaatagctttaagacagggg

SEQ ID NO: 26721 - DNA, 23 bp, Artificial sequence
  SiRNA target sequence
tctaatagctttaagacaggggt

SEQ ID NO: 26722 - DNA, 23 bp, Artificial sequence
  SiRNA target sequence
ctaatagctttaagacaggggtt

SEQ ID NO: 26723 - DNA, 23 bp, Artificial sequence
  SiRNA target sequence
taatagctttaagacaggggttt

SEQ ID NO: 26724 - DNA, 23 bp, Artificial sequence
  SiRNA target sequence
aatagctttaagacaggggttta

SEQ ID NO: 26725 - DNA, 23 bp, Artificial sequence
  SiRNA target sequence
atagctttaagacaggggtttat

SEQ ID NO: 26726 - DNA, 23 bp, Artificial sequence
  SiRNA target sequence
tagctttaagacaggggtttatt

SEQ ID NO: 26727 - DNA, 23 bp, Artificial sequence
  SiRNA target sequence
agctttaagacaggggtttattg

SEQ ID NO: 26728 - DNA, 23 bp, Artificial sequence
  SiRNA target sequence
gctttaagacaggggtttattgt

SEQ ID NO: 26729 - DNA, 23 bp, Artificial sequence
  SiRNA target sequence
ctttaagacaggggtttattgtt

SEQ ID NO: 26730 - DNA, 23 bp, Artificial sequence
  SiRNA target sequence
tttaagacaggggtttattgttt

SEQ ID NO: 26731 - DNA, 23 bp, Artificial sequence
  SiRNA target sequence
ttaagacaggggtttattgtttt

SEQ ID NO: 26732 - DNA, 23 bp, Artificial sequence
  SiRNA target sequence
taagacaggggtttattgttttg

SEQ ID NO: 26733 - DNA, 23 bp, Artificial sequence
  SiRNA target sequence
aagacaggggtttattgttttgt

SEQ ID NO: 26734 - DNA, 23 bp, Artificial sequence
  SiRNA target sequence
agacaggggtttattgttttgtc

SEQ ID NO: 26735 - DNA, 23 bp, Artificial sequence
  SiRNA target sequence
gacaggggtttattgttttgtct

SEQ ID NO: 26736 - DNA, 23 bp, Artificial sequence
  SiRNA target sequence
acaggggtttattgttttgtcta

SEQ ID NO: 26737 - DNA, 23 bp, Artificial sequence
  SiRNA target sequence
caggggtttattgttttgtctat

SEQ ID NO: 26738 - DNA, 23 bp, Artificial sequence
  SiRNA target sequence
aggggtttattgttttgtctatt

SEQ ID NO: 26739 - DNA, 23 bp, Artificial sequence
  SiRNA target sequence
ggggtttattgttttgtctatta

SEQ ID NO: 26740 - DNA, 23 bp, Artificial sequence
  SiRNA target sequence
gggtttattgttttgtctattaa

SEQ ID NO: 26741 - DNA, 23 bp, Artificial sequence
  SiRNA target sequence
ggtttattgttttgtctattaac

SEQ ID NO: 26742 - DNA, 23 bp, Artificial sequence
  SiRNA target sequence
gtttattgttttgtctattaact

SEQ ID NO: 26743 - DNA, 23 bp, Artificial sequence
  SiRNA target sequence
tttattgttttgtctattaactt

SEQ ID NO: 26744 - DNA, 23 bp, Artificial sequence
  SiRNA target sequence
ttattgttttgtctattaacttt

SEQ ID NO: 26745 - DNA, 23 bp, Artificial sequence
  SiRNA target sequence
tattgttttgtctattaactttt

SEQ ID NO: 26746 - DNA, 23 bp, Artificial sequence
  SiRNA target sequence
attgttttgtctattaacttttt

SEQ ID NO: 26747 - DNA, 23 bp, Artificial sequence
  SiRNA target sequence
ttgttttgtctattaactttttt

SEQ ID NO: 26748 - DNA, 23 bp, Artificial sequence
  SiRNA target sequence
tgttttgtctattaacttttttg

SEQ ID NO: 26749 - DNA, 23 bp, Artificial sequence
  SiRNA target sequence
gttttgtctattaacttttttgt

SEQ ID NO: 26750 - DNA, 23 bp, Artificial sequence
  SiRNA target sequence
ttttgtctattaacttttttgta

SEQ ID NO: 26751 - DNA, 23 bp, Artificial sequence
  SiRNA target sequence
tttgtctattaacttttttgtaa

SEQ ID NO: 26752 - DNA, 23 bp, Artificial sequence
  SiRNA target sequence
ttgtctattaacttttttgtaat

SEQ ID NO: 26753 - DNA, 23 bp, Artificial sequence
  SiRNA target sequence
tgtctattaacttttttgtaatt

SEQ ID NO: 26754 - DNA, 23 bp, Artificial sequence
  SiRNA target sequence
gtctattaacttttttgtaattt

SEQ ID NO: 26755 - DNA, 23 bp, Artificial sequence
  SiRNA target sequence
tctattaacttttttgtaatttt

SEQ ID NO: 26756 - DNA, 23 bp, Artificial sequence
  SiRNA target sequence
ctattaacttttttgtaattttt

SEQ ID NO: 26757 - DNA, 23 bp, Artificial sequence
  SiRNA target sequence
tattaacttttttgtaatttttt

SEQ ID NO: 26758 - DNA, 23 bp, Artificial sequence
  SiRNA target sequence
attaacttttttgtaattttttc

SEQ ID NO: 26759 - DNA, 23 bp, Artificial sequence
  SiRNA target sequence
ttaacttttttgtaattttttca

SEQ ID NO: 26760 - DNA, 23 bp, Artificial sequence
  SiRNA target sequence
taacttttttgtaattttttcaa

SEQ ID NO: 26761 - DNA, 23 bp, Artificial sequence
  SiRNA target sequence
aacttttttgtaattttttcaaa

SEQ ID NO: 26762 - DNA, 23 bp, Artificial sequence
  SiRNA target sequence
acttttttgtaattttttcaaat

SEQ ID NO: 26763 - DNA, 23 bp, Artificial sequence
  SiRNA target sequence
cttttttgtaattttttcaaatt

SEQ ID NO: 26764 - DNA, 23 bp, Artificial sequence
  SiRNA target sequence
ttttttgtaattttttcaaattc

SEQ ID NO: 26765 - DNA, 23 bp, Artificial sequence
  SiRNA target sequence
tttttgtaattttttcaaattcg

SEQ ID NO: 26766 - DNA, 23 bp, Artificial sequence
  SiRNA target sequence
ttttgtaattttttcaaattcgt

SEQ ID NO: 26767 - DNA, 23 bp, Artificial sequence
  SiRNA target sequence
tttgtaattttttcaaattcgtc

SEQ ID NO: 26768 - DNA, 23 bp, Artificial sequence
  SiRNA target sequence
ttgtaattttttcaaattcgtcg

SEQ ID NO: 26769 - DNA, 23 bp, Artificial sequence
  SiRNA target sequence
tgtaattttttcaaattcgtcgc

SEQ ID NO: 26770 - DNA, 23 bp, Artificial sequence
  SiRNA target sequence
gtaattttttcaaattcgtcgcg

SEQ ID NO: 26771 - DNA, 23 bp, Artificial sequence
  SiRNA target sequence
taattttttcaaattcgtcgcgt

SEQ ID NO: 26772 - DNA, 23 bp, Artificial sequence
  SiRNA target sequence
aattttttcaaattcgtcgcgtg

SEQ ID NO: 26773 - DNA, 23 bp, Artificial sequence
  SiRNA target sequence
attttttcaaattcgtcgcgtgt

SEQ ID NO: 26774 - DNA, 23 bp, Artificial sequence
  SiRNA target sequence
ttttttcaaattcgtcgcgtgta

SEQ ID NO: 26775 - DNA, 23 bp, Artificial sequence
  SiRNA target sequence
tttttcaaattcgtcgcgtgtaa

SEQ ID NO: 26776 - DNA, 23 bp, Artificial sequence
  SiRNA target sequence
ttttcaaattcgtcgcgtgtaat

SEQ ID NO: 26777 - DNA, 23 bp, Artificial sequence
  SiRNA target sequence
tttcaaattcgtcgcgtgtaatt

SEQ ID NO: 26778 - DNA, 23 bp, Artificial sequence
  SiRNA target sequence
ttcaaattcgtcgcgtgtaatta

SEQ ID NO: 26779 - DNA, 23 bp, Artificial sequence
  SiRNA target sequence
tcaaattcgtcgcgtgtaattac

SEQ ID NO: 26780 - DNA, 23 bp, Artificial sequence
  SiRNA target sequence
caaattcgtcgcgtgtaattacc

SEQ ID NO: 26781 - DNA, 23 bp, Artificial sequence
  SiRNA target sequence
aaattcgtcgcgtgtaattacct

SEQ ID NO: 26782 - DNA, 23 bp, Artificial sequence
  SiRNA target sequence
aattcgtcgcgtgtaattacctc

SEQ ID NO: 26783 - DNA, 23 bp, Artificial sequence
  SiRNA target sequence
attcgtcgcgtgtaattacctct

SEQ ID NO: 26784 - DNA, 23 bp, Artificial sequence
  SiRNA target sequence
ttcgtcgcgtgtaattacctctt

SEQ ID NO: 26785 - DNA, 23 bp, Artificial sequence
  SiRNA target sequence
tcgtcgcgtgtaattacctcttt

SEQ ID NO: 26786 - DNA, 23 bp, Artificial sequence
  SiRNA target sequence
cgtcgcgtgtaattacctctttt

SEQ ID NO: 26787 - DNA, 23 bp, Artificial sequence
  SiRNA target sequence
gtcgcgtgtaattacctctttta

SEQ ID NO: 26788 - DNA, 23 bp, Artificial sequence
  SiRNA target sequence
tcgcgtgtaattacctcttttaa

SEQ ID NO: 26789 - DNA, 23 bp, Artificial sequence
  SiRNA target sequence
cgcgtgtaattacctcttttaag

SEQ ID NO: 26790 - DNA, 23 bp, Artificial sequence
  SiRNA target sequence
gcgtgtaattacctcttttaagt

SEQ ID NO: 26791 - DNA, 23 bp, Artificial sequence
  SiRNA target sequence
cgtgtaattacctcttttaagtg

SEQ ID NO: 26792 - DNA, 23 bp, Artificial sequence
  SiRNA target sequence
gtgtaattacctcttttaagtga

SEQ ID NO: 26793 - DNA, 23 bp, Artificial sequence
  SiRNA target sequence
tgtaattacctcttttaagtgat

SEQ ID NO: 26794 - DNA, 23 bp, Artificial sequence
  SiRNA target sequence
gtaattacctcttttaagtgata

SEQ ID NO: 26795 - DNA, 23 bp, Artificial sequence
  SiRNA target sequence
taattacctcttttaagtgataa

SEQ ID NO: 26796 - DNA, 23 bp, Artificial sequence
  SiRNA target sequence
aattacctcttttaagtgataat

SEQ ID NO: 26797 - DNA, 23 bp, Artificial sequence
  SiRNA target sequence
attacctcttttaagtgataatt

SEQ ID NO: 26798 - DNA, 23 bp, Artificial sequence
  SiRNA target sequence
ttacctcttttaagtgataattc

SEQ ID NO: 26799 - DNA, 23 bp, Artificial sequence
  SiRNA target sequence
tacctcttttaagtgataattct

SEQ ID NO: 26800 - DNA, 23 bp, Artificial sequence
  SiRNA target sequence
acctcttttaagtgataattctt

SEQ ID NO: 26801 - DNA, 23 bp, Artificial sequence
  SiRNA target sequence
cctcttttaagtgataattcttt

SEQ ID NO: 26802 - DNA, 23 bp, Artificial sequence
  SiRNA target sequence
ctcttttaagtgataattctttt

SEQ ID NO: 26803 - DNA, 23 bp, Artificial sequence
  SiRNA target sequence
tcttttaagtgataattcttttt

SEQ ID NO: 26804 - DNA, 23 bp, Artificial sequence
  SiRNA target sequence
cttttaagtgataattcttttta

SEQ ID NO: 26805 - DNA, 23 bp, Artificial sequence
  SiRNA target sequence
ttttaagtgataattctttttac

SEQ ID NO: 26806 - DNA, 23 bp, Artificial sequence
  SiRNA target sequence
tttaagtgataattctttttact

SEQ ID NO: 26807 - DNA, 23 bp, Artificial sequence
  SiRNA target sequence
ttaagtgataattctttttacta

SEQ ID NO: 26808 - DNA, 23 bp, Artificial sequence
  SiRNA target sequence
taagtgataattctttttactat

SEQ ID NO: 26809 - DNA, 23 bp, Artificial sequence
  SiRNA target sequence
aagtgataattctttttactatc

SEQ ID NO: 26810 - DNA, 23 bp, Artificial sequence
  SiRNA target sequence
agtgataattctttttactatcg

SEQ ID NO: 26811 - DNA, 23 bp, Artificial sequence
  SiRNA target sequence
gtgataattctttttactatcgt

SEQ ID NO: 26812 - DNA, 23 bp, Artificial sequence
  SiRNA target sequence
tgataattctttttactatcgtt

SEQ ID NO: 26813 - DNA, 23 bp, Artificial sequence
  SiRNA target sequence
gataattctttttactatcgtta

SEQ ID NO: 26814 - DNA, 23 bp, Artificial sequence
  SiRNA target sequence
ataattctttttactatcgttat

SEQ ID NO: 26815 - DNA, 23 bp, Artificial sequence
  SiRNA target sequence
taattctttttactatcgttata

SEQ ID NO: 26816 - DNA, 23 bp, Artificial sequence
  SiRNA target sequence
aattctttttactatcgttataa

SEQ ID NO: 26817 - DNA, 23 bp, Artificial sequence
  SiRNA target sequence
attctttttactatcgttataaa

SEQ ID NO: 26818 - DNA, 23 bp, Artificial sequence
  SiRNA target sequence
ttctttttactatcgttataaat

SEQ ID NO: 26819 - DNA, 23 bp, Artificial sequence
  SiRNA target sequence
tctttttactatcgttataaata

SEQ ID NO: 26820 - DNA, 23 bp, Artificial sequence
  SiRNA target sequence
ctttttactatcgttataaatat

SEQ ID NO: 26821 - DNA, 23 bp, Artificial sequence
  SiRNA target sequence
tttttactatcgttataaatata

SEQ ID NO: 26822 - DNA, 23 bp, Artificial sequence
  SiRNA target sequence
ttttactatcgttataaatatac

SEQ ID NO: 26823 - DNA, 23 bp, Artificial sequence
  SiRNA target sequence
tttactatcgttataaatatacg

SEQ ID NO: 26824 - DNA, 23 bp, Artificial sequence
  SiRNA target sequence
ttactatcgttataaatatacgg

SEQ ID NO: 26825 - DNA, 23 bp, Artificial sequence
  SiRNA target sequence
tactatcgttataaatatacgga

SEQ ID NO: 26826 - DNA, 23 bp, Artificial sequence
  SiRNA target sequence
actatcgttataaatatacggaa

SEQ ID NO: 26827 - DNA, 23 bp, Artificial sequence
  SiRNA target sequence
ctatcgttataaatatacggaat

SEQ ID NO: 26828 - DNA, 23 bp, Artificial sequence
  SiRNA target sequence
tatcgttataaatatacggaata

SEQ ID NO: 26829 - DNA, 23 bp, Artificial sequence
  SiRNA target sequence
atcgttataaatatacggaatat

SEQ ID NO: 26830 - DNA, 23 bp, Artificial sequence
  SiRNA target sequence
tcgttataaatatacggaatatt

SEQ ID NO: 26831 - DNA, 23 bp, Artificial sequence
  SiRNA target sequence
cgttataaatatacggaatatta

SEQ ID NO: 26832 - DNA, 23 bp, Artificial sequence
  SiRNA target sequence
gttataaatatacggaatattaa

SEQ ID NO: 26833 - DNA, 23 bp, Artificial sequence
  SiRNA target sequence
ttataaatatacggaatattaat

SEQ ID NO: 26834 - DNA, 23 bp, Artificial sequence
  SiRNA target sequence
tataaatatacggaatattaatt

SEQ ID NO: 26835 - DNA, 23 bp, Artificial sequence
  SiRNA target sequence
ataaatatacggaatattaattt

SEQ ID NO: 26836 - DNA, 23 bp, Artificial sequence
  SiRNA target sequence
taaatatacggaatattaatttc

SEQ ID NO: 26837 - DNA, 23 bp, Artificial sequence
  SiRNA target sequence
aaatatacggaatattaatttca

SEQ ID NO: 26838 - DNA, 23 bp, Artificial sequence
  SiRNA target sequence
aatatacggaatattaatttcag

SEQ ID NO: 26839 - DNA, 23 bp, Artificial sequence
  SiRNA target sequence
atatacggaatattaatttcaga

SEQ ID NO: 26840 - DNA, 23 bp, Artificial sequence
  SiRNA target sequence
tatacggaatattaatttcagac

SEQ ID NO: 26841 - DNA, 23 bp, Artificial sequence
  SiRNA target sequence
atacggaatattaatttcagacg

SEQ ID NO: 26842 - DNA, 23 bp, Artificial sequence
  SiRNA target sequence
tacggaatattaatttcagacga

SEQ ID NO: 26843 - DNA, 23 bp, Artificial sequence
  SiRNA target sequence
acggaatattaatttcagacgaa

SEQ ID NO: 26844 - DNA, 23 bp, Artificial sequence
  SiRNA target sequence
cggaatattaatttcagacgaaa

SEQ ID NO: 26845 - DNA, 23 bp, Artificial sequence
  SiRNA target sequence
ggaatattaatttcagacgaaag

SEQ ID NO: 26846 - DNA, 23 bp, Artificial sequence
  SiRNA target sequence
gaatattaatttcagacgaaaga

SEQ ID NO: 26847 - DNA, 23 bp, Artificial sequence
  SiRNA target sequence
aatattaatttcagacgaaagat

SEQ ID NO: 26848 - DNA, 23 bp, Artificial sequence
  SiRNA target sequence
atattaatttcagacgaaagatt

SEQ ID NO: 26849 - DNA, 23 bp, Artificial sequence
  SiRNA target sequence
tattaatttcagacgaaagatta

SEQ ID NO: 26850 - DNA, 23 bp, Artificial sequence
  SiRNA target sequence
attaatttcagacgaaagattag

SEQ ID NO: 26851 - DNA, 23 bp, Artificial sequence
  SiRNA target sequence
ttaatttcagacgaaagattaga

SEQ ID NO: 26852 - DNA, 23 bp, Artificial sequence
  SiRNA target sequence
taatttcagacgaaagattagac

SEQ ID NO: 26853 - DNA, 23 bp, Artificial sequence
  SiRNA target sequence
aatttcagacgaaagattagacg

SEQ ID NO: 26854 - DNA, 23 bp, Artificial sequence
  SiRNA target sequence
atttcagacgaaagattagacga

SEQ ID NO: 26855 - DNA, 23 bp, Artificial sequence
  SiRNA target sequence
tttcagacgaaagattagacgac

SEQ ID NO: 26856 - DNA, 23 bp, Artificial sequence
  SiRNA target sequence
ttcagacgaaagattagacgaca

SEQ ID NO: 26857 - DNA, 23 bp, Artificial sequence
  SiRNA target sequence
tcagacgaaagattagacgacag

SEQ ID NO: 26858 - DNA, 23 bp, Artificial sequence
  SiRNA target sequence
cagacgaaagattagacgacagt

SEQ ID NO: 26859 - DNA, 23 bp, Artificial sequence
  SiRNA target sequence
agacgaaagattagacgacagtt

SEQ ID NO: 26860 - DNA, 23 bp, Artificial sequence
  SiRNA target sequence
gacgaaagattagacgacagttc

SEQ ID NO: 26861 - DNA, 23 bp, Artificial sequence
  SiRNA target sequence
acgaaagattagacgacagttct

SEQ ID NO: 26862 - DNA, 23 bp, Artificial sequence
  SiRNA target sequence
cgaaagattagacgacagttctt

SEQ ID NO: 26863 - DNA, 23 bp, Artificial sequence
  SiRNA target sequence
gaaagattagacgacagttcttt

SEQ ID NO: 26864 - DNA, 23 bp, Artificial sequence
  SiRNA target sequence
aaagattagacgacagttctttt

SEQ ID NO: 26865 - DNA, 23 bp, Artificial sequence
  SiRNA target sequence
aagattagacgacagttcttttt

SEQ ID NO: 26866 - DNA, 23 bp, Artificial sequence
  SiRNA target sequence
agattagacgacagttctttttt

SEQ ID NO: 26867 - DNA, 23 bp, Artificial sequence
  SiRNA target sequence
gattagacgacagttcttttttc

SEQ ID NO: 26868 - DNA, 23 bp, Artificial sequence
  SiRNA target sequence
attagacgacagttcttttttca

SEQ ID NO: 26869 - DNA, 23 bp, Artificial sequence
  SiRNA target sequence
ttagacgacagttcttttttcat

SEQ ID NO: 26870 - DNA, 23 bp, Artificial sequence
  SiRNA target sequence
tagacgacagttcttttttcatt

SEQ ID NO: 26871 - DNA, 23 bp, Artificial sequence
  SiRNA target sequence
agacgacagttcttttttcattt

SEQ ID NO: 26872 - DNA, 23 bp, Artificial sequence
  SiRNA target sequence
gacgacagttcttttttcatttt

SEQ ID NO: 26873 - DNA, 23 bp, Artificial sequence
  SiRNA target sequence
acgacagttcttttttcattttt

SEQ ID NO: 26874 - DNA, 23 bp, Artificial sequence
  SiRNA target sequence
cgacagttcttttttcatttttt

SEQ ID NO: 26875 - DNA, 23 bp, Artificial sequence
  SiRNA target sequence
gacagttcttttttcattttttc

SEQ ID NO: 26876 - DNA, 23 bp, Artificial sequence
  SiRNA target sequence
acagttcttttttcattttttcc

SEQ ID NO: 26877 - DNA, 23 bp, Artificial sequence
  SiRNA target sequence
cagttcttttttcattttttccg

SEQ ID NO: 26878 - DNA, 23 bp, Artificial sequence
  SiRNA target sequence
agttcttttttcattttttccgc

SEQ ID NO: 26879 - DNA, 23 bp, Artificial sequence
  SiRNA target sequence
gttcttttttcattttttccgct

SEQ ID NO: 26880 - DNA, 23 bp, Artificial sequence
  SiRNA target sequence
ttcttttttcattttttccgctg

SEQ ID NO: 26881 - DNA, 23 bp, Artificial sequence
  SiRNA target sequence
tcttttttcattttttccgctgc

SEQ ID NO: 26882 - DNA, 23 bp, Artificial sequence
  SiRNA target sequence
cttttttcattttttccgctgct

SEQ ID NO: 26883 - DNA, 23 bp, Artificial sequence
  SiRNA target sequence
ttttttcattttttccgctgctt

SEQ ID NO: 26884 - DNA, 23 bp, Artificial sequence
  SiRNA target sequence
tttttcattttttccgctgcttc

SEQ ID NO: 26885 - DNA, 23 bp, Artificial sequence
  SiRNA target sequence
ttttcattttttccgctgcttct

SEQ ID NO: 26886 - DNA, 23 bp, Artificial sequence
  SiRNA target sequence
tttcattttttccgctgcttctt

SEQ ID NO: 26887 - DNA, 23 bp, Artificial sequence
  SiRNA target sequence
ttcattttttccgctgcttcttt

SEQ ID NO: 26888 - DNA, 23 bp, Artificial sequence
  SiRNA target sequence
tcattttttccgctgcttcttta

SEQ ID NO: 26889 - DNA, 23 bp, Artificial sequence
  SiRNA target sequence
cattttttccgctgcttctttaa

SEQ ID NO: 26890 - DNA, 23 bp, Artificial sequence
  SiRNA target sequence
attttttccgctgcttctttaat

SEQ ID NO: 26891 - DNA, 23 bp, Artificial sequence
  SiRNA target sequence
ttttttccgctgcttctttaatt

SEQ ID NO: 26892 - DNA, 23 bp, Artificial sequence
  SiRNA target sequence
tttttccgctgcttctttaattc

SEQ ID NO: 26893 - DNA, 23 bp, Artificial sequence
  SiRNA target sequence
ttttccgctgcttctttaattct

SEQ ID NO: 26894 - DNA, 23 bp, Artificial sequence
  SiRNA target sequence
tttccgctgcttctttaattcta

SEQ ID NO: 26895 - DNA, 23 bp, Artificial sequence
  SiRNA target sequence
ttccgctgcttctttaattctat

SEQ ID NO: 26896 - DNA, 23 bp, Artificial sequence
  SiRNA target sequence
tccgctgcttctttaattctatt

SEQ ID NO: 26897 - DNA, 23 bp, Artificial sequence
  SiRNA target sequence
ccgctgcttctttaattctatta

SEQ ID NO: 26898 - DNA, 23 bp, Artificial sequence
  SiRNA target sequence
cgctgcttctttaattctattat

SEQ ID NO: 26899 - DNA, 23 bp, Artificial sequence
  SiRNA target sequence
gctgcttctttaattctattata

SEQ ID NO: 26900 - DNA, 23 bp, Artificial sequence
  SiRNA target sequence
ctgcttctttaattctattataa

SEQ ID NO: 26901 - DNA, 23 bp, Artificial sequence
  SiRNA target sequence
tgcttctttaattctattataac

SEQ ID NO: 26902 - DNA, 23 bp, Artificial sequence
  SiRNA target sequence
gcttctttaattctattataaca

SEQ ID NO: 26903 - DNA, 23 bp, Artificial sequence
  SiRNA target sequence
cttctttaattctattataacaa

SEQ ID NO: 26904 - DNA, 23 bp, Artificial sequence
  SiRNA target sequence
ttctttaattctattataacaag

SEQ ID NO: 26905 - DNA, 23 bp, Artificial sequence
  SiRNA target sequence
tctttaattctattataacaaga

SEQ ID NO: 26906 - DNA, 23 bp, Artificial sequence
  SiRNA target sequence
ctttaattctattataacaagaa

SEQ ID NO: 26907 - DNA, 23 bp, Artificial sequence
  SiRNA target sequence
tttaattctattataacaagaat

SEQ ID NO: 26908 - DNA, 23 bp, Artificial sequence
  SiRNA target sequence
ttaattctattataacaagaatc

SEQ ID NO: 26909 - DNA, 23 bp, Artificial sequence
  SiRNA target sequence
taattctattataacaagaatcg

SEQ ID NO: 26910 - DNA, 23 bp, Artificial sequence
  SiRNA target sequence
aattctattataacaagaatcgt

SEQ ID NO: 26911 - DNA, 23 bp, Artificial sequence
  SiRNA target sequence
attctattataacaagaatcgtg

SEQ ID NO: 26912 - DNA, 23 bp, Artificial sequence
  SiRNA target sequence
ttctattataacaagaatcgtgt

SEQ ID NO: 26913 - DNA, 23 bp, Artificial sequence
  SiRNA target sequence
tctattataacaagaatcgtgtt

SEQ ID NO: 26914 - DNA, 23 bp, Artificial sequence
  SiRNA target sequence
ctattataacaagaatcgtgttt

SEQ ID NO: 26915 - DNA, 23 bp, Artificial sequence
  SiRNA target sequence
tattataacaagaatcgtgttta

SEQ ID NO: 26916 - DNA, 23 bp, Artificial sequence
  SiRNA target sequence
attataacaagaatcgtgtttaa

SEQ ID NO: 26917 - DNA, 23 bp, Artificial sequence
  SiRNA target sequence
ttataacaagaatcgtgtttaag

SEQ ID NO: 26918 - DNA, 23 bp, Artificial sequence
  SiRNA target sequence
tataacaagaatcgtgtttaagt

SEQ ID NO: 26919 - DNA, 23 bp, Artificial sequence
  SiRNA target sequence
ataacaagaatcgtgtttaagta

SEQ ID NO: 26920 - DNA, 23 bp, Artificial sequence
  SiRNA target sequence
taacaagaatcgtgtttaagtaa

SEQ ID NO: 26921 - DNA, 23 bp, Artificial sequence
  SiRNA target sequence
aacaagaatcgtgtttaagtaaa

SEQ ID NO: 26922 - DNA, 23 bp, Artificial sequence
  SiRNA target sequence
acaagaatcgtgtttaagtaaat

SEQ ID NO: 26923 - DNA, 23 bp, Artificial sequence
  SiRNA target sequence
caagaatcgtgtttaagtaaatc

SEQ ID NO: 26924 - DNA, 23 bp, Artificial sequence
  SiRNA target sequence
aagaatcgtgtttaagtaaatca

SEQ ID NO: 26925 - DNA, 23 bp, Artificial sequence
  SiRNA target sequence
agaatcgtgtttaagtaaatcaa

SEQ ID NO: 26926 - DNA, 23 bp, Artificial sequence
  SiRNA target sequence
gaatcgtgtttaagtaaatcaat

SEQ ID NO: 26927 - DNA, 23 bp, Artificial sequence
  SiRNA target sequence
aatcgtgtttaagtaaatcaatt

SEQ ID NO: 26928 - DNA, 23 bp, Artificial sequence
  SiRNA target sequence
atcgtgtttaagtaaatcaattc

SEQ ID NO: 26929 - DNA, 23 bp, Artificial sequence
  SiRNA target sequence
tcgtgtttaagtaaatcaattcc

SEQ ID NO: 26930 - DNA, 23 bp, Artificial sequence
  SiRNA target sequence
cgtgtttaagtaaatcaattcct

SEQ ID NO: 26931 - DNA, 23 bp, Artificial sequence
  SiRNA target sequence
gtgtttaagtaaatcaattcctg

SEQ ID NO: 26932 - DNA, 23 bp, Artificial sequence
  SiRNA target sequence
tgtttaagtaaatcaattcctgt

SEQ ID NO: 26933 - DNA, 23 bp, Artificial sequence
  SiRNA target sequence
gtttaagtaaatcaattcctgtt

SEQ ID NO: 26934 - DNA, 23 bp, Artificial sequence
  SiRNA target sequence
tttaagtaaatcaattcctgttc

SEQ ID NO: 26935 - DNA, 23 bp, Artificial sequence
  SiRNA target sequence
ttaagtaaatcaattcctgttct

SEQ ID NO: 26936 - DNA, 23 bp, Artificial sequence
  SiRNA target sequence
taagtaaatcaattcctgttcta

SEQ ID NO: 26937 - DNA, 23 bp, Artificial sequence
  SiRNA target sequence
aagtaaatcaattcctgttctac

SEQ ID NO: 26938 - DNA, 23 bp, Artificial sequence
  SiRNA target sequence
agtaaatcaattcctgttctact

SEQ ID NO: 26939 - DNA, 23 bp, Artificial sequence
  SiRNA target sequence
gtaaatcaattcctgttctactt

SEQ ID NO: 26940 - DNA, 23 bp, Artificial sequence
  SiRNA target sequence
taaatcaattcctgttctacttt

SEQ ID NO: 26941 - DNA, 23 bp, Artificial sequence
  SiRNA target sequence
aaatcaattcctgttctactttt

SEQ ID NO: 26942 - DNA, 23 bp, Artificial sequence
  SiRNA target sequence
aatcaattcctgttctactttta

SEQ ID NO: 26943 - DNA, 23 bp, Artificial sequence
  SiRNA target sequence
atcaattcctgttctacttttaa

SEQ ID NO: 26944 - DNA, 23 bp, Artificial sequence
  SiRNA target sequence
tcaattcctgttctacttttaaa

SEQ ID NO: 26945 - DNA, 23 bp, Artificial sequence
  SiRNA target sequence
caattcctgttctacttttaaat

SEQ ID NO: 26946 - DNA, 23 bp, Artificial sequence
  SiRNA target sequence
aattcctgttctacttttaaatt

SEQ ID NO: 26947 - DNA, 23 bp, Artificial sequence
  SiRNA target sequence
attcctgttctacttttaaattt

SEQ ID NO: 26948 - DNA, 23 bp, Artificial sequence
  SiRNA target sequence
ttcctgttctacttttaaatttt

SEQ ID NO: 26949 - DNA, 23 bp, Artificial sequence
  SiRNA target sequence
tcctgttctacttttaaattttt

SEQ ID NO: 26950 - DNA, 23 bp, Artificial sequence
  SiRNA target sequence
cctgttctacttttaaatttttc

SEQ ID NO: 26951 - DNA, 23 bp, Artificial sequence
  SiRNA target sequence
ctgttctacttttaaatttttca

SEQ ID NO: 26952 - DNA, 23 bp, Artificial sequence
  SiRNA target sequence
tgttctacttttaaatttttcat

SEQ ID NO: 26953 - DNA, 23 bp, Artificial sequence
  SiRNA target sequence
gttctacttttaaatttttcatt

SEQ ID NO: 26954 - DNA, 23 bp, Artificial sequence
  SiRNA target sequence
ttctacttttaaatttttcatta

SEQ ID NO: 26955 - DNA, 23 bp, Artificial sequence
  SiRNA target sequence
tctacttttaaatttttcattaa

SEQ ID NO: 26956 - DNA, 23 bp, Artificial sequence
  SiRNA target sequence
ctacttttaaatttttcattaat

SEQ ID NO: 26957 - DNA, 23 bp, Artificial sequence
  SiRNA target sequence
tacttttaaatttttcattaata

SEQ ID NO: 26958 - DNA, 23 bp, Artificial sequence
  SiRNA target sequence
acttttaaatttttcattaatat

SEQ ID NO: 26959 - DNA, 23 bp, Artificial sequence
  SiRNA target sequence
cttttaaatttttcattaatata

SEQ ID NO: 26960 - DNA, 23 bp, Artificial sequence
  SiRNA target sequence
ttttaaatttttcattaatataa

SEQ ID NO: 26961 - DNA, 23 bp, Artificial sequence
  SiRNA target sequence
tttaaatttttcattaatataat

SEQ ID NO: 26962 - DNA, 23 bp, Artificial sequence
  SiRNA target sequence
ttaaatttttcattaatataatc

SEQ ID NO: 26963 - DNA, 23 bp, Artificial sequence
  SiRNA target sequence
taaatttttcattaatataatct

SEQ ID NO: 26964 - DNA, 23 bp, Artificial sequence
  SiRNA target sequence
aaatttttcattaatataatcta

SEQ ID NO: 26965 - DNA, 23 bp, Artificial sequence
  SiRNA target sequence
aatttttcattaatataatctac

SEQ ID NO: 26966 - DNA, 23 bp, Artificial sequence
  SiRNA target sequence
atttttcattaatataatctact

SEQ ID NO: 26967 - DNA, 23 bp, Artificial sequence
  SiRNA target sequence
tttttcattaatataatctacta

SEQ ID NO: 26968 - DNA, 23 bp, Artificial sequence
  SiRNA target sequence
ttttcattaatataatctactaa

SEQ ID NO: 26969 - DNA, 23 bp, Artificial sequence
  SiRNA target sequence
tttcattaatataatctactaaa

SEQ ID NO: 26970 - DNA, 23 bp, Artificial sequence
  SiRNA target sequence
ttcattaatataatctactaaag

SEQ ID NO: 26971 - DNA, 23 bp, Artificial sequence
  SiRNA target sequence
tcattaatataatctactaaagt

SEQ ID NO: 26972 - DNA, 23 bp, Artificial sequence
  SiRNA target sequence
cattaatataatctactaaagta

SEQ ID NO: 26973 - DNA, 23 bp, Artificial sequence
  SiRNA target sequence
attaatataatctactaaagtat

SEQ ID NO: 26974 - DNA, 23 bp, Artificial sequence
  SiRNA target sequence
ttaatataatctactaaagtatt

SEQ ID NO: 26975 - DNA, 23 bp, Artificial sequence
  SiRNA target sequence
taatataatctactaaagtatta

SEQ ID NO: 26976 - DNA, 23 bp, Artificial sequence
  SiRNA target sequence
aatataatctactaaagtattat

SEQ ID NO: 26977 - DNA, 23 bp, Artificial sequence
  SiRNA target sequence
atataatctactaaagtattatc

SEQ ID NO: 26978 - DNA, 23 bp, Artificial sequence
  SiRNA target sequence
tataatctactaaagtattatcc

SEQ ID NO: 26979 - DNA, 23 bp, Artificial sequence
  SiRNA target sequence
ataatctactaaagtattatcca

SEQ ID NO: 26980 - DNA, 23 bp, Artificial sequence
  SiRNA target sequence
taatctactaaagtattatccaa

SEQ ID NO: 26981 - DNA, 23 bp, Artificial sequence
  SiRNA target sequence
aatctactaaagtattatccaaa

SEQ ID NO: 26982 - DNA, 23 bp, Artificial sequence
  SiRNA target sequence
atctactaaagtattatccaaat

SEQ ID NO: 26983 - DNA, 23 bp, Artificial sequence
  SiRNA target sequence
tctactaaagtattatccaaatc

SEQ ID NO: 26984 - DNA, 23 bp, Artificial sequence
  SiRNA target sequence
ctactaaagtattatccaaatct

SEQ ID NO: 26985 - DNA, 23 bp, Artificial sequence
  SiRNA target sequence
tactaaagtattatccaaatctt

SEQ ID NO: 26986 - DNA, 23 bp, Artificial sequence
  SiRNA target sequence
actaaagtattatccaaatcttc

SEQ ID NO: 26987 - DNA, 23 bp, Artificial sequence
  SiRNA target sequence
ctaaagtattatccaaatcttct

SEQ ID NO: 26988 - DNA, 23 bp, Artificial sequence
  SiRNA target sequence
taaagtattatccaaatcttctc

SEQ ID NO: 26989 - DNA, 23 bp, Artificial sequence
  SiRNA target sequence
aaagtattatccaaatcttctcc

SEQ ID NO: 26990 - DNA, 23 bp, Artificial sequence
  SiRNA target sequence
aagtattatccaaatcttctcct

SEQ ID NO: 26991 - DNA, 23 bp, Artificial sequence
  SiRNA target sequence
agtattatccaaatcttctcctc

SEQ ID NO: 26992 - DNA, 23 bp, Artificial sequence
  SiRNA target sequence
gtattatccaaatcttctcctcc

SEQ ID NO: 26993 - DNA, 23 bp, Artificial sequence
  SiRNA target sequence
tattatccaaatcttctcctcct

SEQ ID NO: 26994 - DNA, 23 bp, Artificial sequence
  SiRNA target sequence
attatccaaatcttctcctccta

SEQ ID NO: 26995 - DNA, 23 bp, Artificial sequence
  SiRNA target sequence
ttatccaaatcttctcctcctaa

SEQ ID NO: 26996 - DNA, 23 bp, Artificial sequence
  SiRNA target sequence
tatccaaatcttctcctcctaaa

SEQ ID NO: 26997 - DNA, 23 bp, Artificial sequence
  SiRNA target sequence
atccaaatcttctcctcctaaaa

SEQ ID NO: 26998 - DNA, 23 bp, Artificial sequence
  SiRNA target sequence
tccaaatcttctcctcctaaaaa

SEQ ID NO: 26999 - DNA, 23 bp, Artificial sequence
  SiRNA target sequence
ccaaatcttctcctcctaaaaaa

SEQ ID NO: 27000 - DNA, 23 bp, Artificial sequence
  SiRNA target sequence
caaatcttctcctcctaaaaaag

SEQ ID NO: 27001 - DNA, 23 bp, Artificial sequence
  SiRNA target sequence
aaatcttctcctcctaaaaaagt

SEQ ID NO: 27002 - DNA, 23 bp, Artificial sequence
  SiRNA target sequence
aatcttctcctcctaaaaaagta

SEQ ID NO: 27003 - DNA, 23 bp, Artificial sequence
  SiRNA target sequence
atcttctcctcctaaaaaagtat

SEQ ID NO: 27004 - DNA, 23 bp, Artificial sequence
  SiRNA target sequence
tcttctcctcctaaaaaagtatt

SEQ ID NO: 27005 - DNA, 23 bp, Artificial sequence
  SiRNA target sequence
cttctcctcctaaaaaagtattt

SEQ ID NO: 27006 - DNA, 23 bp, Artificial sequence
  SiRNA target sequence
ttctcctcctaaaaaagtatttc

SEQ ID NO: 27007 - DNA, 23 bp, Artificial sequence
  SiRNA target sequence
tctcctcctaaaaaagtatttcc

SEQ ID NO: 27008 - DNA, 23 bp, Artificial sequence
  SiRNA target sequence
ctcctcctaaaaaagtatttccg

SEQ ID NO: 27009 - DNA, 23 bp, Artificial sequence
  SiRNA target sequence
tcctcctaaaaaagtatttccgt

SEQ ID NO: 27010 - DNA, 23 bp, Artificial sequence
  SiRNA target sequence
cctcctaaaaaagtatttccgtt

SEQ ID NO: 27011 - DNA, 23 bp, Artificial sequence
  SiRNA target sequence
ctcctaaaaaagtatttccgtta

SEQ ID NO: 27012 - DNA, 23 bp, Artificial sequence
  SiRNA target sequence
tcctaaaaaagtatttccgttag

SEQ ID NO: 27013 - DNA, 23 bp, Artificial sequence
  SiRNA target sequence
cctaaaaaagtatttccgttagt

SEQ ID NO: 27014 - DNA, 23 bp, Artificial sequence
  SiRNA target sequence
ctaaaaaagtatttccgttagta

SEQ ID NO: 27015 - DNA, 23 bp, Artificial sequence
  SiRNA target sequence
taaaaaagtatttccgttagtag

SEQ ID NO: 27016 - DNA, 23 bp, Artificial sequence
  SiRNA target sequence
aaaaaagtatttccgttagtaga

SEQ ID NO: 27017 - DNA, 23 bp, Artificial sequence
  SiRNA target sequence
aaaaagtatttccgttagtagat

SEQ ID NO: 27018 - DNA, 23 bp, Artificial sequence
  SiRNA target sequence
aaaagtatttccgttagtagatt

SEQ ID NO: 27019 - DNA, 23 bp, Artificial sequence
  SiRNA target sequence
aaagtatttccgttagtagattt

SEQ ID NO: 27020 - DNA, 23 bp, Artificial sequence
  SiRNA target sequence
aagtatttccgttagtagatttt

SEQ ID NO: 27021 - DNA, 23 bp, Artificial sequence
  SiRNA target sequence
agtatttccgttagtagatttta

SEQ ID NO: 27022 - DNA, 23 bp, Artificial sequence
  SiRNA target sequence
gtatttccgttagtagattttac

SEQ ID NO: 27023 - DNA, 23 bp, Artificial sequence
  SiRNA target sequence
tatttccgttagtagattttaca

SEQ ID NO: 27024 - DNA, 23 bp, Artificial sequence
  SiRNA target sequence
atttccgttagtagattttacat

SEQ ID NO: 27025 - DNA, 23 bp, Artificial sequence
  SiRNA target sequence
tttccgttagtagattttacatg

SEQ ID NO: 27026 - DNA, 23 bp, Artificial sequence
  SiRNA target sequence
ttccgttagtagattttacatga

SEQ ID NO: 27027 - DNA, 23 bp, Artificial sequence
  SiRNA target sequence
tccgttagtagattttacatgaa

SEQ ID NO: 27028 - DNA, 23 bp, Artificial sequence
  SiRNA target sequence
ccgttagtagattttacatgaaa

SEQ ID NO: 27029 - DNA, 23 bp, Artificial sequence
  SiRNA target sequence
cgttagtagattttacatgaaaa

SEQ ID NO: 27030 - DNA, 23 bp, Artificial sequence
  SiRNA target sequence
gttagtagattttacatgaaaaa

SEQ ID NO: 27031 - DNA, 23 bp, Artificial sequence
  SiRNA target sequence
ttagtagattttacatgaaaaat

SEQ ID NO: 27032 - DNA, 23 bp, Artificial sequence
  SiRNA target sequence
tagtagattttacatgaaaaata

SEQ ID NO: 27033 - DNA, 23 bp, Artificial sequence
  SiRNA target sequence
agtagattttacatgaaaaatac

SEQ ID NO: 27034 - DNA, 23 bp, Artificial sequence
  SiRNA target sequence
gtagattttacatgaaaaatacc

SEQ ID NO: 27035 - DNA, 23 bp, Artificial sequence
  SiRNA target sequence
tagattttacatgaaaaatacca

SEQ ID NO: 27036 - DNA, 23 bp, Artificial sequence
  SiRNA target sequence
agattttacatgaaaaataccat

SEQ ID NO: 27037 - DNA, 23 bp, Artificial sequence
  SiRNA target sequence
gattttacatgaaaaataccatt

SEQ ID NO: 27038 - DNA, 23 bp, Artificial sequence
  SiRNA target sequence
attttacatgaaaaataccatta

SEQ ID NO: 27039 - DNA, 23 bp, Artificial sequence
  SiRNA target sequence
ttttacatgaaaaataccattat

SEQ ID NO: 27040 - DNA, 23 bp, Artificial sequence
  SiRNA target sequence
tttacatgaaaaataccattatc

SEQ ID NO: 27041 - DNA, 23 bp, Artificial sequence
  SiRNA target sequence
ttacatgaaaaataccattatct

SEQ ID NO: 27042 - DNA, 23 bp, Artificial sequence
  SiRNA target sequence
tacatgaaaaataccattatcta

SEQ ID NO: 27043 - DNA, 23 bp, Artificial sequence
  SiRNA target sequence
acatgaaaaataccattatctaa

SEQ ID NO: 27044 - DNA, 23 bp, Artificial sequence
  SiRNA target sequence
catgaaaaataccattatctaat

SEQ ID NO: 27045 - DNA, 23 bp, Artificial sequence
  SiRNA target sequence
atgaaaaataccattatctaatt

SEQ ID NO: 27046 - DNA, 23 bp, Artificial sequence
  SiRNA target sequence
tgaaaaataccattatctaattc

SEQ ID NO: 27047 - DNA, 23 bp, Artificial sequence
  SiRNA target sequence
gaaaaataccattatctaattct

SEQ ID NO: 27048 - DNA, 23 bp, Artificial sequence
  SiRNA target sequence
aaaaataccattatctaattcta

SEQ ID NO: 27049 - DNA, 23 bp, Artificial sequence
  SiRNA target sequence
aaaataccattatctaattctaa

SEQ ID NO: 27050 - DNA, 23 bp, Artificial sequence
  SiRNA target sequence
aaataccattatctaattctaat

SEQ ID NO: 27051 - DNA, 23 bp, Artificial sequence
  SiRNA target sequence
aataccattatctaattctaata

SEQ ID NO: 27052 - DNA, 23 bp, Artificial sequence
  SiRNA target sequence
ataccattatctaattctaatat

SEQ ID NO: 27053 - DNA, 23 bp, Artificial sequence
  SiRNA target sequence
taccattatctaattctaatata

SEQ ID NO: 27054 - DNA, 23 bp, Artificial sequence
  SiRNA target sequence
accattatctaattctaatatac

SEQ ID NO: 27055 - DNA, 23 bp, Artificial sequence
  SiRNA target sequence
ccattatctaattctaatatact

SEQ ID NO: 27056 - DNA, 23 bp, Artificial sequence
  SiRNA target sequence
cattatctaattctaatatacta

SEQ ID NO: 27057 - DNA, 23 bp, Artificial sequence
  SiRNA target sequence
attatctaattctaatatactaa

SEQ ID NO: 27058 - DNA, 23 bp, Artificial sequence
  SiRNA target sequence
ttatctaattctaatatactaat

SEQ ID NO: 27059 - DNA, 23 bp, Artificial sequence
  SiRNA target sequence
tatctaattctaatatactaatg

SEQ ID NO: 27060 - DNA, 23 bp, Artificial sequence
  SiRNA target sequence
atctaattctaatatactaatgt

SEQ ID NO: 27061 - DNA, 23 bp, Artificial sequence
  SiRNA target sequence
tctaattctaatatactaatgtc

SEQ ID NO: 27062 - DNA, 23 bp, Artificial sequence
  SiRNA target sequence
ctaattctaatatactaatgtca

SEQ ID NO: 27063 - DNA, 23 bp, Artificial sequence
  SiRNA target sequence
taattctaatatactaatgtcaa

SEQ ID NO: 27064 - DNA, 23 bp, Artificial sequence
  SiRNA target sequence
aattctaatatactaatgtcaaa

SEQ ID NO: 27065 - DNA, 23 bp, Artificial sequence
  SiRNA target sequence
attctaatatactaatgtcaaaa

SEQ ID NO: 27066 - DNA, 23 bp, Artificial sequence
  SiRNA target sequence
ttctaatatactaatgtcaaaag

SEQ ID NO: 27067 - DNA, 23 bp, Artificial sequence
  SiRNA target sequence
tctaatatactaatgtcaaaagt

SEQ ID NO: 27068 - DNA, 23 bp, Artificial sequence
  SiRNA target sequence
ctaatatactaatgtcaaaagtt

SEQ ID NO: 27069 - DNA, 23 bp, Artificial sequence
  SiRNA target sequence
taatatactaatgtcaaaagttc

SEQ ID NO: 27070 - DNA, 23 bp, Artificial sequence
  SiRNA target sequence
aatatactaatgtcaaaagttcc

SEQ ID NO: 27071 - DNA, 23 bp, Artificial sequence
  SiRNA target sequence
atatactaatgtcaaaagttcct

SEQ ID NO: 27072 - DNA, 23 bp, Artificial sequence
  SiRNA target sequence
tatactaatgtcaaaagttcctc

SEQ ID NO: 27073 - DNA, 23 bp, Artificial sequence
  SiRNA target sequence
atactaatgtcaaaagttcctcc

SEQ ID NO: 27074 - DNA, 23 bp, Artificial sequence
  SiRNA target sequence
tactaatgtcaaaagttcctcct

SEQ ID NO: 27075 - DNA, 23 bp, Artificial sequence
  SiRNA target sequence
actaatgtcaaaagttcctcctc

SEQ ID NO: 27076 - DNA, 23 bp, Artificial sequence
  SiRNA target sequence
ctaatgtcaaaagttcctcctcc

SEQ ID NO: 27077 - DNA, 23 bp, Artificial sequence
  SiRNA target sequence
taatgtcaaaagttcctcctccc

SEQ ID NO: 27078 - DNA, 23 bp, Artificial sequence
  SiRNA target sequence
aatgtcaaaagttcctcctccca

SEQ ID NO: 27079 - DNA, 23 bp, Artificial sequence
  SiRNA target sequence
atgtcaaaagttcctcctcccag

SEQ ID NO: 27080 - DNA, 23 bp, Artificial sequence
  SiRNA target sequence
tgtcaaaagttcctcctcccaga

SEQ ID NO: 27081 - DNA, 23 bp, Artificial sequence
  SiRNA target sequence
gtcaaaagttcctcctcccagat

SEQ ID NO: 27082 - DNA, 23 bp, Artificial sequence
  SiRNA target sequence
tcaaaagttcctcctcccagatc

SEQ ID NO: 27083 - DNA, 23 bp, Artificial sequence
  SiRNA target sequence
caaaagttcctcctcccagatca

SEQ ID NO: 27084 - DNA, 23 bp, Artificial sequence
  SiRNA target sequence
aaaagttcctcctcccagatcat

SEQ ID NO: 27085 - DNA, 23 bp, Artificial sequence
  SiRNA target sequence
aaagttcctcctcccagatcata

SEQ ID NO: 27086 - DNA, 23 bp, Artificial sequence
  SiRNA target sequence
aagttcctcctcccagatcataa

SEQ ID NO: 27087 - DNA, 23 bp, Artificial sequence
  SiRNA target sequence
agttcctcctcccagatcataaa

SEQ ID NO: 27088 - DNA, 23 bp, Artificial sequence
  SiRNA target sequence
gttcctcctcccagatcataaac

SEQ ID NO: 27089 - DNA, 23 bp, Artificial sequence
  SiRNA target sequence
ttcctcctcccagatcataaaca

SEQ ID NO: 27090 - DNA, 23 bp, Artificial sequence
  SiRNA target sequence
tcctcctcccagatcataaacag

SEQ ID NO: 27091 - DNA, 23 bp, Artificial sequence
  SiRNA target sequence
cctcctcccagatcataaacagc

SEQ ID NO: 27092 - DNA, 23 bp, Artificial sequence
  SiRNA target sequence
ctcctcccagatcataaacagct

SEQ ID NO: 27093 - DNA, 23 bp, Artificial sequence
  SiRNA target sequence
tcctcccagatcataaacagcta

SEQ ID NO: 27094 - DNA, 23 bp, Artificial sequence
  SiRNA target sequence
cctcccagatcataaacagctat

SEQ ID NO: 27095 - DNA, 23 bp, Artificial sequence
  SiRNA target sequence
ctcccagatcataaacagctata

SEQ ID NO: 27096 - DNA, 23 bp, Artificial sequence
  SiRNA target sequence
tcccagatcataaacagctataa

SEQ ID NO: 27097 - DNA, 23 bp, Artificial sequence
  SiRNA target sequence
cccagatcataaacagctataat

SEQ ID NO: 27098 - DNA, 23 bp, Artificial sequence
  SiRNA target sequence
ccagatcataaacagctataata

SEQ ID NO: 27099 - DNA, 23 bp, Artificial sequence
  SiRNA target sequence
cagatcataaacagctataatac

SEQ ID NO: 27100 - DNA, 23 bp, Artificial sequence
  SiRNA target sequence
agatcataaacagctataatacc

SEQ ID NO: 27101 - DNA, 23 bp, Artificial sequence
  SiRNA target sequence
gatcataaacagctataataccc

SEQ ID NO: 27102 - DNA, 23 bp, Artificial sequence
  SiRNA target sequence
atcataaacagctataataccct

SEQ ID NO: 27103 - DNA, 23 bp, Artificial sequence
  SiRNA target sequence
tcataaacagctataataccctg

SEQ ID NO: 27104 - DNA, 23 bp, Artificial sequence
  SiRNA target sequence
cataaacagctataataccctgt

SEQ ID NO: 27105 - DNA, 23 bp, Artificial sequence
  SiRNA target sequence
ataaacagctataataccctgtg

SEQ ID NO: 27106 - DNA, 23 bp, Artificial sequence
  SiRNA target sequence
taaacagctataataccctgtgc

SEQ ID NO: 27107 - DNA, 23 bp, Artificial sequence
  SiRNA target sequence
aaacagctataataccctgtgca

SEQ ID NO: 27108 - DNA, 23 bp, Artificial sequence
  SiRNA target sequence
aacagctataataccctgtgcag

SEQ ID NO: 27109 - DNA, 23 bp, Artificial sequence
  SiRNA target sequence
acagctataataccctgtgcaga

SEQ ID NO: 27110 - DNA, 23 bp, Artificial sequence
  SiRNA target sequence
cagctataataccctgtgcagac

SEQ ID NO: 27111 - DNA, 23 bp, Artificial sequence
  SiRNA target sequence
agctataataccctgtgcagact

SEQ ID NO: 27112 - DNA, 23 bp, Artificial sequence
  SiRNA target sequence
gctataataccctgtgcagactt

SEQ ID NO: 27113 - DNA, 23 bp, Artificial sequence
  SiRNA target sequence
ctataataccctgtgcagacttg

SEQ ID NO: 27114 - DNA, 23 bp, Artificial sequence
  SiRNA target sequence
tataataccctgtgcagacttgt

SEQ ID NO: 27115 - DNA, 23 bp, Artificial sequence
  SiRNA target sequence
ataataccctgtgcagacttgtc

SEQ ID NO: 27116 - DNA, 23 bp, Artificial sequence
  SiRNA target sequence
taataccctgtgcagacttgtca

SEQ ID NO: 27117 - DNA, 23 bp, Artificial sequence
  SiRNA target sequence
aataccctgtgcagacttgtcaa

SEQ ID NO: 27118 - DNA, 23 bp, Artificial sequence
  SiRNA target sequence
ataccctgtgcagacttgtcaag

SEQ ID NO: 27119 - DNA, 23 bp, Artificial sequence
  SiRNA target sequence
taccctgtgcagacttgtcaagc

SEQ ID NO: 27120 - DNA, 23 bp, Artificial sequence
  SiRNA target sequence
accctgtgcagacttgtcaagcc

SEQ ID NO: 27121 - DNA, 23 bp, Artificial sequence
  SiRNA target sequence
ccctgtgcagacttgtcaagccc

SEQ ID NO: 27122 - DNA, 23 bp, Artificial sequence
  SiRNA target sequence
cctgtgcagacttgtcaagccca

SEQ ID NO: 27123 - DNA, 23 bp, Artificial sequence
  SiRNA target sequence
ctgtgcagacttgtcaagcccat

SEQ ID NO: 27124 - DNA, 23 bp, Artificial sequence
  SiRNA target sequence
tgtgcagacttgtcaagcccata

SEQ ID NO: 27125 - DNA, 23 bp, Artificial sequence
  SiRNA target sequence
gtgcagacttgtcaagcccataa

SEQ ID NO: 27126 - DNA, 23 bp, Artificial sequence
  SiRNA target sequence
tgcagacttgtcaagcccataag

SEQ ID NO: 27127 - DNA, 23 bp, Artificial sequence
  SiRNA target sequence
gcagacttgtcaagcccataagc

SEQ ID NO: 27128 - DNA, 23 bp, Artificial sequence
  SiRNA target sequence
cagacttgtcaagcccataagca

SEQ ID NO: 27129 - DNA, 23 bp, Artificial sequence
  SiRNA target sequence
agacttgtcaagcccataagcaa

SEQ ID NO: 27130 - DNA, 23 bp, Artificial sequence
  SiRNA target sequence
gacttgtcaagcccataagcaag

SEQ ID NO: 27131 - DNA, 23 bp, Artificial sequence
  SiRNA target sequence
acttgtcaagcccataagcaagt

SEQ ID NO: 27132 - DNA, 23 bp, Artificial sequence
  SiRNA target sequence
cttgtcaagcccataagcaagtg

SEQ ID NO: 27133 - DNA, 23 bp, Artificial sequence
  SiRNA target sequence
ttgtcaagcccataagcaagtgc

SEQ ID NO: 27134 - DNA, 23 bp, Artificial sequence
  SiRNA target sequence
tgtcaagcccataagcaagtgct

SEQ ID NO: 27135 - DNA, 23 bp, Artificial sequence
  SiRNA target sequence
gtcaagcccataagcaagtgctg

SEQ ID NO: 27136 - DNA, 23 bp, Artificial sequence
  SiRNA target sequence
tcaagcccataagcaagtgctgc

SEQ ID NO: 27137 - DNA, 23 bp, Artificial sequence
  SiRNA target sequence
caagcccataagcaagtgctgcc

SEQ ID NO: 27138 - DNA, 23 bp, Artificial sequence
  SiRNA target sequence
aagcccataagcaagtgctgccg

SEQ ID NO: 27139 - DNA, 23 bp, Artificial sequence
  SiRNA target sequence
agcccataagcaagtgctgccgc

SEQ ID NO: 27140 - DNA, 23 bp, Artificial sequence
  SiRNA target sequence
gcccataagcaagtgctgccgca

SEQ ID NO: 27141 - DNA, 23 bp, Artificial sequence
  SiRNA target sequence
cccataagcaagtgctgccgcag

SEQ ID NO: 27142 - DNA, 23 bp, Artificial sequence
  SiRNA target sequence
ccataagcaagtgctgccgcagt

SEQ ID NO: 27143 - DNA, 23 bp, Artificial sequence
  SiRNA target sequence
cataagcaagtgctgccgcagta

SEQ ID NO: 27144 - DNA, 23 bp, Artificial sequence
  SiRNA target sequence
ataagcaagtgctgccgcagtag

SEQ ID NO: 27145 - DNA, 23 bp, Artificial sequence
  SiRNA target sequence
taagcaagtgctgccgcagtagg

SEQ ID NO: 27146 - DNA, 23 bp, Artificial sequence
  SiRNA target sequence
aagcaagtgctgccgcagtaggc

SEQ ID NO: 27147 - DNA, 23 bp, Artificial sequence
  SiRNA target sequence
agcaagtgctgccgcagtaggct

SEQ ID NO: 27148 - DNA, 23 bp, Artificial sequence
  SiRNA target sequence
gcaagtgctgccgcagtaggctc

SEQ ID NO: 27149 - DNA, 23 bp, Artificial sequence
  SiRNA target sequence
caagtgctgccgcagtaggctca

SEQ ID NO: 27150 - DNA, 23 bp, Artificial sequence
  SiRNA target sequence
aagtgctgccgcagtaggctcat

SEQ ID NO: 27151 - DNA, 23 bp, Artificial sequence
  SiRNA target sequence
agtgctgccgcagtaggctcatt

SEQ ID NO: 27152 - DNA, 23 bp, Artificial sequence
  SiRNA target sequence
gtgctgccgcagtaggctcatta

SEQ ID NO: 27153 - DNA, 23 bp, Artificial sequence
  SiRNA target sequence
tgctgccgcagtaggctcattaa

SEQ ID NO: 27154 - DNA, 23 bp, Artificial sequence
  SiRNA target sequence
gctgccgcagtaggctcattaat

SEQ ID NO: 27155 - DNA, 23 bp, Artificial sequence
  SiRNA target sequence
ctgccgcagtaggctcattaatc

SEQ ID NO: 27156 - DNA, 23 bp, Artificial sequence
  SiRNA target sequence
tgccgcagtaggctcattaatca

SEQ ID NO: 27157 - DNA, 23 bp, Artificial sequence
  SiRNA target sequence
gccgcagtaggctcattaatcac

SEQ ID NO: 27158 - DNA, 23 bp, Artificial sequence
  SiRNA target sequence
ccgcagtaggctcattaatcact

SEQ ID NO: 27159 - DNA, 23 bp, Artificial sequence
  SiRNA target sequence
cgcagtaggctcattaatcactc

SEQ ID NO: 27160 - DNA, 23 bp, Artificial sequence
  SiRNA target sequence
gcagtaggctcattaatcactct

SEQ ID NO: 27161 - DNA, 23 bp, Artificial sequence
  SiRNA target sequence
cagtaggctcattaatcactcta

SEQ ID NO: 27162 - DNA, 23 bp, Artificial sequence
  SiRNA target sequence
agtaggctcattaatcactctaa

SEQ ID NO: 27163 - DNA, 23 bp, Artificial sequence
  SiRNA target sequence
gtaggctcattaatcactctaag

SEQ ID NO: 27164 - DNA, 23 bp, Artificial sequence
  SiRNA target sequence
taggctcattaatcactctaagc

SEQ ID NO: 27165 - DNA, 23 bp, Artificial sequence
  SiRNA target sequence
aggctcattaatcactctaagca

SEQ ID NO: 27166 - DNA, 23 bp, Artificial sequence
  SiRNA target sequence
ggctcattaatcactctaagcac

SEQ ID NO: 27167 - DNA, 23 bp, Artificial sequence
  SiRNA target sequence
gctcattaatcactctaagcact

SEQ ID NO: 27168 - DNA, 23 bp, Artificial sequence
  SiRNA target sequence
ctcattaatcactctaagcactt

SEQ ID NO: 27169 - DNA, 23 bp, Artificial sequence
  SiRNA target sequence
tcattaatcactctaagcacttg

SEQ ID NO: 27170 - DNA, 23 bp, Artificial sequence
  SiRNA target sequence
cattaatcactctaagcacttgt

SEQ ID NO: 27171 - DNA, 23 bp, Artificial sequence
  SiRNA target sequence
attaatcactctaagcacttgta

SEQ ID NO: 27172 - DNA, 23 bp, Artificial sequence
  SiRNA target sequence
ttaatcactctaagcacttgtaa

SEQ ID NO: 27173 - DNA, 23 bp, Artificial sequence
  SiRNA target sequence
taatcactctaagcacttgtaat

SEQ ID NO: 27174 - DNA, 23 bp, Artificial sequence
  SiRNA target sequence
aatcactctaagcacttgtaatc

SEQ ID NO: 27175 - DNA, 23 bp, Artificial sequence
  SiRNA target sequence
atcactctaagcacttgtaatcc

SEQ ID NO: 27176 - DNA, 23 bp, Artificial sequence
  SiRNA target sequence
tcactctaagcacttgtaatccc

SEQ ID NO: 27177 - DNA, 23 bp, Artificial sequence
  SiRNA target sequence
cactctaagcacttgtaatcccg

SEQ ID NO: 27178 - DNA, 23 bp, Artificial sequence
  SiRNA target sequence
actctaagcacttgtaatcccgc

SEQ ID NO: 27179 - DNA, 23 bp, Artificial sequence
  SiRNA target sequence
ctctaagcacttgtaatcccgca

SEQ ID NO: 27180 - DNA, 23 bp, Artificial sequence
  SiRNA target sequence
tctaagcacttgtaatcccgcaa

SEQ ID NO: 27181 - DNA, 23 bp, Artificial sequence
  SiRNA target sequence
ctaagcacttgtaatcccgcaat

SEQ ID NO: 27182 - DNA, 23 bp, Artificial sequence
  SiRNA target sequence
taagcacttgtaatcccgcaatc

SEQ ID NO: 27183 - DNA, 23 bp, Artificial sequence
  SiRNA target sequence
aagcacttgtaatcccgcaatcc

SEQ ID NO: 27184 - DNA, 23 bp, Artificial sequence
  SiRNA target sequence
agcacttgtaatcccgcaatcct

SEQ ID NO: 27185 - DNA, 23 bp, Artificial sequence
  SiRNA target sequence
gcacttgtaatcccgcaatcctt

SEQ ID NO: 27186 - DNA, 23 bp, Artificial sequence
  SiRNA target sequence
cacttgtaatcccgcaatccttc

SEQ ID NO: 27187 - DNA, 23 bp, Artificial sequence
  SiRNA target sequence
acttgtaatcccgcaatccttcc

SEQ ID NO: 27188 - DNA, 23 bp, Artificial sequence
  SiRNA target sequence
cttgtaatcccgcaatccttccc

SEQ ID NO: 27189 - DNA, 23 bp, Artificial sequence
  SiRNA target sequence
ttgtaatcccgcaatccttcccg

SEQ ID NO: 27190 - DNA, 23 bp, Artificial sequence
  SiRNA target sequence
tgtaatcccgcaatccttcccgc

SEQ ID NO: 27191 - DNA, 23 bp, Artificial sequence
  SiRNA target sequence
gtaatcccgcaatccttcccgca

SEQ ID NO: 27192 - DNA, 23 bp, Artificial sequence
  SiRNA target sequence
taatcccgcaatccttcccgcat

SEQ ID NO: 27193 - DNA, 23 bp, Artificial sequence
  SiRNA target sequence
aatcccgcaatccttcccgcatc

SEQ ID NO: 27194 - DNA, 23 bp, Artificial sequence
  SiRNA target sequence
atcccgcaatccttcccgcatct

SEQ ID NO: 27195 - DNA, 23 bp, Artificial sequence
  SiRNA target sequence
tcccgcaatccttcccgcatctt

SEQ ID NO: 27196 - DNA, 23 bp, Artificial sequence
  SiRNA target sequence
cccgcaatccttcccgcatcttt

SEQ ID NO: 27197 - DNA, 23 bp, Artificial sequence
  SiRNA target sequence
ccgcaatccttcccgcatcttta

SEQ ID NO: 27198 - DNA, 23 bp, Artificial sequence
  SiRNA target sequence
cgcaatccttcccgcatctttag

SEQ ID NO: 27199 - DNA, 23 bp, Artificial sequence
  SiRNA target sequence
gcaatccttcccgcatctttagt

SEQ ID NO: 27200 - DNA, 23 bp, Artificial sequence
  SiRNA target sequence
caatccttcccgcatctttagta

SEQ ID NO: 27201 - DNA, 23 bp, Artificial sequence
  SiRNA target sequence
aatccttcccgcatctttagtag

SEQ ID NO: 27202 - DNA, 23 bp, Artificial sequence
  SiRNA target sequence
atccttcccgcatctttagtagc

SEQ ID NO: 27203 - DNA, 23 bp, Artificial sequence
  SiRNA target sequence
tccttcccgcatctttagtagct

SEQ ID NO: 27204 - DNA, 23 bp, Artificial sequence
  SiRNA target sequence
ccttcccgcatctttagtagctt

SEQ ID NO: 27205 - DNA, 23 bp, Artificial sequence
  SiRNA target sequence
cttcccgcatctttagtagcttg

SEQ ID NO: 27206 - DNA, 23 bp, Artificial sequence
  SiRNA target sequence
ttcccgcatctttagtagcttgc

SEQ ID NO: 27207 - DNA, 23 bp, Artificial sequence
  SiRNA target sequence
tcccgcatctttagtagcttgcc

SEQ ID NO: 27208 - DNA, 23 bp, Artificial sequence
  SiRNA target sequence
cccgcatctttagtagcttgcct

SEQ ID NO: 27209 - DNA, 23 bp, Artificial sequence
  SiRNA target sequence
ccgcatctttagtagcttgcctt

SEQ ID NO: 27210 - DNA, 23 bp, Artificial sequence
  SiRNA target sequence
cgcatctttagtagcttgccttt

SEQ ID NO: 27211 - DNA, 23 bp, Artificial sequence
  SiRNA target sequence
gcatctttagtagcttgcctttg

SEQ ID NO: 27212 - DNA, 23 bp, Artificial sequence
  SiRNA target sequence
catctttagtagcttgcctttgc

SEQ ID NO: 27213 - DNA, 23 bp, Artificial sequence
  SiRNA target sequence
atctttagtagcttgcctttgca

SEQ ID NO: 27214 - DNA, 23 bp, Artificial sequence
  SiRNA target sequence
tctttagtagcttgcctttgcat

SEQ ID NO: 27215 - DNA, 23 bp, Artificial sequence
  SiRNA target sequence
ctttagtagcttgcctttgcatg

SEQ ID NO: 27216 - DNA, 23 bp, Artificial sequence
  SiRNA target sequence
tttagtagcttgcctttgcatgt

SEQ ID NO: 27217 - DNA, 23 bp, Artificial sequence
  SiRNA target sequence
ttagtagcttgcctttgcatgtc

SEQ ID NO: 27218 - DNA, 23 bp, Artificial sequence
  SiRNA target sequence
tagtagcttgcctttgcatgtca

SEQ ID NO: 27219 - DNA, 23 bp, Artificial sequence
  SiRNA target sequence
agtagcttgcctttgcatgtcat

SEQ ID NO: 27220 - DNA, 23 bp, Artificial sequence
  SiRNA target sequence
gtagcttgcctttgcatgtcatc

SEQ ID NO: 27221 - DNA, 23 bp, Artificial sequence
  SiRNA target sequence
tagcttgcctttgcatgtcatca

SEQ ID NO: 27222 - DNA, 23 bp, Artificial sequence
  SiRNA target sequence
agcttgcctttgcatgtcatcaa

SEQ ID NO: 27223 - DNA, 23 bp, Artificial sequence
  SiRNA target sequence
gcttgcctttgcatgtcatcaaa

SEQ ID NO: 27224 - DNA, 23 bp, Artificial sequence
  SiRNA target sequence
cttgcctttgcatgtcatcaaaa

SEQ ID NO: 27225 - DNA, 23 bp, Artificial sequence
  SiRNA target sequence
ttgcctttgcatgtcatcaaaat

SEQ ID NO: 27226 - DNA, 23 bp, Artificial sequence
  SiRNA target sequence
tgcctttgcatgtcatcaaaata

SEQ ID NO: 27227 - DNA, 23 bp, Artificial sequence
  SiRNA target sequence
gcctttgcatgtcatcaaaatat

SEQ ID NO: 27228 - DNA, 23 bp, Artificial sequence
  SiRNA target sequence
cctttgcatgtcatcaaaatatg

SEQ ID NO: 27229 - DNA, 23 bp, Artificial sequence
  SiRNA target sequence
ctttgcatgtcatcaaaatatgc

SEQ ID NO: 27230 - DNA, 23 bp, Artificial sequence
  SiRNA target sequence
tttgcatgtcatcaaaatatgcg

SEQ ID NO: 27231 - DNA, 23 bp, Artificial sequence
  SiRNA target sequence
ttgcatgtcatcaaaatatgcgg

SEQ ID NO: 27232 - DNA, 23 bp, Artificial sequence
  SiRNA target sequence
tgcatgtcatcaaaatatgcggg

SEQ ID NO: 27233 - DNA, 23 bp, Artificial sequence
  SiRNA target sequence
gcatgtcatcaaaatatgcgggc

SEQ ID NO: 27234 - DNA, 23 bp, Artificial sequence
  SiRNA target sequence
catgtcatcaaaatatgcgggca

SEQ ID NO: 27235 - DNA, 23 bp, Artificial sequence
  SiRNA target sequence
atgtcatcaaaatatgcgggcac

SEQ ID NO: 27236 - DNA, 23 bp, Artificial sequence
  SiRNA target sequence
tgtcatcaaaatatgcgggcact

SEQ ID NO: 27237 - DNA, 23 bp, Artificial sequence
  SiRNA target sequence
gtcatcaaaatatgcgggcactg

SEQ ID NO: 27238 - DNA, 23 bp, Artificial sequence
  SiRNA target sequence
tcatcaaaatatgcgggcactgt

SEQ ID NO: 27239 - DNA, 23 bp, Artificial sequence
  SiRNA target sequence
catcaaaatatgcgggcactgtt

SEQ ID NO: 27240 - DNA, 23 bp, Artificial sequence
  SiRNA target sequence
atcaaaatatgcgggcactgtta

SEQ ID NO: 27241 - DNA, 23 bp, Artificial sequence
  SiRNA target sequence
tcaaaatatgcgggcactgttat

SEQ ID NO: 27242 - DNA, 23 bp, Artificial sequence
  SiRNA target sequence
caaaatatgcgggcactgttata

SEQ ID NO: 27243 - DNA, 23 bp, Artificial sequence
  SiRNA target sequence
aaaatatgcgggcactgttataa

SEQ ID NO: 27244 - DNA, 23 bp, Artificial sequence
  SiRNA target sequence
aaatatgcgggcactgttataac

SEQ ID NO: 27245 - DNA, 23 bp, Artificial sequence
  SiRNA target sequence
aatatgcgggcactgttataaca

SEQ ID NO: 27246 - DNA, 23 bp, Artificial sequence
  SiRNA target sequence
atatgcgggcactgttataacag

SEQ ID NO: 27247 - DNA, 23 bp, Artificial sequence
  SiRNA target sequence
tatgcgggcactgttataacaga

SEQ ID NO: 27248 - DNA, 23 bp, Artificial sequence
  SiRNA target sequence
atgcgggcactgttataacagat

SEQ ID NO: 27249 - DNA, 23 bp, Artificial sequence
  SiRNA target sequence
tgcgggcactgttataacagatc

SEQ ID NO: 27250 - DNA, 23 bp, Artificial sequence
  SiRNA target sequence
gcgggcactgttataacagatct

SEQ ID NO: 27251 - DNA, 23 bp, Artificial sequence
  SiRNA target sequence
cgggcactgttataacagatctt

SEQ ID NO: 27252 - DNA, 23 bp, Artificial sequence
  SiRNA target sequence
gggcactgttataacagatctta

SEQ ID NO: 27253 - DNA, 23 bp, Artificial sequence
  SiRNA target sequence
ggcactgttataacagatcttaa

SEQ ID NO: 27254 - DNA, 23 bp, Artificial sequence
  SiRNA target sequence
gcactgttataacagatcttaat

SEQ ID NO: 27255 - DNA, 23 bp, Artificial sequence
  SiRNA target sequence
cactgttataacagatcttaata

SEQ ID NO: 27256 - DNA, 23 bp, Artificial sequence
  SiRNA target sequence
actgttataacagatcttaatac

SEQ ID NO: 27257 - DNA, 23 bp, Artificial sequence
  SiRNA target sequence
ctgttataacagatcttaatact

SEQ ID NO: 27258 - DNA, 23 bp, Artificial sequence
  SiRNA target sequence
tgttataacagatcttaatactt

SEQ ID NO: 27259 - DNA, 23 bp, Artificial sequence
  SiRNA target sequence
gttataacagatcttaatacttt

SEQ ID NO: 27260 - DNA, 23 bp, Artificial sequence
  SiRNA target sequence
ttataacagatcttaatacttta

SEQ ID NO: 27261 - DNA, 23 bp, Artificial sequence
  SiRNA target sequence
tataacagatcttaatactttag

SEQ ID NO: 27262 - DNA, 23 bp, Artificial sequence
  SiRNA target sequence
ataacagatcttaatactttaga

SEQ ID NO: 27263 - DNA, 23 bp, Artificial sequence
  SiRNA target sequence
taacagatcttaatactttagaa

SEQ ID NO: 27264 - DNA, 23 bp, Artificial sequence
  SiRNA target sequence
aacagatcttaatactttagaat

SEQ ID NO: 27265 - DNA, 23 bp, Artificial sequence
  SiRNA target sequence
acagatcttaatactttagaatt

SEQ ID NO: 27266 - DNA, 23 bp, Artificial sequence
  SiRNA target sequence
cagatcttaatactttagaattt

SEQ ID NO: 27267 - DNA, 23 bp, Artificial sequence
  SiRNA target sequence
agatcttaatactttagaattta

SEQ ID NO: 27268 - DNA, 23 bp, Artificial sequence
  SiRNA target sequence
gatcttaatactttagaatttaa

SEQ ID NO: 27269 - DNA, 23 bp, Artificial sequence
  SiRNA target sequence
atcttaatactttagaatttaaa

SEQ ID NO: 27270 - DNA, 23 bp, Artificial sequence
  SiRNA target sequence
tcttaatactttagaatttaaaa

SEQ ID NO: 27271 - DNA, 23 bp, Artificial sequence
  SiRNA target sequence
cttaatactttagaatttaaaaa

SEQ ID NO: 27272 - DNA, 23 bp, Artificial sequence
  SiRNA target sequence
ttaatactttagaatttaaaaaa

SEQ ID NO: 27273 - DNA, 23 bp, Artificial sequence
  SiRNA target sequence
taatactttagaatttaaaaaat

SEQ ID NO: 27274 - DNA, 23 bp, Artificial sequence
  SiRNA target sequence
aatactttagaatttaaaaaatt

SEQ ID NO: 27275 - DNA, 23 bp, Artificial sequence
  SiRNA target sequence
atactttagaatttaaaaaattc

SEQ ID NO: 27276 - DNA, 23 bp, Artificial sequence
  SiRNA target sequence
tactttagaatttaaaaaattct

SEQ ID NO: 27277 - DNA, 23 bp, Artificial sequence
  SiRNA target sequence
actttagaatttaaaaaattctc

SEQ ID NO: 27278 - DNA, 23 bp, Artificial sequence
  SiRNA target sequence
ctttagaatttaaaaaattctct

SEQ ID NO: 27279 - DNA, 23 bp, Artificial sequence
  SiRNA target sequence
tttagaatttaaaaaattctctg

SEQ ID NO: 27280 - DNA, 23 bp, Artificial sequence
  SiRNA target sequence
ttagaatttaaaaaattctctgc

SEQ ID NO: 27281 - DNA, 23 bp, Artificial sequence
  SiRNA target sequence
tagaatttaaaaaattctctgcg

SEQ ID NO: 27282 - DNA, 23 bp, Artificial sequence
  SiRNA target sequence
agaatttaaaaaattctctgcgg

SEQ ID NO: 27283 - DNA, 23 bp, Artificial sequence
  SiRNA target sequence
gaatttaaaaaattctctgcggc

SEQ ID NO: 27284 - DNA, 23 bp, Artificial sequence
  SiRNA target sequence
aatttaaaaaattctctgcggca

SEQ ID NO: 27285 - DNA, 23 bp, Artificial sequence
  SiRNA target sequence
atttaaaaaattctctgcggcat

SEQ ID NO: 27286 - DNA, 23 bp, Artificial sequence
  SiRNA target sequence
tttaaaaaattctctgcggcatt

SEQ ID NO: 27287 - DNA, 23 bp, Artificial sequence
  SiRNA target sequence
ttaaaaaattctctgcggcattt

SEQ ID NO: 27288 - DNA, 23 bp, Artificial sequence
  SiRNA target sequence
taaaaaattctctgcggcatttt

SEQ ID NO: 27289 - DNA, 23 bp, Artificial sequence
  SiRNA target sequence
aaaaaattctctgcggcattttt

SEQ ID NO: 27290 - DNA, 23 bp, Artificial sequence
  SiRNA target sequence
aaaaattctctgcggcatttttc

SEQ ID NO: 27291 - DNA, 23 bp, Artificial sequence
  SiRNA target sequence
aaaattctctgcggcatttttca

SEQ ID NO: 27292 - DNA, 23 bp, Artificial sequence
  SiRNA target sequence
aaattctctgcggcatttttcat

SEQ ID NO: 27293 - DNA, 23 bp, Artificial sequence
  SiRNA target sequence
aattctctgcggcatttttcatt

SEQ ID NO: 27294 - DNA, 23 bp, Artificial sequence
  SiRNA target sequence
attctctgcggcatttttcattt

SEQ ID NO: 27295 - DNA, 23 bp, Artificial sequence
  SiRNA target sequence
ttctctgcggcatttttcatttt

SEQ ID NO: 27296 - DNA, 23 bp, Artificial sequence
  SiRNA target sequence
tctctgcggcatttttcattttt

SEQ ID NO: 27297 - DNA, 23 bp, Artificial sequence
  SiRNA target sequence
ctctgcggcatttttcatttttg

SEQ ID NO: 27298 - DNA, 23 bp, Artificial sequence
  SiRNA target sequence
tctgcggcatttttcatttttga

SEQ ID NO: 27299 - DNA, 23 bp, Artificial sequence
  SiRNA target sequence
ctgcggcatttttcatttttgac

SEQ ID NO: 27300 - DNA, 23 bp, Artificial sequence
  SiRNA target sequence
tgcggcatttttcatttttgaca

SEQ ID NO: 27301 - DNA, 23 bp, Artificial sequence
  SiRNA target sequence
gcggcatttttcatttttgacaa

SEQ ID NO: 27302 - DNA, 23 bp, Artificial sequence
  SiRNA target sequence
cggcatttttcatttttgacaaa

SEQ ID NO: 27303 - DNA, 23 bp, Artificial sequence
  SiRNA target sequence
ggcatttttcatttttgacaaaa

SEQ ID NO: 27304 - DNA, 23 bp, Artificial sequence
  SiRNA target sequence
gcatttttcatttttgacaaaat

SEQ ID NO: 27305 - DNA, 23 bp, Artificial sequence
  SiRNA target sequence
catttttcatttttgacaaaata

SEQ ID NO: 27306 - DNA, 23 bp, Artificial sequence
  SiRNA target sequence
atttttcatttttgacaaaataa

SEQ ID NO: 27307 - DNA, 23 bp, Artificial sequence
  SiRNA target sequence
tttttcatttttgacaaaataaa

SEQ ID NO: 27308 - DNA, 23 bp, Artificial sequence
  SiRNA target sequence
ttttcatttttgacaaaataaat

SEQ ID NO: 27309 - DNA, 23 bp, Artificial sequence
  SiRNA target sequence
tttcatttttgacaaaataaatg

SEQ ID NO: 27310 - DNA, 23 bp, Artificial sequence
  SiRNA target sequence
ttcatttttgacaaaataaatgc

SEQ ID NO: 27311 - DNA, 23 bp, Artificial sequence
  SiRNA target sequence
tcatttttgacaaaataaatgca

SEQ ID NO: 27312 - DNA, 23 bp, Artificial sequence
  SiRNA target sequence
catttttgacaaaataaatgcac

SEQ ID NO: 27313 - DNA, 23 bp, Artificial sequence
  SiRNA target sequence
atttttgacaaaataaatgcacc

SEQ ID NO: 27314 - DNA, 23 bp, Artificial sequence
  SiRNA target sequence
tttttgacaaaataaatgcacca

SEQ ID NO: 27315 - DNA, 23 bp, Artificial sequence
  SiRNA target sequence
ttttgacaaaataaatgcaccaa

SEQ ID NO: 27316 - DNA, 23 bp, Artificial sequence
  SiRNA target sequence
tttgacaaaataaatgcaccaat

SEQ ID NO: 27317 - DNA, 23 bp, Artificial sequence
  SiRNA target sequence
ttgacaaaataaatgcaccaatt

SEQ ID NO: 27318 - DNA, 23 bp, Artificial sequence
  SiRNA target sequence
tgacaaaataaatgcaccaattt

SEQ ID NO: 27319 - DNA, 23 bp, Artificial sequence
  SiRNA target sequence
gacaaaataaatgcaccaatttg

SEQ ID NO: 27320 - DNA, 23 bp, Artificial sequence
  SiRNA target sequence
acaaaataaatgcaccaatttgt

SEQ ID NO: 27321 - DNA, 23 bp, Artificial sequence
  SiRNA target sequence
caaaataaatgcaccaatttgtg

SEQ ID NO: 27322 - DNA, 23 bp, Artificial sequence
  SiRNA target sequence
aaaataaatgcaccaatttgtgc

SEQ ID NO: 27323 - DNA, 23 bp, Artificial sequence
  SiRNA target sequence
aaataaatgcaccaatttgtgca

SEQ ID NO: 27324 - DNA, 23 bp, Artificial sequence
  SiRNA target sequence
aataaatgcaccaatttgtgcag

SEQ ID NO: 27325 - DNA, 23 bp, Artificial sequence
  SiRNA target sequence
ataaatgcaccaatttgtgcagg

SEQ ID NO: 27326 - DNA, 23 bp, Artificial sequence
  SiRNA target sequence
taaatgcaccaatttgtgcagga

SEQ ID NO: 27327 - DNA, 23 bp, Artificial sequence
  SiRNA target sequence
aaatgcaccaatttgtgcaggag

SEQ ID NO: 27328 - DNA, 23 bp, Artificial sequence
  SiRNA target sequence
aatgcaccaatttgtgcaggaga

SEQ ID NO: 27329 - DNA, 23 bp, Artificial sequence
  SiRNA target sequence
atgcaccaatttgtgcaggagaa

SEQ ID NO: 27330 - DNA, 23 bp, Artificial sequence
  SiRNA target sequence
tgcaccaatttgtgcaggagaat

SEQ ID NO: 27331 - DNA, 23 bp, Artificial sequence
  SiRNA target sequence
gcaccaatttgtgcaggagaata

SEQ ID NO: 27332 - DNA, 23 bp, Artificial sequence
  SiRNA target sequence
caccaatttgtgcaggagaatat

SEQ ID NO: 27333 - DNA, 23 bp, Artificial sequence
  SiRNA target sequence
accaatttgtgcaggagaatatt

SEQ ID NO: 27334 - DNA, 23 bp, Artificial sequence
  SiRNA target sequence
ccaatttgtgcaggagaatattt

SEQ ID NO: 27335 - DNA, 23 bp, Artificial sequence
  SiRNA target sequence
caatttgtgcaggagaatatttc

SEQ ID NO: 27336 - DNA, 23 bp, Artificial sequence
  SiRNA target sequence
aatttgtgcaggagaatatttct

SEQ ID NO: 27337 - DNA, 23 bp, Artificial sequence
  SiRNA target sequence
atttgtgcaggagaatatttctt

SEQ ID NO: 27338 - DNA, 23 bp, Artificial sequence
  SiRNA target sequence
tttgtgcaggagaatatttctta

SEQ ID NO: 27339 - DNA, 23 bp, Artificial sequence
  SiRNA target sequence
ttgtgcaggagaatatttcttat

SEQ ID NO: 27340 - DNA, 23 bp, Artificial sequence
  SiRNA target sequence
tgtgcaggagaatatttcttatt

SEQ ID NO: 27341 - DNA, 23 bp, Artificial sequence
  SiRNA target sequence
gtgcaggagaatatttcttattg

SEQ ID NO: 27342 - DNA, 23 bp, Artificial sequence
  SiRNA target sequence
tgcaggagaatatttcttattgt

SEQ ID NO: 27343 - DNA, 23 bp, Artificial sequence
  SiRNA target sequence
gcaggagaatatttcttattgtc

SEQ ID NO: 27344 - DNA, 23 bp, Artificial sequence
  SiRNA target sequence
caggagaatatttcttattgtca

SEQ ID NO: 27345 - DNA, 23 bp, Artificial sequence
  SiRNA target sequence
aggagaatatttcttattgtcaa

SEQ ID NO: 27346 - DNA, 23 bp, Artificial sequence
  SiRNA target sequence
ggagaatatttcttattgtcaat

SEQ ID NO: 27347 - DNA, 23 bp, Artificial sequence
  SiRNA target sequence
gagaatatttcttattgtcaatt

SEQ ID NO: 27348 - DNA, 23 bp, Artificial sequence
  SiRNA target sequence
agaatatttcttattgtcaattt

SEQ ID NO: 27349 - DNA, 23 bp, Artificial sequence
  SiRNA target sequence
gaatatttcttattgtcaatttt

SEQ ID NO: 27350 - DNA, 23 bp, Artificial sequence
  SiRNA target sequence
aatatttcttattgtcaattttt

SEQ ID NO: 27351 - DNA, 23 bp, Artificial sequence
  SiRNA target sequence
atatttcttattgtcaattttta

SEQ ID NO: 27352 - DNA, 23 bp, Artificial sequence
  SiRNA target sequence
tatttcttattgtcaatttttat

SEQ ID NO: 27353 - DNA, 23 bp, Artificial sequence
  SiRNA target sequence
atttcttattgtcaatttttatc

SEQ ID NO: 27354 - DNA, 23 bp, Artificial sequence
  SiRNA target sequence
tttcttattgtcaatttttatcc

SEQ ID NO: 27355 - DNA, 23 bp, Artificial sequence
  SiRNA target sequence
ttcttattgtcaatttttatcca

SEQ ID NO: 27356 - DNA, 23 bp, Artificial sequence
  SiRNA target sequence
tcttattgtcaatttttatccaa

SEQ ID NO: 27357 - DNA, 23 bp, Artificial sequence
  SiRNA target sequence
cttattgtcaatttttatccaaa

SEQ ID NO: 27358 - DNA, 23 bp, Artificial sequence
  SiRNA target sequence
ttattgtcaatttttatccaaat

SEQ ID NO: 27359 - DNA, 23 bp, Artificial sequence
  SiRNA target sequence
tattgtcaatttttatccaaata

SEQ ID NO: 27360 - DNA, 23 bp, Artificial sequence
  SiRNA target sequence
attgtcaatttttatccaaatat

SEQ ID NO: 27361 - DNA, 23 bp, Artificial sequence
  SiRNA target sequence
ttgtcaatttttatccaaatatc

SEQ ID NO: 27362 - DNA, 23 bp, Artificial sequence
  SiRNA target sequence
tgtcaatttttatccaaatatcg

SEQ ID NO: 27363 - DNA, 23 bp, Artificial sequence
  SiRNA target sequence
gtcaatttttatccaaatatcgc

SEQ ID NO: 27364 - DNA, 23 bp, Artificial sequence
  SiRNA target sequence
tcaatttttatccaaatatcgcc

SEQ ID NO: 27365 - DNA, 23 bp, Artificial sequence
  SiRNA target sequence
caatttttatccaaatatcgccg

SEQ ID NO: 27366 - DNA, 23 bp, Artificial sequence
  SiRNA target sequence
aatttttatccaaatatcgccgt

SEQ ID NO: 27367 - DNA, 23 bp, Artificial sequence
  SiRNA target sequence
atttttatccaaatatcgccgtt

SEQ ID NO: 27368 - DNA, 23 bp, Artificial sequence
  SiRNA target sequence
tttttatccaaatatcgccgtta

SEQ ID NO: 27369 - DNA, 23 bp, Artificial sequence
  SiRNA target sequence
ttttatccaaatatcgccgttac

SEQ ID NO: 27370 - DNA, 23 bp, Artificial sequence
  SiRNA target sequence
tttatccaaatatcgccgttaca

SEQ ID NO: 27371 - DNA, 23 bp, Artificial sequence
  SiRNA target sequence
ttatccaaatatcgccgttacaa

SEQ ID NO: 27372 - DNA, 23 bp, Artificial sequence
  SiRNA target sequence
tatccaaatatcgccgttacaat

SEQ ID NO: 27373 - DNA, 23 bp, Artificial sequence
  SiRNA target sequence
atccaaatatcgccgttacaatg

SEQ ID NO: 27374 - DNA, 23 bp, Artificial sequence
  SiRNA target sequence
tccaaatatcgccgttacaatgc

SEQ ID NO: 27375 - DNA, 23 bp, Artificial sequence
  SiRNA target sequence
ccaaatatcgccgttacaatgct

SEQ ID NO: 27376 - DNA, 23 bp, Artificial sequence
  SiRNA target sequence
caaatatcgccgttacaatgctt

SEQ ID NO: 27377 - DNA, 23 bp, Artificial sequence
  SiRNA target sequence
aaatatcgccgttacaatgctta

SEQ ID NO: 27378 - DNA, 23 bp, Artificial sequence
  SiRNA target sequence
aatatcgccgttacaatgcttag

SEQ ID NO: 27379 - DNA, 23 bp, Artificial sequence
  SiRNA target sequence
atatcgccgttacaatgcttagt

SEQ ID NO: 27380 - DNA, 23 bp, Artificial sequence
  SiRNA target sequence
tatcgccgttacaatgcttagta

SEQ ID NO: 27381 - DNA, 23 bp, Artificial sequence
  SiRNA target sequence
atcgccgttacaatgcttagtag

SEQ ID NO: 27382 - DNA, 23 bp, Artificial sequence
  SiRNA target sequence
tcgccgttacaatgcttagtagt

SEQ ID NO: 27383 - DNA, 23 bp, Artificial sequence
  SiRNA target sequence
cgccgttacaatgcttagtagtg

SEQ ID NO: 27384 - DNA, 23 bp, Artificial sequence
  SiRNA target sequence
gccgttacaatgcttagtagtgt

SEQ ID NO: 27385 - DNA, 23 bp, Artificial sequence
  SiRNA target sequence
ccgttacaatgcttagtagtgtc

SEQ ID NO: 27386 - DNA, 23 bp, Artificial sequence
  SiRNA target sequence
cgttacaatgcttagtagtgtca

SEQ ID NO: 27387 - DNA, 23 bp, Artificial sequence
  SiRNA target sequence
gttacaatgcttagtagtgtcat

SEQ ID NO: 27388 - DNA, 23 bp, Artificial sequence
  SiRNA target sequence
ttacaatgcttagtagtgtcata

SEQ ID NO: 27389 - DNA, 23 bp, Artificial sequence
  SiRNA target sequence
tacaatgcttagtagtgtcatat

SEQ ID NO: 27390 - DNA, 23 bp, Artificial sequence
  SiRNA target sequence
acaatgcttagtagtgtcatatg

SEQ ID NO: 27391 - DNA, 23 bp, Artificial sequence
  SiRNA target sequence
caatgcttagtagtgtcatatgg

SEQ ID NO: 27392 - DNA, 23 bp, Artificial sequence
  SiRNA target sequence
aatgcttagtagtgtcatatggt

SEQ ID NO: 27393 - DNA, 23 bp, Artificial sequence
  SiRNA target sequence
atgcttagtagtgtcatatggta

SEQ ID NO: 27394 - DNA, 23 bp, Artificial sequence
  SiRNA target sequence
tgcttagtagtgtcatatggtaa

SEQ ID NO: 27395 - DNA, 23 bp, Artificial sequence
  SiRNA target sequence
gcttagtagtgtcatatggtaag

SEQ ID NO: 27396 - DNA, 23 bp, Artificial sequence
  SiRNA target sequence
cttagtagtgtcatatggtaagc

SEQ ID NO: 27397 - DNA, 23 bp, Artificial sequence
  SiRNA target sequence
ttagtagtgtcatatggtaagct

SEQ ID NO: 27398 - DNA, 23 bp, Artificial sequence
  SiRNA target sequence
tagtagtgtcatatggtaagctt

SEQ ID NO: 27399 - DNA, 23 bp, Artificial sequence
  SiRNA target sequence
agtagtgtcatatggtaagcttt

SEQ ID NO: 27400 - DNA, 23 bp, Artificial sequence
  SiRNA target sequence
gtagtgtcatatggtaagctttt

SEQ ID NO: 27401 - DNA, 23 bp, Artificial sequence
  SiRNA target sequence
tagtgtcatatggtaagcttttt

SEQ ID NO: 27402 - DNA, 23 bp, Artificial sequence
  SiRNA target sequence
agtgtcatatggtaagcttttta

SEQ ID NO: 27403 - DNA, 23 bp, Artificial sequence
  SiRNA target sequence
gtgtcatatggtaagctttttaa

SEQ ID NO: 27404 - DNA, 23 bp, Artificial sequence
  SiRNA target sequence
tgtcatatggtaagctttttaaa

SEQ ID NO: 27405 - DNA, 23 bp, Artificial sequence
  SiRNA target sequence
gtcatatggtaagctttttaaat

SEQ ID NO: 27406 - DNA, 23 bp, Artificial sequence
  SiRNA target sequence
tcatatggtaagctttttaaata

SEQ ID NO: 27407 - DNA, 23 bp, Artificial sequence
  SiRNA target sequence
catatggtaagctttttaaataa

SEQ ID NO: 27408 - DNA, 23 bp, Artificial sequence
  SiRNA target sequence
atatggtaagctttttaaataat

SEQ ID NO: 27409 - DNA, 23 bp, Artificial sequence
  SiRNA target sequence
tatggtaagctttttaaataatc

SEQ ID NO: 27410 - DNA, 23 bp, Artificial sequence
  SiRNA target sequence
atggtaagctttttaaataatct

SEQ ID NO: 27411 - DNA, 23 bp, Artificial sequence
  SiRNA target sequence
tggtaagctttttaaataatctt

SEQ ID NO: 27412 - DNA, 23 bp, Artificial sequence
  SiRNA target sequence
ggtaagctttttaaataatcttt

SEQ ID NO: 27413 - DNA, 23 bp, Artificial sequence
  SiRNA target sequence
gtaagctttttaaataatctttt

SEQ ID NO: 27414 - DNA, 23 bp, Artificial sequence
  SiRNA target sequence
taagctttttaaataatctttta

SEQ ID NO: 27415 - DNA, 23 bp, Artificial sequence
  SiRNA target sequence
aagctttttaaataatcttttaa

SEQ ID NO: 27416 - DNA, 23 bp, Artificial sequence
  SiRNA target sequence
agctttttaaataatcttttaat

SEQ ID NO: 27417 - DNA, 23 bp, Artificial sequence
  SiRNA target sequence
gctttttaaataatcttttaatt

SEQ ID NO: 27418 - DNA, 23 bp, Artificial sequence
  SiRNA target sequence
ctttttaaataatcttttaattc

SEQ ID NO: 27419 - DNA, 23 bp, Artificial sequence
  SiRNA target sequence
tttttaaataatcttttaattct

SEQ ID NO: 27420 - DNA, 23 bp, Artificial sequence
  SiRNA target sequence
ttttaaataatcttttaattcta

SEQ ID NO: 27421 - DNA, 23 bp, Artificial sequence
  SiRNA target sequence
tttaaataatcttttaattctac

SEQ ID NO: 27422 - DNA, 23 bp, Artificial sequence
  SiRNA target sequence
ttaaataatcttttaattctaca

SEQ ID NO: 27423 - DNA, 23 bp, Artificial sequence
  SiRNA target sequence
taaataatcttttaattctacat

SEQ ID NO: 27424 - DNA, 23 bp, Artificial sequence
  SiRNA target sequence
aaataatcttttaattctacatc

SEQ ID NO: 27425 - DNA, 23 bp, Artificial sequence
  SiRNA target sequence
aataatcttttaattctacatca

SEQ ID NO: 27426 - DNA, 23 bp, Artificial sequence
  SiRNA target sequence
ataatcttttaattctacatcat

SEQ ID NO: 27427 - DNA, 23 bp, Artificial sequence
  SiRNA target sequence
taatcttttaattctacatcatc

SEQ ID NO: 27428 - DNA, 23 bp, Artificial sequence
  SiRNA target sequence
aatcttttaattctacatcatca

SEQ ID NO: 27429 - DNA, 23 bp, Artificial sequence
  SiRNA target sequence
atcttttaattctacatcatcaa

SEQ ID NO: 27430 - DNA, 23 bp, Artificial sequence
  SiRNA target sequence
tcttttaattctacatcatcaaa

SEQ ID NO: 27431 - DNA, 23 bp, Artificial sequence
  SiRNA target sequence
cttttaattctacatcatcaaat

SEQ ID NO: 27432 - DNA, 23 bp, Artificial sequence
  SiRNA target sequence
ttttaattctacatcatcaaatt

SEQ ID NO: 27433 - DNA, 23 bp, Artificial sequence
  SiRNA target sequence
tttaattctacatcatcaaattt

SEQ ID NO: 27434 - DNA, 23 bp, Artificial sequence
  SiRNA target sequence
ttaattctacatcatcaaatttt

SEQ ID NO: 27435 - DNA, 23 bp, Artificial sequence
  SiRNA target sequence
taattctacatcatcaaattttc

SEQ ID NO: 27436 - DNA, 23 bp, Artificial sequence
  SiRNA target sequence
aattctacatcatcaaattttcg

SEQ ID NO: 27437 - DNA, 23 bp, Artificial sequence
  SiRNA target sequence
attctacatcatcaaattttcgt

SEQ ID NO: 27438 - DNA, 23 bp, Artificial sequence
  SiRNA target sequence
ttctacatcatcaaattttcgtc

SEQ ID NO: 27439 - DNA, 23 bp, Artificial sequence
  SiRNA target sequence
tctacatcatcaaattttcgtcc

SEQ ID NO: 27440 - DNA, 23 bp, Artificial sequence
  SiRNA target sequence
ctacatcatcaaattttcgtccc

SEQ ID NO: 27441 - DNA, 23 bp, Artificial sequence
  SiRNA target sequence
tacatcatcaaattttcgtccca

SEQ ID NO: 27442 - DNA, 23 bp, Artificial sequence
  SiRNA target sequence
acatcatcaaattttcgtcccag

SEQ ID NO: 27443 - DNA, 23 bp, Artificial sequence
  SiRNA target sequence
catcatcaaattttcgtcccagc

SEQ ID NO: 27444 - DNA, 23 bp, Artificial sequence
  SiRNA target sequence
atcatcaaattttcgtcccagca

SEQ ID NO: 27445 - DNA, 23 bp, Artificial sequence
  SiRNA target sequence
tcatcaaattttcgtcccagcaa

SEQ ID NO: 27446 - DNA, 23 bp, Artificial sequence
  SiRNA target sequence
catcaaattttcgtcccagcaat

SEQ ID NO: 27447 - DNA, 23 bp, Artificial sequence
  SiRNA target sequence
atcaaattttcgtcccagcaatc

SEQ ID NO: 27448 - DNA, 23 bp, Artificial sequence
  SiRNA target sequence
tcaaattttcgtcccagcaatct

SEQ ID NO: 27449 - DNA, 23 bp, Artificial sequence
  SiRNA target sequence
caaattttcgtcccagcaatctc

SEQ ID NO: 27450 - DNA, 23 bp, Artificial sequence
  SiRNA target sequence
aaattttcgtcccagcaatctct

SEQ ID NO: 27451 - DNA, 23 bp, Artificial sequence
  SiRNA target sequence
aattttcgtcccagcaatctctt

SEQ ID NO: 27452 - DNA, 23 bp, Artificial sequence
  SiRNA target sequence
attttcgtcccagcaatctctta

SEQ ID NO: 27453 - DNA, 23 bp, Artificial sequence
  SiRNA target sequence
ttttcgtcccagcaatctcttag

SEQ ID NO: 27454 - DNA, 23 bp, Artificial sequence
  SiRNA target sequence
tttcgtcccagcaatctcttaga

SEQ ID NO: 27455 - DNA, 23 bp, Artificial sequence
  SiRNA target sequence
ttcgtcccagcaatctcttagac

SEQ ID NO: 27456 - DNA, 23 bp, Artificial sequence
  SiRNA target sequence
tcgtcccagcaatctcttagacg

SEQ ID NO: 27457 - DNA, 23 bp, Artificial sequence
  SiRNA target sequence
cgtcccagcaatctcttagacgc

SEQ ID NO: 27458 - DNA, 23 bp, Artificial sequence
  SiRNA target sequence
gtcccagcaatctcttagacgca

SEQ ID NO: 27459 - DNA, 23 bp, Artificial sequence
  SiRNA target sequence
tcccagcaatctcttagacgcaa

SEQ ID NO: 27460 - DNA, 23 bp, Artificial sequence
  SiRNA target sequence
cccagcaatctcttagacgcaaa

SEQ ID NO: 27461 - DNA, 23 bp, Artificial sequence
  SiRNA target sequence
ccagcaatctcttagacgcaaaa

SEQ ID NO: 27462 - DNA, 23 bp, Artificial sequence
  SiRNA target sequence
cagcaatctcttagacgcaaaaa

SEQ ID NO: 27463 - DNA, 23 bp, Artificial sequence
  SiRNA target sequence
agcaatctcttagacgcaaaaat

SEQ ID NO: 27464 - DNA, 23 bp, Artificial sequence
  SiRNA target sequence
gcaatctcttagacgcaaaaatc

SEQ ID NO: 27465 - DNA, 23 bp, Artificial sequence
  SiRNA target sequence
caatctcttagacgcaaaaatcg

SEQ ID NO: 27466 - DNA, 23 bp, Artificial sequence
  SiRNA target sequence
aatctcttagacgcaaaaatcgt

SEQ ID NO: 27467 - DNA, 23 bp, Artificial sequence
  SiRNA target sequence
atctcttagacgcaaaaatcgta

SEQ ID NO: 27468 - DNA, 23 bp, Artificial sequence
  SiRNA target sequence
tctcttagacgcaaaaatcgtat

SEQ ID NO: 27469 - DNA, 23 bp, Artificial sequence
  SiRNA target sequence
ctcttagacgcaaaaatcgtatt

SEQ ID NO: 27470 - DNA, 23 bp, Artificial sequence
  SiRNA target sequence
tcttagacgcaaaaatcgtattc

SEQ ID NO: 27471 - DNA, 23 bp, Artificial sequence
  SiRNA target sequence
cttagacgcaaaaatcgtattct

SEQ ID NO: 27472 - DNA, 23 bp, Artificial sequence
  SiRNA target sequence
ttagacgcaaaaatcgtattctt

SEQ ID NO: 27473 - DNA, 23 bp, Artificial sequence
  SiRNA target sequence
tagacgcaaaaatcgtattcttg

SEQ ID NO: 27474 - DNA, 23 bp, Artificial sequence
  SiRNA target sequence
agacgcaaaaatcgtattcttgg

SEQ ID NO: 27475 - DNA, 23 bp, Artificial sequence
  SiRNA target sequence
gacgcaaaaatcgtattcttggg

SEQ ID NO: 27476 - DNA, 23 bp, Artificial sequence
  SiRNA target sequence
acgcaaaaatcgtattcttggga

SEQ ID NO: 27477 - DNA, 23 bp, Artificial sequence
  SiRNA target sequence
cgcaaaaatcgtattcttgggat

SEQ ID NO: 27478 - DNA, 23 bp, Artificial sequence
  SiRNA target sequence
gcaaaaatcgtattcttgggatg

SEQ ID NO: 27479 - DNA, 23 bp, Artificial sequence
  SiRNA target sequence
caaaaatcgtattcttgggatgt

SEQ ID NO: 27480 - DNA, 23 bp, Artificial sequence
  SiRNA target sequence
aaaaatcgtattcttgggatgta

SEQ ID NO: 27481 - DNA, 23 bp, Artificial sequence
  SiRNA target sequence
aaaatcgtattcttgggatgtaa

SEQ ID NO: 27482 - DNA, 23 bp, Artificial sequence
  SiRNA target sequence
aaatcgtattcttgggatgtaat

SEQ ID NO: 27483 - DNA, 23 bp, Artificial sequence
  SiRNA target sequence
aatcgtattcttgggatgtaata

SEQ ID NO: 27484 - DNA, 23 bp, Artificial sequence
  SiRNA target sequence
atcgtattcttgggatgtaataa

SEQ ID NO: 27485 - DNA, 23 bp, Artificial sequence
  SiRNA target sequence
tcgtattcttgggatgtaataac

SEQ ID NO: 27486 - DNA, 23 bp, Artificial sequence
  SiRNA target sequence
cgtattcttgggatgtaataaca

SEQ ID NO: 27487 - DNA, 23 bp, Artificial sequence
  SiRNA target sequence
gtattcttgggatgtaataacaa

SEQ ID NO: 27488 - DNA, 23 bp, Artificial sequence
  SiRNA target sequence
tattcttgggatgtaataacaag

SEQ ID NO: 27489 - DNA, 23 bp, Artificial sequence
  SiRNA target sequence
attcttgggatgtaataacaagt

SEQ ID NO: 27490 - DNA, 23 bp, Artificial sequence
  SiRNA target sequence
ttcttgggatgtaataacaagtt

SEQ ID NO: 27491 - DNA, 23 bp, Artificial sequence
  SiRNA target sequence
tcttgggatgtaataacaagtta

SEQ ID NO: 27492 - DNA, 23 bp, Artificial sequence
  SiRNA target sequence
cttgggatgtaataacaagttag

SEQ ID NO: 27493 - DNA, 23 bp, Artificial sequence
  SiRNA target sequence
ttgggatgtaataacaagttaga

SEQ ID NO: 27494 - DNA, 23 bp, Artificial sequence
  SiRNA target sequence
tgggatgtaataacaagttagac

SEQ ID NO: 27495 - DNA, 23 bp, Artificial sequence
  SiRNA target sequence
gggatgtaataacaagttagact

SEQ ID NO: 27496 - DNA, 23 bp, Artificial sequence
  SiRNA target sequence
ggatgtaataacaagttagactt

SEQ ID NO: 27497 - DNA, 23 bp, Artificial sequence
  SiRNA target sequence
gatgtaataacaagttagactta

SEQ ID NO: 27498 - DNA, 23 bp, Artificial sequence
  SiRNA target sequence
atgtaataacaagttagacttag

SEQ ID NO: 27499 - DNA, 23 bp, Artificial sequence
  SiRNA target sequence
tgtaataacaagttagacttagc

SEQ ID NO: 27500 - DNA, 23 bp, Artificial sequence
  SiRNA target sequence
gtaataacaagttagacttagct

SEQ ID NO: 27501 - DNA, 23 bp, Artificial sequence
  SiRNA target sequence
taataacaagttagacttagctt

SEQ ID NO: 27502 - DNA, 23 bp, Artificial sequence
  SiRNA target sequence
aataacaagttagacttagcttg

SEQ ID NO: 27503 - DNA, 23 bp, Artificial sequence
  SiRNA target sequence
ataacaagttagacttagcttgc

SEQ ID NO: 27504 - DNA, 23 bp, Artificial sequence
  SiRNA target sequence
taacaagttagacttagcttgct

SEQ ID NO: 27505 - DNA, 23 bp, Artificial sequence
  SiRNA target sequence
aacaagttagacttagcttgctc

SEQ ID NO: 27506 - DNA, 23 bp, Artificial sequence
  SiRNA target sequence
acaagttagacttagcttgctca

SEQ ID NO: 27507 - DNA, 23 bp, Artificial sequence
  SiRNA target sequence
caagttagacttagcttgctcac

SEQ ID NO: 27508 - DNA, 23 bp, Artificial sequence
  SiRNA target sequence
aagttagacttagcttgctcacc

SEQ ID NO: 27509 - DNA, 23 bp, Artificial sequence
  SiRNA target sequence
agttagacttagcttgctcacct

SEQ ID NO: 27510 - DNA, 23 bp, Artificial sequence
  SiRNA target sequence
gttagacttagcttgctcacctg

SEQ ID NO: 27511 - DNA, 23 bp, Artificial sequence
  SiRNA target sequence
ttagacttagcttgctcacctgt

SEQ ID NO: 27512 - DNA, 23 bp, Artificial sequence
  SiRNA target sequence
tagacttagcttgctcacctgtt

SEQ ID NO: 27513 - DNA, 23 bp, Artificial sequence
  SiRNA target sequence
agacttagcttgctcacctgtta

SEQ ID NO: 27514 - DNA, 23 bp, Artificial sequence
  SiRNA target sequence
gacttagcttgctcacctgttaa

SEQ ID NO: 27515 - DNA, 23 bp, Artificial sequence
  SiRNA target sequence
acttagcttgctcacctgttaaa

SEQ ID NO: 27516 - DNA, 23 bp, Artificial sequence
  SiRNA target sequence
cttagcttgctcacctgttaaaa

SEQ ID NO: 27517 - DNA, 23 bp, Artificial sequence
  SiRNA target sequence
ttagcttgctcacctgttaaaat

SEQ ID NO: 27518 - DNA, 23 bp, Artificial sequence
  SiRNA target sequence
tagcttgctcacctgttaaaatt

SEQ ID NO: 27519 - DNA, 23 bp, Artificial sequence
  SiRNA target sequence
agcttgctcacctgttaaaattt

SEQ ID NO: 27520 - DNA, 23 bp, Artificial sequence
  SiRNA target sequence
gcttgctcacctgttaaaatttt

SEQ ID NO: 27521 - DNA, 23 bp, Artificial sequence
  SiRNA target sequence
cttgctcacctgttaaaatttta

SEQ ID NO: 27522 - DNA, 23 bp, Artificial sequence
  SiRNA target sequence
ttgctcacctgttaaaattttat

SEQ ID NO: 27523 - DNA, 23 bp, Artificial sequence
  SiRNA target sequence
tgctcacctgttaaaattttatc

SEQ ID NO: 27524 - DNA, 23 bp, Artificial sequence
  SiRNA target sequence
gctcacctgttaaaattttatct

SEQ ID NO: 27525 - DNA, 23 bp, Artificial sequence
  SiRNA target sequence
ctcacctgttaaaattttatctt

SEQ ID NO: 27526 - DNA, 23 bp, Artificial sequence
  SiRNA target sequence
tcacctgttaaaattttatcttt

SEQ ID NO: 27527 - DNA, 23 bp, Artificial sequence
  SiRNA target sequence
cacctgttaaaattttatcttta

SEQ ID NO: 27528 - DNA, 23 bp, Artificial sequence
  SiRNA target sequence
acctgttaaaattttatctttaa

SEQ ID NO: 27529 - DNA, 23 bp, Artificial sequence
  SiRNA target sequence
cctgttaaaattttatctttaaa

SEQ ID NO: 27530 - DNA, 23 bp, Artificial sequence
  SiRNA target sequence
ctgttaaaattttatctttaaaa

SEQ ID NO: 27531 - DNA, 23 bp, Artificial sequence
  SiRNA target sequence
tgttaaaattttatctttaaaaa

SEQ ID NO: 27532 - DNA, 23 bp, Artificial sequence
  SiRNA target sequence
gttaaaattttatctttaaaaat

SEQ ID NO: 27533 - DNA, 23 bp, Artificial sequence
  SiRNA target sequence
ttaaaattttatctttaaaaatt

SEQ ID NO: 27534 - DNA, 23 bp, Artificial sequence
  SiRNA target sequence
taaaattttatctttaaaaattg

SEQ ID NO: 27535 - DNA, 23 bp, Artificial sequence
  SiRNA target sequence
aaaattttatctttaaaaattga

SEQ ID NO: 27536 - DNA, 23 bp, Artificial sequence
  SiRNA target sequence
aaattttatctttaaaaattgat

SEQ ID NO: 27537 - DNA, 23 bp, Artificial sequence
  SiRNA target sequence
aattttatctttaaaaattgata

SEQ ID NO: 27538 - DNA, 23 bp, Artificial sequence
  SiRNA target sequence
attttatctttaaaaattgatac

SEQ ID NO: 27539 - DNA, 23 bp, Artificial sequence
  SiRNA target sequence
ttttatctttaaaaattgatacc

SEQ ID NO: 27540 - DNA, 23 bp, Artificial sequence
  SiRNA target sequence
tttatctttaaaaattgatacca

SEQ ID NO: 27541 - DNA, 23 bp, Artificial sequence
  SiRNA target sequence
ttatctttaaaaattgataccac

SEQ ID NO: 27542 - DNA, 23 bp, Artificial sequence
  SiRNA target sequence
tatctttaaaaattgataccacc

SEQ ID NO: 27543 - DNA, 23 bp, Artificial sequence
  SiRNA target sequence
atctttaaaaattgataccaccg

SEQ ID NO: 27544 - DNA, 23 bp, Artificial sequence
  SiRNA target sequence
tctttaaaaattgataccaccga

SEQ ID NO: 27545 - DNA, 23 bp, Artificial sequence
  SiRNA target sequence
ctttaaaaattgataccaccgat

SEQ ID NO: 27546 - DNA, 23 bp, Artificial sequence
  SiRNA target sequence
tttaaaaattgataccaccgatg

SEQ ID NO: 27547 - DNA, 23 bp, Artificial sequence
  SiRNA target sequence
ttaaaaattgataccaccgatgg

SEQ ID NO: 27548 - DNA, 23 bp, Artificial sequence
  SiRNA target sequence
taaaaattgataccaccgatggt

SEQ ID NO: 27549 - DNA, 23 bp, Artificial sequence
  SiRNA target sequence
aaaaattgataccaccgatggtg

SEQ ID NO: 27550 - DNA, 23 bp, Artificial sequence
  SiRNA target sequence
aaaattgataccaccgatggtgt

SEQ ID NO: 27551 - DNA, 23 bp, Artificial sequence
  SiRNA target sequence
aaattgataccaccgatggtgta

SEQ ID NO: 27552 - DNA, 23 bp, Artificial sequence
  SiRNA target sequence
aattgataccaccgatggtgtag

SEQ ID NO: 27553 - DNA, 23 bp, Artificial sequence
  SiRNA target sequence
attgataccaccgatggtgtagt

SEQ ID NO: 27554 - DNA, 23 bp, Artificial sequence
  SiRNA target sequence
ttgataccaccgatggtgtagtt

SEQ ID NO: 27555 - DNA, 23 bp, Artificial sequence
  SiRNA target sequence
tgataccaccgatggtgtagttc

SEQ ID NO: 27556 - DNA, 23 bp, Artificial sequence
  SiRNA target sequence
gataccaccgatggtgtagttct

SEQ ID NO: 27557 - DNA, 23 bp, Artificial sequence
  SiRNA target sequence
ataccaccgatggtgtagttcta

SEQ ID NO: 27558 - DNA, 23 bp, Artificial sequence
  SiRNA target sequence
taccaccgatggtgtagttctac

SEQ ID NO: 27559 - DNA, 23 bp, Artificial sequence
  SiRNA target sequence
accaccgatggtgtagttctacc

SEQ ID NO: 27560 - DNA, 23 bp, Artificial sequence
  SiRNA target sequence
ccaccgatggtgtagttctacca

SEQ ID NO: 27561 - DNA, 23 bp, Artificial sequence
  SiRNA target sequence
caccgatggtgtagttctaccac

SEQ ID NO: 27562 - DNA, 23 bp, Artificial sequence
  SiRNA target sequence
accgatggtgtagttctaccacc

SEQ ID NO: 27563 - DNA, 23 bp, Artificial sequence
  SiRNA target sequence
ccgatggtgtagttctaccacct

SEQ ID NO: 27564 - DNA, 23 bp, Artificial sequence
  SiRNA target sequence
cgatggtgtagttctaccacctt

SEQ ID NO: 27565 - DNA, 23 bp, Artificial sequence
  SiRNA target sequence
gatggtgtagttctaccaccttc

SEQ ID NO: 27566 - DNA, 23 bp, Artificial sequence
  SiRNA target sequence
atggtgtagttctaccaccttct

SEQ ID NO: 27567 - DNA, 23 bp, Artificial sequence
  SiRNA target sequence
tggtgtagttctaccaccttctt

SEQ ID NO: 27568 - DNA, 23 bp, Artificial sequence
  SiRNA target sequence
ggtgtagttctaccaccttcttc

SEQ ID NO: 27569 - DNA, 23 bp, Artificial sequence
  SiRNA target sequence
gtgtagttctaccaccttcttcg

SEQ ID NO: 27570 - DNA, 23 bp, Artificial sequence
  SiRNA target sequence
tgtagttctaccaccttcttcgt

SEQ ID NO: 27571 - DNA, 23 bp, Artificial sequence
  SiRNA target sequence
gtagttctaccaccttcttcgtt

SEQ ID NO: 27572 - DNA, 23 bp, Artificial sequence
  SiRNA target sequence
tagttctaccaccttcttcgttt

SEQ ID NO: 27573 - DNA, 23 bp, Artificial sequence
  SiRNA target sequence
agttctaccaccttcttcgtttt

SEQ ID NO: 27574 - DNA, 23 bp, Artificial sequence
  SiRNA target sequence
gttctaccaccttcttcgttttc

SEQ ID NO: 27575 - DNA, 23 bp, Artificial sequence
  SiRNA target sequence
ttctaccaccttcttcgttttca

SEQ ID NO: 27576 - DNA, 23 bp, Artificial sequence
  SiRNA target sequence
tctaccaccttcttcgttttcaa

SEQ ID NO: 27577 - DNA, 23 bp, Artificial sequence
  SiRNA target sequence
ctaccaccttcttcgttttcaat

SEQ ID NO: 27578 - DNA, 23 bp, Artificial sequence
  SiRNA target sequence
taccaccttcttcgttttcaata

SEQ ID NO: 27579 - DNA, 23 bp, Artificial sequence
  SiRNA target sequence
accaccttcttcgttttcaataa

SEQ ID NO: 27580 - DNA, 23 bp, Artificial sequence
  SiRNA target sequence
ccaccttcttcgttttcaataat

SEQ ID NO: 27581 - DNA, 23 bp, Artificial sequence
  SiRNA target sequence
caccttcttcgttttcaataatt

SEQ ID NO: 27582 - DNA, 23 bp, Artificial sequence
  SiRNA target sequence
accttcttcgttttcaataattt

SEQ ID NO: 27583 - DNA, 23 bp, Artificial sequence
  SiRNA target sequence
ccttcttcgttttcaataatttg

SEQ ID NO: 27584 - DNA, 23 bp, Artificial sequence
  SiRNA target sequence
cttcttcgttttcaataatttgt

SEQ ID NO: 27585 - DNA, 23 bp, Artificial sequence
  SiRNA target sequence
ttcttcgttttcaataatttgtg

SEQ ID NO: 27586 - DNA, 23 bp, Artificial sequence
  SiRNA target sequence
tcttcgttttcaataatttgtgg

SEQ ID NO: 27587 - DNA, 23 bp, Artificial sequence
  SiRNA target sequence
cttcgttttcaataatttgtggg

SEQ ID NO: 27588 - DNA, 23 bp, Artificial sequence
  SiRNA target sequence
ttcgttttcaataatttgtggga

SEQ ID NO: 27589 - DNA, 23 bp, Artificial sequence
  SiRNA target sequence
tcgttttcaataatttgtgggat

SEQ ID NO: 27590 - DNA, 23 bp, Artificial sequence
  SiRNA target sequence
cgttttcaataatttgtgggata

SEQ ID NO: 27591 - DNA, 23 bp, Artificial sequence
  SiRNA target sequence
gttttcaataatttgtgggatat

SEQ ID NO: 27592 - DNA, 23 bp, Artificial sequence
  SiRNA target sequence
ttttcaataatttgtgggatatt

SEQ ID NO: 27593 - DNA, 23 bp, Artificial sequence
  SiRNA target sequence
tttcaataatttgtgggatattg

SEQ ID NO: 27594 - DNA, 23 bp, Artificial sequence
  SiRNA target sequence
ttcaataatttgtgggatattgt

SEQ ID NO: 27595 - DNA, 23 bp, Artificial sequence
  SiRNA target sequence
tcaataatttgtgggatattgtt

SEQ ID NO: 27596 - DNA, 23 bp, Artificial sequence
  SiRNA target sequence
caataatttgtgggatattgtta

SEQ ID NO: 27597 - DNA, 23 bp, Artificial sequence
  SiRNA target sequence
aataatttgtgggatattgttat

SEQ ID NO: 27598 - DNA, 23 bp, Artificial sequence
  SiRNA target sequence
ataatttgtgggatattgttatg

SEQ ID NO: 27599 - DNA, 23 bp, Artificial sequence
  SiRNA target sequence
taatttgtgggatattgttatgt

SEQ ID NO: 27600 - DNA, 23 bp, Artificial sequence
  SiRNA target sequence
aatttgtgggatattgttatgta

SEQ ID NO: 27601 - DNA, 23 bp, Artificial sequence
  SiRNA target sequence
atttgtgggatattgttatgtat

SEQ ID NO: 27602 - DNA, 23 bp, Artificial sequence
  SiRNA target sequence
tttgtgggatattgttatgtata

SEQ ID NO: 27603 - DNA, 23 bp, Artificial sequence
  SiRNA target sequence
ttgtgggatattgttatgtataa

SEQ ID NO: 27604 - DNA, 23 bp, Artificial sequence
  SiRNA target sequence
tgtgggatattgttatgtataag

SEQ ID NO: 27605 - DNA, 23 bp, Artificial sequence
  SiRNA target sequence
gtgggatattgttatgtataaga

SEQ ID NO: 27606 - DNA, 23 bp, Artificial sequence
  SiRNA target sequence
tgggatattgttatgtataagag

SEQ ID NO: 27607 - DNA, 23 bp, Artificial sequence
  SiRNA target sequence
gggatattgttatgtataagaga

SEQ ID NO: 27608 - DNA, 23 bp, Artificial sequence
  SiRNA target sequence
ggatattgttatgtataagagac

SEQ ID NO: 27609 - DNA, 23 bp, Artificial sequence
  SiRNA target sequence
gatattgttatgtataagagaca

SEQ ID NO: 27610 - DNA, 23 bp, Artificial sequence
  SiRNA target sequence
atattgttatgtataagagacac

SEQ ID NO: 27611 - DNA, 23 bp, Artificial sequence
  SiRNA target sequence
tattgttatgtataagagacaca

SEQ ID NO: 27612 - DNA, 23 bp, Artificial sequence
  SiRNA target sequence
attgttatgtataagagacacac

SEQ ID NO: 27613 - DNA, 23 bp, Artificial sequence
  SiRNA target sequence
ttgttatgtataagagacacaca

SEQ ID NO: 27614 - DNA, 23 bp, Artificial sequence
  SiRNA target sequence
tgttatgtataagagacacacaa

SEQ ID NO: 27615 - DNA, 23 bp, Artificial sequence
  SiRNA target sequence
gttatgtataagagacacacaag

SEQ ID NO: 27616 - DNA, 23 bp, Artificial sequence
  SiRNA target sequence
ttatgtataagagacacacaaga

SEQ ID NO: 27617 - DNA, 23 bp, Artificial sequence
  SiRNA target sequence
tatgtataagagacacacaagaa

SEQ ID NO: 27618 - DNA, 23 bp, Artificial sequence
  SiRNA target sequence
atgtataagagacacacaagaat

SEQ ID NO: 27619 - DNA, 23 bp, Artificial sequence
  SiRNA target sequence
tgtataagagacacacaagaatt

SEQ ID NO: 27620 - DNA, 23 bp, Artificial sequence
  SiRNA target sequence
gtataagagacacacaagaattg

SEQ ID NO: 27621 - DNA, 23 bp, Artificial sequence
  SiRNA target sequence
tataagagacacacaagaattgg

SEQ ID NO: 27622 - DNA, 23 bp, Artificial sequence
  SiRNA target sequence
ataagagacacacaagaattggt

SEQ ID NO: 27623 - DNA, 23 bp, Artificial sequence
  SiRNA target sequence
taagagacacacaagaattggtt

SEQ ID NO: 27624 - DNA, 23 bp, Artificial sequence
  SiRNA target sequence
aagagacacacaagaattggttg

SEQ ID NO: 27625 - DNA, 23 bp, Artificial sequence
  SiRNA target sequence
agagacacacaagaattggttgt

SEQ ID NO: 27626 - DNA, 23 bp, Artificial sequence
  SiRNA target sequence
gagacacacaagaattggttgtt

SEQ ID NO: 27627 - DNA, 23 bp, Artificial sequence
  SiRNA target sequence
agacacacaagaattggttgttc

SEQ ID NO: 27628 - DNA, 23 bp, Artificial sequence
  SiRNA target sequence
gacacacaagaattggttgttcc

SEQ ID NO: 27629 - DNA, 23 bp, Artificial sequence
  SiRNA target sequence
acacacaagaattggttgttcct

SEQ ID NO: 27630 - DNA, 23 bp, Artificial sequence
  SiRNA target sequence
cacacaagaattggttgttccta

SEQ ID NO: 27631 - DNA, 23 bp, Artificial sequence
  SiRNA target sequence
acacaagaattggttgttcctag

SEQ ID NO: 27632 - DNA, 23 bp, Artificial sequence
  SiRNA target sequence
cacaagaattggttgttcctaga

SEQ ID NO: 27633 - DNA, 23 bp, Artificial sequence
  SiRNA target sequence
acaagaattggttgttcctagat

SEQ ID NO: 27634 - DNA, 23 bp, Artificial sequence
  SiRNA target sequence
caagaattggttgttcctagatc

SEQ ID NO: 27635 - DNA, 23 bp, Artificial sequence
  SiRNA target sequence
aagaattggttgttcctagatca

SEQ ID NO: 27636 - DNA, 23 bp, Artificial sequence
  SiRNA target sequence
agaattggttgttcctagatcaa

SEQ ID NO: 27637 - DNA, 23 bp, Artificial sequence
  SiRNA target sequence
gaattggttgttcctagatcaat

SEQ ID NO: 27638 - DNA, 23 bp, Artificial sequence
  SiRNA target sequence
aattggttgttcctagatcaatt

SEQ ID NO: 27639 - DNA, 23 bp, Artificial sequence
  SiRNA target sequence
attggttgttcctagatcaattc

SEQ ID NO: 27640 - DNA, 23 bp, Artificial sequence
  SiRNA target sequence
ttggttgttcctagatcaattcc

SEQ ID NO: 27641 - DNA, 23 bp, Artificial sequence
  SiRNA target sequence
tggttgttcctagatcaattcct

SEQ ID NO: 27642 - DNA, 23 bp, Artificial sequence
  SiRNA target sequence
ggttgttcctagatcaattccta

SEQ ID NO: 27643 - DNA, 23 bp, Artificial sequence
  SiRNA target sequence
gttgttcctagatcaattcctat

SEQ ID NO: 27644 - DNA, 23 bp, Artificial sequence
  SiRNA target sequence
ttgttcctagatcaattcctatt

SEQ ID NO: 27645 - DNA, 23 bp, Artificial sequence
  SiRNA target sequence
tgttcctagatcaattcctatta

SEQ ID NO: 27646 - DNA, 23 bp, Artificial sequence
  SiRNA target sequence
gttcctagatcaattcctattat

SEQ ID NO: 27647 - DNA, 23 bp, Artificial sequence
  SiRNA target sequence
ttcctagatcaattcctattatt

SEQ ID NO: 27648 - DNA, 23 bp, Artificial sequence
  SiRNA target sequence
tcctagatcaattcctattattt

SEQ ID NO: 27649 - DNA, 23 bp, Artificial sequence
  SiRNA target sequence
cctagatcaattcctattatttt

SEQ ID NO: 27650 - DNA, 23 bp, Artificial sequence
  SiRNA target sequence
ctagatcaattcctattatttta

SEQ ID NO: 27651 - DNA, 23 bp, Artificial sequence
  SiRNA target sequence
tagatcaattcctattattttag

SEQ ID NO: 27652 - DNA, 23 bp, Artificial sequence
  SiRNA target sequence
agatcaattcctattattttaga

SEQ ID NO: 27653 - DNA, 23 bp, Artificial sequence
  SiRNA target sequence
gatcaattcctattattttagag

SEQ ID NO: 27654 - DNA, 23 bp, Artificial sequence
  SiRNA target sequence
atcaattcctattattttagagc

SEQ ID NO: 27655 - DNA, 23 bp, Artificial sequence
  SiRNA target sequence
tcaattcctattattttagagct

SEQ ID NO: 27656 - DNA, 23 bp, Artificial sequence
  SiRNA target sequence
caattcctattattttagagcta

SEQ ID NO: 27657 - DNA, 23 bp, Artificial sequence
  SiRNA target sequence
aattcctattattttagagctaa

SEQ ID NO: 27658 - DNA, 23 bp, Artificial sequence
  SiRNA target sequence
attcctattattttagagctaat

SEQ ID NO: 27659 - DNA, 23 bp, Artificial sequence
  SiRNA target sequence
ttcctattattttagagctaatt

SEQ ID NO: 27660 - DNA, 23 bp, Artificial sequence
  SiRNA target sequence
tcctattattttagagctaattt

SEQ ID NO: 27661 - DNA, 23 bp, Artificial sequence
  SiRNA target sequence
cctattattttagagctaatttc

SEQ ID NO: 27662 - DNA, 23 bp, Artificial sequence
  SiRNA target sequence
ctattattttagagctaatttct

SEQ ID NO: 27663 - DNA, 23 bp, Artificial sequence
  SiRNA target sequence
tattattttagagctaatttctt

SEQ ID NO: 27664 - DNA, 23 bp, Artificial sequence
  SiRNA target sequence
attattttagagctaatttcttc

SEQ ID NO: 27665 - DNA, 23 bp, Artificial sequence
  SiRNA target sequence
ttattttagagctaatttcttct

SEQ ID NO: 27666 - DNA, 23 bp, Artificial sequence
  SiRNA target sequence
tattttagagctaatttcttctt

SEQ ID NO: 27667 - DNA, 23 bp, Artificial sequence
  SiRNA target sequence
attttagagctaatttcttcttt

SEQ ID NO: 27668 - DNA, 23 bp, Artificial sequence
  SiRNA target sequence
ttttagagctaatttcttcttta

SEQ ID NO: 27669 - DNA, 23 bp, Artificial sequence
  SiRNA target sequence
tttagagctaatttcttctttag

SEQ ID NO: 27670 - DNA, 23 bp, Artificial sequence
  SiRNA target sequence
ttagagctaatttcttctttaga

SEQ ID NO: 27671 - DNA, 23 bp, Artificial sequence
  SiRNA target sequence
tagagctaatttcttctttagac

SEQ ID NO: 27672 - DNA, 23 bp, Artificial sequence
  SiRNA target sequence
agagctaatttcttctttagaca

SEQ ID NO: 27673 - DNA, 23 bp, Artificial sequence
  SiRNA target sequence
gagctaatttcttctttagacat

SEQ ID NO: 27674 - DNA, 24 bp, Artificial sequence
  SiRNA target sequence
ttaagaatttttcaatattttttt

SEQ ID NO: 27675 - DNA, 24 bp, Artificial sequence
  SiRNA target sequence
taagaatttttcaatatttttttt

SEQ ID NO: 27676 - DNA, 24 bp, Artificial sequence
  SiRNA target sequence
aagaatttttcaatattttttttg

SEQ ID NO: 27677 - DNA, 24 bp, Artificial sequence
  SiRNA target sequence
agaatttttcaatattttttttgc

SEQ ID NO: 27678 - DNA, 24 bp, Artificial sequence
  SiRNA target sequence
gaatttttcaatattttttttgct

SEQ ID NO: 27679 - DNA, 24 bp, Artificial sequence
  SiRNA target sequence
aatttttcaatattttttttgctt

SEQ ID NO: 27680 - DNA, 24 bp, Artificial sequence
  SiRNA target sequence
atttttcaatattttttttgcttg

SEQ ID NO: 27681 - DNA, 24 bp, Artificial sequence
  SiRNA target sequence
tttttcaatattttttttgcttgt

SEQ ID NO: 27682 - DNA, 24 bp, Artificial sequence
  SiRNA target sequence
ttttcaatattttttttgcttgtt

SEQ ID NO: 27683 - DNA, 24 bp, Artificial sequence
  SiRNA target sequence
tttcaatattttttttgcttgttc

SEQ ID NO: 27684 - DNA, 24 bp, Artificial sequence
  SiRNA target sequence
ttcaatattttttttgcttgttct

SEQ ID NO: 27685 - DNA, 24 bp, Artificial sequence
  SiRNA target sequence
tcaatattttttttgcttgttcta

SEQ ID NO: 27686 - DNA, 24 bp, Artificial sequence
  SiRNA target sequence
caatattttttttgcttgttctaa

SEQ ID NO: 27687 - DNA, 24 bp, Artificial sequence
  SiRNA target sequence
aatattttttttgcttgttctaag

SEQ ID NO: 27688 - DNA, 24 bp, Artificial sequence
  SiRNA target sequence
atattttttttgcttgttctaagt

SEQ ID NO: 27689 - DNA, 24 bp, Artificial sequence
  SiRNA target sequence
tattttttttgcttgttctaagtc

SEQ ID NO: 27690 - DNA, 24 bp, Artificial sequence
  SiRNA target sequence
attttttttgcttgttctaagtca

SEQ ID NO: 27691 - DNA, 24 bp, Artificial sequence
  SiRNA target sequence
ttttttttgcttgttctaagtcat

SEQ ID NO: 27692 - DNA, 24 bp, Artificial sequence
  SiRNA target sequence
tttttttgcttgttctaagtcata

SEQ ID NO: 27693 - DNA, 24 bp, Artificial sequence
  SiRNA target sequence
ttttttgcttgttctaagtcataa

SEQ ID NO: 27694 - DNA, 24 bp, Artificial sequence
  SiRNA target sequence
tttttgcttgttctaagtcataaa

SEQ ID NO: 27695 - DNA, 24 bp, Artificial sequence
  SiRNA target sequence
ttttgcttgttctaagtcataaat

SEQ ID NO: 27696 - DNA, 24 bp, Artificial sequence
  SiRNA target sequence
tttgcttgttctaagtcataaatt

SEQ ID NO: 27697 - DNA, 24 bp, Artificial sequence
  SiRNA target sequence
ttgcttgttctaagtcataaattt

SEQ ID NO: 27698 - DNA, 24 bp, Artificial sequence
  SiRNA target sequence
tgcttgttctaagtcataaatttt

SEQ ID NO: 27699 - DNA, 24 bp, Artificial sequence
  SiRNA target sequence
gcttgttctaagtcataaattttt

SEQ ID NO: 27700 - DNA, 24 bp, Artificial sequence
  SiRNA target sequence
cttgttctaagtcataaatttttt

SEQ ID NO: 27701 - DNA, 24 bp, Artificial sequence
  SiRNA target sequence
ttgttctaagtcataaattttttt

SEQ ID NO: 27702 - DNA, 24 bp, Artificial sequence
  SiRNA target sequence
tgttctaagtcataaattttttta

SEQ ID NO: 27703 - DNA, 24 bp, Artificial sequence
  SiRNA target sequence
gttctaagtcataaatttttttag

SEQ ID NO: 27704 - DNA, 24 bp, Artificial sequence
  SiRNA target sequence
ttctaagtcataaatttttttagt

SEQ ID NO: 27705 - DNA, 24 bp, Artificial sequence
  SiRNA target sequence
tctaagtcataaatttttttagtc

SEQ ID NO: 27706 - DNA, 24 bp, Artificial sequence
  SiRNA target sequence
ctaagtcataaatttttttagtca

SEQ ID NO: 27707 - DNA, 24 bp, Artificial sequence
  SiRNA target sequence
taagtcataaatttttttagtcaa

SEQ ID NO: 27708 - DNA, 24 bp, Artificial sequence
  SiRNA target sequence
aagtcataaatttttttagtcaaa

SEQ ID NO: 27709 - DNA, 24 bp, Artificial sequence
  SiRNA target sequence
agtcataaatttttttagtcaaat

SEQ ID NO: 27710 - DNA, 24 bp, Artificial sequence
  SiRNA target sequence
gtcataaatttttttagtcaaata

SEQ ID NO: 27711 - DNA, 24 bp, Artificial sequence
  SiRNA target sequence
tcataaatttttttagtcaaatat

SEQ ID NO: 27712 - DNA, 24 bp, Artificial sequence
  SiRNA target sequence
cataaatttttttagtcaaatatg

SEQ ID NO: 27713 - DNA, 24 bp, Artificial sequence
  SiRNA target sequence
ataaatttttttagtcaaatatga

SEQ ID NO: 27714 - DNA, 24 bp, Artificial sequence
  SiRNA target sequence
taaatttttttagtcaaatatgac

SEQ ID NO: 27715 - DNA, 24 bp, Artificial sequence
  SiRNA target sequence
aaatttttttagtcaaatatgact

SEQ ID NO: 27716 - DNA, 24 bp, Artificial sequence
  SiRNA target sequence
aatttttttagtcaaatatgactt

SEQ ID NO: 27717 - DNA, 24 bp, Artificial sequence
  SiRNA target sequence
atttttttagtcaaatatgacttt

SEQ ID NO: 27718 - DNA, 24 bp, Artificial sequence
  SiRNA target sequence
tttttttagtcaaatatgacttta

SEQ ID NO: 27719 - DNA, 24 bp, Artificial sequence
  SiRNA target sequence
ttttttagtcaaatatgactttaa

SEQ ID NO: 27720 - DNA, 24 bp, Artificial sequence
  SiRNA target sequence
tttttagtcaaatatgactttaaa

SEQ ID NO: 27721 - DNA, 24 bp, Artificial sequence
  SiRNA target sequence
ttttagtcaaatatgactttaaaa

SEQ ID NO: 27722 - DNA, 24 bp, Artificial sequence
  SiRNA target sequence
tttagtcaaatatgactttaaaat

SEQ ID NO: 27723 - DNA, 24 bp, Artificial sequence
  SiRNA target sequence
ttagtcaaatatgactttaaaatc

SEQ ID NO: 27724 - DNA, 24 bp, Artificial sequence
  SiRNA target sequence
tagtcaaatatgactttaaaatct

SEQ ID NO: 27725 - DNA, 24 bp, Artificial sequence
  SiRNA target sequence
agtcaaatatgactttaaaatctc

SEQ ID NO: 27726 - DNA, 24 bp, Artificial sequence
  SiRNA target sequence
gtcaaatatgactttaaaatctct

SEQ ID NO: 27727 - DNA, 24 bp, Artificial sequence
  SiRNA target sequence
tcaaatatgactttaaaatctctt

SEQ ID NO: 27728 - DNA, 24 bp, Artificial sequence
  SiRNA target sequence
caaatatgactttaaaatctcttt

SEQ ID NO: 27729 - DNA, 24 bp, Artificial sequence
  SiRNA target sequence
aaatatgactttaaaatctctttt

SEQ ID NO: 27730 - DNA, 24 bp, Artificial sequence
  SiRNA target sequence
aatatgactttaaaatctcttttg

SEQ ID NO: 27731 - DNA, 24 bp, Artificial sequence
  SiRNA target sequence
atatgactttaaaatctcttttgt

SEQ ID NO: 27732 - DNA, 24 bp, Artificial sequence
  SiRNA target sequence
tatgactttaaaatctcttttgtt

SEQ ID NO: 27733 - DNA, 24 bp, Artificial sequence
  SiRNA target sequence
atgactttaaaatctcttttgttt

SEQ ID NO: 27734 - DNA, 24 bp, Artificial sequence
  SiRNA target sequence
tgactttaaaatctcttttgtttc

SEQ ID NO: 27735 - DNA, 24 bp, Artificial sequence
  SiRNA target sequence
gactttaaaatctcttttgtttca

SEQ ID NO: 27736 - DNA, 24 bp, Artificial sequence
  SiRNA target sequence
actttaaaatctcttttgtttcat

SEQ ID NO: 27737 - DNA, 24 bp, Artificial sequence
  SiRNA target sequence
ctttaaaatctcttttgtttcatc

SEQ ID NO: 27738 - DNA, 24 bp, Artificial sequence
  SiRNA target sequence
tttaaaatctcttttgtttcatct

SEQ ID NO: 27739 - DNA, 24 bp, Artificial sequence
  SiRNA target sequence
ttaaaatctcttttgtttcatctg

SEQ ID NO: 27740 - DNA, 24 bp, Artificial sequence
  SiRNA target sequence
taaaatctcttttgtttcatctgt

SEQ ID NO: 27741 - DNA, 24 bp, Artificial sequence
  SiRNA target sequence
aaaatctcttttgtttcatctgtt

SEQ ID NO: 27742 - DNA, 24 bp, Artificial sequence
  SiRNA target sequence
aaatctcttttgtttcatctgtta

SEQ ID NO: 27743 - DNA, 24 bp, Artificial sequence
  SiRNA target sequence
aatctcttttgtttcatctgttac

SEQ ID NO: 27744 - DNA, 24 bp, Artificial sequence
  SiRNA target sequence
atctcttttgtttcatctgttact

SEQ ID NO: 27745 - DNA, 24 bp, Artificial sequence
  SiRNA target sequence
tctcttttgtttcatctgttactt

SEQ ID NO: 27746 - DNA, 24 bp, Artificial sequence
  SiRNA target sequence
ctcttttgtttcatctgttacttg

SEQ ID NO: 27747 - DNA, 24 bp, Artificial sequence
  SiRNA target sequence
tcttttgtttcatctgttacttgt

SEQ ID NO: 27748 - DNA, 24 bp, Artificial sequence
  SiRNA target sequence
cttttgtttcatctgttacttgtt

SEQ ID NO: 27749 - DNA, 24 bp, Artificial sequence
  SiRNA target sequence
ttttgtttcatctgttacttgttt

SEQ ID NO: 27750 - DNA, 24 bp, Artificial sequence
  SiRNA target sequence
tttgtttcatctgttacttgtttg

SEQ ID NO: 27751 - DNA, 24 bp, Artificial sequence
  SiRNA target sequence
ttgtttcatctgttacttgtttgt

SEQ ID NO: 27752 - DNA, 24 bp, Artificial sequence
  SiRNA target sequence
tgtttcatctgttacttgtttgta

SEQ ID NO: 27753 - DNA, 24 bp, Artificial sequence
  SiRNA target sequence
gtttcatctgttacttgtttgtac

SEQ ID NO: 27754 - DNA, 24 bp, Artificial sequence
  SiRNA target sequence
tttcatctgttacttgtttgtact

SEQ ID NO: 27755 - DNA, 24 bp, Artificial sequence
  SiRNA target sequence
ttcatctgttacttgtttgtactt

SEQ ID NO: 27756 - DNA, 24 bp, Artificial sequence
  SiRNA target sequence
tcatctgttacttgtttgtacttt

SEQ ID NO: 27757 - DNA, 24 bp, Artificial sequence
  SiRNA target sequence
catctgttacttgtttgtacttta

SEQ ID NO: 27758 - DNA, 24 bp, Artificial sequence
  SiRNA target sequence
atctgttacttgtttgtactttaa

SEQ ID NO: 27759 - DNA, 24 bp, Artificial sequence
  SiRNA target sequence
tctgttacttgtttgtactttaaa

SEQ ID NO: 27760 - DNA, 24 bp, Artificial sequence
  SiRNA target sequence
ctgttacttgtttgtactttaaaa

SEQ ID NO: 27761 - DNA, 24 bp, Artificial sequence
  SiRNA target sequence
tgttacttgtttgtactttaaaaa

SEQ ID NO: 27762 - DNA, 24 bp, Artificial sequence
  SiRNA target sequence
gttacttgtttgtactttaaaaat

SEQ ID NO: 27763 - DNA, 24 bp, Artificial sequence
  SiRNA target sequence
ttacttgtttgtactttaaaaatt

SEQ ID NO: 27764 - DNA, 24 bp, Artificial sequence
  SiRNA target sequence
tacttgtttgtactttaaaaattg

SEQ ID NO: 27765 - DNA, 24 bp, Artificial sequence
  SiRNA target sequence
acttgtttgtactttaaaaattgt

SEQ ID NO: 27766 - DNA, 24 bp, Artificial sequence
  SiRNA target sequence
cttgtttgtactttaaaaattgtt

SEQ ID NO: 27767 - DNA, 24 bp, Artificial sequence
  SiRNA target sequence
ttgtttgtactttaaaaattgttg

SEQ ID NO: 27768 - DNA, 24 bp, Artificial sequence
  SiRNA target sequence
tgtttgtactttaaaaattgttga

SEQ ID NO: 27769 - DNA, 24 bp, Artificial sequence
  SiRNA target sequence
gtttgtactttaaaaattgttgaa

SEQ ID NO: 27770 - DNA, 24 bp, Artificial sequence
  SiRNA target sequence
tttgtactttaaaaattgttgaat

SEQ ID NO: 27771 - DNA, 24 bp, Artificial sequence
  SiRNA target sequence
ttgtactttaaaaattgttgaatt

SEQ ID NO: 27772 - DNA, 24 bp, Artificial sequence
  SiRNA target sequence
tgtactttaaaaattgttgaattt

SEQ ID NO: 27773 - DNA, 24 bp, Artificial sequence
  SiRNA target sequence
gtactttaaaaattgttgaatttc

SEQ ID NO: 27774 - DNA, 24 bp, Artificial sequence
  SiRNA target sequence
tactttaaaaattgttgaatttca

SEQ ID NO: 27775 - DNA, 24 bp, Artificial sequence
  SiRNA target sequence
actttaaaaattgttgaatttcaa

SEQ ID NO: 27776 - DNA, 24 bp, Artificial sequence
  SiRNA target sequence
ctttaaaaattgttgaatttcaat

SEQ ID NO: 27777 - DNA, 24 bp, Artificial sequence
  SiRNA target sequence
tttaaaaattgttgaatttcaatt

SEQ ID NO: 27778 - DNA, 24 bp, Artificial sequence
  SiRNA target sequence
ttaaaaattgttgaatttcaattt

SEQ ID NO: 27779 - DNA, 24 bp, Artificial sequence
  SiRNA target sequence
taaaaattgttgaatttcaatttt

SEQ ID NO: 27780 - DNA, 24 bp, Artificial sequence
  SiRNA target sequence
aaaaattgttgaatttcaatttta

SEQ ID NO: 27781 - DNA, 24 bp, Artificial sequence
  SiRNA target sequence
aaaattgttgaatttcaattttaa

SEQ ID NO: 27782 - DNA, 24 bp, Artificial sequence
  SiRNA target sequence
aaattgttgaatttcaattttaaa

SEQ ID NO: 27783 - DNA, 24 bp, Artificial sequence
  SiRNA target sequence
aattgttgaatttcaattttaaat

SEQ ID NO: 27784 - DNA, 24 bp, Artificial sequence
  SiRNA target sequence
attgttgaatttcaattttaaatt

SEQ ID NO: 27785 - DNA, 24 bp, Artificial sequence
  SiRNA target sequence
ttgttgaatttcaattttaaattc

SEQ ID NO: 27786 - DNA, 24 bp, Artificial sequence
  SiRNA target sequence
tgttgaatttcaattttaaattcg

SEQ ID NO: 27787 - DNA, 24 bp, Artificial sequence
  SiRNA target sequence
gttgaatttcaattttaaattcgg

SEQ ID NO: 27788 - DNA, 24 bp, Artificial sequence
  SiRNA target sequence
ttgaatttcaattttaaattcggc

SEQ ID NO: 27789 - DNA, 24 bp, Artificial sequence
  SiRNA target sequence
tgaatttcaattttaaattcggca

SEQ ID NO: 27790 - DNA, 24 bp, Artificial sequence
  SiRNA target sequence
gaatttcaattttaaattcggcac

SEQ ID NO: 27791 - DNA, 24 bp, Artificial sequence
  SiRNA target sequence
aatttcaattttaaattcggcaca

SEQ ID NO: 27792 - DNA, 24 bp, Artificial sequence
  SiRNA target sequence
atttcaattttaaattcggcacaa

SEQ ID NO: 27793 - DNA, 24 bp, Artificial sequence
  SiRNA target sequence
tttcaattttaaattcggcacaat

SEQ ID NO: 27794 - DNA, 24 bp, Artificial sequence
  SiRNA target sequence
ttcaattttaaattcggcacaatt

SEQ ID NO: 27795 - DNA, 24 bp, Artificial sequence
  SiRNA target sequence
tcaattttaaattcggcacaattt

SEQ ID NO: 27796 - DNA, 24 bp, Artificial sequence
  SiRNA target sequence
caattttaaattcggcacaatttt

SEQ ID NO: 27797 - DNA, 24 bp, Artificial sequence
  SiRNA target sequence
aattttaaattcggcacaattttt

SEQ ID NO: 27798 - DNA, 24 bp, Artificial sequence
  SiRNA target sequence
attttaaattcggcacaatttttt

SEQ ID NO: 27799 - DNA, 24 bp, Artificial sequence
  SiRNA target sequence
ttttaaattcggcacaattttttt

SEQ ID NO: 27800 - DNA, 24 bp, Artificial sequence
  SiRNA target sequence
tttaaattcggcacaatttttttc

SEQ ID NO: 27801 - DNA, 24 bp, Artificial sequence
  SiRNA target sequence
ttaaattcggcacaatttttttca

SEQ ID NO: 27802 - DNA, 24 bp, Artificial sequence
  SiRNA target sequence
taaattcggcacaatttttttcaa

SEQ ID NO: 27803 - DNA, 24 bp, Artificial sequence
  SiRNA target sequence
aaattcggcacaatttttttcaat

SEQ ID NO: 27804 - DNA, 24 bp, Artificial sequence
  SiRNA target sequence
aattcggcacaatttttttcaatt

SEQ ID NO: 27805 - DNA, 24 bp, Artificial sequence
  SiRNA target sequence
attcggcacaatttttttcaattt

SEQ ID NO: 27806 - DNA, 24 bp, Artificial sequence
  SiRNA target sequence
ttcggcacaatttttttcaatttc

SEQ ID NO: 27807 - DNA, 24 bp, Artificial sequence
  SiRNA target sequence
tcggcacaatttttttcaatttca

SEQ ID NO: 27808 - DNA, 24 bp, Artificial sequence
  SiRNA target sequence
cggcacaatttttttcaatttcat

SEQ ID NO: 27809 - DNA, 24 bp, Artificial sequence
  SiRNA target sequence
ggcacaatttttttcaatttcatc

SEQ ID NO: 27810 - DNA, 24 bp, Artificial sequence
  SiRNA target sequence
gcacaatttttttcaatttcatct

SEQ ID NO: 27811 - DNA, 24 bp, Artificial sequence
  SiRNA target sequence
cacaatttttttcaatttcatctt

SEQ ID NO: 27812 - DNA, 24 bp, Artificial sequence
  SiRNA target sequence
acaatttttttcaatttcatcttt

SEQ ID NO: 27813 - DNA, 24 bp, Artificial sequence
  SiRNA target sequence
caatttttttcaatttcatctttt

SEQ ID NO: 27814 - DNA, 24 bp, Artificial sequence
  SiRNA target sequence
aatttttttcaatttcatcttttt

SEQ ID NO: 27815 - DNA, 24 bp, Artificial sequence
  SiRNA target sequence
atttttttcaatttcatctttttt

SEQ ID NO: 27816 - DNA, 24 bp, Artificial sequence
  SiRNA target sequence
tttttttcaatttcatcttttttc

SEQ ID NO: 27817 - DNA, 24 bp, Artificial sequence
  SiRNA target sequence
ttttttcaatttcatcttttttcg

SEQ ID NO: 27818 - DNA, 24 bp, Artificial sequence
  SiRNA target sequence
tttttcaatttcatcttttttcga

SEQ ID NO: 27819 - DNA, 24 bp, Artificial sequence
  SiRNA target sequence
ttttcaatttcatcttttttcgaa

SEQ ID NO: 27820 - DNA, 24 bp, Artificial sequence
  SiRNA target sequence
tttcaatttcatcttttttcgaat

SEQ ID NO: 27821 - DNA, 24 bp, Artificial sequence
  SiRNA target sequence
ttcaatttcatcttttttcgaatt

SEQ ID NO: 27822 - DNA, 24 bp, Artificial sequence
  SiRNA target sequence
tcaatttcatcttttttcgaattt

SEQ ID NO: 27823 - DNA, 24 bp, Artificial sequence
  SiRNA target sequence
caatttcatcttttttcgaatttt

SEQ ID NO: 27824 - DNA, 24 bp, Artificial sequence
  SiRNA target sequence
aatttcatcttttttcgaattttc

SEQ ID NO: 27825 - DNA, 24 bp, Artificial sequence
  SiRNA target sequence
atttcatcttttttcgaattttct

SEQ ID NO: 27826 - DNA, 24 bp, Artificial sequence
  SiRNA target sequence
tttcatcttttttcgaattttctt

SEQ ID NO: 27827 - DNA, 24 bp, Artificial sequence
  SiRNA target sequence
ttcatcttttttcgaattttcttc

SEQ ID NO: 27828 - DNA, 24 bp, Artificial sequence
  SiRNA target sequence
tcatcttttttcgaattttcttcg

SEQ ID NO: 27829 - DNA, 24 bp, Artificial sequence
  SiRNA target sequence
catcttttttcgaattttcttcgg

SEQ ID NO: 27830 - DNA, 24 bp, Artificial sequence
  SiRNA target sequence
atcttttttcgaattttcttcggc

SEQ ID NO: 27831 - DNA, 24 bp, Artificial sequence
  SiRNA target sequence
tcttttttcgaattttcttcggct

SEQ ID NO: 27832 - DNA, 24 bp, Artificial sequence
  SiRNA target sequence
cttttttcgaattttcttcggctt

SEQ ID NO: 27833 - DNA, 24 bp, Artificial sequence
  SiRNA target sequence
ttttttcgaattttcttcggcttc

SEQ ID NO: 27834 - DNA, 24 bp, Artificial sequence
  SiRNA target sequence
tttttcgaattttcttcggcttct

SEQ ID NO: 27835 - DNA, 24 bp, Artificial sequence
  SiRNA target sequence
ttttcgaattttcttcggcttctc

SEQ ID NO: 27836 - DNA, 24 bp, Artificial sequence
  SiRNA target sequence
tttcgaattttcttcggcttctcg

SEQ ID NO: 27837 - DNA, 24 bp, Artificial sequence
  SiRNA target sequence
ttcgaattttcttcggcttctcgt

SEQ ID NO: 27838 - DNA, 24 bp, Artificial sequence
  SiRNA target sequence
tcgaattttcttcggcttctcgta

SEQ ID NO: 27839 - DNA, 24 bp, Artificial sequence
  SiRNA target sequence
cgaattttcttcggcttctcgtat

SEQ ID NO: 27840 - DNA, 24 bp, Artificial sequence
  SiRNA target sequence
gaattttcttcggcttctcgtatc

SEQ ID NO: 27841 - DNA, 24 bp, Artificial sequence
  SiRNA target sequence
aattttcttcggcttctcgtatca

SEQ ID NO: 27842 - DNA, 24 bp, Artificial sequence
  SiRNA target sequence
attttcttcggcttctcgtatcat

SEQ ID NO: 27843 - DNA, 24 bp, Artificial sequence
  SiRNA target sequence
ttttcttcggcttctcgtatcatt

SEQ ID NO: 27844 - DNA, 24 bp, Artificial sequence
  SiRNA target sequence
tttcttcggcttctcgtatcattt

SEQ ID NO: 27845 - DNA, 24 bp, Artificial sequence
  SiRNA target sequence
ttcttcggcttctcgtatcatttg

SEQ ID NO: 27846 - DNA, 24 bp, Artificial sequence
  SiRNA target sequence
tcttcggcttctcgtatcatttgc

SEQ ID NO: 27847 - DNA, 24 bp, Artificial sequence
  SiRNA target sequence
cttcggcttctcgtatcatttgcg

SEQ ID NO: 27848 - DNA, 24 bp, Artificial sequence
  SiRNA target sequence
ttcggcttctcgtatcatttgcga

SEQ ID NO: 27849 - DNA, 24 bp, Artificial sequence
  SiRNA target sequence
tcggcttctcgtatcatttgcgaa

SEQ ID NO: 27850 - DNA, 24 bp, Artificial sequence
  SiRNA target sequence
cggcttctcgtatcatttgcgaaa

SEQ ID NO: 27851 - DNA, 24 bp, Artificial sequence
  SiRNA target sequence
ggcttctcgtatcatttgcgaaat

SEQ ID NO: 27852 - DNA, 24 bp, Artificial sequence
  SiRNA target sequence
gcttctcgtatcatttgcgaaatt

SEQ ID NO: 27853 - DNA, 24 bp, Artificial sequence
  SiRNA target sequence
cttctcgtatcatttgcgaaattt

SEQ ID NO: 27854 - DNA, 24 bp, Artificial sequence
  SiRNA target sequence
ttctcgtatcatttgcgaaatttc

SEQ ID NO: 27855 - DNA, 24 bp, Artificial sequence
  SiRNA target sequence
tctcgtatcatttgcgaaatttca

SEQ ID NO: 27856 - DNA, 24 bp, Artificial sequence
  SiRNA target sequence
ctcgtatcatttgcgaaatttcac

SEQ ID NO: 27857 - DNA, 24 bp, Artificial sequence
  SiRNA target sequence
tcgtatcatttgcgaaatttcacc

SEQ ID NO: 27858 - DNA, 24 bp, Artificial sequence
  SiRNA target sequence
cgtatcatttgcgaaatttcacct

SEQ ID NO: 27859 - DNA, 24 bp, Artificial sequence
  SiRNA target sequence
gtatcatttgcgaaatttcacctt

SEQ ID NO: 27860 - DNA, 24 bp, Artificial sequence
  SiRNA target sequence
tatcatttgcgaaatttcaccttc

SEQ ID NO: 27861 - DNA, 24 bp, Artificial sequence
  SiRNA target sequence
atcatttgcgaaatttcaccttca

SEQ ID NO: 27862 - DNA, 24 bp, Artificial sequence
  SiRNA target sequence
tcatttgcgaaatttcaccttcat

SEQ ID NO: 27863 - DNA, 24 bp, Artificial sequence
  SiRNA target sequence
catttgcgaaatttcaccttcatt

SEQ ID NO: 27864 - DNA, 24 bp, Artificial sequence
  SiRNA target sequence
atttgcgaaatttcaccttcattt

SEQ ID NO: 27865 - DNA, 24 bp, Artificial sequence
  SiRNA target sequence
tttgcgaaatttcaccttcattta

SEQ ID NO: 27866 - DNA, 24 bp, Artificial sequence
  SiRNA target sequence
ttgcgaaatttcaccttcatttaa

SEQ ID NO: 27867 - DNA, 24 bp, Artificial sequence
  SiRNA target sequence
tgcgaaatttcaccttcatttaat

SEQ ID NO: 27868 - DNA, 24 bp, Artificial sequence
  SiRNA target sequence
gcgaaatttcaccttcatttaatc

SEQ ID NO: 27869 - DNA, 24 bp, Artificial sequence
  SiRNA target sequence
cgaaatttcaccttcatttaatcc

SEQ ID NO: 27870 - DNA, 24 bp, Artificial sequence
  SiRNA target sequence
gaaatttcaccttcatttaatcca

SEQ ID NO: 27871 - DNA, 24 bp, Artificial sequence
  SiRNA target sequence
aaatttcaccttcatttaatccac

SEQ ID NO: 27872 - DNA, 24 bp, Artificial sequence
  SiRNA target sequence
aatttcaccttcatttaatccact

SEQ ID NO: 27873 - DNA, 24 bp, Artificial sequence
  SiRNA target sequence
atttcaccttcatttaatccactt

SEQ ID NO: 27874 - DNA, 24 bp, Artificial sequence
  SiRNA target sequence
tttcaccttcatttaatccacttg

SEQ ID NO: 27875 - DNA, 24 bp, Artificial sequence
  SiRNA target sequence
ttcaccttcatttaatccacttga

SEQ ID NO: 27876 - DNA, 24 bp, Artificial sequence
  SiRNA target sequence
tcaccttcatttaatccacttgaa

SEQ ID NO: 27877 - DNA, 24 bp, Artificial sequence
  SiRNA target sequence
caccttcatttaatccacttgaag

SEQ ID NO: 27878 - DNA, 24 bp, Artificial sequence
  SiRNA target sequence
accttcatttaatccacttgaagg

SEQ ID NO: 27879 - DNA, 24 bp, Artificial sequence
  SiRNA target sequence
ccttcatttaatccacttgaaggc

SEQ ID NO: 27880 - DNA, 24 bp, Artificial sequence
  SiRNA target sequence
cttcatttaatccacttgaaggca

SEQ ID NO: 27881 - DNA, 24 bp, Artificial sequence
  SiRNA target sequence
ttcatttaatccacttgaaggcac

SEQ ID NO: 27882 - DNA, 24 bp, Artificial sequence
  SiRNA target sequence
tcatttaatccacttgaaggcaca

SEQ ID NO: 27883 - DNA, 24 bp, Artificial sequence
  SiRNA target sequence
catttaatccacttgaaggcacaa

SEQ ID NO: 27884 - DNA, 24 bp, Artificial sequence
  SiRNA target sequence
atttaatccacttgaaggcacaat

SEQ ID NO: 27885 - DNA, 24 bp, Artificial sequence
  SiRNA target sequence
tttaatccacttgaaggcacaatt

SEQ ID NO: 27886 - DNA, 24 bp, Artificial sequence
  SiRNA target sequence
ttaatccacttgaaggcacaattt

SEQ ID NO: 27887 - DNA, 24 bp, Artificial sequence
  SiRNA target sequence
taatccacttgaaggcacaatttc

SEQ ID NO: 27888 - DNA, 24 bp, Artificial sequence
  SiRNA target sequence
aatccacttgaaggcacaatttcg

SEQ ID NO: 27889 - DNA, 24 bp, Artificial sequence
  SiRNA target sequence
atccacttgaaggcacaatttcga

SEQ ID NO: 27890 - DNA, 24 bp, Artificial sequence
  SiRNA target sequence
tccacttgaaggcacaatttcgat

SEQ ID NO: 27891 - DNA, 24 bp, Artificial sequence
  SiRNA target sequence
ccacttgaaggcacaatttcgatt

SEQ ID NO: 27892 - DNA, 24 bp, Artificial sequence
  SiRNA target sequence
cacttgaaggcacaatttcgattt

SEQ ID NO: 27893 - DNA, 24 bp, Artificial sequence
  SiRNA target sequence
acttgaaggcacaatttcgatttc

SEQ ID NO: 27894 - DNA, 24 bp, Artificial sequence
  SiRNA target sequence
cttgaaggcacaatttcgatttct

SEQ ID NO: 27895 - DNA, 24 bp, Artificial sequence
  SiRNA target sequence
ttgaaggcacaatttcgatttctt

SEQ ID NO: 27896 - DNA, 24 bp, Artificial sequence
  SiRNA target sequence
tgaaggcacaatttcgatttcttg

SEQ ID NO: 27897 - DNA, 24 bp, Artificial sequence
  SiRNA target sequence
gaaggcacaatttcgatttcttgc

SEQ ID NO: 27898 - DNA, 24 bp, Artificial sequence
  SiRNA target sequence
aaggcacaatttcgatttcttgct

SEQ ID NO: 27899 - DNA, 24 bp, Artificial sequence
  SiRNA target sequence
aggcacaatttcgatttcttgctt

SEQ ID NO: 27900 - DNA, 24 bp, Artificial sequence
  SiRNA target sequence
ggcacaatttcgatttcttgcttt

SEQ ID NO: 27901 - DNA, 24 bp, Artificial sequence
  SiRNA target sequence
gcacaatttcgatttcttgctttt

SEQ ID NO: 27902 - DNA, 24 bp, Artificial sequence
  SiRNA target sequence
cacaatttcgatttcttgcttttt

SEQ ID NO: 27903 - DNA, 24 bp, Artificial sequence
  SiRNA target sequence
acaatttcgatttcttgctttttt

SEQ ID NO: 27904 - DNA, 24 bp, Artificial sequence
  SiRNA target sequence
caatttcgatttcttgcttttttt

SEQ ID NO: 27905 - DNA, 24 bp, Artificial sequence
  SiRNA target sequence
aatttcgatttcttgctttttttt

SEQ ID NO: 27906 - DNA, 24 bp, Artificial sequence
  SiRNA target sequence
atttcgatttcttgcttttttttc

SEQ ID NO: 27907 - DNA, 24 bp, Artificial sequence
  SiRNA target sequence
tttcgatttcttgcttttttttcg

SEQ ID NO: 27908 - DNA, 24 bp, Artificial sequence
  SiRNA target sequence
ttcgatttcttgcttttttttcgt

SEQ ID NO: 27909 - DNA, 24 bp, Artificial sequence
  SiRNA target sequence
tcgatttcttgcttttttttcgtt

SEQ ID NO: 27910 - DNA, 24 bp, Artificial sequence
  SiRNA target sequence
cgatttcttgcttttttttcgtta

SEQ ID NO: 27911 - DNA, 24 bp, Artificial sequence
  SiRNA target sequence
gatttcttgcttttttttcgttat

SEQ ID NO: 27912 - DNA, 24 bp, Artificial sequence
  SiRNA target sequence
atttcttgcttttttttcgttatc

SEQ ID NO: 27913 - DNA, 24 bp, Artificial sequence
  SiRNA target sequence
tttcttgcttttttttcgttatcc

SEQ ID NO: 27914 - DNA, 24 bp, Artificial sequence
  SiRNA target sequence
ttcttgcttttttttcgttatccc

SEQ ID NO: 27915 - DNA, 24 bp, Artificial sequence
  SiRNA target sequence
tcttgcttttttttcgttatcccg

SEQ ID NO: 27916 - DNA, 24 bp, Artificial sequence
  SiRNA target sequence
cttgcttttttttcgttatcccgt

SEQ ID NO: 27917 - DNA, 24 bp, Artificial sequence
  SiRNA target sequence
ttgcttttttttcgttatcccgtc

SEQ ID NO: 27918 - DNA, 24 bp, Artificial sequence
  SiRNA target sequence
tgcttttttttcgttatcccgtct

SEQ ID NO: 27919 - DNA, 24 bp, Artificial sequence
  SiRNA target sequence
gcttttttttcgttatcccgtctt

SEQ ID NO: 27920 - DNA, 24 bp, Artificial sequence
  SiRNA target sequence
cttttttttcgttatcccgtcttg

SEQ ID NO: 27921 - DNA, 24 bp, Artificial sequence
  SiRNA target sequence
ttttttttcgttatcccgtcttgc

SEQ ID NO: 27922 - DNA, 24 bp, Artificial sequence
  SiRNA target sequence
tttttttcgttatcccgtcttgcg

SEQ ID NO: 27923 - DNA, 24 bp, Artificial sequence
  SiRNA target sequence
ttttttcgttatcccgtcttgcgc

SEQ ID NO: 27924 - DNA, 24 bp, Artificial sequence
  SiRNA target sequence
tttttcgttatcccgtcttgcgca

SEQ ID NO: 27925 - DNA, 24 bp, Artificial sequence
  SiRNA target sequence
ttttcgttatcccgtcttgcgcag

SEQ ID NO: 27926 - DNA, 24 bp, Artificial sequence
  SiRNA target sequence
tttcgttatcccgtcttgcgcaga

SEQ ID NO: 27927 - DNA, 24 bp, Artificial sequence
  SiRNA target sequence
ttcgttatcccgtcttgcgcagat

SEQ ID NO: 27928 - DNA, 24 bp, Artificial sequence
  SiRNA target sequence
tcgttatcccgtcttgcgcagata

SEQ ID NO: 27929 - DNA, 24 bp, Artificial sequence
  SiRNA target sequence
cgttatcccgtcttgcgcagatac

SEQ ID NO: 27930 - DNA, 24 bp, Artificial sequence
  SiRNA target sequence
gttatcccgtcttgcgcagatact

SEQ ID NO: 27931 - DNA, 24 bp, Artificial sequence
  SiRNA target sequence
ttatcccgtcttgcgcagatactt

SEQ ID NO: 27932 - DNA, 24 bp, Artificial sequence
  SiRNA target sequence
tatcccgtcttgcgcagatacttt

SEQ ID NO: 27933 - DNA, 24 bp, Artificial sequence
  SiRNA target sequence
atcccgtcttgcgcagatactttg

SEQ ID NO: 27934 - DNA, 24 bp, Artificial sequence
  SiRNA target sequence
tcccgtcttgcgcagatactttgt

SEQ ID NO: 27935 - DNA, 24 bp, Artificial sequence
  SiRNA target sequence
cccgtcttgcgcagatactttgta

SEQ ID NO: 27936 - DNA, 24 bp, Artificial sequence
  SiRNA target sequence
ccgtcttgcgcagatactttgtat

SEQ ID NO: 27937 - DNA, 24 bp, Artificial sequence
  SiRNA target sequence
cgtcttgcgcagatactttgtata

SEQ ID NO: 27938 - DNA, 24 bp, Artificial sequence
  SiRNA target sequence
gtcttgcgcagatactttgtatat

SEQ ID NO: 27939 - DNA, 24 bp, Artificial sequence
  SiRNA target sequence
tcttgcgcagatactttgtatatt

SEQ ID NO: 27940 - DNA, 24 bp, Artificial sequence
  SiRNA target sequence
cttgcgcagatactttgtatattc

SEQ ID NO: 27941 - DNA, 24 bp, Artificial sequence
  SiRNA target sequence
ttgcgcagatactttgtatattcc

SEQ ID NO: 27942 - DNA, 24 bp, Artificial sequence
  SiRNA target sequence
tgcgcagatactttgtatattccg

SEQ ID NO: 27943 - DNA, 24 bp, Artificial sequence
  SiRNA target sequence
gcgcagatactttgtatattccgt

SEQ ID NO: 27944 - DNA, 24 bp, Artificial sequence
  SiRNA target sequence
cgcagatactttgtatattccgtt

SEQ ID NO: 27945 - DNA, 24 bp, Artificial sequence
  SiRNA target sequence
gcagatactttgtatattccgtta

SEQ ID NO: 27946 - DNA, 24 bp, Artificial sequence
  SiRNA target sequence
cagatactttgtatattccgttag

SEQ ID NO: 27947 - DNA, 24 bp, Artificial sequence
  SiRNA target sequence
agatactttgtatattccgttagc

SEQ ID NO: 27948 - DNA, 24 bp, Artificial sequence
  SiRNA target sequence
gatactttgtatattccgttagca

SEQ ID NO: 27949 - DNA, 24 bp, Artificial sequence
  SiRNA target sequence
atactttgtatattccgttagcat

SEQ ID NO: 27950 - DNA, 24 bp, Artificial sequence
  SiRNA target sequence
tactttgtatattccgttagcatc

SEQ ID NO: 27951 - DNA, 24 bp, Artificial sequence
  SiRNA target sequence
actttgtatattccgttagcatcg

SEQ ID NO: 27952 - DNA, 24 bp, Artificial sequence
  SiRNA target sequence
ctttgtatattccgttagcatcgg

SEQ ID NO: 27953 - DNA, 24 bp, Artificial sequence
  SiRNA target sequence
tttgtatattccgttagcatcggc

SEQ ID NO: 27954 - DNA, 24 bp, Artificial sequence
  SiRNA target sequence
ttgtatattccgttagcatcggct

SEQ ID NO: 27955 - DNA, 24 bp, Artificial sequence
  SiRNA target sequence
tgtatattccgttagcatcggctt

SEQ ID NO: 27956 - DNA, 24 bp, Artificial sequence
  SiRNA target sequence
gtatattccgttagcatcggcttc

SEQ ID NO: 27957 - DNA, 24 bp, Artificial sequence
  SiRNA target sequence
tatattccgttagcatcggcttca

SEQ ID NO: 27958 - DNA, 24 bp, Artificial sequence
  SiRNA target sequence
atattccgttagcatcggcttcaa

SEQ ID NO: 27959 - DNA, 24 bp, Artificial sequence
  SiRNA target sequence
tattccgttagcatcggcttcaaa

SEQ ID NO: 27960 - DNA, 24 bp, Artificial sequence
  SiRNA target sequence
attccgttagcatcggcttcaaat

SEQ ID NO: 27961 - DNA, 24 bp, Artificial sequence
  SiRNA target sequence
ttccgttagcatcggcttcaaatg

SEQ ID NO: 27962 - DNA, 24 bp, Artificial sequence
  SiRNA target sequence
tccgttagcatcggcttcaaatgt

SEQ ID NO: 27963 - DNA, 24 bp, Artificial sequence
  SiRNA target sequence
ccgttagcatcggcttcaaatgta

SEQ ID NO: 27964 - DNA, 24 bp, Artificial sequence
  SiRNA target sequence
cgttagcatcggcttcaaatgtaa

SEQ ID NO: 27965 - DNA, 24 bp, Artificial sequence
  SiRNA target sequence
gttagcatcggcttcaaatgtaac

SEQ ID NO: 27966 - DNA, 24 bp, Artificial sequence
  SiRNA target sequence
ttagcatcggcttcaaatgtaaca

SEQ ID NO: 27967 - DNA, 24 bp, Artificial sequence
  SiRNA target sequence
tagcatcggcttcaaatgtaacat

SEQ ID NO: 27968 - DNA, 24 bp, Artificial sequence
  SiRNA target sequence
agcatcggcttcaaatgtaacatc

SEQ ID NO: 27969 - DNA, 24 bp, Artificial sequence
  SiRNA target sequence
gcatcggcttcaaatgtaacatct

SEQ ID NO: 27970 - DNA, 24 bp, Artificial sequence
  SiRNA target sequence
catcggcttcaaatgtaacatcta

SEQ ID NO: 27971 - DNA, 24 bp, Artificial sequence
  SiRNA target sequence
atcggcttcaaatgtaacatctat

SEQ ID NO: 27972 - DNA, 24 bp, Artificial sequence
  SiRNA target sequence
tcggcttcaaatgtaacatctatc

SEQ ID NO: 27973 - DNA, 24 bp, Artificial sequence
  SiRNA target sequence
cggcttcaaatgtaacatctatct

SEQ ID NO: 27974 - DNA, 24 bp, Artificial sequence
  SiRNA target sequence
ggcttcaaatgtaacatctatctt

SEQ ID NO: 27975 - DNA, 24 bp, Artificial sequence
  SiRNA target sequence
gcttcaaatgtaacatctatcttt

SEQ ID NO: 27976 - DNA, 24 bp, Artificial sequence
  SiRNA target sequence
cttcaaatgtaacatctatctttg

SEQ ID NO: 27977 - DNA, 24 bp, Artificial sequence
  SiRNA target sequence
ttcaaatgtaacatctatctttgg

SEQ ID NO: 27978 - DNA, 24 bp, Artificial sequence
  SiRNA target sequence
tcaaatgtaacatctatctttgga

SEQ ID NO: 27979 - DNA, 24 bp, Artificial sequence
  SiRNA target sequence
caaatgtaacatctatctttggaa

SEQ ID NO: 27980 - DNA, 24 bp, Artificial sequence
  SiRNA target sequence
aaatgtaacatctatctttggaat

SEQ ID NO: 27981 - DNA, 24 bp, Artificial sequence
  SiRNA target sequence
aatgtaacatctatctttggaata

SEQ ID NO: 27982 - DNA, 24 bp, Artificial sequence
  SiRNA target sequence
atgtaacatctatctttggaatac

SEQ ID NO: 27983 - DNA, 24 bp, Artificial sequence
  SiRNA target sequence
tgtaacatctatctttggaatacc

SEQ ID NO: 27984 - DNA, 24 bp, Artificial sequence
  SiRNA target sequence
gtaacatctatctttggaatacct

SEQ ID NO: 27985 - DNA, 24 bp, Artificial sequence
  SiRNA target sequence
taacatctatctttggaatacctg

SEQ ID NO: 27986 - DNA, 24 bp, Artificial sequence
  SiRNA target sequence
aacatctatctttggaatacctgc

SEQ ID NO: 27987 - DNA, 24 bp, Artificial sequence
  SiRNA target sequence
acatctatctttggaatacctgca

SEQ ID NO: 27988 - DNA, 24 bp, Artificial sequence
  SiRNA target sequence
catctatctttggaatacctgcag

SEQ ID NO: 27989 - DNA, 24 bp, Artificial sequence
  SiRNA target sequence
atctatctttggaatacctgcagg

SEQ ID NO: 27990 - DNA, 24 bp, Artificial sequence
  SiRNA target sequence
tctatctttggaatacctgcaggt

SEQ ID NO: 27991 - DNA, 24 bp, Artificial sequence
  SiRNA target sequence
ctatctttggaatacctgcaggtg

SEQ ID NO: 27992 - DNA, 24 bp, Artificial sequence
  SiRNA target sequence
tatctttggaatacctgcaggtgc

SEQ ID NO: 27993 - DNA, 24 bp, Artificial sequence
  SiRNA target sequence
atctttggaatacctgcaggtgct

SEQ ID NO: 27994 - DNA, 24 bp, Artificial sequence
  SiRNA target sequence
tctttggaatacctgcaggtgctt

SEQ ID NO: 27995 - DNA, 24 bp, Artificial sequence
  SiRNA target sequence
ctttggaatacctgcaggtgcttt

SEQ ID NO: 27996 - DNA, 24 bp, Artificial sequence
  SiRNA target sequence
tttggaatacctgcaggtgcttta

SEQ ID NO: 27997 - DNA, 24 bp, Artificial sequence
  SiRNA target sequence
ttggaatacctgcaggtgctttag

SEQ ID NO: 27998 - DNA, 24 bp, Artificial sequence
  SiRNA target sequence
tggaatacctgcaggtgctttagg

SEQ ID NO: 27999 - DNA, 24 bp, Artificial sequence
  SiRNA target sequence
ggaatacctgcaggtgctttagga

SEQ ID NO: 28000 - DNA, 24 bp, Artificial sequence
  SiRNA target sequence
gaatacctgcaggtgctttaggaa

SEQ ID NO: 28001 - DNA, 24 bp, Artificial sequence
  SiRNA target sequence
aatacctgcaggtgctttaggaat

SEQ ID NO: 28002 - DNA, 24 bp, Artificial sequence
  SiRNA target sequence
atacctgcaggtgctttaggaatg

SEQ ID NO: 28003 - DNA, 24 bp, Artificial sequence
  SiRNA target sequence
tacctgcaggtgctttaggaatgt

SEQ ID NO: 28004 - DNA, 24 bp, Artificial sequence
  SiRNA target sequence
acctgcaggtgctttaggaatgtt

SEQ ID NO: 28005 - DNA, 24 bp, Artificial sequence
  SiRNA target sequence
cctgcaggtgctttaggaatgttt

SEQ ID NO: 28006 - DNA, 24 bp, Artificial sequence
  SiRNA target sequence
ctgcaggtgctttaggaatgtttt

SEQ ID NO: 28007 - DNA, 24 bp, Artificial sequence
  SiRNA target sequence
tgcaggtgctttaggaatgttttt

SEQ ID NO: 28008 - DNA, 24 bp, Artificial sequence
  SiRNA target sequence
gcaggtgctttaggaatgtttttg

SEQ ID NO: 28009 - DNA, 24 bp, Artificial sequence
  SiRNA target sequence
caggtgctttaggaatgtttttga

SEQ ID NO: 28010 - DNA, 24 bp, Artificial sequence
  SiRNA target sequence
aggtgctttaggaatgtttttgag

SEQ ID NO: 28011 - DNA, 24 bp, Artificial sequence
  SiRNA target sequence
ggtgctttaggaatgtttttgagc

SEQ ID NO: 28012 - DNA, 24 bp, Artificial sequence
  SiRNA target sequence
gtgctttaggaatgtttttgagct

SEQ ID NO: 28013 - DNA, 24 bp, Artificial sequence
  SiRNA target sequence
tgctttaggaatgtttttgagctt

SEQ ID NO: 28014 - DNA, 24 bp, Artificial sequence
  SiRNA target sequence
gctttaggaatgtttttgagcttt

SEQ ID NO: 28015 - DNA, 24 bp, Artificial sequence
  SiRNA target sequence
ctttaggaatgtttttgagcttta

SEQ ID NO: 28016 - DNA, 24 bp, Artificial sequence
  SiRNA target sequence
tttaggaatgtttttgagctttat

SEQ ID NO: 28017 - DNA, 24 bp, Artificial sequence
  SiRNA target sequence
ttaggaatgtttttgagctttata

SEQ ID NO: 28018 - DNA, 24 bp, Artificial sequence
  SiRNA target sequence
taggaatgtttttgagctttatag

SEQ ID NO: 28019 - DNA, 24 bp, Artificial sequence
  SiRNA target sequence
aggaatgtttttgagctttatagc

SEQ ID NO: 28020 - DNA, 24 bp, Artificial sequence
  SiRNA target sequence
ggaatgtttttgagctttatagct

SEQ ID NO: 28021 - DNA, 24 bp, Artificial sequence
  SiRNA target sequence
gaatgtttttgagctttatagctc

SEQ ID NO: 28022 - DNA, 24 bp, Artificial sequence
  SiRNA target sequence
aatgtttttgagctttatagctcc

SEQ ID NO: 28023 - DNA, 24 bp, Artificial sequence
  SiRNA target sequence
atgtttttgagctttatagctcct

SEQ ID NO: 28024 - DNA, 24 bp, Artificial sequence
  SiRNA target sequence
tgtttttgagctttatagctccta

SEQ ID NO: 28025 - DNA, 24 bp, Artificial sequence
  SiRNA target sequence
gtttttgagctttatagctcctaa

SEQ ID NO: 28026 - DNA, 24 bp, Artificial sequence
  SiRNA target sequence
tttttgagctttatagctcctaaa

SEQ ID NO: 28027 - DNA, 24 bp, Artificial sequence
  SiRNA target sequence
ttttgagctttatagctcctaaat

SEQ ID NO: 28028 - DNA, 24 bp, Artificial sequence
  SiRNA target sequence
tttgagctttatagctcctaaata

SEQ ID NO: 28029 - DNA, 24 bp, Artificial sequence
  SiRNA target sequence
ttgagctttatagctcctaaatat

SEQ ID NO: 28030 - DNA, 24 bp, Artificial sequence
  SiRNA target sequence
tgagctttatagctcctaaatatt

SEQ ID NO: 28031 - DNA, 24 bp, Artificial sequence
  SiRNA target sequence
gagctttatagctcctaaatattt

SEQ ID NO: 28032 - DNA, 24 bp, Artificial sequence
  SiRNA target sequence
agctttatagctcctaaatattta

SEQ ID NO: 28033 - DNA, 24 bp, Artificial sequence
  SiRNA target sequence
gctttatagctcctaaatatttat

SEQ ID NO: 28034 - DNA, 24 bp, Artificial sequence
  SiRNA target sequence
ctttatagctcctaaatatttatt

SEQ ID NO: 28035 - DNA, 24 bp, Artificial sequence
  SiRNA target sequence
tttatagctcctaaatatttattg

SEQ ID NO: 28036 - DNA, 24 bp, Artificial sequence
  SiRNA target sequence
ttatagctcctaaatatttattgt

SEQ ID NO: 28037 - DNA, 24 bp, Artificial sequence
  SiRNA target sequence
tatagctcctaaatatttattgtc

SEQ ID NO: 28038 - DNA, 24 bp, Artificial sequence
  SiRNA target sequence
atagctcctaaatatttattgtct

SEQ ID NO: 28039 - DNA, 24 bp, Artificial sequence
  SiRNA target sequence
tagctcctaaatatttattgtctt

SEQ ID NO: 28040 - DNA, 24 bp, Artificial sequence
  SiRNA target sequence
agctcctaaatatttattgtcttt

SEQ ID NO: 28041 - DNA, 24 bp, Artificial sequence
  SiRNA target sequence
gctcctaaatatttattgtctttt

SEQ ID NO: 28042 - DNA, 24 bp, Artificial sequence
  SiRNA target sequence
ctcctaaatatttattgtctttta

SEQ ID NO: 28043 - DNA, 24 bp, Artificial sequence
  SiRNA target sequence
tcctaaatatttattgtcttttac

SEQ ID NO: 28044 - DNA, 24 bp, Artificial sequence
  SiRNA target sequence
cctaaatatttattgtcttttacc

SEQ ID NO: 28045 - DNA, 24 bp, Artificial sequence
  SiRNA target sequence
ctaaatatttattgtcttttacca

SEQ ID NO: 28046 - DNA, 24 bp, Artificial sequence
  SiRNA target sequence
taaatatttattgtcttttaccat

SEQ ID NO: 28047 - DNA, 24 bp, Artificial sequence
  SiRNA target sequence
aaatatttattgtcttttaccatc

SEQ ID NO: 28048 - DNA, 24 bp, Artificial sequence
  SiRNA target sequence
aatatttattgtcttttaccatct

SEQ ID NO: 28049 - DNA, 24 bp, Artificial sequence
  SiRNA target sequence
atatttattgtcttttaccatctt

SEQ ID NO: 28050 - DNA, 24 bp, Artificial sequence
  SiRNA target sequence
tatttattgtcttttaccatcttt

SEQ ID NO: 28051 - DNA, 24 bp, Artificial sequence
  SiRNA target sequence
atttattgtcttttaccatctttc

SEQ ID NO: 28052 - DNA, 24 bp, Artificial sequence
  SiRNA target sequence
tttattgtcttttaccatctttct

SEQ ID NO: 28053 - DNA, 24 bp, Artificial sequence
  SiRNA target sequence
ttattgtcttttaccatctttctt

SEQ ID NO: 28054 - DNA, 24 bp, Artificial sequence
  SiRNA target sequence
tattgtcttttaccatctttcttt

SEQ ID NO: 28055 - DNA, 24 bp, Artificial sequence
  SiRNA target sequence
attgtcttttaccatctttctttc

SEQ ID NO: 28056 - DNA, 24 bp, Artificial sequence
  SiRNA target sequence
ttgtcttttaccatctttctttct

SEQ ID NO: 28057 - DNA, 24 bp, Artificial sequence
  SiRNA target sequence
tgtcttttaccatctttctttctc

SEQ ID NO: 28058 - DNA, 24 bp, Artificial sequence
  SiRNA target sequence
gtcttttaccatctttctttctcc

SEQ ID NO: 28059 - DNA, 24 bp, Artificial sequence
  SiRNA target sequence
tcttttaccatctttctttctcct

SEQ ID NO: 28060 - DNA, 24 bp, Artificial sequence
  SiRNA target sequence
cttttaccatctttctttctcctt

SEQ ID NO: 28061 - DNA, 24 bp, Artificial sequence
  SiRNA target sequence
ttttaccatctttctttctccttg

SEQ ID NO: 28062 - DNA, 24 bp, Artificial sequence
  SiRNA target sequence
tttaccatctttctttctccttga

SEQ ID NO: 28063 - DNA, 24 bp, Artificial sequence
  SiRNA target sequence
ttaccatctttctttctccttgat

SEQ ID NO: 28064 - DNA, 24 bp, Artificial sequence
  SiRNA target sequence
taccatctttctttctccttgata

SEQ ID NO: 28065 - DNA, 24 bp, Artificial sequence
  SiRNA target sequence
accatctttctttctccttgatat

SEQ ID NO: 28066 - DNA, 24 bp, Artificial sequence
  SiRNA target sequence
ccatctttctttctccttgatata

SEQ ID NO: 28067 - DNA, 24 bp, Artificial sequence
  SiRNA target sequence
catctttctttctccttgatatat

SEQ ID NO: 28068 - DNA, 24 bp, Artificial sequence
  SiRNA target sequence
atctttctttctccttgatatatt

SEQ ID NO: 28069 - DNA, 24 bp, Artificial sequence
  SiRNA target sequence
tctttctttctccttgatatattc

SEQ ID NO: 28070 - DNA, 24 bp, Artificial sequence
  SiRNA target sequence
ctttctttctccttgatatattct

SEQ ID NO: 28071 - DNA, 24 bp, Artificial sequence
  SiRNA target sequence
tttctttctccttgatatattcta

SEQ ID NO: 28072 - DNA, 24 bp, Artificial sequence
  SiRNA target sequence
ttctttctccttgatatattctaa

SEQ ID NO: 28073 - DNA, 24 bp, Artificial sequence
  SiRNA target sequence
tctttctccttgatatattctaat

SEQ ID NO: 28074 - DNA, 24 bp, Artificial sequence
  SiRNA target sequence
ctttctccttgatatattctaata

SEQ ID NO: 28075 - DNA, 24 bp, Artificial sequence
  SiRNA target sequence
tttctccttgatatattctaatat

SEQ ID NO: 28076 - DNA, 24 bp, Artificial sequence
  SiRNA target sequence
ttctccttgatatattctaatatc

SEQ ID NO: 28077 - DNA, 24 bp, Artificial sequence
  SiRNA target sequence
tctccttgatatattctaatatct

SEQ ID NO: 28078 - DNA, 24 bp, Artificial sequence
  SiRNA target sequence
ctccttgatatattctaatatcta

SEQ ID NO: 28079 - DNA, 24 bp, Artificial sequence
  SiRNA target sequence
tccttgatatattctaatatctac

SEQ ID NO: 28080 - DNA, 24 bp, Artificial sequence
  SiRNA target sequence
ccttgatatattctaatatctact

SEQ ID NO: 28081 - DNA, 24 bp, Artificial sequence
  SiRNA target sequence
cttgatatattctaatatctactt

SEQ ID NO: 28082 - DNA, 24 bp, Artificial sequence
  SiRNA target sequence
ttgatatattctaatatctacttc

SEQ ID NO: 28083 - DNA, 24 bp, Artificial sequence
  SiRNA target sequence
tgatatattctaatatctacttcg

SEQ ID NO: 28084 - DNA, 24 bp, Artificial sequence
  SiRNA target sequence
gatatattctaatatctacttcgg

SEQ ID NO: 28085 - DNA, 24 bp, Artificial sequence
  SiRNA target sequence
atatattctaatatctacttcgga

SEQ ID NO: 28086 - DNA, 24 bp, Artificial sequence
  SiRNA target sequence
tatattctaatatctacttcggat

SEQ ID NO: 28087 - DNA, 24 bp, Artificial sequence
  SiRNA target sequence
atattctaatatctacttcggatt

SEQ ID NO: 28088 - DNA, 24 bp, Artificial sequence
  SiRNA target sequence
tattctaatatctacttcggattg

SEQ ID NO: 28089 - DNA, 24 bp, Artificial sequence
  SiRNA target sequence
attctaatatctacttcggattga

SEQ ID NO: 28090 - DNA, 24 bp, Artificial sequence
  SiRNA target sequence
ttctaatatctacttcggattgat

SEQ ID NO: 28091 - DNA, 24 bp, Artificial sequence
  SiRNA target sequence
tctaatatctacttcggattgatt

SEQ ID NO: 28092 - DNA, 24 bp, Artificial sequence
  SiRNA target sequence
ctaatatctacttcggattgatta

SEQ ID NO: 28093 - DNA, 24 bp, Artificial sequence
  SiRNA target sequence
taatatctacttcggattgattat

SEQ ID NO: 28094 - DNA, 24 bp, Artificial sequence
  SiRNA target sequence
aatatctacttcggattgattatc

SEQ ID NO: 28095 - DNA, 24 bp, Artificial sequence
  SiRNA target sequence
atatctacttcggattgattatct

SEQ ID NO: 28096 - DNA, 24 bp, Artificial sequence
  SiRNA target sequence
tatctacttcggattgattatctt

SEQ ID NO: 28097 - DNA, 24 bp, Artificial sequence
  SiRNA target sequence
atctacttcggattgattatcttc

SEQ ID NO: 28098 - DNA, 24 bp, Artificial sequence
  SiRNA target sequence
tctacttcggattgattatcttca

SEQ ID NO: 28099 - DNA, 24 bp, Artificial sequence
  SiRNA target sequence
ctacttcggattgattatcttcag

SEQ ID NO: 28100 - DNA, 24 bp, Artificial sequence
  SiRNA target sequence
tacttcggattgattatcttcaga

SEQ ID NO: 28101 - DNA, 24 bp, Artificial sequence
  SiRNA target sequence
acttcggattgattatcttcagag

SEQ ID NO: 28102 - DNA, 24 bp, Artificial sequence
  SiRNA target sequence
cttcggattgattatcttcagagg

SEQ ID NO: 28103 - DNA, 24 bp, Artificial sequence
  SiRNA target sequence
ttcggattgattatcttcagaggt

SEQ ID NO: 28104 - DNA, 24 bp, Artificial sequence
  SiRNA target sequence
tcggattgattatcttcagaggta

SEQ ID NO: 28105 - DNA, 24 bp, Artificial sequence
  SiRNA target sequence
cggattgattatcttcagaggtag

SEQ ID NO: 28106 - DNA, 24 bp, Artificial sequence
  SiRNA target sequence
ggattgattatcttcagaggtaga

SEQ ID NO: 28107 - DNA, 24 bp, Artificial sequence
  SiRNA target sequence
gattgattatcttcagaggtagaa

SEQ ID NO: 28108 - DNA, 24 bp, Artificial sequence
  SiRNA target sequence
attgattatcttcagaggtagaaa

SEQ ID NO: 28109 - DNA, 24 bp, Artificial sequence
  SiRNA target sequence
ttgattatcttcagaggtagaaaa

SEQ ID NO: 28110 - DNA, 24 bp, Artificial sequence
  SiRNA target sequence
tgattatcttcagaggtagaaaaa

SEQ ID NO: 28111 - DNA, 24 bp, Artificial sequence
  SiRNA target sequence
gattatcttcagaggtagaaaaac

SEQ ID NO: 28112 - DNA, 24 bp, Artificial sequence
  SiRNA target sequence
attatcttcagaggtagaaaaact

SEQ ID NO: 28113 - DNA, 24 bp, Artificial sequence
  SiRNA target sequence
ttatcttcagaggtagaaaaactg

SEQ ID NO: 28114 - DNA, 24 bp, Artificial sequence
  SiRNA target sequence
tatcttcagaggtagaaaaactgt

SEQ ID NO: 28115 - DNA, 24 bp, Artificial sequence
  SiRNA target sequence
atcttcagaggtagaaaaactgtg

SEQ ID NO: 28116 - DNA, 24 bp, Artificial sequence
  SiRNA target sequence
tcttcagaggtagaaaaactgtgt

SEQ ID NO: 28117 - DNA, 24 bp, Artificial sequence
  SiRNA target sequence
cttcagaggtagaaaaactgtgtg

SEQ ID NO: 28118 - DNA, 24 bp, Artificial sequence
  SiRNA target sequence
ttcagaggtagaaaaactgtgtgt

SEQ ID NO: 28119 - DNA, 24 bp, Artificial sequence
  SiRNA target sequence
tcagaggtagaaaaactgtgtgtt

SEQ ID NO: 28120 - DNA, 24 bp, Artificial sequence
  SiRNA target sequence
cagaggtagaaaaactgtgtgttt

SEQ ID NO: 28121 - DNA, 24 bp, Artificial sequence
  SiRNA target sequence
agaggtagaaaaactgtgtgtttc

SEQ ID NO: 28122 - DNA, 24 bp, Artificial sequence
  SiRNA target sequence
gaggtagaaaaactgtgtgtttcc

SEQ ID NO: 28123 - DNA, 24 bp, Artificial sequence
  SiRNA target sequence
aggtagaaaaactgtgtgtttcct

SEQ ID NO: 28124 - DNA, 24 bp, Artificial sequence
  SiRNA target sequence
ggtagaaaaactgtgtgtttcctt

SEQ ID NO: 28125 - DNA, 24 bp, Artificial sequence
  SiRNA target sequence
gtagaaaaactgtgtgtttcctta

SEQ ID NO: 28126 - DNA, 24 bp, Artificial sequence
  SiRNA target sequence
tagaaaaactgtgtgtttccttaa

SEQ ID NO: 28127 - DNA, 24 bp, Artificial sequence
  SiRNA target sequence
agaaaaactgtgtgtttccttaaa

SEQ ID NO: 28128 - DNA, 24 bp, Artificial sequence
  SiRNA target sequence
gaaaaactgtgtgtttccttaaat

SEQ ID NO: 28129 - DNA, 24 bp, Artificial sequence
  SiRNA target sequence
aaaaactgtgtgtttccttaaatg

SEQ ID NO: 28130 - DNA, 24 bp, Artificial sequence
  SiRNA target sequence
aaaactgtgtgtttccttaaatgg

SEQ ID NO: 28131 - DNA, 24 bp, Artificial sequence
  SiRNA target sequence
aaactgtgtgtttccttaaatgga

SEQ ID NO: 28132 - DNA, 24 bp, Artificial sequence
  SiRNA target sequence
aactgtgtgtttccttaaatggaa

SEQ ID NO: 28133 - DNA, 24 bp, Artificial sequence
  SiRNA target sequence
actgtgtgtttccttaaatggaat

SEQ ID NO: 28134 - DNA, 24 bp, Artificial sequence
  SiRNA target sequence
ctgtgtgtttccttaaatggaata

SEQ ID NO: 28135 - DNA, 24 bp, Artificial sequence
  SiRNA target sequence
tgtgtgtttccttaaatggaatag

SEQ ID NO: 28136 - DNA, 24 bp, Artificial sequence
  SiRNA target sequence
gtgtgtttccttaaatggaatagt

SEQ ID NO: 28137 - DNA, 24 bp, Artificial sequence
  SiRNA target sequence
tgtgtttccttaaatggaatagta

SEQ ID NO: 28138 - DNA, 24 bp, Artificial sequence
  SiRNA target sequence
gtgtttccttaaatggaatagtag

SEQ ID NO: 28139 - DNA, 24 bp, Artificial sequence
  SiRNA target sequence
tgtttccttaaatggaatagtaga

SEQ ID NO: 28140 - DNA, 24 bp, Artificial sequence
  SiRNA target sequence
gtttccttaaatggaatagtagaa

SEQ ID NO: 28141 - DNA, 24 bp, Artificial sequence
  SiRNA target sequence
tttccttaaatggaatagtagaat

SEQ ID NO: 28142 - DNA, 24 bp, Artificial sequence
  SiRNA target sequence
ttccttaaatggaatagtagaatt

SEQ ID NO: 28143 - DNA, 24 bp, Artificial sequence
  SiRNA target sequence
tccttaaatggaatagtagaattt

SEQ ID NO: 28144 - DNA, 24 bp, Artificial sequence
  SiRNA target sequence
ccttaaatggaatagtagaatttc

SEQ ID NO: 28145 - DNA, 24 bp, Artificial sequence
  SiRNA target sequence
cttaaatggaatagtagaatttct

SEQ ID NO: 28146 - DNA, 24 bp, Artificial sequence
  SiRNA target sequence
ttaaatggaatagtagaatttcta

SEQ ID NO: 28147 - DNA, 24 bp, Artificial sequence
  SiRNA target sequence
taaatggaatagtagaatttctat

SEQ ID NO: 28148 - DNA, 24 bp, Artificial sequence
  SiRNA target sequence
aaatggaatagtagaatttctatg

SEQ ID NO: 28149 - DNA, 24 bp, Artificial sequence
  SiRNA target sequence
aatggaatagtagaatttctatga

SEQ ID NO: 28150 - DNA, 24 bp, Artificial sequence
  SiRNA target sequence
atggaatagtagaatttctatgaa

SEQ ID NO: 28151 - DNA, 24 bp, Artificial sequence
  SiRNA target sequence
tggaatagtagaatttctatgaat

SEQ ID NO: 28152 - DNA, 24 bp, Artificial sequence
  SiRNA target sequence
ggaatagtagaatttctatgaatt

SEQ ID NO: 28153 - DNA, 24 bp, Artificial sequence
  SiRNA target sequence
gaatagtagaatttctatgaatta

SEQ ID NO: 28154 - DNA, 24 bp, Artificial sequence
  SiRNA target sequence
aatagtagaatttctatgaattat

SEQ ID NO: 28155 - DNA, 24 bp, Artificial sequence
  SiRNA target sequence
atagtagaatttctatgaattatc

SEQ ID NO: 28156 - DNA, 24 bp, Artificial sequence
  SiRNA target sequence
tagtagaatttctatgaattatct

SEQ ID NO: 28157 - DNA, 24 bp, Artificial sequence
  SiRNA target sequence
agtagaatttctatgaattatctt

SEQ ID NO: 28158 - DNA, 24 bp, Artificial sequence
  SiRNA target sequence
gtagaatttctatgaattatctta

SEQ ID NO: 28159 - DNA, 24 bp, Artificial sequence
  SiRNA target sequence
tagaatttctatgaattatcttat

SEQ ID NO: 28160 - DNA, 24 bp, Artificial sequence
  SiRNA target sequence
agaatttctatgaattatcttatt

SEQ ID NO: 28161 - DNA, 24 bp, Artificial sequence
  SiRNA target sequence
gaatttctatgaattatcttatta

SEQ ID NO: 28162 - DNA, 24 bp, Artificial sequence
  SiRNA target sequence
aatttctatgaattatcttattaa

SEQ ID NO: 28163 - DNA, 24 bp, Artificial sequence
  SiRNA target sequence
atttctatgaattatcttattaaa

SEQ ID NO: 28164 - DNA, 24 bp, Artificial sequence
  SiRNA target sequence
tttctatgaattatcttattaaaa

SEQ ID NO: 28165 - DNA, 24 bp, Artificial sequence
  SiRNA target sequence
ttctatgaattatcttattaaaaa

SEQ ID NO: 28166 - DNA, 24 bp, Artificial sequence
  SiRNA target sequence
tctatgaattatcttattaaaaat

SEQ ID NO: 28167 - DNA, 24 bp, Artificial sequence
  SiRNA target sequence
ctatgaattatcttattaaaaatc

SEQ ID NO: 28168 - DNA, 24 bp, Artificial sequence
  SiRNA target sequence
tatgaattatcttattaaaaatcc

SEQ ID NO: 28169 - DNA, 24 bp, Artificial sequence
  SiRNA target sequence
atgaattatcttattaaaaatccc

SEQ ID NO: 28170 - DNA, 24 bp, Artificial sequence
  SiRNA target sequence
tgaattatcttattaaaaatcccg

SEQ ID NO: 28171 - DNA, 24 bp, Artificial sequence
  SiRNA target sequence
gaattatcttattaaaaatcccgc

SEQ ID NO: 28172 - DNA, 24 bp, Artificial sequence
  SiRNA target sequence
aattatcttattaaaaatcccgcc

SEQ ID NO: 28173 - DNA, 24 bp, Artificial sequence
  SiRNA target sequence
attatcttattaaaaatcccgccc

SEQ ID NO: 28174 - DNA, 24 bp, Artificial sequence
  SiRNA target sequence
ttatcttattaaaaatcccgccca

SEQ ID NO: 28175 - DNA, 24 bp, Artificial sequence
  SiRNA target sequence
tatcttattaaaaatcccgcccaa

SEQ ID NO: 28176 - DNA, 24 bp, Artificial sequence
  SiRNA target sequence
atcttattaaaaatcccgcccaaa

SEQ ID NO: 28177 - DNA, 24 bp, Artificial sequence
  SiRNA target sequence
tcttattaaaaatcccgcccaaaa

SEQ ID NO: 28178 - DNA, 24 bp, Artificial sequence
  SiRNA target sequence
cttattaaaaatcccgcccaaaag

SEQ ID NO: 28179 - DNA, 24 bp, Artificial sequence
  SiRNA target sequence
ttattaaaaatcccgcccaaaagc

SEQ ID NO: 28180 - DNA, 24 bp, Artificial sequence
  SiRNA target sequence
tattaaaaatcccgcccaaaagct

SEQ ID NO: 28181 - DNA, 24 bp, Artificial sequence
  SiRNA target sequence
attaaaaatcccgcccaaaagctc

SEQ ID NO: 28182 - DNA, 24 bp, Artificial sequence
  SiRNA target sequence
ttaaaaatcccgcccaaaagctct

SEQ ID NO: 28183 - DNA, 24 bp, Artificial sequence
  SiRNA target sequence
taaaaatcccgcccaaaagctcta

SEQ ID NO: 28184 - DNA, 24 bp, Artificial sequence
  SiRNA target sequence
aaaaatcccgcccaaaagctctat

SEQ ID NO: 28185 - DNA, 24 bp, Artificial sequence
  SiRNA target sequence
aaaatcccgcccaaaagctctata

SEQ ID NO: 28186 - DNA, 24 bp, Artificial sequence
  SiRNA target sequence
aaatcccgcccaaaagctctatac

SEQ ID NO: 28187 - DNA, 24 bp, Artificial sequence
  SiRNA target sequence
aatcccgcccaaaagctctatacc

SEQ ID NO: 28188 - DNA, 24 bp, Artificial sequence
  SiRNA target sequence
atcccgcccaaaagctctatacct

SEQ ID NO: 28189 - DNA, 24 bp, Artificial sequence
  SiRNA target sequence
tcccgcccaaaagctctataccta

SEQ ID NO: 28190 - DNA, 24 bp, Artificial sequence
  SiRNA target sequence
cccgcccaaaagctctatacctaa

SEQ ID NO: 28191 - DNA, 24 bp, Artificial sequence
  SiRNA target sequence
ccgcccaaaagctctatacctaaa

SEQ ID NO: 28192 - DNA, 24 bp, Artificial sequence
  SiRNA target sequence
cgcccaaaagctctatacctaaac

SEQ ID NO: 28193 - DNA, 24 bp, Artificial sequence
  SiRNA target sequence
gcccaaaagctctatacctaaact

SEQ ID NO: 28194 - DNA, 24 bp, Artificial sequence
  SiRNA target sequence
cccaaaagctctatacctaaactc

SEQ ID NO: 28195 - DNA, 24 bp, Artificial sequence
  SiRNA target sequence
ccaaaagctctatacctaaactca

SEQ ID NO: 28196 - DNA, 24 bp, Artificial sequence
  SiRNA target sequence
caaaagctctatacctaaactcaa

SEQ ID NO: 28197 - DNA, 24 bp, Artificial sequence
  SiRNA target sequence
aaaagctctatacctaaactcaat

SEQ ID NO: 28198 - DNA, 24 bp, Artificial sequence
  SiRNA target sequence
aaagctctatacctaaactcaatg

SEQ ID NO: 28199 - DNA, 24 bp, Artificial sequence
  SiRNA target sequence
aagctctatacctaaactcaatgg

SEQ ID NO: 28200 - DNA, 24 bp, Artificial sequence
  SiRNA target sequence
agctctatacctaaactcaatggt

SEQ ID NO: 28201 - DNA, 24 bp, Artificial sequence
  SiRNA target sequence
gctctatacctaaactcaatggta

SEQ ID NO: 28202 - DNA, 24 bp, Artificial sequence
  SiRNA target sequence
ctctatacctaaactcaatggtac

SEQ ID NO: 28203 - DNA, 24 bp, Artificial sequence
  SiRNA target sequence
tctatacctaaactcaatggtact

SEQ ID NO: 28204 - DNA, 24 bp, Artificial sequence
  SiRNA target sequence
ctatacctaaactcaatggtacta

SEQ ID NO: 28205 - DNA, 24 bp, Artificial sequence
  SiRNA target sequence
tatacctaaactcaatggtactac

SEQ ID NO: 28206 - DNA, 24 bp, Artificial sequence
  SiRNA target sequence
atacctaaactcaatggtactaca

SEQ ID NO: 28207 - DNA, 24 bp, Artificial sequence
  SiRNA target sequence
tacctaaactcaatggtactacat

SEQ ID NO: 28208 - DNA, 24 bp, Artificial sequence
  SiRNA target sequence
acctaaactcaatggtactacatc

SEQ ID NO: 28209 - DNA, 24 bp, Artificial sequence
  SiRNA target sequence
cctaaactcaatggtactacatcc

SEQ ID NO: 28210 - DNA, 24 bp, Artificial sequence
  SiRNA target sequence
ctaaactcaatggtactacatcca

SEQ ID NO: 28211 - DNA, 24 bp, Artificial sequence
  SiRNA target sequence
taaactcaatggtactacatccaa

SEQ ID NO: 28212 - DNA, 24 bp, Artificial sequence
  SiRNA target sequence
aaactcaatggtactacatccaat

SEQ ID NO: 28213 - DNA, 24 bp, Artificial sequence
  SiRNA target sequence
aactcaatggtactacatccaata

SEQ ID NO: 28214 - DNA, 24 bp, Artificial sequence
  SiRNA target sequence
actcaatggtactacatccaataa

SEQ ID NO: 28215 - DNA, 24 bp, Artificial sequence
  SiRNA target sequence
ctcaatggtactacatccaataat

SEQ ID NO: 28216 - DNA, 24 bp, Artificial sequence
  SiRNA target sequence
tcaatggtactacatccaataata

SEQ ID NO: 28217 - DNA, 24 bp, Artificial sequence
  SiRNA target sequence
caatggtactacatccaataatag

SEQ ID NO: 28218 - DNA, 24 bp, Artificial sequence
  SiRNA target sequence
aatggtactacatccaataatagg

SEQ ID NO: 28219 - DNA, 24 bp, Artificial sequence
  SiRNA target sequence
atggtactacatccaataatagga

SEQ ID NO: 28220 - DNA, 24 bp, Artificial sequence
  SiRNA target sequence
tggtactacatccaataataggac

SEQ ID NO: 28221 - DNA, 24 bp, Artificial sequence
  SiRNA target sequence
ggtactacatccaataataggaca

SEQ ID NO: 28222 - DNA, 24 bp, Artificial sequence
  SiRNA target sequence
gtactacatccaataataggacat

SEQ ID NO: 28223 - DNA, 24 bp, Artificial sequence
  SiRNA target sequence
tactacatccaataataggacatc

SEQ ID NO: 28224 - DNA, 24 bp, Artificial sequence
  SiRNA target sequence
actacatccaataataggacatct

SEQ ID NO: 28225 - DNA, 24 bp, Artificial sequence
  SiRNA target sequence
ctacatccaataataggacatctt

SEQ ID NO: 28226 - DNA, 24 bp, Artificial sequence
  SiRNA target sequence
tacatccaataataggacatcttt

SEQ ID NO: 28227 - DNA, 24 bp, Artificial sequence
  SiRNA target sequence
acatccaataataggacatctttt

SEQ ID NO: 28228 - DNA, 24 bp, Artificial sequence
  SiRNA target sequence
catccaataataggacatctttta

SEQ ID NO: 28229 - DNA, 24 bp, Artificial sequence
  SiRNA target sequence
atccaataataggacatcttttat

SEQ ID NO: 28230 - DNA, 24 bp, Artificial sequence
  SiRNA target sequence
tccaataataggacatcttttatt

SEQ ID NO: 28231 - DNA, 24 bp, Artificial sequence
  SiRNA target sequence
ccaataataggacatcttttattt

SEQ ID NO: 28232 - DNA, 24 bp, Artificial sequence
  SiRNA target sequence
caataataggacatcttttatttt

SEQ ID NO: 28233 - DNA, 24 bp, Artificial sequence
  SiRNA target sequence
aataataggacatcttttattttt

SEQ ID NO: 28234 - DNA, 24 bp, Artificial sequence
  SiRNA target sequence
ataataggacatcttttatttttc

SEQ ID NO: 28235 - DNA, 24 bp, Artificial sequence
  SiRNA target sequence
taataggacatcttttatttttcc

SEQ ID NO: 28236 - DNA, 24 bp, Artificial sequence
  SiRNA target sequence
aataggacatcttttatttttcct

SEQ ID NO: 28237 - DNA, 24 bp, Artificial sequence
  SiRNA target sequence
ataggacatcttttatttttcctt

SEQ ID NO: 28238 - DNA, 24 bp, Artificial sequence
  SiRNA target sequence
taggacatcttttatttttccttc

SEQ ID NO: 28239 - DNA, 24 bp, Artificial sequence
  SiRNA target sequence
aggacatcttttatttttccttct

SEQ ID NO: 28240 - DNA, 24 bp, Artificial sequence
  SiRNA target sequence
ggacatcttttatttttccttcta

SEQ ID NO: 28241 - DNA, 24 bp, Artificial sequence
  SiRNA target sequence
gacatcttttatttttccttctaa

SEQ ID NO: 28242 - DNA, 24 bp, Artificial sequence
  SiRNA target sequence
acatcttttatttttccttctaac

SEQ ID NO: 28243 - DNA, 24 bp, Artificial sequence
  SiRNA target sequence
catcttttatttttccttctaaca

SEQ ID NO: 28244 - DNA, 24 bp, Artificial sequence
  SiRNA target sequence
atcttttatttttccttctaacac

SEQ ID NO: 28245 - DNA, 24 bp, Artificial sequence
  SiRNA target sequence
tcttttatttttccttctaacacg

SEQ ID NO: 28246 - DNA, 24 bp, Artificial sequence
  SiRNA target sequence
cttttatttttccttctaacacgc

SEQ ID NO: 28247 - DNA, 24 bp, Artificial sequence
  SiRNA target sequence
ttttatttttccttctaacacgcc

SEQ ID NO: 28248 - DNA, 24 bp, Artificial sequence
  SiRNA target sequence
tttatttttccttctaacacgcct

SEQ ID NO: 28249 - DNA, 24 bp, Artificial sequence
  SiRNA target sequence
ttatttttccttctaacacgcctg

SEQ ID NO: 28250 - DNA, 24 bp, Artificial sequence
  SiRNA target sequence
tatttttccttctaacacgcctgc

SEQ ID NO: 28251 - DNA, 24 bp, Artificial sequence
  SiRNA target sequence
atttttccttctaacacgcctgct

SEQ ID NO: 28252 - DNA, 24 bp, Artificial sequence
  SiRNA target sequence
tttttccttctaacacgcctgctt

SEQ ID NO: 28253 - DNA, 24 bp, Artificial sequence
  SiRNA target sequence
ttttccttctaacacgcctgcttg

SEQ ID NO: 28254 - DNA, 24 bp, Artificial sequence
  SiRNA target sequence
tttccttctaacacgcctgcttgt

SEQ ID NO: 28255 - DNA, 24 bp, Artificial sequence
  SiRNA target sequence
ttccttctaacacgcctgcttgta

SEQ ID NO: 28256 - DNA, 24 bp, Artificial sequence
  SiRNA target sequence
tccttctaacacgcctgcttgtag

SEQ ID NO: 28257 - DNA, 24 bp, Artificial sequence
  SiRNA target sequence
ccttctaacacgcctgcttgtaga

SEQ ID NO: 28258 - DNA, 24 bp, Artificial sequence
  SiRNA target sequence
cttctaacacgcctgcttgtagag

SEQ ID NO: 28259 - DNA, 24 bp, Artificial sequence
  SiRNA target sequence
ttctaacacgcctgcttgtagagc

SEQ ID NO: 28260 - DNA, 24 bp, Artificial sequence
  SiRNA target sequence
tctaacacgcctgcttgtagagcg

SEQ ID NO: 28261 - DNA, 24 bp, Artificial sequence
  SiRNA target sequence
ctaacacgcctgcttgtagagcgg

SEQ ID NO: 28262 - DNA, 24 bp, Artificial sequence
  SiRNA target sequence
taacacgcctgcttgtagagcggc

SEQ ID NO: 28263 - DNA, 24 bp, Artificial sequence
  SiRNA target sequence
aacacgcctgcttgtagagcggcc

SEQ ID NO: 28264 - DNA, 24 bp, Artificial sequence
  SiRNA target sequence
acacgcctgcttgtagagcggccc

SEQ ID NO: 28265 - DNA, 24 bp, Artificial sequence
  SiRNA target sequence
cacgcctgcttgtagagcggcccc

SEQ ID NO: 28266 - DNA, 24 bp, Artificial sequence
  SiRNA target sequence
acgcctgcttgtagagcggcccct

SEQ ID NO: 28267 - DNA, 24 bp, Artificial sequence
  SiRNA target sequence
cgcctgcttgtagagcggcccctt

SEQ ID NO: 28268 - DNA, 24 bp, Artificial sequence
  SiRNA target sequence
gcctgcttgtagagcggccccttt

SEQ ID NO: 28269 - DNA, 24 bp, Artificial sequence
  SiRNA target sequence
cctgcttgtagagcggccccttta

SEQ ID NO: 28270 - DNA, 24 bp, Artificial sequence
  SiRNA target sequence
ctgcttgtagagcggcccctttag

SEQ ID NO: 28271 - DNA, 24 bp, Artificial sequence
  SiRNA target sequence
tgcttgtagagcggcccctttagc

SEQ ID NO: 28272 - DNA, 24 bp, Artificial sequence
  SiRNA target sequence
gcttgtagagcggcccctttagca

SEQ ID NO: 28273 - DNA, 24 bp, Artificial sequence
  SiRNA target sequence
cttgtagagcggcccctttagcaa

SEQ ID NO: 28274 - DNA, 24 bp, Artificial sequence
  SiRNA target sequence
ttgtagagcggcccctttagcaac

SEQ ID NO: 28275 - DNA, 24 bp, Artificial sequence
  SiRNA target sequence
tgtagagcggcccctttagcaaca

SEQ ID NO: 28276 - DNA, 24 bp, Artificial sequence
  SiRNA target sequence
gtagagcggcccctttagcaacag

SEQ ID NO: 28277 - DNA, 24 bp, Artificial sequence
  SiRNA target sequence
tagagcggcccctttagcaacagc

SEQ ID NO: 28278 - DNA, 24 bp, Artificial sequence
  SiRNA target sequence
agagcggcccctttagcaacagct

SEQ ID NO: 28279 - DNA, 24 bp, Artificial sequence
  SiRNA target sequence
gagcggcccctttagcaacagctt

SEQ ID NO: 28280 - DNA, 24 bp, Artificial sequence
  SiRNA target sequence
agcggcccctttagcaacagcttc

SEQ ID NO: 28281 - DNA, 24 bp, Artificial sequence
  SiRNA target sequence
gcggcccctttagcaacagcttca

SEQ ID NO: 28282 - DNA, 24 bp, Artificial sequence
  SiRNA target sequence
cggcccctttagcaacagcttcat

SEQ ID NO: 28283 - DNA, 24 bp, Artificial sequence
  SiRNA target sequence
ggcccctttagcaacagcttcatc

SEQ ID NO: 28284 - DNA, 24 bp, Artificial sequence
  SiRNA target sequence
gcccctttagcaacagcttcatct

SEQ ID NO: 28285 - DNA, 24 bp, Artificial sequence
  SiRNA target sequence
cccctttagcaacagcttcatctg

SEQ ID NO: 28286 - DNA, 24 bp, Artificial sequence
  SiRNA target sequence
ccctttagcaacagcttcatctgg

SEQ ID NO: 28287 - DNA, 24 bp, Artificial sequence
  SiRNA target sequence
cctttagcaacagcttcatctgga

SEQ ID NO: 28288 - DNA, 24 bp, Artificial sequence
  SiRNA target sequence
ctttagcaacagcttcatctggat

SEQ ID NO: 28289 - DNA, 24 bp, Artificial sequence
  SiRNA target sequence
tttagcaacagcttcatctggatt

SEQ ID NO: 28290 - DNA, 24 bp, Artificial sequence
  SiRNA target sequence
ttagcaacagcttcatctggatta

SEQ ID NO: 28291 - DNA, 24 bp, Artificial sequence
  SiRNA target sequence
tagcaacagcttcatctggattaa

SEQ ID NO: 28292 - DNA, 24 bp, Artificial sequence
  SiRNA target sequence
agcaacagcttcatctggattaat

SEQ ID NO: 28293 - DNA, 24 bp, Artificial sequence
  SiRNA target sequence
gcaacagcttcatctggattaata

SEQ ID NO: 28294 - DNA, 24 bp, Artificial sequence
  SiRNA target sequence
caacagcttcatctggattaatat

SEQ ID NO: 28295 - DNA, 24 bp, Artificial sequence
  SiRNA target sequence
aacagcttcatctggattaatatt

SEQ ID NO: 28296 - DNA, 24 bp, Artificial sequence
  SiRNA target sequence
acagcttcatctggattaatattt

SEQ ID NO: 28297 - DNA, 24 bp, Artificial sequence
  SiRNA target sequence
cagcttcatctggattaatatttg

SEQ ID NO: 28298 - DNA, 24 bp, Artificial sequence
  SiRNA target sequence
agcttcatctggattaatatttgt

SEQ ID NO: 28299 - DNA, 24 bp, Artificial sequence
  SiRNA target sequence
gcttcatctggattaatatttgta

SEQ ID NO: 28300 - DNA, 24 bp, Artificial sequence
  SiRNA target sequence
cttcatctggattaatatttgtag

SEQ ID NO: 28301 - DNA, 24 bp, Artificial sequence
  SiRNA target sequence
ttcatctggattaatatttgtaga

SEQ ID NO: 28302 - DNA, 24 bp, Artificial sequence
  SiRNA target sequence
tcatctggattaatatttgtagaa

SEQ ID NO: 28303 - DNA, 24 bp, Artificial sequence
  SiRNA target sequence
catctggattaatatttgtagaag

SEQ ID NO: 28304 - DNA, 24 bp, Artificial sequence
  SiRNA target sequence
atctggattaatatttgtagaagg

SEQ ID NO: 28305 - DNA, 24 bp, Artificial sequence
  SiRNA target sequence
tctggattaatatttgtagaaggc

SEQ ID NO: 28306 - DNA, 24 bp, Artificial sequence
  SiRNA target sequence
ctggattaatatttgtagaaggct

SEQ ID NO: 28307 - DNA, 24 bp, Artificial sequence
  SiRNA target sequence
tggattaatatttgtagaaggctc

SEQ ID NO: 28308 - DNA, 24 bp, Artificial sequence
  SiRNA target sequence
ggattaatatttgtagaaggctcg

SEQ ID NO: 28309 - DNA, 24 bp, Artificial sequence
  SiRNA target sequence
gattaatatttgtagaaggctcga

SEQ ID NO: 28310 - DNA, 24 bp, Artificial sequence
  SiRNA target sequence
attaatatttgtagaaggctcgat

SEQ ID NO: 28311 - DNA, 24 bp, Artificial sequence
  SiRNA target sequence
ttaatatttgtagaaggctcgata

SEQ ID NO: 28312 - DNA, 24 bp, Artificial sequence
  SiRNA target sequence
taatatttgtagaaggctcgatac

SEQ ID NO: 28313 - DNA, 24 bp, Artificial sequence
  SiRNA target sequence
aatatttgtagaaggctcgatacc

SEQ ID NO: 28314 - DNA, 24 bp, Artificial sequence
  SiRNA target sequence
atatttgtagaaggctcgatacca

SEQ ID NO: 28315 - DNA, 24 bp, Artificial sequence
  SiRNA target sequence
tatttgtagaaggctcgataccaa

SEQ ID NO: 28316 - DNA, 24 bp, Artificial sequence
  SiRNA target sequence
atttgtagaaggctcgataccaaa

SEQ ID NO: 28317 - DNA, 24 bp, Artificial sequence
  SiRNA target sequence
tttgtagaaggctcgataccaaaa

SEQ ID NO: 28318 - DNA, 24 bp, Artificial sequence
  SiRNA target sequence
ttgtagaaggctcgataccaaaaa

SEQ ID NO: 28319 - DNA, 24 bp, Artificial sequence
  SiRNA target sequence
tgtagaaggctcgataccaaaaat

SEQ ID NO: 28320 - DNA, 24 bp, Artificial sequence
  SiRNA target sequence
gtagaaggctcgataccaaaaatc

SEQ ID NO: 28321 - DNA, 24 bp, Artificial sequence
  SiRNA target sequence
tagaaggctcgataccaaaaatct

SEQ ID NO: 28322 - DNA, 24 bp, Artificial sequence
  SiRNA target sequence
agaaggctcgataccaaaaatctt

SEQ ID NO: 28323 - DNA, 24 bp, Artificial sequence
  SiRNA target sequence
gaaggctcgataccaaaaatcttc

SEQ ID NO: 28324 - DNA, 24 bp, Artificial sequence
  SiRNA target sequence
aaggctcgataccaaaaatcttct

SEQ ID NO: 28325 - DNA, 24 bp, Artificial sequence
  SiRNA target sequence
aggctcgataccaaaaatcttctt

SEQ ID NO: 28326 - DNA, 24 bp, Artificial sequence
  SiRNA target sequence
ggctcgataccaaaaatcttctta

SEQ ID NO: 28327 - DNA, 24 bp, Artificial sequence
  SiRNA target sequence
gctcgataccaaaaatcttcttaa

SEQ ID NO: 28328 - DNA, 24 bp, Artificial sequence
  SiRNA target sequence
ctcgataccaaaaatcttcttaac

SEQ ID NO: 28329 - DNA, 24 bp, Artificial sequence
  SiRNA target sequence
tcgataccaaaaatcttcttaaca

SEQ ID NO: 28330 - DNA, 24 bp, Artificial sequence
  SiRNA target sequence
cgataccaaaaatcttcttaacaa

SEQ ID NO: 28331 - DNA, 24 bp, Artificial sequence
  SiRNA target sequence
gataccaaaaatcttcttaacaag

SEQ ID NO: 28332 - DNA, 24 bp, Artificial sequence
  SiRNA target sequence
ataccaaaaatcttcttaacaagt

SEQ ID NO: 28333 - DNA, 24 bp, Artificial sequence
  SiRNA target sequence
taccaaaaatcttcttaacaagtt

SEQ ID NO: 28334 - DNA, 24 bp, Artificial sequence
  SiRNA target sequence
accaaaaatcttcttaacaagttt

SEQ ID NO: 28335 - DNA, 24 bp, Artificial sequence
  SiRNA target sequence
ccaaaaatcttcttaacaagtttt

SEQ ID NO: 28336 - DNA, 24 bp, Artificial sequence
  SiRNA target sequence
caaaaatcttcttaacaagttttc

SEQ ID NO: 28337 - DNA, 24 bp, Artificial sequence
  SiRNA target sequence
aaaaatcttcttaacaagttttct

SEQ ID NO: 28338 - DNA, 24 bp, Artificial sequence
  SiRNA target sequence
aaaatcttcttaacaagttttcta

SEQ ID NO: 28339 - DNA, 24 bp, Artificial sequence
  SiRNA target sequence
aaatcttcttaacaagttttctaa

SEQ ID NO: 28340 - DNA, 24 bp, Artificial sequence
  SiRNA target sequence
aatcttcttaacaagttttctaac

SEQ ID NO: 28341 - DNA, 24 bp, Artificial sequence
  SiRNA target sequence
atcttcttaacaagttttctaaca

SEQ ID NO: 28342 - DNA, 24 bp, Artificial sequence
  SiRNA target sequence
tcttcttaacaagttttctaacat

SEQ ID NO: 28343 - DNA, 24 bp, Artificial sequence
  SiRNA target sequence
cttcttaacaagttttctaacata

SEQ ID NO: 28344 - DNA, 24 bp, Artificial sequence
  SiRNA target sequence
ttcttaacaagttttctaacatac

SEQ ID NO: 28345 - DNA, 24 bp, Artificial sequence
  SiRNA target sequence
tcttaacaagttttctaacatacg

SEQ ID NO: 28346 - DNA, 24 bp, Artificial sequence
  SiRNA target sequence
cttaacaagttttctaacatacgg

SEQ ID NO: 28347 - DNA, 24 bp, Artificial sequence
  SiRNA target sequence
ttaacaagttttctaacatacggc

SEQ ID NO: 28348 - DNA, 24 bp, Artificial sequence
  SiRNA target sequence
taacaagttttctaacatacggca

SEQ ID NO: 28349 - DNA, 24 bp, Artificial sequence
  SiRNA target sequence
aacaagttttctaacatacggcat

SEQ ID NO: 28350 - DNA, 24 bp, Artificial sequence
  SiRNA target sequence
acaagttttctaacatacggcatt

SEQ ID NO: 28351 - DNA, 24 bp, Artificial sequence
  SiRNA target sequence
caagttttctaacatacggcattc

SEQ ID NO: 28352 - DNA, 24 bp, Artificial sequence
  SiRNA target sequence
aagttttctaacatacggcattcg

SEQ ID NO: 28353 - DNA, 24 bp, Artificial sequence
  SiRNA target sequence
agttttctaacatacggcattcgt

SEQ ID NO: 28354 - DNA, 24 bp, Artificial sequence
  SiRNA target sequence
gttttctaacatacggcattcgtg

SEQ ID NO: 28355 - DNA, 24 bp, Artificial sequence
  SiRNA target sequence
ttttctaacatacggcattcgtgt

SEQ ID NO: 28356 - DNA, 24 bp, Artificial sequence
  SiRNA target sequence
tttctaacatacggcattcgtgtc

SEQ ID NO: 28357 - DNA, 24 bp, Artificial sequence
  SiRNA target sequence
ttctaacatacggcattcgtgtca

SEQ ID NO: 28358 - DNA, 24 bp, Artificial sequence
  SiRNA target sequence
tctaacatacggcattcgtgtcat

SEQ ID NO: 28359 - DNA, 24 bp, Artificial sequence
  SiRNA target sequence
ctaacatacggcattcgtgtcatt

SEQ ID NO: 28360 - DNA, 24 bp, Artificial sequence
  SiRNA target sequence
taacatacggcattcgtgtcattc

SEQ ID NO: 28361 - DNA, 24 bp, Artificial sequence
  SiRNA target sequence
aacatacggcattcgtgtcattcc

SEQ ID NO: 28362 - DNA, 24 bp, Artificial sequence
  SiRNA target sequence
acatacggcattcgtgtcattcca

SEQ ID NO: 28363 - DNA, 24 bp, Artificial sequence
  SiRNA target sequence
catacggcattcgtgtcattccac

SEQ ID NO: 28364 - DNA, 24 bp, Artificial sequence
  SiRNA target sequence
atacggcattcgtgtcattccacc

SEQ ID NO: 28365 - DNA, 24 bp, Artificial sequence
  SiRNA target sequence
tacggcattcgtgtcattccaccc

SEQ ID NO: 28366 - DNA, 24 bp, Artificial sequence
  SiRNA target sequence
acggcattcgtgtcattccaccca

SEQ ID NO: 28367 - DNA, 24 bp, Artificial sequence
  SiRNA target sequence
cggcattcgtgtcattccacccac

SEQ ID NO: 28368 - DNA, 24 bp, Artificial sequence
  SiRNA target sequence
ggcattcgtgtcattccacccaca

SEQ ID NO: 28369 - DNA, 24 bp, Artificial sequence
  SiRNA target sequence
gcattcgtgtcattccacccacaa

SEQ ID NO: 28370 - DNA, 24 bp, Artificial sequence
  SiRNA target sequence
cattcgtgtcattccacccacaag

SEQ ID NO: 28371 - DNA, 24 bp, Artificial sequence
  SiRNA target sequence
attcgtgtcattccacccacaagt

SEQ ID NO: 28372 - DNA, 24 bp, Artificial sequence
  SiRNA target sequence
ttcgtgtcattccacccacaagta

SEQ ID NO: 28373 - DNA, 24 bp, Artificial sequence
  SiRNA target sequence
tcgtgtcattccacccacaagtat

SEQ ID NO: 28374 - DNA, 24 bp, Artificial sequence
  SiRNA target sequence
cgtgtcattccacccacaagtata

SEQ ID NO: 28375 - DNA, 24 bp, Artificial sequence
  SiRNA target sequence
gtgtcattccacccacaagtataa

SEQ ID NO: 28376 - DNA, 24 bp, Artificial sequence
  SiRNA target sequence
tgtcattccacccacaagtataac

SEQ ID NO: 28377 - DNA, 24 bp, Artificial sequence
  SiRNA target sequence
gtcattccacccacaagtataacg

SEQ ID NO: 28378 - DNA, 24 bp, Artificial sequence
  SiRNA target sequence
tcattccacccacaagtataacgt

SEQ ID NO: 28379 - DNA, 24 bp, Artificial sequence
  SiRNA target sequence
cattccacccacaagtataacgtg

SEQ ID NO: 28380 - DNA, 24 bp, Artificial sequence
  SiRNA target sequence
attccacccacaagtataacgtgt

SEQ ID NO: 28381 - DNA, 24 bp, Artificial sequence
  SiRNA target sequence
ttccacccacaagtataacgtgtt

SEQ ID NO: 28382 - DNA, 24 bp, Artificial sequence
  SiRNA target sequence
tccacccacaagtataacgtgttt

SEQ ID NO: 28383 - DNA, 24 bp, Artificial sequence
  SiRNA target sequence
ccacccacaagtataacgtgttta

SEQ ID NO: 28384 - DNA, 24 bp, Artificial sequence
  SiRNA target sequence
cacccacaagtataacgtgtttaa

SEQ ID NO: 28385 - DNA, 24 bp, Artificial sequence
  SiRNA target sequence
acccacaagtataacgtgtttaat

SEQ ID NO: 28386 - DNA, 24 bp, Artificial sequence
  SiRNA target sequence
cccacaagtataacgtgtttaata

SEQ ID NO: 28387 - DNA, 24 bp, Artificial sequence
  SiRNA target sequence
ccacaagtataacgtgtttaatat

SEQ ID NO: 28388 - DNA, 24 bp, Artificial sequence
  SiRNA target sequence
cacaagtataacgtgtttaatatc

SEQ ID NO: 28389 - DNA, 24 bp, Artificial sequence
  SiRNA target sequence
acaagtataacgtgtttaatatca

SEQ ID NO: 28390 - DNA, 24 bp, Artificial sequence
  SiRNA target sequence
caagtataacgtgtttaatatcac

SEQ ID NO: 28391 - DNA, 24 bp, Artificial sequence
  SiRNA target sequence
aagtataacgtgtttaatatcact

SEQ ID NO: 28392 - DNA, 24 bp, Artificial sequence
  SiRNA target sequence
agtataacgtgtttaatatcactt

SEQ ID NO: 28393 - DNA, 24 bp, Artificial sequence
  SiRNA target sequence
gtataacgtgtttaatatcacttt

SEQ ID NO: 28394 - DNA, 24 bp, Artificial sequence
  SiRNA target sequence
tataacgtgtttaatatcactttt

SEQ ID NO: 28395 - DNA, 24 bp, Artificial sequence
  SiRNA target sequence
ataacgtgtttaatatcactttta

SEQ ID NO: 28396 - DNA, 24 bp, Artificial sequence
  SiRNA target sequence
taacgtgtttaatatcacttttag

SEQ ID NO: 28397 - DNA, 24 bp, Artificial sequence
  SiRNA target sequence
aacgtgtttaatatcacttttagt

SEQ ID NO: 28398 - DNA, 24 bp, Artificial sequence
  SiRNA target sequence
acgtgtttaatatcacttttagtt

SEQ ID NO: 28399 - DNA, 24 bp, Artificial sequence
  SiRNA target sequence
cgtgtttaatatcacttttagtta

SEQ ID NO: 28400 - DNA, 24 bp, Artificial sequence
  SiRNA target sequence
gtgtttaatatcacttttagttat

SEQ ID NO: 28401 - DNA, 24 bp, Artificial sequence
  SiRNA target sequence
tgtttaatatcacttttagttata

SEQ ID NO: 28402 - DNA, 24 bp, Artificial sequence
  SiRNA target sequence
gtttaatatcacttttagttatat

SEQ ID NO: 28403 - DNA, 24 bp, Artificial sequence
  SiRNA target sequence
tttaatatcacttttagttatatt

SEQ ID NO: 28404 - DNA, 24 bp, Artificial sequence
  SiRNA target sequence
ttaatatcacttttagttatattg

SEQ ID NO: 28405 - DNA, 24 bp, Artificial sequence
  SiRNA target sequence
taatatcacttttagttatattgg

SEQ ID NO: 28406 - DNA, 24 bp, Artificial sequence
  SiRNA target sequence
aatatcacttttagttatattggc

SEQ ID NO: 28407 - DNA, 24 bp, Artificial sequence
  SiRNA target sequence
atatcacttttagttatattggca

SEQ ID NO: 28408 - DNA, 24 bp, Artificial sequence
  SiRNA target sequence
tatcacttttagttatattggcat

SEQ ID NO: 28409 - DNA, 24 bp, Artificial sequence
  SiRNA target sequence
atcacttttagttatattggcatc

SEQ ID NO: 28410 - DNA, 24 bp, Artificial sequence
  SiRNA target sequence
tcacttttagttatattggcatct

SEQ ID NO: 28411 - DNA, 24 bp, Artificial sequence
  SiRNA target sequence
cacttttagttatattggcatctc

SEQ ID NO: 28412 - DNA, 24 bp, Artificial sequence
  SiRNA target sequence
acttttagttatattggcatctct

SEQ ID NO: 28413 - DNA, 24 bp, Artificial sequence
  SiRNA target sequence
cttttagttatattggcatctcta

SEQ ID NO: 28414 - DNA, 24 bp, Artificial sequence
  SiRNA target sequence
ttttagttatattggcatctctaa

SEQ ID NO: 28415 - DNA, 24 bp, Artificial sequence
  SiRNA target sequence
tttagttatattggcatctctaat

SEQ ID NO: 28416 - DNA, 24 bp, Artificial sequence
  SiRNA target sequence
ttagttatattggcatctctaata

SEQ ID NO: 28417 - DNA, 24 bp, Artificial sequence
  SiRNA target sequence
tagttatattggcatctctaatag

SEQ ID NO: 28418 - DNA, 24 bp, Artificial sequence
  SiRNA target sequence
agttatattggcatctctaatagc

SEQ ID NO: 28419 - DNA, 24 bp, Artificial sequence
  SiRNA target sequence
gttatattggcatctctaatagct

SEQ ID NO: 28420 - DNA, 24 bp, Artificial sequence
  SiRNA target sequence
ttatattggcatctctaatagctt

SEQ ID NO: 28421 - DNA, 24 bp, Artificial sequence
  SiRNA target sequence
tatattggcatctctaatagcttt

SEQ ID NO: 28422 - DNA, 24 bp, Artificial sequence
  SiRNA target sequence
atattggcatctctaatagcttta

SEQ ID NO: 28423 - DNA, 24 bp, Artificial sequence
  SiRNA target sequence
tattggcatctctaatagctttaa

SEQ ID NO: 28424 - DNA, 24 bp, Artificial sequence
  SiRNA target sequence
attggcatctctaatagctttaag

SEQ ID NO: 28425 - DNA, 24 bp, Artificial sequence
  SiRNA target sequence
ttggcatctctaatagctttaaga

SEQ ID NO: 28426 - DNA, 24 bp, Artificial sequence
  SiRNA target sequence
tggcatctctaatagctttaagac

SEQ ID NO: 28427 - DNA, 24 bp, Artificial sequence
  SiRNA target sequence
ggcatctctaatagctttaagaca

SEQ ID NO: 28428 - DNA, 24 bp, Artificial sequence
  SiRNA target sequence
gcatctctaatagctttaagacag

SEQ ID NO: 28429 - DNA, 24 bp, Artificial sequence
  SiRNA target sequence
catctctaatagctttaagacagg

SEQ ID NO: 28430 - DNA, 24 bp, Artificial sequence
  SiRNA target sequence
atctctaatagctttaagacaggg

SEQ ID NO: 28431 - DNA, 24 bp, Artificial sequence
  SiRNA target sequence
tctctaatagctttaagacagggg

SEQ ID NO: 28432 - DNA, 24 bp, Artificial sequence
  SiRNA target sequence
ctctaatagctttaagacaggggt

SEQ ID NO: 28433 - DNA, 24 bp, Artificial sequence
  SiRNA target sequence
tctaatagctttaagacaggggtt

SEQ ID NO: 28434 - DNA, 24 bp, Artificial sequence
  SiRNA target sequence
ctaatagctttaagacaggggttt

SEQ ID NO: 28435 - DNA, 24 bp, Artificial sequence
  SiRNA target sequence
taatagctttaagacaggggttta

SEQ ID NO: 28436 - DNA, 24 bp, Artificial sequence
  SiRNA target sequence
aatagctttaagacaggggtttat

SEQ ID NO: 28437 - DNA, 24 bp, Artificial sequence
  SiRNA target sequence
atagctttaagacaggggtttatt

SEQ ID NO: 28438 - DNA, 24 bp, Artificial sequence
  SiRNA target sequence
tagctttaagacaggggtttattg

SEQ ID NO: 28439 - DNA, 24 bp, Artificial sequence
  SiRNA target sequence
agctttaagacaggggtttattgt

SEQ ID NO: 28440 - DNA, 24 bp, Artificial sequence
  SiRNA target sequence
gctttaagacaggggtttattgtt

SEQ ID NO: 28441 - DNA, 24 bp, Artificial sequence
  SiRNA target sequence
ctttaagacaggggtttattgttt

SEQ ID NO: 28442 - DNA, 24 bp, Artificial sequence
  SiRNA target sequence
tttaagacaggggtttattgtttt

SEQ ID NO: 28443 - DNA, 24 bp, Artificial sequence
  SiRNA target sequence
ttaagacaggggtttattgttttg

SEQ ID NO: 28444 - DNA, 24 bp, Artificial sequence
  SiRNA target sequence
taagacaggggtttattgttttgt

SEQ ID NO: 28445 - DNA, 24 bp, Artificial sequence
  SiRNA target sequence
aagacaggggtttattgttttgtc

SEQ ID NO: 28446 - DNA, 24 bp, Artificial sequence
  SiRNA target sequence
agacaggggtttattgttttgtct

SEQ ID NO: 28447 - DNA, 24 bp, Artificial sequence
  SiRNA target sequence
gacaggggtttattgttttgtcta

SEQ ID NO: 28448 - DNA, 24 bp, Artificial sequence
  SiRNA target sequence
acaggggtttattgttttgtctat

SEQ ID NO: 28449 - DNA, 24 bp, Artificial sequence
  SiRNA target sequence
caggggtttattgttttgtctatt

SEQ ID NO: 28450 - DNA, 24 bp, Artificial sequence
  SiRNA target sequence
aggggtttattgttttgtctatta

SEQ ID NO: 28451 - DNA, 24 bp, Artificial sequence
  SiRNA target sequence
ggggtttattgttttgtctattaa

SEQ ID NO: 28452 - DNA, 24 bp, Artificial sequence
  SiRNA target sequence
gggtttattgttttgtctattaac

SEQ ID NO: 28453 - DNA, 24 bp, Artificial sequence
  SiRNA target sequence
ggtttattgttttgtctattaact

SEQ ID NO: 28454 - DNA, 24 bp, Artificial sequence
  SiRNA target sequence
gtttattgttttgtctattaactt

SEQ ID NO: 28455 - DNA, 24 bp, Artificial sequence
  SiRNA target sequence
tttattgttttgtctattaacttt

SEQ ID NO: 28456 - DNA, 24 bp, Artificial sequence
  SiRNA target sequence
ttattgttttgtctattaactttt

SEQ ID NO: 28457 - DNA, 24 bp, Artificial sequence
  SiRNA target sequence
tattgttttgtctattaacttttt

SEQ ID NO: 28458 - DNA, 24 bp, Artificial sequence
  SiRNA target sequence
attgttttgtctattaactttttt

SEQ ID NO: 28459 - DNA, 24 bp, Artificial sequence
  SiRNA target sequence
ttgttttgtctattaacttttttg

SEQ ID NO: 28460 - DNA, 24 bp, Artificial sequence
  SiRNA target sequence
tgttttgtctattaacttttttgt

SEQ ID NO: 28461 - DNA, 24 bp, Artificial sequence
  SiRNA target sequence
gttttgtctattaacttttttgta

SEQ ID NO: 28462 - DNA, 24 bp, Artificial sequence
  SiRNA target sequence
ttttgtctattaacttttttgtaa

SEQ ID NO: 28463 - DNA, 24 bp, Artificial sequence
  SiRNA target sequence
tttgtctattaacttttttgtaat

SEQ ID NO: 28464 - DNA, 24 bp, Artificial sequence
  SiRNA target sequence
ttgtctattaacttttttgtaatt

SEQ ID NO: 28465 - DNA, 24 bp, Artificial sequence
  SiRNA target sequence
tgtctattaacttttttgtaattt

SEQ ID NO: 28466 - DNA, 24 bp, Artificial sequence
  SiRNA target sequence
gtctattaacttttttgtaatttt

SEQ ID NO: 28467 - DNA, 24 bp, Artificial sequence
  SiRNA target sequence
tctattaacttttttgtaattttt

SEQ ID NO: 28468 - DNA, 24 bp, Artificial sequence
  SiRNA target sequence
ctattaacttttttgtaatttttt

SEQ ID NO: 28469 - DNA, 24 bp, Artificial sequence
  SiRNA target sequence
tattaacttttttgtaattttttc

SEQ ID NO: 28470 - DNA, 24 bp, Artificial sequence
  SiRNA target sequence
attaacttttttgtaattttttca

SEQ ID NO: 28471 - DNA, 24 bp, Artificial sequence
  SiRNA target sequence
ttaacttttttgtaattttttcaa

SEQ ID NO: 28472 - DNA, 24 bp, Artificial sequence
  SiRNA target sequence
taacttttttgtaattttttcaaa

SEQ ID NO: 28473 - DNA, 24 bp, Artificial sequence
  SiRNA target sequence
aacttttttgtaattttttcaaat

SEQ ID NO: 28474 - DNA, 24 bp, Artificial sequence
  SiRNA target sequence
acttttttgtaattttttcaaatt

SEQ ID NO: 28475 - DNA, 24 bp, Artificial sequence
  SiRNA target sequence
cttttttgtaattttttcaaattc

SEQ ID NO: 28476 - DNA, 24 bp, Artificial sequence
  SiRNA target sequence
ttttttgtaattttttcaaattcg

SEQ ID NO: 28477 - DNA, 24 bp, Artificial sequence
  SiRNA target sequence
tttttgtaattttttcaaattcgt

SEQ ID NO: 28478 - DNA, 24 bp, Artificial sequence
  SiRNA target sequence
ttttgtaattttttcaaattcgtc

SEQ ID NO: 28479 - DNA, 24 bp, Artificial sequence
  SiRNA target sequence
tttgtaattttttcaaattcgtcg

SEQ ID NO: 28480 - DNA, 24 bp, Artificial sequence
  SiRNA target sequence
ttgtaattttttcaaattcgtcgc

SEQ ID NO: 28481 - DNA, 24 bp, Artificial sequence
  SiRNA target sequence
tgtaattttttcaaattcgtcgcg

SEQ ID NO: 28482 - DNA, 24 bp, Artificial sequence
  SiRNA target sequence
gtaattttttcaaattcgtcgcgt

SEQ ID NO: 28483 - DNA, 24 bp, Artificial sequence
  SiRNA target sequence
taattttttcaaattcgtcgcgtg

SEQ ID NO: 28484 - DNA, 24 bp, Artificial sequence
  SiRNA target sequence
aattttttcaaattcgtcgcgtgt

SEQ ID NO: 28485 - DNA, 24 bp, Artificial sequence
  SiRNA target sequence
attttttcaaattcgtcgcgtgta

SEQ ID NO: 28486 - DNA, 24 bp, Artificial sequence
  SiRNA target sequence
ttttttcaaattcgtcgcgtgtaa

SEQ ID NO: 28487 - DNA, 24 bp, Artificial sequence
  SiRNA target sequence
tttttcaaattcgtcgcgtgtaat

SEQ ID NO: 28488 - DNA, 24 bp, Artificial sequence
  SiRNA target sequence
ttttcaaattcgtcgcgtgtaatt

SEQ ID NO: 28489 - DNA, 24 bp, Artificial sequence
  SiRNA target sequence
tttcaaattcgtcgcgtgtaatta

SEQ ID NO: 28490 - DNA, 24 bp, Artificial sequence
  SiRNA target sequence
ttcaaattcgtcgcgtgtaattac

SEQ ID NO: 28491 - DNA, 24 bp, Artificial sequence
  SiRNA target sequence
tcaaattcgtcgcgtgtaattacc

SEQ ID NO: 28492 - DNA, 24 bp, Artificial sequence
  SiRNA target sequence
caaattcgtcgcgtgtaattacct

SEQ ID NO: 28493 - DNA, 24 bp, Artificial sequence
  SiRNA target sequence
aaattcgtcgcgtgtaattacctc

SEQ ID NO: 28494 - DNA, 24 bp, Artificial sequence
  SiRNA target sequence
aattcgtcgcgtgtaattacctct

SEQ ID NO: 28495 - DNA, 24 bp, Artificial sequence
  SiRNA target sequence
attcgtcgcgtgtaattacctctt

SEQ ID NO: 28496 - DNA, 24 bp, Artificial sequence
  SiRNA target sequence
ttcgtcgcgtgtaattacctcttt

SEQ ID NO: 28497 - DNA, 24 bp, Artificial sequence
  SiRNA target sequence
tcgtcgcgtgtaattacctctttt

SEQ ID NO: 28498 - DNA, 24 bp, Artificial sequence
  SiRNA target sequence
cgtcgcgtgtaattacctctttta

SEQ ID NO: 28499 - DNA, 24 bp, Artificial sequence
  SiRNA target sequence
gtcgcgtgtaattacctcttttaa

SEQ ID NO: 28500 - DNA, 24 bp, Artificial sequence
  SiRNA target sequence
tcgcgtgtaattacctcttttaag

SEQ ID NO: 28501 - DNA, 24 bp, Artificial sequence
  SiRNA target sequence
cgcgtgtaattacctcttttaagt

SEQ ID NO: 28502 - DNA, 24 bp, Artificial sequence
  SiRNA target sequence
gcgtgtaattacctcttttaagtg

SEQ ID NO: 28503 - DNA, 24 bp, Artificial sequence
  SiRNA target sequence
cgtgtaattacctcttttaagtga

SEQ ID NO: 28504 - DNA, 24 bp, Artificial sequence
  SiRNA target sequence
gtgtaattacctcttttaagtgat

SEQ ID NO: 28505 - DNA, 24 bp, Artificial sequence
  SiRNA target sequence
tgtaattacctcttttaagtgata

SEQ ID NO: 28506 - DNA, 24 bp, Artificial sequence
  SiRNA target sequence
gtaattacctcttttaagtgataa

SEQ ID NO: 28507 - DNA, 24 bp, Artificial sequence
  SiRNA target sequence
taattacctcttttaagtgataat

SEQ ID NO: 28508 - DNA, 24 bp, Artificial sequence
  SiRNA target sequence
aattacctcttttaagtgataatt

SEQ ID NO: 28509 - DNA, 24 bp, Artificial sequence
  SiRNA target sequence
attacctcttttaagtgataattc

SEQ ID NO: 28510 - DNA, 24 bp, Artificial sequence
  SiRNA target sequence
ttacctcttttaagtgataattct

SEQ ID NO: 28511 - DNA, 24 bp, Artificial sequence
  SiRNA target sequence
tacctcttttaagtgataattctt

SEQ ID NO: 28512 - DNA, 24 bp, Artificial sequence
  SiRNA target sequence
acctcttttaagtgataattcttt

SEQ ID NO: 28513 - DNA, 24 bp, Artificial sequence
  SiRNA target sequence
cctcttttaagtgataattctttt

SEQ ID NO: 28514 - DNA, 24 bp, Artificial sequence
  SiRNA target sequence
ctcttttaagtgataattcttttt

SEQ ID NO: 28515 - DNA, 24 bp, Artificial sequence
  SiRNA target sequence
tcttttaagtgataattcttttta

SEQ ID NO: 28516 - DNA, 24 bp, Artificial sequence
  SiRNA target sequence
cttttaagtgataattctttttac

SEQ ID NO: 28517 - DNA, 24 bp, Artificial sequence
  SiRNA target sequence
ttttaagtgataattctttttact

SEQ ID NO: 28518 - DNA, 24 bp, Artificial sequence
  SiRNA target sequence
tttaagtgataattctttttacta

SEQ ID NO: 28519 - DNA, 24 bp, Artificial sequence
  SiRNA target sequence
ttaagtgataattctttttactat

SEQ ID NO: 28520 - DNA, 24 bp, Artificial sequence
  SiRNA target sequence
taagtgataattctttttactatc

SEQ ID NO: 28521 - DNA, 24 bp, Artificial sequence
  SiRNA target sequence
aagtgataattctttttactatcg

SEQ ID NO: 28522 - DNA, 24 bp, Artificial sequence
  SiRNA target sequence
agtgataattctttttactatcgt

SEQ ID NO: 28523 - DNA, 24 bp, Artificial sequence
  SiRNA target sequence
gtgataattctttttactatcgtt

SEQ ID NO: 28524 - DNA, 24 bp, Artificial sequence
  SiRNA target sequence
tgataattctttttactatcgtta

SEQ ID NO: 28525 - DNA, 24 bp, Artificial sequence
  SiRNA target sequence
gataattctttttactatcgttat

SEQ ID NO: 28526 - DNA, 24 bp, Artificial sequence
  SiRNA target sequence
ataattctttttactatcgttata

SEQ ID NO: 28527 - DNA, 24 bp, Artificial sequence
  SiRNA target sequence
taattctttttactatcgttataa

SEQ ID NO: 28528 - DNA, 24 bp, Artificial sequence
  SiRNA target sequence
aattctttttactatcgttataaa

SEQ ID NO: 28529 - DNA, 24 bp, Artificial sequence
  SiRNA target sequence
attctttttactatcgttataaat

SEQ ID NO: 28530 - DNA, 24 bp, Artificial sequence
  SiRNA target sequence
ttctttttactatcgttataaata

SEQ ID NO: 28531 - DNA, 24 bp, Artificial sequence
  SiRNA target sequence
tctttttactatcgttataaatat

SEQ ID NO: 28532 - DNA, 24 bp, Artificial sequence
  SiRNA target sequence
ctttttactatcgttataaatata

SEQ ID NO: 28533 - DNA, 24 bp, Artificial sequence
  SiRNA target sequence
tttttactatcgttataaatatac

SEQ ID NO: 28534 - DNA, 24 bp, Artificial sequence
  SiRNA target sequence
ttttactatcgttataaatatacg

SEQ ID NO: 28535 - DNA, 24 bp, Artificial sequence
  SiRNA target sequence
tttactatcgttataaatatacgg

SEQ ID NO: 28536 - DNA, 24 bp, Artificial sequence
  SiRNA target sequence
ttactatcgttataaatatacgga

SEQ ID NO: 28537 - DNA, 24 bp, Artificial sequence
  SiRNA target sequence
tactatcgttataaatatacggaa

SEQ ID NO: 28538 - DNA, 24 bp, Artificial sequence
  SiRNA target sequence
actatcgttataaatatacggaat

SEQ ID NO: 28539 - DNA, 24 bp, Artificial sequence
  SiRNA target sequence
ctatcgttataaatatacggaata

SEQ ID NO: 28540 - DNA, 24 bp, Artificial sequence
  SiRNA target sequence
tatcgttataaatatacggaatat

SEQ ID NO: 28541 - DNA, 24 bp, Artificial sequence
  SiRNA target sequence
atcgttataaatatacggaatatt

SEQ ID NO: 28542 - DNA, 24 bp, Artificial sequence
  SiRNA target sequence
tcgttataaatatacggaatatta

SEQ ID NO: 28543 - DNA, 24 bp, Artificial sequence
  SiRNA target sequence
cgttataaatatacggaatattaa

SEQ ID NO: 28544 - DNA, 24 bp, Artificial sequence
  SiRNA target sequence
gttataaatatacggaatattaat

SEQ ID NO: 28545 - DNA, 24 bp, Artificial sequence
  SiRNA target sequence
ttataaatatacggaatattaatt

SEQ ID NO: 28546 - DNA, 24 bp, Artificial sequence
  SiRNA target sequence
tataaatatacggaatattaattt

SEQ ID NO: 28547 - DNA, 24 bp, Artificial sequence
  SiRNA target sequence
ataaatatacggaatattaatttc

SEQ ID NO: 28548 - DNA, 24 bp, Artificial sequence
  SiRNA target sequence
taaatatacggaatattaatttca

SEQ ID NO: 28549 - DNA, 24 bp, Artificial sequence
  SiRNA target sequence
aaatatacggaatattaatttcag

SEQ ID NO: 28550 - DNA, 24 bp, Artificial sequence
  SiRNA target sequence
aatatacggaatattaatttcaga

SEQ ID NO: 28551 - DNA, 24 bp, Artificial sequence
  SiRNA target sequence
atatacggaatattaatttcagac

SEQ ID NO: 28552 - DNA, 24 bp, Artificial sequence
  SiRNA target sequence
tatacggaatattaatttcagacg

SEQ ID NO: 28553 - DNA, 24 bp, Artificial sequence
  SiRNA target sequence
atacggaatattaatttcagacga

SEQ ID NO: 28554 - DNA, 24 bp, Artificial sequence
  SiRNA target sequence
tacggaatattaatttcagacgaa

SEQ ID NO: 28555 - DNA, 24 bp, Artificial sequence
  SiRNA target sequence
acggaatattaatttcagacgaaa

SEQ ID NO: 28556 - DNA, 24 bp, Artificial sequence
  SiRNA target sequence
cggaatattaatttcagacgaaag

SEQ ID NO: 28557 - DNA, 24 bp, Artificial sequence
  SiRNA target sequence
ggaatattaatttcagacgaaaga

SEQ ID NO: 28558 - DNA, 24 bp, Artificial sequence
  SiRNA target sequence
gaatattaatttcagacgaaagat

SEQ ID NO: 28559 - DNA, 24 bp, Artificial sequence
  SiRNA target sequence
aatattaatttcagacgaaagatt

SEQ ID NO: 28560 - DNA, 24 bp, Artificial sequence
  SiRNA target sequence
atattaatttcagacgaaagatta

SEQ ID NO: 28561 - DNA, 24 bp, Artificial sequence
  SiRNA target sequence
tattaatttcagacgaaagattag

SEQ ID NO: 28562 - DNA, 24 bp, Artificial sequence
  SiRNA target sequence
attaatttcagacgaaagattaga

SEQ ID NO: 28563 - DNA, 24 bp, Artificial sequence
  SiRNA target sequence
ttaatttcagacgaaagattagac

SEQ ID NO: 28564 - DNA, 24 bp, Artificial sequence
  SiRNA target sequence
taatttcagacgaaagattagacg

SEQ ID NO: 28565 - DNA, 24 bp, Artificial sequence
  SiRNA target sequence
aatttcagacgaaagattagacga

SEQ ID NO: 28566 - DNA, 24 bp, Artificial sequence
  SiRNA target sequence
atttcagacgaaagattagacgac

SEQ ID NO: 28567 - DNA, 24 bp, Artificial sequence
  SiRNA target sequence
tttcagacgaaagattagacgaca

SEQ ID NO: 28568 - DNA, 24 bp, Artificial sequence
  SiRNA target sequence
ttcagacgaaagattagacgacag

SEQ ID NO: 28569 - DNA, 24 bp, Artificial sequence
  SiRNA target sequence
tcagacgaaagattagacgacagt

SEQ ID NO: 28570 - DNA, 24 bp, Artificial sequence
  SiRNA target sequence
cagacgaaagattagacgacagtt

SEQ ID NO: 28571 - DNA, 24 bp, Artificial sequence
  SiRNA target sequence
agacgaaagattagacgacagttc

SEQ ID NO: 28572 - DNA, 24 bp, Artificial sequence
  SiRNA target sequence
gacgaaagattagacgacagttct

SEQ ID NO: 28573 - DNA, 24 bp, Artificial sequence
  SiRNA target sequence
acgaaagattagacgacagttctt

SEQ ID NO: 28574 - DNA, 24 bp, Artificial sequence
  SiRNA target sequence
cgaaagattagacgacagttcttt

SEQ ID NO: 28575 - DNA, 24 bp, Artificial sequence
  SiRNA target sequence
gaaagattagacgacagttctttt

SEQ ID NO: 28576 - DNA, 24 bp, Artificial sequence
  SiRNA target sequence
aaagattagacgacagttcttttt

SEQ ID NO: 28577 - DNA, 24 bp, Artificial sequence
  SiRNA target sequence
aagattagacgacagttctttttt

SEQ ID NO: 28578 - DNA, 24 bp, Artificial sequence
  SiRNA target sequence
agattagacgacagttcttttttc

SEQ ID NO: 28579 - DNA, 24 bp, Artificial sequence
  SiRNA target sequence
gattagacgacagttcttttttca

SEQ ID NO: 28580 - DNA, 24 bp, Artificial sequence
  SiRNA target sequence
attagacgacagttcttttttcat

SEQ ID NO: 28581 - DNA, 24 bp, Artificial sequence
  SiRNA target sequence
ttagacgacagttcttttttcatt

SEQ ID NO: 28582 - DNA, 24 bp, Artificial sequence
  SiRNA target sequence
tagacgacagttcttttttcattt

SEQ ID NO: 28583 - DNA, 24 bp, Artificial sequence
  SiRNA target sequence
agacgacagttcttttttcatttt

SEQ ID NO: 28584 - DNA, 24 bp, Artificial sequence
  SiRNA target sequence
gacgacagttcttttttcattttt

SEQ ID NO: 28585 - DNA, 24 bp, Artificial sequence
  SiRNA target sequence
acgacagttcttttttcatttttt

SEQ ID NO: 28586 - DNA, 24 bp, Artificial sequence
  SiRNA target sequence
cgacagttcttttttcattttttc

SEQ ID NO: 28587 - DNA, 24 bp, Artificial sequence
  SiRNA target sequence
gacagttcttttttcattttttcc

SEQ ID NO: 28588 - DNA, 24 bp, Artificial sequence
  SiRNA target sequence
acagttcttttttcattttttccg

SEQ ID NO: 28589 - DNA, 24 bp, Artificial sequence
  SiRNA target sequence
cagttcttttttcattttttccgc

SEQ ID NO: 28590 - DNA, 24 bp, Artificial sequence
  SiRNA target sequence
agttcttttttcattttttccgct

SEQ ID NO: 28591 - DNA, 24 bp, Artificial sequence
  SiRNA target sequence
gttcttttttcattttttccgctg

SEQ ID NO: 28592 - DNA, 24 bp, Artificial sequence
  SiRNA target sequence
ttcttttttcattttttccgctgc

SEQ ID NO: 28593 - DNA, 24 bp, Artificial sequence
  SiRNA target sequence
tcttttttcattttttccgctgct

SEQ ID NO: 28594 - DNA, 24 bp, Artificial sequence
  SiRNA target sequence
cttttttcattttttccgctgctt

SEQ ID NO: 28595 - DNA, 24 bp, Artificial sequence
  SiRNA target sequence
ttttttcattttttccgctgcttc

SEQ ID NO: 28596 - DNA, 24 bp, Artificial sequence
  SiRNA target sequence
tttttcattttttccgctgcttct

SEQ ID NO: 28597 - DNA, 24 bp, Artificial sequence
  SiRNA target sequence
ttttcattttttccgctgcttctt

SEQ ID NO: 28598 - DNA, 24 bp, Artificial sequence
  SiRNA target sequence
tttcattttttccgctgcttcttt

SEQ ID NO: 28599 - DNA, 24 bp, Artificial sequence
  SiRNA target sequence
ttcattttttccgctgcttcttta

SEQ ID NO: 28600 - DNA, 24 bp, Artificial sequence
  SiRNA target sequence
tcattttttccgctgcttctttaa

SEQ ID NO: 28601 - DNA, 24 bp, Artificial sequence
  SiRNA target sequence
cattttttccgctgcttctttaat

SEQ ID NO: 28602 - DNA, 24 bp, Artificial sequence
  SiRNA target sequence
attttttccgctgcttctttaatt

SEQ ID NO: 28603 - DNA, 24 bp, Artificial sequence
  SiRNA target sequence
ttttttccgctgcttctttaattc

SEQ ID NO: 28604 - DNA, 24 bp, Artificial sequence
  SiRNA target sequence
tttttccgctgcttctttaattct

SEQ ID NO: 28605 - DNA, 24 bp, Artificial sequence
  SiRNA target sequence
ttttccgctgcttctttaattcta

SEQ ID NO: 28606 - DNA, 24 bp, Artificial sequence
  SiRNA target sequence
tttccgctgcttctttaattctat

SEQ ID NO: 28607 - DNA, 24 bp, Artificial sequence
  SiRNA target sequence
ttccgctgcttctttaattctatt

SEQ ID NO: 28608 - DNA, 24 bp, Artificial sequence
  SiRNA target sequence
tccgctgcttctttaattctatta

SEQ ID NO: 28609 - DNA, 24 bp, Artificial sequence
  SiRNA target sequence
ccgctgcttctttaattctattat

SEQ ID NO: 28610 - DNA, 24 bp, Artificial sequence
  SiRNA target sequence
cgctgcttctttaattctattata

SEQ ID NO: 28611 - DNA, 24 bp, Artificial sequence
  SiRNA target sequence
gctgcttctttaattctattataa

SEQ ID NO: 28612 - DNA, 24 bp, Artificial sequence
  SiRNA target sequence
ctgcttctttaattctattataac

SEQ ID NO: 28613 - DNA, 24 bp, Artificial sequence
  SiRNA target sequence
tgcttctttaattctattataaca

SEQ ID NO: 28614 - DNA, 24 bp, Artificial sequence
  SiRNA target sequence
gcttctttaattctattataacaa

SEQ ID NO: 28615 - DNA, 24 bp, Artificial sequence
  SiRNA target sequence
cttctttaattctattataacaag

SEQ ID NO: 28616 - DNA, 24 bp, Artificial sequence
  SiRNA target sequence
ttctttaattctattataacaaga

SEQ ID NO: 28617 - DNA, 24 bp, Artificial sequence
  SiRNA target sequence
tctttaattctattataacaagaa

SEQ ID NO: 28618 - DNA, 24 bp, Artificial sequence
  SiRNA target sequence
ctttaattctattataacaagaat

SEQ ID NO: 28619 - DNA, 24 bp, Artificial sequence
  SiRNA target sequence
tttaattctattataacaagaatc

SEQ ID NO: 28620 - DNA, 24 bp, Artificial sequence
  SiRNA target sequence
ttaattctattataacaagaatcg

SEQ ID NO: 28621 - DNA, 24 bp, Artificial sequence
  SiRNA target sequence
taattctattataacaagaatcgt

SEQ ID NO: 28622 - DNA, 24 bp, Artificial sequence
  SiRNA target sequence
aattctattataacaagaatcgtg

SEQ ID NO: 28623 - DNA, 24 bp, Artificial sequence
  SiRNA target sequence
attctattataacaagaatcgtgt

SEQ ID NO: 28624 - DNA, 24 bp, Artificial sequence
  SiRNA target sequence
ttctattataacaagaatcgtgtt

SEQ ID NO: 28625 - DNA, 24 bp, Artificial sequence
  SiRNA target sequence
tctattataacaagaatcgtgttt

SEQ ID NO: 28626 - DNA, 24 bp, Artificial sequence
  SiRNA target sequence
ctattataacaagaatcgtgttta

SEQ ID NO: 28627 - DNA, 24 bp, Artificial sequence
  SiRNA target sequence
tattataacaagaatcgtgtttaa

SEQ ID NO: 28628 - DNA, 24 bp, Artificial sequence
  SiRNA target sequence
attataacaagaatcgtgtttaag

SEQ ID NO: 28629 - DNA, 24 bp, Artificial sequence
  SiRNA target sequence
ttataacaagaatcgtgtttaagt

SEQ ID NO: 28630 - DNA, 24 bp, Artificial sequence
  SiRNA target sequence
tataacaagaatcgtgtttaagta

SEQ ID NO: 28631 - DNA, 24 bp, Artificial sequence
  SiRNA target sequence
ataacaagaatcgtgtttaagtaa

SEQ ID NO: 28632 - DNA, 24 bp, Artificial sequence
  SiRNA target sequence
taacaagaatcgtgtttaagtaaa

SEQ ID NO: 28633 - DNA, 24 bp, Artificial sequence
  SiRNA target sequence
aacaagaatcgtgtttaagtaaat

SEQ ID NO: 28634 - DNA, 24 bp, Artificial sequence
  SiRNA target sequence
acaagaatcgtgtttaagtaaatc

SEQ ID NO: 28635 - DNA, 24 bp, Artificial sequence
  SiRNA target sequence
caagaatcgtgtttaagtaaatca

SEQ ID NO: 28636 - DNA, 24 bp, Artificial sequence
  SiRNA target sequence
aagaatcgtgtttaagtaaatcaa

SEQ ID NO: 28637 - DNA, 24 bp, Artificial sequence
  SiRNA target sequence
agaatcgtgtttaagtaaatcaat

SEQ ID NO: 28638 - DNA, 24 bp, Artificial sequence
  SiRNA target sequence
gaatcgtgtttaagtaaatcaatt

SEQ ID NO: 28639 - DNA, 24 bp, Artificial sequence
  SiRNA target sequence
aatcgtgtttaagtaaatcaattc

SEQ ID NO: 28640 - DNA, 24 bp, Artificial sequence
  SiRNA target sequence
atcgtgtttaagtaaatcaattcc

SEQ ID NO: 28641 - DNA, 24 bp, Artificial sequence
  SiRNA target sequence
tcgtgtttaagtaaatcaattcct

SEQ ID NO: 28642 - DNA, 24 bp, Artificial sequence
  SiRNA target sequence
cgtgtttaagtaaatcaattcctg

SEQ ID NO: 28643 - DNA, 24 bp, Artificial sequence
  SiRNA target sequence
gtgtttaagtaaatcaattcctgt

SEQ ID NO: 28644 - DNA, 24 bp, Artificial sequence
  SiRNA target sequence
tgtttaagtaaatcaattcctgtt

SEQ ID NO: 28645 - DNA, 24 bp, Artificial sequence
  SiRNA target sequence
gtttaagtaaatcaattcctgttc

SEQ ID NO: 28646 - DNA, 24 bp, Artificial sequence
  SiRNA target sequence
tttaagtaaatcaattcctgttct

SEQ ID NO: 28647 - DNA, 24 bp, Artificial sequence
  SiRNA target sequence
ttaagtaaatcaattcctgttcta

SEQ ID NO: 28648 - DNA, 24 bp, Artificial sequence
  SiRNA target sequence
taagtaaatcaattcctgttctac

SEQ ID NO: 28649 - DNA, 24 bp, Artificial sequence
  SiRNA target sequence
aagtaaatcaattcctgttctact

SEQ ID NO: 28650 - DNA, 24 bp, Artificial sequence
  SiRNA target sequence
agtaaatcaattcctgttctactt

SEQ ID NO: 28651 - DNA, 24 bp, Artificial sequence
  SiRNA target sequence
gtaaatcaattcctgttctacttt

SEQ ID NO: 28652 - DNA, 24 bp, Artificial sequence
  SiRNA target sequence
taaatcaattcctgttctactttt

SEQ ID NO: 28653 - DNA, 24 bp, Artificial sequence
  SiRNA target sequence
aaatcaattcctgttctactttta

SEQ ID NO: 28654 - DNA, 24 bp, Artificial sequence
  SiRNA target sequence
aatcaattcctgttctacttttaa

SEQ ID NO: 28655 - DNA, 24 bp, Artificial sequence
  SiRNA target sequence
atcaattcctgttctacttttaaa

SEQ ID NO: 28656 - DNA, 24 bp, Artificial sequence
  SiRNA target sequence
tcaattcctgttctacttttaaat

SEQ ID NO: 28657 - DNA, 24 bp, Artificial sequence
  SiRNA target sequence
caattcctgttctacttttaaatt

SEQ ID NO: 28658 - DNA, 24 bp, Artificial sequence
  SiRNA target sequence
aattcctgttctacttttaaattt

SEQ ID NO: 28659 - DNA, 24 bp, Artificial sequence
  SiRNA target sequence
attcctgttctacttttaaatttt

SEQ ID NO: 28660 - DNA, 24 bp, Artificial sequence
  SiRNA target sequence
ttcctgttctacttttaaattttt

SEQ ID NO: 28661 - DNA, 24 bp, Artificial sequence
  SiRNA target sequence
tcctgttctacttttaaatttttc

SEQ ID NO: 28662 - DNA, 24 bp, Artificial sequence
  SiRNA target sequence
cctgttctacttttaaatttttca

SEQ ID NO: 28663 - DNA, 24 bp, Artificial sequence
  SiRNA target sequence
ctgttctacttttaaatttttcat

SEQ ID NO: 28664 - DNA, 24 bp, Artificial sequence
  SiRNA target sequence
tgttctacttttaaatttttcatt

SEQ ID NO: 28665 - DNA, 24 bp, Artificial sequence
  SiRNA target sequence
gttctacttttaaatttttcatta

SEQ ID NO: 28666 - DNA, 24 bp, Artificial sequence
  SiRNA target sequence
ttctacttttaaatttttcattaa

SEQ ID NO: 28667 - DNA, 24 bp, Artificial sequence
  SiRNA target sequence
tctacttttaaatttttcattaat

SEQ ID NO: 28668 - DNA, 24 bp, Artificial sequence
  SiRNA target sequence
ctacttttaaatttttcattaata

SEQ ID NO: 28669 - DNA, 24 bp, Artificial sequence
  SiRNA target sequence
tacttttaaatttttcattaatat

SEQ ID NO: 28670 - DNA, 24 bp, Artificial sequence
  SiRNA target sequence
acttttaaatttttcattaatata

SEQ ID NO: 28671 - DNA, 24 bp, Artificial sequence
  SiRNA target sequence
cttttaaatttttcattaatataa

SEQ ID NO: 28672 - DNA, 24 bp, Artificial sequence
  SiRNA target sequence
ttttaaatttttcattaatataat

SEQ ID NO: 28673 - DNA, 24 bp, Artificial sequence
  SiRNA target sequence
tttaaatttttcattaatataatc

SEQ ID NO: 28674 - DNA, 24 bp, Artificial sequence
  SiRNA target sequence
ttaaatttttcattaatataatct

SEQ ID NO: 28675 - DNA, 24 bp, Artificial sequence
  SiRNA target sequence
taaatttttcattaatataatcta

SEQ ID NO: 28676 - DNA, 24 bp, Artificial sequence
  SiRNA target sequence
aaatttttcattaatataatctac

SEQ ID NO: 28677 - DNA, 24 bp, Artificial sequence
  SiRNA target sequence
aatttttcattaatataatctact

SEQ ID NO: 28678 - DNA, 24 bp, Artificial sequence
  SiRNA target sequence
atttttcattaatataatctacta

SEQ ID NO: 28679 - DNA, 24 bp, Artificial sequence
  SiRNA target sequence
tttttcattaatataatctactaa

SEQ ID NO: 28680 - DNA, 24 bp, Artificial sequence
  SiRNA target sequence
ttttcattaatataatctactaaa

SEQ ID NO: 28681 - DNA, 24 bp, Artificial sequence
  SiRNA target sequence
tttcattaatataatctactaaag

SEQ ID NO: 28682 - DNA, 24 bp, Artificial sequence
  SiRNA target sequence
ttcattaatataatctactaaagt

SEQ ID NO: 28683 - DNA, 24 bp, Artificial sequence
  SiRNA target sequence
tcattaatataatctactaaagta

SEQ ID NO: 28684 - DNA, 24 bp, Artificial sequence
  SiRNA target sequence
cattaatataatctactaaagtat

SEQ ID NO: 28685 - DNA, 24 bp, Artificial sequence
  SiRNA target sequence
attaatataatctactaaagtatt

SEQ ID NO: 28686 - DNA, 24 bp, Artificial sequence
  SiRNA target sequence
ttaatataatctactaaagtatta

SEQ ID NO: 28687 - DNA, 24 bp, Artificial sequence
  SiRNA target sequence
taatataatctactaaagtattat

SEQ ID NO: 28688 - DNA, 24 bp, Artificial sequence
  SiRNA target sequence
aatataatctactaaagtattatc

SEQ ID NO: 28689 - DNA, 24 bp, Artificial sequence
  SiRNA target sequence
atataatctactaaagtattatcc

SEQ ID NO: 28690 - DNA, 24 bp, Artificial sequence
  SiRNA target sequence
tataatctactaaagtattatcca

SEQ ID NO: 28691 - DNA, 24 bp, Artificial sequence
  SiRNA target sequence
ataatctactaaagtattatccaa

SEQ ID NO: 28692 - DNA, 24 bp, Artificial sequence
  SiRNA target sequence
taatctactaaagtattatccaaa

SEQ ID NO: 28693 - DNA, 24 bp, Artificial sequence
  SiRNA target sequence
aatctactaaagtattatccaaat

SEQ ID NO: 28694 - DNA, 24 bp, Artificial sequence
  SiRNA target sequence
atctactaaagtattatccaaatc

SEQ ID NO: 28695 - DNA, 24 bp, Artificial sequence
  SiRNA target sequence
tctactaaagtattatccaaatct

SEQ ID NO: 28696 - DNA, 24 bp, Artificial sequence
  SiRNA target sequence
ctactaaagtattatccaaatctt

SEQ ID NO: 28697 - DNA, 24 bp, Artificial sequence
  SiRNA target sequence
tactaaagtattatccaaatcttc

SEQ ID NO: 28698 - DNA, 24 bp, Artificial sequence
  SiRNA target sequence
actaaagtattatccaaatcttct

SEQ ID NO: 28699 - DNA, 24 bp, Artificial sequence
  SiRNA target sequence
ctaaagtattatccaaatcttctc

SEQ ID NO: 28700 - DNA, 24 bp, Artificial sequence
  SiRNA target sequence
taaagtattatccaaatcttctcc

SEQ ID NO: 28701 - DNA, 24 bp, Artificial sequence
  SiRNA target sequence
aaagtattatccaaatcttctcct

SEQ ID NO: 28702 - DNA, 24 bp, Artificial sequence
  SiRNA target sequence
aagtattatccaaatcttctcctc

SEQ ID NO: 28703 - DNA, 24 bp, Artificial sequence
  SiRNA target sequence
agtattatccaaatcttctcctcc

SEQ ID NO: 28704 - DNA, 24 bp, Artificial sequence
  SiRNA target sequence
gtattatccaaatcttctcctcct

SEQ ID NO: 28705 - DNA, 24 bp, Artificial sequence
  SiRNA target sequence
tattatccaaatcttctcctccta

SEQ ID NO: 28706 - DNA, 24 bp, Artificial sequence
  SiRNA target sequence
attatccaaatcttctcctcctaa

SEQ ID NO: 28707 - DNA, 24 bp, Artificial sequence
  SiRNA target sequence
ttatccaaatcttctcctcctaaa

SEQ ID NO: 28708 - DNA, 24 bp, Artificial sequence
  SiRNA target sequence
tatccaaatcttctcctcctaaaa

SEQ ID NO: 28709 - DNA, 24 bp, Artificial sequence
  SiRNA target sequence
atccaaatcttctcctcctaaaaa

SEQ ID NO: 28710 - DNA, 24 bp, Artificial sequence
  SiRNA target sequence
tccaaatcttctcctcctaaaaaa

SEQ ID NO: 28711 - DNA, 24 bp, Artificial sequence
  SiRNA target sequence
ccaaatcttctcctcctaaaaaag

SEQ ID NO: 28712 - DNA, 24 bp, Artificial sequence
  SiRNA target sequence
caaatcttctcctcctaaaaaagt

SEQ ID NO: 28713 - DNA, 24 bp, Artificial sequence
  SiRNA target sequence
aaatcttctcctcctaaaaaagta

SEQ ID NO: 28714 - DNA, 24 bp, Artificial sequence
  SiRNA target sequence
aatcttctcctcctaaaaaagtat

SEQ ID NO: 28715 - DNA, 24 bp, Artificial sequence
  SiRNA target sequence
atcttctcctcctaaaaaagtatt

SEQ ID NO: 28716 - DNA, 24 bp, Artificial sequence
  SiRNA target sequence
tcttctcctcctaaaaaagtattt

SEQ ID NO: 28717 - DNA, 24 bp, Artificial sequence
  SiRNA target sequence
cttctcctcctaaaaaagtatttc

SEQ ID NO: 28718 - DNA, 24 bp, Artificial sequence
  SiRNA target sequence
ttctcctcctaaaaaagtatttcc

SEQ ID NO: 28719 - DNA, 24 bp, Artificial sequence
  SiRNA target sequence
tctcctcctaaaaaagtatttccg

SEQ ID NO: 28720 - DNA, 24 bp, Artificial sequence
  SiRNA target sequence
ctcctcctaaaaaagtatttccgt

SEQ ID NO: 28721 - DNA, 24 bp, Artificial sequence
  SiRNA target sequence
tcctcctaaaaaagtatttccgtt

SEQ ID NO: 28722 - DNA, 24 bp, Artificial sequence
  SiRNA target sequence
cctcctaaaaaagtatttccgtta

SEQ ID NO: 28723 - DNA, 24 bp, Artificial sequence
  SiRNA target sequence
ctcctaaaaaagtatttccgttag

SEQ ID NO: 28724 - DNA, 24 bp, Artificial sequence
  SiRNA target sequence
tcctaaaaaagtatttccgttagt

SEQ ID NO: 28725 - DNA, 24 bp, Artificial sequence
  SiRNA target sequence
cctaaaaaagtatttccgttagta

SEQ ID NO: 28726 - DNA, 24 bp, Artificial sequence
  SiRNA target sequence
ctaaaaaagtatttccgttagtag

SEQ ID NO: 28727 - DNA, 24 bp, Artificial sequence
  SiRNA target sequence
taaaaaagtatttccgttagtaga

SEQ ID NO: 28728 - DNA, 24 bp, Artificial sequence
  SiRNA target sequence
aaaaaagtatttccgttagtagat

SEQ ID NO: 28729 - DNA, 24 bp, Artificial sequence
  SiRNA target sequence
aaaaagtatttccgttagtagatt

SEQ ID NO: 28730 - DNA, 24 bp, Artificial sequence
  SiRNA target sequence
aaaagtatttccgttagtagattt

SEQ ID NO: 28731 - DNA, 24 bp, Artificial sequence
  SiRNA target sequence
aaagtatttccgttagtagatttt

SEQ ID NO: 28732 - DNA, 24 bp, Artificial sequence
  SiRNA target sequence
aagtatttccgttagtagatttta

SEQ ID NO: 28733 - DNA, 24 bp, Artificial sequence
  SiRNA target sequence
agtatttccgttagtagattttac

SEQ ID NO: 28734 - DNA, 24 bp, Artificial sequence
  SiRNA target sequence
gtatttccgttagtagattttaca

SEQ ID NO: 28735 - DNA, 24 bp, Artificial sequence
  SiRNA target sequence
tatttccgttagtagattttacat

SEQ ID NO: 28736 - DNA, 24 bp, Artificial sequence
  SiRNA target sequence
atttccgttagtagattttacatg

SEQ ID NO: 28737 - DNA, 24 bp, Artificial sequence
  SiRNA target sequence
tttccgttagtagattttacatga

SEQ ID NO: 28738 - DNA, 24 bp, Artificial sequence
  SiRNA target sequence
ttccgttagtagattttacatgaa

SEQ ID NO: 28739 - DNA, 24 bp, Artificial sequence
  SiRNA target sequence
tccgttagtagattttacatgaaa

SEQ ID NO: 28740 - DNA, 24 bp, Artificial sequence
  SiRNA target sequence
ccgttagtagattttacatgaaaa

SEQ ID NO: 28741 - DNA, 24 bp, Artificial sequence
  SiRNA target sequence
cgttagtagattttacatgaaaaa

SEQ ID NO: 28742 - DNA, 24 bp, Artificial sequence
  SiRNA target sequence
gttagtagattttacatgaaaaat

SEQ ID NO: 28743 - DNA, 24 bp, Artificial sequence
  SiRNA target sequence
ttagtagattttacatgaaaaata

SEQ ID NO: 28744 - DNA, 24 bp, Artificial sequence
  SiRNA target sequence
tagtagattttacatgaaaaatac

SEQ ID NO: 28745 - DNA, 24 bp, Artificial sequence
  SiRNA target sequence
agtagattttacatgaaaaatacc

SEQ ID NO: 28746 - DNA, 24 bp, Artificial sequence
  SiRNA target sequence
gtagattttacatgaaaaatacca

SEQ ID NO: 28747 - DNA, 24 bp, Artificial sequence
  SiRNA target sequence
tagattttacatgaaaaataccat

SEQ ID NO: 28748 - DNA, 24 bp, Artificial sequence
  SiRNA target sequence
agattttacatgaaaaataccatt

SEQ ID NO: 28749 - DNA, 24 bp, Artificial sequence
  SiRNA target sequence
gattttacatgaaaaataccatta

SEQ ID NO: 28750 - DNA, 24 bp, Artificial sequence
  SiRNA target sequence
attttacatgaaaaataccattat

SEQ ID NO: 28751 - DNA, 24 bp, Artificial sequence
  SiRNA target sequence
ttttacatgaaaaataccattatc

SEQ ID NO: 28752 - DNA, 24 bp, Artificial sequence
  SiRNA target sequence
tttacatgaaaaataccattatct

SEQ ID NO: 28753 - DNA, 24 bp, Artificial sequence
  SiRNA target sequence
ttacatgaaaaataccattatcta

SEQ ID NO: 28754 - DNA, 24 bp, Artificial sequence
  SiRNA target sequence
tacatgaaaaataccattatctaa

SEQ ID NO: 28755 - DNA, 24 bp, Artificial sequence
  SiRNA target sequence
acatgaaaaataccattatctaat

SEQ ID NO: 28756 - DNA, 24 bp, Artificial sequence
  SiRNA target sequence
catgaaaaataccattatctaatt

SEQ ID NO: 28757 - DNA, 24 bp, Artificial sequence
  SiRNA target sequence
atgaaaaataccattatctaattc

SEQ ID NO: 28758 - DNA, 24 bp, Artificial sequence
  SiRNA target sequence
tgaaaaataccattatctaattct

SEQ ID NO: 28759 - DNA, 24 bp, Artificial sequence
  SiRNA target sequence
gaaaaataccattatctaattcta

SEQ ID NO: 28760 - DNA, 24 bp, Artificial sequence
  SiRNA target sequence
aaaaataccattatctaattctaa

SEQ ID NO: 28761 - DNA, 24 bp, Artificial sequence
  SiRNA target sequence
aaaataccattatctaattctaat

SEQ ID NO: 28762 - DNA, 24 bp, Artificial sequence
  SiRNA target sequence
aaataccattatctaattctaata

SEQ ID NO: 28763 - DNA, 24 bp, Artificial sequence
  SiRNA target sequence
aataccattatctaattctaatat

SEQ ID NO: 28764 - DNA, 24 bp, Artificial sequence
  SiRNA target sequence
ataccattatctaattctaatata

SEQ ID NO: 28765 - DNA, 24 bp, Artificial sequence
  SiRNA target sequence
taccattatctaattctaatatac

SEQ ID NO: 28766 - DNA, 24 bp, Artificial sequence
  SiRNA target sequence
accattatctaattctaatatact

SEQ ID NO: 28767 - DNA, 24 bp, Artificial sequence
  SiRNA target sequence
ccattatctaattctaatatacta

SEQ ID NO: 28768 - DNA, 24 bp, Artificial sequence
  SiRNA target sequence
cattatctaattctaatatactaa

SEQ ID NO: 28769 - DNA, 24 bp, Artificial sequence
  SiRNA target sequence
attatctaattctaatatactaat

SEQ ID NO: 28770 - DNA, 24 bp, Artificial sequence
  SiRNA target sequence
ttatctaattctaatatactaatg

SEQ ID NO: 28771 - DNA, 24 bp, Artificial sequence
  SiRNA target sequence
tatctaattctaatatactaatgt

SEQ ID NO: 28772 - DNA, 24 bp, Artificial sequence
  SiRNA target sequence
atctaattctaatatactaatgtc

SEQ ID NO: 28773 - DNA, 24 bp, Artificial sequence
  SiRNA target sequence
tctaattctaatatactaatgtca

SEQ ID NO: 28774 - DNA, 24 bp, Artificial sequence
  SiRNA target sequence
ctaattctaatatactaatgtcaa

SEQ ID NO: 28775 - DNA, 24 bp, Artificial sequence
  SiRNA target sequence
taattctaatatactaatgtcaaa

SEQ ID NO: 28776 - DNA, 24 bp, Artificial sequence
  SiRNA target sequence
aattctaatatactaatgtcaaaa

SEQ ID NO: 28777 - DNA, 24 bp, Artificial sequence
  SiRNA target sequence
attctaatatactaatgtcaaaag

SEQ ID NO: 28778 - DNA, 24 bp, Artificial sequence
  SiRNA target sequence
ttctaatatactaatgtcaaaagt

SEQ ID NO: 28779 - DNA, 24 bp, Artificial sequence
  SiRNA target sequence
tctaatatactaatgtcaaaagtt

SEQ ID NO: 28780 - DNA, 24 bp, Artificial sequence
  SiRNA target sequence
ctaatatactaatgtcaaaagttc

SEQ ID NO: 28781 - DNA, 24 bp, Artificial sequence
  SiRNA target sequence
taatatactaatgtcaaaagttcc

SEQ ID NO: 28782 - DNA, 24 bp, Artificial sequence
  SiRNA target sequence
aatatactaatgtcaaaagttcct

SEQ ID NO: 28783 - DNA, 24 bp, Artificial sequence
  SiRNA target sequence
atatactaatgtcaaaagttcctc

SEQ ID NO: 28784 - DNA, 24 bp, Artificial sequence
  SiRNA target sequence
tatactaatgtcaaaagttcctcc

SEQ ID NO: 28785 - DNA, 24 bp, Artificial sequence
  SiRNA target sequence
atactaatgtcaaaagttcctcct

SEQ ID NO: 28786 - DNA, 24 bp, Artificial sequence
  SiRNA target sequence
tactaatgtcaaaagttcctcctc

SEQ ID NO: 28787 - DNA, 24 bp, Artificial sequence
  SiRNA target sequence
actaatgtcaaaagttcctcctcc

SEQ ID NO: 28788 - DNA, 24 bp, Artificial sequence
  SiRNA target sequence
ctaatgtcaaaagttcctcctccc

SEQ ID NO: 28789 - DNA, 24 bp, Artificial sequence
  SiRNA target sequence
taatgtcaaaagttcctcctccca

SEQ ID NO: 28790 - DNA, 24 bp, Artificial sequence
  SiRNA target sequence
aatgtcaaaagttcctcctcccag

SEQ ID NO: 28791 - DNA, 24 bp, Artificial sequence
  SiRNA target sequence
atgtcaaaagttcctcctcccaga

SEQ ID NO: 28792 - DNA, 24 bp, Artificial sequence
  SiRNA target sequence
tgtcaaaagttcctcctcccagat

SEQ ID NO: 28793 - DNA, 24 bp, Artificial sequence
  SiRNA target sequence
gtcaaaagttcctcctcccagatc

SEQ ID NO: 28794 - DNA, 24 bp, Artificial sequence
  SiRNA target sequence
tcaaaagttcctcctcccagatca

SEQ ID NO: 28795 - DNA, 24 bp, Artificial sequence
  SiRNA target sequence
caaaagttcctcctcccagatcat

SEQ ID NO: 28796 - DNA, 24 bp, Artificial sequence
  SiRNA target sequence
aaaagttcctcctcccagatcata

SEQ ID NO: 28797 - DNA, 24 bp, Artificial sequence
  SiRNA target sequence
aaagttcctcctcccagatcataa

SEQ ID NO: 28798 - DNA, 24 bp, Artificial sequence
  SiRNA target sequence
aagttcctcctcccagatcataaa

SEQ ID NO: 28799 - DNA, 24 bp, Artificial sequence
  SiRNA target sequence
agttcctcctcccagatcataaac

SEQ ID NO: 28800 - DNA, 24 bp, Artificial sequence
  SiRNA target sequence
gttcctcctcccagatcataaaca

SEQ ID NO: 28801 - DNA, 24 bp, Artificial sequence
  SiRNA target sequence
ttcctcctcccagatcataaacag

SEQ ID NO: 28802 - DNA, 24 bp, Artificial sequence
  SiRNA target sequence
tcctcctcccagatcataaacagc

SEQ ID NO: 28803 - DNA, 24 bp, Artificial sequence
  SiRNA target sequence
cctcctcccagatcataaacagct

SEQ ID NO: 28804 - DNA, 24 bp, Artificial sequence
  SiRNA target sequence
ctcctcccagatcataaacagcta

SEQ ID NO: 28805 - DNA, 24 bp, Artificial sequence
  SiRNA target sequence
tcctcccagatcataaacagctat

SEQ ID NO: 28806 - DNA, 24 bp, Artificial sequence
  SiRNA target sequence
cctcccagatcataaacagctata

SEQ ID NO: 28807 - DNA, 24 bp, Artificial sequence
  SiRNA target sequence
ctcccagatcataaacagctataa

SEQ ID NO: 28808 - DNA, 24 bp, Artificial sequence
  SiRNA target sequence
tcccagatcataaacagctataat

SEQ ID NO: 28809 - DNA, 24 bp, Artificial sequence
  SiRNA target sequence
cccagatcataaacagctataata

SEQ ID NO: 28810 - DNA, 24 bp, Artificial sequence
  SiRNA target sequence
ccagatcataaacagctataatac

SEQ ID NO: 28811 - DNA, 24 bp, Artificial sequence
  SiRNA target sequence
cagatcataaacagctataatacc

SEQ ID NO: 28812 - DNA, 24 bp, Artificial sequence
  SiRNA target sequence
agatcataaacagctataataccc

SEQ ID NO: 28813 - DNA, 24 bp, Artificial sequence
  SiRNA target sequence
gatcataaacagctataataccct

SEQ ID NO: 28814 - DNA, 24 bp, Artificial sequence
  SiRNA target sequence
atcataaacagctataataccctg

SEQ ID NO: 28815 - DNA, 24 bp, Artificial sequence
  SiRNA target sequence
tcataaacagctataataccctgt

SEQ ID NO: 28816 - DNA, 24 bp, Artificial sequence
  SiRNA target sequence
cataaacagctataataccctgtg

SEQ ID NO: 28817 - DNA, 24 bp, Artificial sequence
  SiRNA target sequence
ataaacagctataataccctgtgc

SEQ ID NO: 28818 - DNA, 24 bp, Artificial sequence
  SiRNA target sequence
taaacagctataataccctgtgca

SEQ ID NO: 28819 - DNA, 24 bp, Artificial sequence
  SiRNA target sequence
aaacagctataataccctgtgcag

SEQ ID NO: 28820 - DNA, 24 bp, Artificial sequence
  SiRNA target sequence
aacagctataataccctgtgcaga

SEQ ID NO: 28821 - DNA, 24 bp, Artificial sequence
  SiRNA target sequence
acagctataataccctgtgcagac

SEQ ID NO: 28822 - DNA, 24 bp, Artificial sequence
  SiRNA target sequence
cagctataataccctgtgcagact

SEQ ID NO: 28823 - DNA, 24 bp, Artificial sequence
  SiRNA target sequence
agctataataccctgtgcagactt

SEQ ID NO: 28824 - DNA, 24 bp, Artificial sequence
  SiRNA target sequence
gctataataccctgtgcagacttg

SEQ ID NO: 28825 - DNA, 24 bp, Artificial sequence
  SiRNA target sequence
ctataataccctgtgcagacttgt

SEQ ID NO: 28826 - DNA, 24 bp, Artificial sequence
  SiRNA target sequence
tataataccctgtgcagacttgtc

SEQ ID NO: 28827 - DNA, 24 bp, Artificial sequence
  SiRNA target sequence
ataataccctgtgcagacttgtca

SEQ ID NO: 28828 - DNA, 24 bp, Artificial sequence
  SiRNA target sequence
taataccctgtgcagacttgtcaa

SEQ ID NO: 28829 - DNA, 24 bp, Artificial sequence
  SiRNA target sequence
aataccctgtgcagacttgtcaag

SEQ ID NO: 28830 - DNA, 24 bp, Artificial sequence
  SiRNA target sequence
ataccctgtgcagacttgtcaagc

SEQ ID NO: 28831 - DNA, 24 bp, Artificial sequence
  SiRNA target sequence
taccctgtgcagacttgtcaagcc

SEQ ID NO: 28832 - DNA, 24 bp, Artificial sequence
  SiRNA target sequence
accctgtgcagacttgtcaagccc

SEQ ID NO: 28833 - DNA, 24 bp, Artificial sequence
  SiRNA target sequence
ccctgtgcagacttgtcaagccca

SEQ ID NO: 28834 - DNA, 24 bp, Artificial sequence
  SiRNA target sequence
cctgtgcagacttgtcaagcccat

SEQ ID NO: 28835 - DNA, 24 bp, Artificial sequence
  SiRNA target sequence
ctgtgcagacttgtcaagcccata

SEQ ID NO: 28836 - DNA, 24 bp, Artificial sequence
  SiRNA target sequence
tgtgcagacttgtcaagcccataa

SEQ ID NO: 28837 - DNA, 24 bp, Artificial sequence
  SiRNA target sequence
gtgcagacttgtcaagcccataag

SEQ ID NO: 28838 - DNA, 24 bp, Artificial sequence
  SiRNA target sequence
tgcagacttgtcaagcccataagc

SEQ ID NO: 28839 - DNA, 24 bp, Artificial sequence
  SiRNA target sequence
gcagacttgtcaagcccataagca

SEQ ID NO: 28840 - DNA, 24 bp, Artificial sequence
  SiRNA target sequence
cagacttgtcaagcccataagcaa

SEQ ID NO: 28841 - DNA, 24 bp, Artificial sequence
  SiRNA target sequence
agacttgtcaagcccataagcaag

SEQ ID NO: 28842 - DNA, 24 bp, Artificial sequence
  SiRNA target sequence
gacttgtcaagcccataagcaagt

SEQ ID NO: 28843 - DNA, 24 bp, Artificial sequence
  SiRNA target sequence
acttgtcaagcccataagcaagtg

SEQ ID NO: 28844 - DNA, 24 bp, Artificial sequence
  SiRNA target sequence
cttgtcaagcccataagcaagtgc

SEQ ID NO: 28845 - DNA, 24 bp, Artificial sequence
  SiRNA target sequence
ttgtcaagcccataagcaagtgct

SEQ ID NO: 28846 - DNA, 24 bp, Artificial sequence
  SiRNA target sequence
tgtcaagcccataagcaagtgctg

SEQ ID NO: 28847 - DNA, 24 bp, Artificial sequence
  SiRNA target sequence
gtcaagcccataagcaagtgctgc

SEQ ID NO: 28848 - DNA, 24 bp, Artificial sequence
  SiRNA target sequence
tcaagcccataagcaagtgctgcc

SEQ ID NO: 28849 - DNA, 24 bp, Artificial sequence
  SiRNA target sequence
caagcccataagcaagtgctgccg

SEQ ID NO: 28850 - DNA, 24 bp, Artificial sequence
  SiRNA target sequence
aagcccataagcaagtgctgccgc

SEQ ID NO: 28851 - DNA, 24 bp, Artificial sequence
  SiRNA target sequence
agcccataagcaagtgctgccgca

SEQ ID NO: 28852 - DNA, 24 bp, Artificial sequence
  SiRNA target sequence
gcccataagcaagtgctgccgcag

SEQ ID NO: 28853 - DNA, 24 bp, Artificial sequence
  SiRNA target sequence
cccataagcaagtgctgccgcagt

SEQ ID NO: 28854 - DNA, 24 bp, Artificial sequence
  SiRNA target sequence
ccataagcaagtgctgccgcagta

SEQ ID NO: 28855 - DNA, 24 bp, Artificial sequence
  SiRNA target sequence
cataagcaagtgctgccgcagtag

SEQ ID NO: 28856 - DNA, 24 bp, Artificial sequence
  SiRNA target sequence
ataagcaagtgctgccgcagtagg

SEQ ID NO: 28857 - DNA, 24 bp, Artificial sequence
  SiRNA target sequence
taagcaagtgctgccgcagtaggc

SEQ ID NO: 28858 - DNA, 24 bp, Artificial sequence
  SiRNA target sequence
aagcaagtgctgccgcagtaggct

SEQ ID NO: 28859 - DNA, 24 bp, Artificial sequence
  SiRNA target sequence
agcaagtgctgccgcagtaggctc

SEQ ID NO: 28860 - DNA, 24 bp, Artificial sequence
  SiRNA target sequence
gcaagtgctgccgcagtaggctca

SEQ ID NO: 28861 - DNA, 24 bp, Artificial sequence
  SiRNA target sequence
caagtgctgccgcagtaggctcat

SEQ ID NO: 28862 - DNA, 24 bp, Artificial sequence
  SiRNA target sequence
aagtgctgccgcagtaggctcatt

SEQ ID NO: 28863 - DNA, 24 bp, Artificial sequence
  SiRNA target sequence
agtgctgccgcagtaggctcatta

SEQ ID NO: 28864 - DNA, 24 bp, Artificial sequence
  SiRNA target sequence
gtgctgccgcagtaggctcattaa

SEQ ID NO: 28865 - DNA, 24 bp, Artificial sequence
  SiRNA target sequence
tgctgccgcagtaggctcattaat

SEQ ID NO: 28866 - DNA, 24 bp, Artificial sequence
  SiRNA target sequence
gctgccgcagtaggctcattaatc

SEQ ID NO: 28867 - DNA, 24 bp, Artificial sequence
  SiRNA target sequence
ctgccgcagtaggctcattaatca

SEQ ID NO: 28868 - DNA, 24 bp, Artificial sequence
  SiRNA target sequence
tgccgcagtaggctcattaatcac

SEQ ID NO: 28869 - DNA, 24 bp, Artificial sequence
  SiRNA target sequence
gccgcagtaggctcattaatcact

SEQ ID NO: 28870 - DNA, 24 bp, Artificial sequence
  SiRNA target sequence
ccgcagtaggctcattaatcactc

SEQ ID NO: 28871 - DNA, 24 bp, Artificial sequence
  SiRNA target sequence
cgcagtaggctcattaatcactct

SEQ ID NO: 28872 - DNA, 24 bp, Artificial sequence
  SiRNA target sequence
gcagtaggctcattaatcactcta

SEQ ID NO: 28873 - DNA, 24 bp, Artificial sequence
  SiRNA target sequence
cagtaggctcattaatcactctaa

SEQ ID NO: 28874 - DNA, 24 bp, Artificial sequence
  SiRNA target sequence
agtaggctcattaatcactctaag

SEQ ID NO: 28875 - DNA, 24 bp, Artificial sequence
  SiRNA target sequence
gtaggctcattaatcactctaagc

SEQ ID NO: 28876 - DNA, 24 bp, Artificial sequence
  SiRNA target sequence
taggctcattaatcactctaagca

SEQ ID NO: 28877 - DNA, 24 bp, Artificial sequence
  SiRNA target sequence
aggctcattaatcactctaagcac

SEQ ID NO: 28878 - DNA, 24 bp, Artificial sequence
  SiRNA target sequence
ggctcattaatcactctaagcact

SEQ ID NO: 28879 - DNA, 24 bp, Artificial sequence
  SiRNA target sequence
gctcattaatcactctaagcactt

SEQ ID NO: 28880 - DNA, 24 bp, Artificial sequence
  SiRNA target sequence
ctcattaatcactctaagcacttg

SEQ ID NO: 28881 - DNA, 24 bp, Artificial sequence
  SiRNA target sequence
tcattaatcactctaagcacttgt

SEQ ID NO: 28882 - DNA, 24 bp, Artificial sequence
  SiRNA target sequence
cattaatcactctaagcacttgta

SEQ ID NO: 28883 - DNA, 24 bp, Artificial sequence
  SiRNA target sequence
attaatcactctaagcacttgtaa

SEQ ID NO: 28884 - DNA, 24 bp, Artificial sequence
  SiRNA target sequence
ttaatcactctaagcacttgtaat

SEQ ID NO: 28885 - DNA, 24 bp, Artificial sequence
  SiRNA target sequence
taatcactctaagcacttgtaatc

SEQ ID NO: 28886 - DNA, 24 bp, Artificial sequence
  SiRNA target sequence
aatcactctaagcacttgtaatcc

SEQ ID NO: 28887 - DNA, 24 bp, Artificial sequence
  SiRNA target sequence
atcactctaagcacttgtaatccc

SEQ ID NO: 28888 - DNA, 24 bp, Artificial sequence
  SiRNA target sequence
tcactctaagcacttgtaatcccg

SEQ ID NO: 28889 - DNA, 24 bp, Artificial sequence
  SiRNA target sequence
cactctaagcacttgtaatcccgc

SEQ ID NO: 28890 - DNA, 24 bp, Artificial sequence
  SiRNA target sequence
actctaagcacttgtaatcccgca

SEQ ID NO: 28891 - DNA, 24 bp, Artificial sequence
  SiRNA target sequence
ctctaagcacttgtaatcccgcaa

SEQ ID NO: 28892 - DNA, 24 bp, Artificial sequence
  SiRNA target sequence
tctaagcacttgtaatcccgcaat

SEQ ID NO: 28893 - DNA, 24 bp, Artificial sequence
  SiRNA target sequence
ctaagcacttgtaatcccgcaatc

SEQ ID NO: 28894 - DNA, 24 bp, Artificial sequence
  SiRNA target sequence
taagcacttgtaatcccgcaatcc

SEQ ID NO: 28895 - DNA, 24 bp, Artificial sequence
  SiRNA target sequence
aagcacttgtaatcccgcaatcct

SEQ ID NO: 28896 - DNA, 24 bp, Artificial sequence
  SiRNA target sequence
agcacttgtaatcccgcaatcctt

SEQ ID NO: 28897 - DNA, 24 bp, Artificial sequence
  SiRNA target sequence
gcacttgtaatcccgcaatccttc

SEQ ID NO: 28898 - DNA, 24 bp, Artificial sequence
  SiRNA target sequence
cacttgtaatcccgcaatccttcc

SEQ ID NO: 28899 - DNA, 24 bp, Artificial sequence
  SiRNA target sequence
acttgtaatcccgcaatccttccc

SEQ ID NO: 28900 - DNA, 24 bp, Artificial sequence
  SiRNA target sequence
cttgtaatcccgcaatccttcccg

SEQ ID NO: 28901 - DNA, 24 bp, Artificial sequence
  SiRNA target sequence
ttgtaatcccgcaatccttcccgc

SEQ ID NO: 28902 - DNA, 24 bp, Artificial sequence
  SiRNA target sequence
tgtaatcccgcaatccttcccgca

SEQ ID NO: 28903 - DNA, 24 bp, Artificial sequence
  SiRNA target sequence
gtaatcccgcaatccttcccgcat

SEQ ID NO: 28904 - DNA, 24 bp, Artificial sequence
  SiRNA target sequence
taatcccgcaatccttcccgcatc

SEQ ID NO: 28905 - DNA, 24 bp, Artificial sequence
  SiRNA target sequence
aatcccgcaatccttcccgcatct

SEQ ID NO: 28906 - DNA, 24 bp, Artificial sequence
  SiRNA target sequence
atcccgcaatccttcccgcatctt

SEQ ID NO: 28907 - DNA, 24 bp, Artificial sequence
  SiRNA target sequence
tcccgcaatccttcccgcatcttt

SEQ ID NO: 28908 - DNA, 24 bp, Artificial sequence
  SiRNA target sequence
cccgcaatccttcccgcatcttta

SEQ ID NO: 28909 - DNA, 24 bp, Artificial sequence
  SiRNA target sequence
ccgcaatccttcccgcatctttag

SEQ ID NO: 28910 - DNA, 24 bp, Artificial sequence
  SiRNA target sequence
cgcaatccttcccgcatctttagt

SEQ ID NO: 28911 - DNA, 24 bp, Artificial sequence
  SiRNA target sequence
gcaatccttcccgcatctttagta

SEQ ID NO: 28912 - DNA, 24 bp, Artificial sequence
  SiRNA target sequence
caatccttcccgcatctttagtag

SEQ ID NO: 28913 - DNA, 24 bp, Artificial sequence
  SiRNA target sequence
aatccttcccgcatctttagtagc

SEQ ID NO: 28914 - DNA, 24 bp, Artificial sequence
  SiRNA target sequence
atccttcccgcatctttagtagct

SEQ ID NO: 28915 - DNA, 24 bp, Artificial sequence
  SiRNA target sequence
tccttcccgcatctttagtagctt

SEQ ID NO: 28916 - DNA, 24 bp, Artificial sequence
  SiRNA target sequence
ccttcccgcatctttagtagcttg

SEQ ID NO: 28917 - DNA, 24 bp, Artificial sequence
  SiRNA target sequence
cttcccgcatctttagtagcttgc

SEQ ID NO: 28918 - DNA, 24 bp, Artificial sequence
  SiRNA target sequence
ttcccgcatctttagtagcttgcc

SEQ ID NO: 28919 - DNA, 24 bp, Artificial sequence
  SiRNA target sequence
tcccgcatctttagtagcttgcct

SEQ ID NO: 28920 - DNA, 24 bp, Artificial sequence
  SiRNA target sequence
cccgcatctttagtagcttgcctt

SEQ ID NO: 28921 - DNA, 24 bp, Artificial sequence
  SiRNA target sequence
ccgcatctttagtagcttgccttt

SEQ ID NO: 28922 - DNA, 24 bp, Artificial sequence
  SiRNA target sequence
cgcatctttagtagcttgcctttg

SEQ ID NO: 28923 - DNA, 24 bp, Artificial sequence
  SiRNA target sequence
gcatctttagtagcttgcctttgc

SEQ ID NO: 28924 - DNA, 24 bp, Artificial sequence
  SiRNA target sequence
catctttagtagcttgcctttgca

SEQ ID NO: 28925 - DNA, 24 bp, Artificial sequence
  SiRNA target sequence
atctttagtagcttgcctttgcat

SEQ ID NO: 28926 - DNA, 24 bp, Artificial sequence
  SiRNA target sequence
tctttagtagcttgcctttgcatg

SEQ ID NO: 28927 - DNA, 24 bp, Artificial sequence
  SiRNA target sequence
ctttagtagcttgcctttgcatgt

SEQ ID NO: 28928 - DNA, 24 bp, Artificial sequence
  SiRNA target sequence
tttagtagcttgcctttgcatgtc

SEQ ID NO: 28929 - DNA, 24 bp, Artificial sequence
  SiRNA target sequence
ttagtagcttgcctttgcatgtca

SEQ ID NO: 28930 - DNA, 24 bp, Artificial sequence
  SiRNA target sequence
tagtagcttgcctttgcatgtcat

SEQ ID NO: 28931 - DNA, 24 bp, Artificial sequence
  SiRNA target sequence
agtagcttgcctttgcatgtcatc

SEQ ID NO: 28932 - DNA, 24 bp, Artificial sequence
  SiRNA target sequence
gtagcttgcctttgcatgtcatca

SEQ ID NO: 28933 - DNA, 24 bp, Artificial sequence
  SiRNA target sequence
tagcttgcctttgcatgtcatcaa

SEQ ID NO: 28934 - DNA, 24 bp, Artificial sequence
  SiRNA target sequence
agcttgcctttgcatgtcatcaaa

SEQ ID NO: 28935 - DNA, 24 bp, Artificial sequence
  SiRNA target sequence
gcttgcctttgcatgtcatcaaaa

SEQ ID NO: 28936 - DNA, 24 bp, Artificial sequence
  SiRNA target sequence
cttgcctttgcatgtcatcaaaat

SEQ ID NO: 28937 - DNA, 24 bp, Artificial sequence
  SiRNA target sequence
ttgcctttgcatgtcatcaaaata

SEQ ID NO: 28938 - DNA, 24 bp, Artificial sequence
  SiRNA target sequence
tgcctttgcatgtcatcaaaatat

SEQ ID NO: 28939 - DNA, 24 bp, Artificial sequence
  SiRNA target sequence
gcctttgcatgtcatcaaaatatg

SEQ ID NO: 28940 - DNA, 24 bp, Artificial sequence
  SiRNA target sequence
cctttgcatgtcatcaaaatatgc

SEQ ID NO: 28941 - DNA, 24 bp, Artificial sequence
  SiRNA target sequence
ctttgcatgtcatcaaaatatgcg

SEQ ID NO: 28942 - DNA, 24 bp, Artificial sequence
  SiRNA target sequence
tttgcatgtcatcaaaatatgcgg

SEQ ID NO: 28943 - DNA, 24 bp, Artificial sequence
  SiRNA target sequence
ttgcatgtcatcaaaatatgcggg

SEQ ID NO: 28944 - DNA, 24 bp, Artificial sequence
  SiRNA target sequence
tgcatgtcatcaaaatatgcgggc

SEQ ID NO: 28945 - DNA, 24 bp, Artificial sequence
  SiRNA target sequence
gcatgtcatcaaaatatgcgggca

SEQ ID NO: 28946 - DNA, 24 bp, Artificial sequence
  SiRNA target sequence
catgtcatcaaaatatgcgggcac

SEQ ID NO: 28947 - DNA, 24 bp, Artificial sequence
  SiRNA target sequence
atgtcatcaaaatatgcgggcact

SEQ ID NO: 28948 - DNA, 24 bp, Artificial sequence
  SiRNA target sequence
tgtcatcaaaatatgcgggcactg

SEQ ID NO: 28949 - DNA, 24 bp, Artificial sequence
  SiRNA target sequence
gtcatcaaaatatgcgggcactgt

SEQ ID NO: 28950 - DNA, 24 bp, Artificial sequence
  SiRNA target sequence
tcatcaaaatatgcgggcactgtt

SEQ ID NO: 28951 - DNA, 24 bp, Artificial sequence
  SiRNA target sequence
catcaaaatatgcgggcactgtta

SEQ ID NO: 28952 - DNA, 24 bp, Artificial sequence
  SiRNA target sequence
atcaaaatatgcgggcactgttat

SEQ ID NO: 28953 - DNA, 24 bp, Artificial sequence
  SiRNA target sequence
tcaaaatatgcgggcactgttata

SEQ ID NO: 28954 - DNA, 24 bp, Artificial sequence
  SiRNA target sequence
caaaatatgcgggcactgttataa

SEQ ID NO: 28955 - DNA, 24 bp, Artificial sequence
  SiRNA target sequence
aaaatatgcgggcactgttataac

SEQ ID NO: 28956 - DNA, 24 bp, Artificial sequence
  SiRNA target sequence
aaatatgcgggcactgttataaca

SEQ ID NO: 28957 - DNA, 24 bp, Artificial sequence
  SiRNA target sequence
aatatgcgggcactgttataacag

SEQ ID NO: 28958 - DNA, 24 bp, Artificial sequence
  SiRNA target sequence
atatgcgggcactgttataacaga

SEQ ID NO: 28959 - DNA, 24 bp, Artificial sequence
  SiRNA target sequence
tatgcgggcactgttataacagat

SEQ ID NO: 28960 - DNA, 24 bp, Artificial sequence
  SiRNA target sequence
atgcgggcactgttataacagatc

SEQ ID NO: 28961 - DNA, 24 bp, Artificial sequence
  SiRNA target sequence
tgcgggcactgttataacagatct

SEQ ID NO: 28962 - DNA, 24 bp, Artificial sequence
  SiRNA target sequence
gcgggcactgttataacagatctt

SEQ ID NO: 28963 - DNA, 24 bp, Artificial sequence
  SiRNA target sequence
cgggcactgttataacagatctta

SEQ ID NO: 28964 - DNA, 24 bp, Artificial sequence
  SiRNA target sequence
gggcactgttataacagatcttaa

SEQ ID NO: 28965 - DNA, 24 bp, Artificial sequence
  SiRNA target sequence
ggcactgttataacagatcttaat

SEQ ID NO: 28966 - DNA, 24 bp, Artificial sequence
  SiRNA target sequence
gcactgttataacagatcttaata

SEQ ID NO: 28967 - DNA, 24 bp, Artificial sequence
  SiRNA target sequence
cactgttataacagatcttaatac

SEQ ID NO: 28968 - DNA, 24 bp, Artificial sequence
  SiRNA target sequence
actgttataacagatcttaatact

SEQ ID NO: 28969 - DNA, 24 bp, Artificial sequence
  SiRNA target sequence
ctgttataacagatcttaatactt

SEQ ID NO: 28970 - DNA, 24 bp, Artificial sequence
  SiRNA target sequence
tgttataacagatcttaatacttt

SEQ ID NO: 28971 - DNA, 24 bp, Artificial sequence
  SiRNA target sequence
gttataacagatcttaatacttta

SEQ ID NO: 28972 - DNA, 24 bp, Artificial sequence
  SiRNA target sequence
ttataacagatcttaatactttag

SEQ ID NO: 28973 - DNA, 24 bp, Artificial sequence
  SiRNA target sequence
tataacagatcttaatactttaga

SEQ ID NO: 28974 - DNA, 24 bp, Artificial sequence
  SiRNA target sequence
ataacagatcttaatactttagaa

SEQ ID NO: 28975 - DNA, 24 bp, Artificial sequence
  SiRNA target sequence
taacagatcttaatactttagaat

SEQ ID NO: 28976 - DNA, 24 bp, Artificial sequence
  SiRNA target sequence
aacagatcttaatactttagaatt

SEQ ID NO: 28977 - DNA, 24 bp, Artificial sequence
  SiRNA target sequence
acagatcttaatactttagaattt

SEQ ID NO: 28978 - DNA, 24 bp, Artificial sequence
  SiRNA target sequence
cagatcttaatactttagaattta

SEQ ID NO: 28979 - DNA, 24 bp, Artificial sequence
  SiRNA target sequence
agatcttaatactttagaatttaa

SEQ ID NO: 28980 - DNA, 24 bp, Artificial sequence
  SiRNA target sequence
gatcttaatactttagaatttaaa

SEQ ID NO: 28981 - DNA, 24 bp, Artificial sequence
  SiRNA target sequence
atcttaatactttagaatttaaaa

SEQ ID NO: 28982 - DNA, 24 bp, Artificial sequence
  SiRNA target sequence
tcttaatactttagaatttaaaaa

SEQ ID NO: 28983 - DNA, 24 bp, Artificial sequence
  SiRNA target sequence
cttaatactttagaatttaaaaaa

SEQ ID NO: 28984 - DNA, 24 bp, Artificial sequence
  SiRNA target sequence
ttaatactttagaatttaaaaaat

SEQ ID NO: 28985 - DNA, 24 bp, Artificial sequence
  SiRNA target sequence
taatactttagaatttaaaaaatt

SEQ ID NO: 28986 - DNA, 24 bp, Artificial sequence
  SiRNA target sequence
aatactttagaatttaaaaaattc

SEQ ID NO: 28987 - DNA, 24 bp, Artificial sequence
  SiRNA target sequence
atactttagaatttaaaaaattct

SEQ ID NO: 28988 - DNA, 24 bp, Artificial sequence
  SiRNA target sequence
tactttagaatttaaaaaattctc

SEQ ID NO: 28989 - DNA, 24 bp, Artificial sequence
  SiRNA target sequence
actttagaatttaaaaaattctct

SEQ ID NO: 28990 - DNA, 24 bp, Artificial sequence
  SiRNA target sequence
ctttagaatttaaaaaattctctg

SEQ ID NO: 28991 - DNA, 24 bp, Artificial sequence
  SiRNA target sequence
tttagaatttaaaaaattctctgc

SEQ ID NO: 28992 - DNA, 24 bp, Artificial sequence
  SiRNA target sequence
ttagaatttaaaaaattctctgcg

SEQ ID NO: 28993 - DNA, 24 bp, Artificial sequence
  SiRNA target sequence
tagaatttaaaaaattctctgcgg

SEQ ID NO: 28994 - DNA, 24 bp, Artificial sequence
  SiRNA target sequence
agaatttaaaaaattctctgcggc

SEQ ID NO: 28995 - DNA, 24 bp, Artificial sequence
  SiRNA target sequence
gaatttaaaaaattctctgcggca

SEQ ID NO: 28996 - DNA, 24 bp, Artificial sequence
  SiRNA target sequence
aatttaaaaaattctctgcggcat

SEQ ID NO: 28997 - DNA, 24 bp, Artificial sequence
  SiRNA target sequence
atttaaaaaattctctgcggcatt

SEQ ID NO: 28998 - DNA, 24 bp, Artificial sequence
  SiRNA target sequence
tttaaaaaattctctgcggcattt

SEQ ID NO: 28999 - DNA, 24 bp, Artificial sequence
  SiRNA target sequence
ttaaaaaattctctgcggcatttt

SEQ ID NO: 29000 - DNA, 24 bp, Artificial sequence
  SiRNA target sequence
taaaaaattctctgcggcattttt

SEQ ID NO: 29001 - DNA, 24 bp, Artificial sequence
  SiRNA target sequence
aaaaaattctctgcggcatttttc

SEQ ID NO: 29002 - DNA, 24 bp, Artificial sequence
  SiRNA target sequence
aaaaattctctgcggcatttttca

SEQ ID NO: 29003 - DNA, 24 bp, Artificial sequence
  SiRNA target sequence
aaaattctctgcggcatttttcat

SEQ ID NO: 29004 - DNA, 24 bp, Artificial sequence
  SiRNA target sequence
aaattctctgcggcatttttcatt

SEQ ID NO: 29005 - DNA, 24 bp, Artificial sequence
  SiRNA target sequence
aattctctgcggcatttttcattt

SEQ ID NO: 29006 - DNA, 24 bp, Artificial sequence
  SiRNA target sequence
attctctgcggcatttttcatttt

SEQ ID NO: 29007 - DNA, 24 bp, Artificial sequence
  SiRNA target sequence
ttctctgcggcatttttcattttt

SEQ ID NO: 29008 - DNA, 24 bp, Artificial sequence
  SiRNA target sequence
tctctgcggcatttttcatttttg

SEQ ID NO: 29009 - DNA, 24 bp, Artificial sequence
  SiRNA target sequence
ctctgcggcatttttcatttttga

SEQ ID NO: 29010 - DNA, 24 bp, Artificial sequence
  SiRNA target sequence
tctgcggcatttttcatttttgac

SEQ ID NO: 29011 - DNA, 24 bp, Artificial sequence
  SiRNA target sequence
ctgcggcatttttcatttttgaca

SEQ ID NO: 29012 - DNA, 24 bp, Artificial sequence
  SiRNA target sequence
tgcggcatttttcatttttgacaa

SEQ ID NO: 29013 - DNA, 24 bp, Artificial sequence
  SiRNA target sequence
gcggcatttttcatttttgacaaa

SEQ ID NO: 29014 - DNA, 24 bp, Artificial sequence
  SiRNA target sequence
cggcatttttcatttttgacaaaa

SEQ ID NO: 29015 - DNA, 24 bp, Artificial sequence
  SiRNA target sequence
ggcatttttcatttttgacaaaat

SEQ ID NO: 29016 - DNA, 24 bp, Artificial sequence
  SiRNA target sequence
gcatttttcatttttgacaaaata

SEQ ID NO: 29017 - DNA, 24 bp, Artificial sequence
  SiRNA target sequence
catttttcatttttgacaaaataa

SEQ ID NO: 29018 - DNA, 24 bp, Artificial sequence
  SiRNA target sequence
atttttcatttttgacaaaataaa

SEQ ID NO: 29019 - DNA, 24 bp, Artificial sequence
  SiRNA target sequence
tttttcatttttgacaaaataaat

SEQ ID NO: 29020 - DNA, 24 bp, Artificial sequence
  SiRNA target sequence
ttttcatttttgacaaaataaatg

SEQ ID NO: 29021 - DNA, 24 bp, Artificial sequence
  SiRNA target sequence
tttcatttttgacaaaataaatgc

SEQ ID NO: 29022 - DNA, 24 bp, Artificial sequence
  SiRNA target sequence
ttcatttttgacaaaataaatgca

SEQ ID NO: 29023 - DNA, 24 bp, Artificial sequence
  SiRNA target sequence
tcatttttgacaaaataaatgcac

SEQ ID NO: 29024 - DNA, 24 bp, Artificial sequence
  SiRNA target sequence
catttttgacaaaataaatgcacc

SEQ ID NO: 29025 - DNA, 24 bp, Artificial sequence
  SiRNA target sequence
atttttgacaaaataaatgcacca

SEQ ID NO: 29026 - DNA, 24 bp, Artificial sequence
  SiRNA target sequence
tttttgacaaaataaatgcaccaa

SEQ ID NO: 29027 - DNA, 24 bp, Artificial sequence
  SiRNA target sequence
ttttgacaaaataaatgcaccaat

SEQ ID NO: 29028 - DNA, 24 bp, Artificial sequence
  SiRNA target sequence
tttgacaaaataaatgcaccaatt

SEQ ID NO: 29029 - DNA, 24 bp, Artificial sequence
  SiRNA target sequence
ttgacaaaataaatgcaccaattt

SEQ ID NO: 29030 - DNA, 24 bp, Artificial sequence
  SiRNA target sequence
tgacaaaataaatgcaccaatttg

SEQ ID NO: 29031 - DNA, 24 bp, Artificial sequence
  SiRNA target sequence
gacaaaataaatgcaccaatttgt

SEQ ID NO: 29032 - DNA, 24 bp, Artificial sequence
  SiRNA target sequence
acaaaataaatgcaccaatttgtg

SEQ ID NO: 29033 - DNA, 24 bp, Artificial sequence
  SiRNA target sequence
caaaataaatgcaccaatttgtgc

SEQ ID NO: 29034 - DNA, 24 bp, Artificial sequence
  SiRNA target sequence
aaaataaatgcaccaatttgtgca

SEQ ID NO: 29035 - DNA, 24 bp, Artificial sequence
  SiRNA target sequence
aaataaatgcaccaatttgtgcag

SEQ ID NO: 29036 - DNA, 24 bp, Artificial sequence
  SiRNA target sequence
aataaatgcaccaatttgtgcagg

SEQ ID NO: 29037 - DNA, 24 bp, Artificial sequence
  SiRNA target sequence
ataaatgcaccaatttgtgcagga

SEQ ID NO: 29038 - DNA, 24 bp, Artificial sequence
  SiRNA target sequence
taaatgcaccaatttgtgcaggag

SEQ ID NO: 29039 - DNA, 24 bp, Artificial sequence
  SiRNA target sequence
aaatgcaccaatttgtgcaggaga

SEQ ID NO: 29040 - DNA, 24 bp, Artificial sequence
  SiRNA target sequence
aatgcaccaatttgtgcaggagaa

SEQ ID NO: 29041 - DNA, 24 bp, Artificial sequence
  SiRNA target sequence
atgcaccaatttgtgcaggagaat

SEQ ID NO: 29042 - DNA, 24 bp, Artificial sequence
  SiRNA target sequence
tgcaccaatttgtgcaggagaata

SEQ ID NO: 29043 - DNA, 24 bp, Artificial sequence
  SiRNA target sequence
gcaccaatttgtgcaggagaatat

SEQ ID NO: 29044 - DNA, 24 bp, Artificial sequence
  SiRNA target sequence
caccaatttgtgcaggagaatatt

SEQ ID NO: 29045 - DNA, 24 bp, Artificial sequence
  SiRNA target sequence
accaatttgtgcaggagaatattt

SEQ ID NO: 29046 - DNA, 24 bp, Artificial sequence
  SiRNA target sequence
ccaatttgtgcaggagaatatttc

SEQ ID NO: 29047 - DNA, 24 bp, Artificial sequence
  SiRNA target sequence
caatttgtgcaggagaatatttct

SEQ ID NO: 29048 - DNA, 24 bp, Artificial sequence
  SiRNA target sequence
aatttgtgcaggagaatatttctt

SEQ ID NO: 29049 - DNA, 24 bp, Artificial sequence
  SiRNA target sequence
atttgtgcaggagaatatttctta

SEQ ID NO: 29050 - DNA, 24 bp, Artificial sequence
  SiRNA target sequence
tttgtgcaggagaatatttcttat

SEQ ID NO: 29051 - DNA, 24 bp, Artificial sequence
  SiRNA target sequence
ttgtgcaggagaatatttcttatt

SEQ ID NO: 29052 - DNA, 24 bp, Artificial sequence
  SiRNA target sequence
tgtgcaggagaatatttcttattg

SEQ ID NO: 29053 - DNA, 24 bp, Artificial sequence
  SiRNA target sequence
gtgcaggagaatatttcttattgt

SEQ ID NO: 29054 - DNA, 24 bp, Artificial sequence
  SiRNA target sequence
tgcaggagaatatttcttattgtc

SEQ ID NO: 29055 - DNA, 24 bp, Artificial sequence
  SiRNA target sequence
gcaggagaatatttcttattgtca

SEQ ID NO: 29056 - DNA, 24 bp, Artificial sequence
  SiRNA target sequence
caggagaatatttcttattgtcaa

SEQ ID NO: 29057 - DNA, 24 bp, Artificial sequence
  SiRNA target sequence
aggagaatatttcttattgtcaat

SEQ ID NO: 29058 - DNA, 24 bp, Artificial sequence
  SiRNA target sequence
ggagaatatttcttattgtcaatt

SEQ ID NO: 29059 - DNA, 24 bp, Artificial sequence
  SiRNA target sequence
gagaatatttcttattgtcaattt

SEQ ID NO: 29060 - DNA, 24 bp, Artificial sequence
  SiRNA target sequence
agaatatttcttattgtcaatttt

SEQ ID NO: 29061 - DNA, 24 bp, Artificial sequence
  SiRNA target sequence
gaatatttcttattgtcaattttt

SEQ ID NO: 29062 - DNA, 24 bp, Artificial sequence
  SiRNA target sequence
aatatttcttattgtcaattttta

SEQ ID NO: 29063 - DNA, 24 bp, Artificial sequence
  SiRNA target sequence
atatttcttattgtcaatttttat

SEQ ID NO: 29064 - DNA, 24 bp, Artificial sequence
  SiRNA target sequence
tatttcttattgtcaatttttatc

SEQ ID NO: 29065 - DNA, 24 bp, Artificial sequence
  SiRNA target sequence
atttcttattgtcaatttttatcc

SEQ ID NO: 29066 - DNA, 24 bp, Artificial sequence
  SiRNA target sequence
tttcttattgtcaatttttatcca

SEQ ID NO: 29067 - DNA, 24 bp, Artificial sequence
  SiRNA target sequence
ttcttattgtcaatttttatccaa

SEQ ID NO: 29068 - DNA, 24 bp, Artificial sequence
  SiRNA target sequence
tcttattgtcaatttttatccaaa

SEQ ID NO: 29069 - DNA, 24 bp, Artificial sequence
  SiRNA target sequence
cttattgtcaatttttatccaaat

SEQ ID NO: 29070 - DNA, 24 bp, Artificial sequence
  SiRNA target sequence
ttattgtcaatttttatccaaata

SEQ ID NO: 29071 - DNA, 24 bp, Artificial sequence
  SiRNA target sequence
tattgtcaatttttatccaaatat

SEQ ID NO: 29072 - DNA, 24 bp, Artificial sequence
  SiRNA target sequence
attgtcaatttttatccaaatatc

SEQ ID NO: 29073 - DNA, 24 bp, Artificial sequence
  SiRNA target sequence
ttgtcaatttttatccaaatatcg

SEQ ID NO: 29074 - DNA, 24 bp, Artificial sequence
  SiRNA target sequence
tgtcaatttttatccaaatatcgc

SEQ ID NO: 29075 - DNA, 24 bp, Artificial sequence
  SiRNA target sequence
gtcaatttttatccaaatatcgcc

SEQ ID NO: 29076 - DNA, 24 bp, Artificial sequence
  SiRNA target sequence
tcaatttttatccaaatatcgccg

SEQ ID NO: 29077 - DNA, 24 bp, Artificial sequence
  SiRNA target sequence
caatttttatccaaatatcgccgt

SEQ ID NO: 29078 - DNA, 24 bp, Artificial sequence
  SiRNA target sequence
aatttttatccaaatatcgccgtt

SEQ ID NO: 29079 - DNA, 24 bp, Artificial sequence
  SiRNA target sequence
atttttatccaaatatcgccgtta

SEQ ID NO: 29080 - DNA, 24 bp, Artificial sequence
  SiRNA target sequence
tttttatccaaatatcgccgttac

SEQ ID NO: 29081 - DNA, 24 bp, Artificial sequence
  SiRNA target sequence
ttttatccaaatatcgccgttaca

SEQ ID NO: 29082 - DNA, 24 bp, Artificial sequence
  SiRNA target sequence
tttatccaaatatcgccgttacaa

SEQ ID NO: 29083 - DNA, 24 bp, Artificial sequence
  SiRNA target sequence
ttatccaaatatcgccgttacaat

SEQ ID NO: 29084 - DNA, 24 bp, Artificial sequence
  SiRNA target sequence
tatccaaatatcgccgttacaatg

SEQ ID NO: 29085 - DNA, 24 bp, Artificial sequence
  SiRNA target sequence
atccaaatatcgccgttacaatgc

SEQ ID NO: 29086 - DNA, 24 bp, Artificial sequence
  SiRNA target sequence
tccaaatatcgccgttacaatgct

SEQ ID NO: 29087 - DNA, 24 bp, Artificial sequence
  SiRNA target sequence
ccaaatatcgccgttacaatgctt

SEQ ID NO: 29088 - DNA, 24 bp, Artificial sequence
  SiRNA target sequence
caaatatcgccgttacaatgctta

SEQ ID NO: 29089 - DNA, 24 bp, Artificial sequence
  SiRNA target sequence
aaatatcgccgttacaatgcttag

SEQ ID NO: 29090 - DNA, 24 bp, Artificial sequence
  SiRNA target sequence
aatatcgccgttacaatgcttagt

SEQ ID NO: 29091 - DNA, 24 bp, Artificial sequence
  SiRNA target sequence
atatcgccgttacaatgcttagta

SEQ ID NO: 29092 - DNA, 24 bp, Artificial sequence
  SiRNA target sequence
tatcgccgttacaatgcttagtag

SEQ ID NO: 29093 - DNA, 24 bp, Artificial sequence
  SiRNA target sequence
atcgccgttacaatgcttagtagt

SEQ ID NO: 29094 - DNA, 24 bp, Artificial sequence
  SiRNA target sequence
tcgccgttacaatgcttagtagtg

SEQ ID NO: 29095 - DNA, 24 bp, Artificial sequence
  SiRNA target sequence
cgccgttacaatgcttagtagtgt

SEQ ID NO: 29096 - DNA, 24 bp, Artificial sequence
  SiRNA target sequence
gccgttacaatgcttagtagtgtc

SEQ ID NO: 29097 - DNA, 24 bp, Artificial sequence
  SiRNA target sequence
ccgttacaatgcttagtagtgtca

SEQ ID NO: 29098 - DNA, 24 bp, Artificial sequence
  SiRNA target sequence
cgttacaatgcttagtagtgtcat

SEQ ID NO: 29099 - DNA, 24 bp, Artificial sequence
  SiRNA target sequence
gttacaatgcttagtagtgtcata

SEQ ID NO: 29100 - DNA, 24 bp, Artificial sequence
  SiRNA target sequence
ttacaatgcttagtagtgtcatat

SEQ ID NO: 29101 - DNA, 24 bp, Artificial sequence
  SiRNA target sequence
tacaatgcttagtagtgtcatatg

SEQ ID NO: 29102 - DNA, 24 bp, Artificial sequence
  SiRNA target sequence
acaatgcttagtagtgtcatatgg

SEQ ID NO: 29103 - DNA, 24 bp, Artificial sequence
  SiRNA target sequence
caatgcttagtagtgtcatatggt

SEQ ID NO: 29104 - DNA, 24 bp, Artificial sequence
  SiRNA target sequence
aatgcttagtagtgtcatatggta

SEQ ID NO: 29105 - DNA, 24 bp, Artificial sequence
  SiRNA target sequence
atgcttagtagtgtcatatggtaa

SEQ ID NO: 29106 - DNA, 24 bp, Artificial sequence
  SiRNA target sequence
tgcttagtagtgtcatatggtaag

SEQ ID NO: 29107 - DNA, 24 bp, Artificial sequence
  SiRNA target sequence
gcttagtagtgtcatatggtaagc

SEQ ID NO: 29108 - DNA, 24 bp, Artificial sequence
  SiRNA target sequence
cttagtagtgtcatatggtaagct

SEQ ID NO: 29109 - DNA, 24 bp, Artificial sequence
  SiRNA target sequence
ttagtagtgtcatatggtaagctt

SEQ ID NO: 29110 - DNA, 24 bp, Artificial sequence
  SiRNA target sequence
tagtagtgtcatatggtaagcttt

SEQ ID NO: 29111 - DNA, 24 bp, Artificial sequence
  SiRNA target sequence
agtagtgtcatatggtaagctttt

SEQ ID NO: 29112 - DNA, 24 bp, Artificial sequence
  SiRNA target sequence
gtagtgtcatatggtaagcttttt

SEQ ID NO: 29113 - DNA, 24 bp, Artificial sequence
  SiRNA target sequence
tagtgtcatatggtaagcttttta

SEQ ID NO: 29114 - DNA, 24 bp, Artificial sequence
  SiRNA target sequence
agtgtcatatggtaagctttttaa

SEQ ID NO: 29115 - DNA, 24 bp, Artificial sequence
  SiRNA target sequence
gtgtcatatggtaagctttttaaa

SEQ ID NO: 29116 - DNA, 24 bp, Artificial sequence
  SiRNA target sequence
tgtcatatggtaagctttttaaat

SEQ ID NO: 29117 - DNA, 24 bp, Artificial sequence
  SiRNA target sequence
gtcatatggtaagctttttaaata

SEQ ID NO: 29118 - DNA, 24 bp, Artificial sequence
  SiRNA target sequence
tcatatggtaagctttttaaataa

SEQ ID NO: 29119 - DNA, 24 bp, Artificial sequence
  SiRNA target sequence
catatggtaagctttttaaataat

SEQ ID NO: 29120 - DNA, 24 bp, Artificial sequence
  SiRNA target sequence
atatggtaagctttttaaataatc

SEQ ID NO: 29121 - DNA, 24 bp, Artificial sequence
  SiRNA target sequence
tatggtaagctttttaaataatct

SEQ ID NO: 29122 - DNA, 24 bp, Artificial sequence
  SiRNA target sequence
atggtaagctttttaaataatctt

SEQ ID NO: 29123 - DNA, 24 bp, Artificial sequence
  SiRNA target sequence
tggtaagctttttaaataatcttt

SEQ ID NO: 29124 - DNA, 24 bp, Artificial sequence
  SiRNA target sequence
ggtaagctttttaaataatctttt

SEQ ID NO: 29125 - DNA, 24 bp, Artificial sequence
  SiRNA target sequence
gtaagctttttaaataatctttta

SEQ ID NO: 29126 - DNA, 24 bp, Artificial sequence
  SiRNA target sequence
taagctttttaaataatcttttaa

SEQ ID NO: 29127 - DNA, 24 bp, Artificial sequence
  SiRNA target sequence
aagctttttaaataatcttttaat

SEQ ID NO: 29128 - DNA, 24 bp, Artificial sequence
  SiRNA target sequence
agctttttaaataatcttttaatt

SEQ ID NO: 29129 - DNA, 24 bp, Artificial sequence
  SiRNA target sequence
gctttttaaataatcttttaattc

SEQ ID NO: 29130 - DNA, 24 bp, Artificial sequence
  SiRNA target sequence
ctttttaaataatcttttaattct

SEQ ID NO: 29131 - DNA, 24 bp, Artificial sequence
  SiRNA target sequence
tttttaaataatcttttaattcta

SEQ ID NO: 29132 - DNA, 24 bp, Artificial sequence
  SiRNA target sequence
ttttaaataatcttttaattctac

SEQ ID NO: 29133 - DNA, 24 bp, Artificial sequence
  SiRNA target sequence
tttaaataatcttttaattctaca

SEQ ID NO: 29134 - DNA, 24 bp, Artificial sequence
  SiRNA target sequence
ttaaataatcttttaattctacat

SEQ ID NO: 29135 - DNA, 24 bp, Artificial sequence
  SiRNA target sequence
taaataatcttttaattctacatc

SEQ ID NO: 29136 - DNA, 24 bp, Artificial sequence
  SiRNA target sequence
aaataatcttttaattctacatca

SEQ ID NO: 29137 - DNA, 24 bp, Artificial sequence
  SiRNA target sequence
aataatcttttaattctacatcat

SEQ ID NO: 29138 - DNA, 24 bp, Artificial sequence
  SiRNA target sequence
ataatcttttaattctacatcatc

SEQ ID NO: 29139 - DNA, 24 bp, Artificial sequence
  SiRNA target sequence
taatcttttaattctacatcatca

SEQ ID NO: 29140 - DNA, 24 bp, Artificial sequence
  SiRNA target sequence
aatcttttaattctacatcatcaa

SEQ ID NO: 29141 - DNA, 24 bp, Artificial sequence
  SiRNA target sequence
atcttttaattctacatcatcaaa

SEQ ID NO: 29142 - DNA, 24 bp, Artificial sequence
  SiRNA target sequence
tcttttaattctacatcatcaaat

SEQ ID NO: 29143 - DNA, 24 bp, Artificial sequence
  SiRNA target sequence
cttttaattctacatcatcaaatt

SEQ ID NO: 29144 - DNA, 24 bp, Artificial sequence
  SiRNA target sequence
ttttaattctacatcatcaaattt

SEQ ID NO: 29145 - DNA, 24 bp, Artificial sequence
  SiRNA target sequence
tttaattctacatcatcaaatttt

SEQ ID NO: 29146 - DNA, 24 bp, Artificial sequence
  SiRNA target sequence
ttaattctacatcatcaaattttc

SEQ ID NO: 29147 - DNA, 24 bp, Artificial sequence
  SiRNA target sequence
taattctacatcatcaaattttcg

SEQ ID NO: 29148 - DNA, 24 bp, Artificial sequence
  SiRNA target sequence
aattctacatcatcaaattttcgt

SEQ ID NO: 29149 - DNA, 24 bp, Artificial sequence
  SiRNA target sequence
attctacatcatcaaattttcgtc

SEQ ID NO: 29150 - DNA, 24 bp, Artificial sequence
  SiRNA target sequence
ttctacatcatcaaattttcgtcc

SEQ ID NO: 29151 - DNA, 24 bp, Artificial sequence
  SiRNA target sequence
tctacatcatcaaattttcgtccc

SEQ ID NO: 29152 - DNA, 24 bp, Artificial sequence
  SiRNA target sequence
ctacatcatcaaattttcgtccca

SEQ ID NO: 29153 - DNA, 24 bp, Artificial sequence
  SiRNA target sequence
tacatcatcaaattttcgtcccag

SEQ ID NO: 29154 - DNA, 24 bp, Artificial sequence
  SiRNA target sequence
acatcatcaaattttcgtcccagc

SEQ ID NO: 29155 - DNA, 24 bp, Artificial sequence
  SiRNA target sequence
catcatcaaattttcgtcccagca

SEQ ID NO: 29156 - DNA, 24 bp, Artificial sequence
  SiRNA target sequence
atcatcaaattttcgtcccagcaa

SEQ ID NO: 29157 - DNA, 24 bp, Artificial sequence
  SiRNA target sequence
tcatcaaattttcgtcccagcaat

SEQ ID NO: 29158 - DNA, 24 bp, Artificial sequence
  SiRNA target sequence
catcaaattttcgtcccagcaatc

SEQ ID NO: 29159 - DNA, 24 bp, Artificial sequence
  SiRNA target sequence
atcaaattttcgtcccagcaatct

SEQ ID NO: 29160 - DNA, 24 bp, Artificial sequence
  SiRNA target sequence
tcaaattttcgtcccagcaatctc

SEQ ID NO: 29161 - DNA, 24 bp, Artificial sequence
  SiRNA target sequence
caaattttcgtcccagcaatctct

SEQ ID NO: 29162 - DNA, 24 bp, Artificial sequence
  SiRNA target sequence
aaattttcgtcccagcaatctctt

SEQ ID NO: 29163 - DNA, 24 bp, Artificial sequence
  SiRNA target sequence
aattttcgtcccagcaatctctta

SEQ ID NO: 29164 - DNA, 24 bp, Artificial sequence
  SiRNA target sequence
attttcgtcccagcaatctcttag

SEQ ID NO: 29165 - DNA, 24 bp, Artificial sequence
  SiRNA target sequence
ttttcgtcccagcaatctcttaga

SEQ ID NO: 29166 - DNA, 24 bp, Artificial sequence
  SiRNA target sequence
tttcgtcccagcaatctcttagac

SEQ ID NO: 29167 - DNA, 24 bp, Artificial sequence
  SiRNA target sequence
ttcgtcccagcaatctcttagacg

SEQ ID NO: 29168 - DNA, 24 bp, Artificial sequence
  SiRNA target sequence
tcgtcccagcaatctcttagacgc

SEQ ID NO: 29169 - DNA, 24 bp, Artificial sequence
  SiRNA target sequence
cgtcccagcaatctcttagacgca

SEQ ID NO: 29170 - DNA, 24 bp, Artificial sequence
  SiRNA target sequence
gtcccagcaatctcttagacgcaa

SEQ ID NO: 29171 - DNA, 24 bp, Artificial sequence
  SiRNA target sequence
tcccagcaatctcttagacgcaaa

SEQ ID NO: 29172 - DNA, 24 bp, Artificial sequence
  SiRNA target sequence
cccagcaatctcttagacgcaaaa

SEQ ID NO: 29173 - DNA, 24 bp, Artificial sequence
  SiRNA target sequence
ccagcaatctcttagacgcaaaaa

SEQ ID NO: 29174 - DNA, 24 bp, Artificial sequence
  SiRNA target sequence
cagcaatctcttagacgcaaaaat

SEQ ID NO: 29175 - DNA, 24 bp, Artificial sequence
  SiRNA target sequence
agcaatctcttagacgcaaaaatc

SEQ ID NO: 29176 - DNA, 24 bp, Artificial sequence
  SiRNA target sequence
gcaatctcttagacgcaaaaatcg

SEQ ID NO: 29177 - DNA, 24 bp, Artificial sequence
  SiRNA target sequence
caatctcttagacgcaaaaatcgt

SEQ ID NO: 29178 - DNA, 24 bp, Artificial sequence
  SiRNA target sequence
aatctcttagacgcaaaaatcgta

SEQ ID NO: 29179 - DNA, 24 bp, Artificial sequence
  SiRNA target sequence
atctcttagacgcaaaaatcgtat

SEQ ID NO: 29180 - DNA, 24 bp, Artificial sequence
  SiRNA target sequence
tctcttagacgcaaaaatcgtatt

SEQ ID NO: 29181 - DNA, 24 bp, Artificial sequence
  SiRNA target sequence
ctcttagacgcaaaaatcgtattc

SEQ ID NO: 29182 - DNA, 24 bp, Artificial sequence
  SiRNA target sequence
tcttagacgcaaaaatcgtattct

SEQ ID NO: 29183 - DNA, 24 bp, Artificial sequence
  SiRNA target sequence
cttagacgcaaaaatcgtattctt

SEQ ID NO: 29184 - DNA, 24 bp, Artificial sequence
  SiRNA target sequence
ttagacgcaaaaatcgtattcttg

SEQ ID NO: 29185 - DNA, 24 bp, Artificial sequence
  SiRNA target sequence
tagacgcaaaaatcgtattcttgg

SEQ ID NO: 29186 - DNA, 24 bp, Artificial sequence
  SiRNA target sequence
agacgcaaaaatcgtattcttggg

SEQ ID NO: 29187 - DNA, 24 bp, Artificial sequence
  SiRNA target sequence
gacgcaaaaatcgtattcttggga

SEQ ID NO: 29188 - DNA, 24 bp, Artificial sequence
  SiRNA target sequence
acgcaaaaatcgtattcttgggat

SEQ ID NO: 29189 - DNA, 24 bp, Artificial sequence
  SiRNA target sequence
cgcaaaaatcgtattcttgggatg

SEQ ID NO: 29190 - DNA, 24 bp, Artificial sequence
  SiRNA target sequence
gcaaaaatcgtattcttgggatgt

SEQ ID NO: 29191 - DNA, 24 bp, Artificial sequence
  SiRNA target sequence
caaaaatcgtattcttgggatgta

SEQ ID NO: 29192 - DNA, 24 bp, Artificial sequence
  SiRNA target sequence
aaaaatcgtattcttgggatgtaa

SEQ ID NO: 29193 - DNA, 24 bp, Artificial sequence
  SiRNA target sequence
aaaatcgtattcttgggatgtaat

SEQ ID NO: 29194 - DNA, 24 bp, Artificial sequence
  SiRNA target sequence
aaatcgtattcttgggatgtaata

SEQ ID NO: 29195 - DNA, 24 bp, Artificial sequence
  SiRNA target sequence
aatcgtattcttgggatgtaataa

SEQ ID NO: 29196 - DNA, 24 bp, Artificial sequence
  SiRNA target sequence
atcgtattcttgggatgtaataac

SEQ ID NO: 29197 - DNA, 24 bp, Artificial sequence
  SiRNA target sequence
tcgtattcttgggatgtaataaca

SEQ ID NO: 29198 - DNA, 24 bp, Artificial sequence
  SiRNA target sequence
cgtattcttgggatgtaataacaa

SEQ ID NO: 29199 - DNA, 24 bp, Artificial sequence
  SiRNA target sequence
gtattcttgggatgtaataacaag

SEQ ID NO: 29200 - DNA, 24 bp, Artificial sequence
  SiRNA target sequence
tattcttgggatgtaataacaagt

SEQ ID NO: 29201 - DNA, 24 bp, Artificial sequence
  SiRNA target sequence
attcttgggatgtaataacaagtt

SEQ ID NO: 29202 - DNA, 24 bp, Artificial sequence
  SiRNA target sequence
ttcttgggatgtaataacaagtta

SEQ ID NO: 29203 - DNA, 24 bp, Artificial sequence
  SiRNA target sequence
tcttgggatgtaataacaagttag

SEQ ID NO: 29204 - DNA, 24 bp, Artificial sequence
  SiRNA target sequence
cttgggatgtaataacaagttaga

SEQ ID NO: 29205 - DNA, 24 bp, Artificial sequence
  SiRNA target sequence
ttgggatgtaataacaagttagac

SEQ ID NO: 29206 - DNA, 24 bp, Artificial sequence
  SiRNA target sequence
tgggatgtaataacaagttagact

SEQ ID NO: 29207 - DNA, 24 bp, Artificial sequence
  SiRNA target sequence
gggatgtaataacaagttagactt

SEQ ID NO: 29208 - DNA, 24 bp, Artificial sequence
  SiRNA target sequence
ggatgtaataacaagttagactta

SEQ ID NO: 29209 - DNA, 24 bp, Artificial sequence
  SiRNA target sequence
gatgtaataacaagttagacttag

SEQ ID NO: 29210 - DNA, 24 bp, Artificial sequence
  SiRNA target sequence
atgtaataacaagttagacttagc

SEQ ID NO: 29211 - DNA, 24 bp, Artificial sequence
  SiRNA target sequence
tgtaataacaagttagacttagct

SEQ ID NO: 29212 - DNA, 24 bp, Artificial sequence
  SiRNA target sequence
gtaataacaagttagacttagctt

SEQ ID NO: 29213 - DNA, 24 bp, Artificial sequence
  SiRNA target sequence
taataacaagttagacttagcttg

SEQ ID NO: 29214 - DNA, 24 bp, Artificial sequence
  SiRNA target sequence
aataacaagttagacttagcttgc

SEQ ID NO: 29215 - DNA, 24 bp, Artificial sequence
  SiRNA target sequence
ataacaagttagacttagcttgct

SEQ ID NO: 29216 - DNA, 24 bp, Artificial sequence
  SiRNA target sequence
taacaagttagacttagcttgctc

SEQ ID NO: 29217 - DNA, 24 bp, Artificial sequence
  SiRNA target sequence
aacaagttagacttagcttgctca

SEQ ID NO: 29218 - DNA, 24 bp, Artificial sequence
  SiRNA target sequence
acaagttagacttagcttgctcac

SEQ ID NO: 29219 - DNA, 24 bp, Artificial sequence
  SiRNA target sequence
caagttagacttagcttgctcacc

SEQ ID NO: 29220 - DNA, 24 bp, Artificial sequence
  SiRNA target sequence
aagttagacttagcttgctcacct

SEQ ID NO: 29221 - DNA, 24 bp, Artificial sequence
  SiRNA target sequence
agttagacttagcttgctcacctg

SEQ ID NO: 29222 - DNA, 24 bp, Artificial sequence
  SiRNA target sequence
gttagacttagcttgctcacctgt

SEQ ID NO: 29223 - DNA, 24 bp, Artificial sequence
  SiRNA target sequence
ttagacttagcttgctcacctgtt

SEQ ID NO: 29224 - DNA, 24 bp, Artificial sequence
  SiRNA target sequence
tagacttagcttgctcacctgtta

SEQ ID NO: 29225 - DNA, 24 bp, Artificial sequence
  SiRNA target sequence
agacttagcttgctcacctgttaa

SEQ ID NO: 29226 - DNA, 24 bp, Artificial sequence
  SiRNA target sequence
gacttagcttgctcacctgttaaa

SEQ ID NO: 29227 - DNA, 24 bp, Artificial sequence
  SiRNA target sequence
acttagcttgctcacctgttaaaa

SEQ ID NO: 29228 - DNA, 24 bp, Artificial sequence
  SiRNA target sequence
cttagcttgctcacctgttaaaat

SEQ ID NO: 29229 - DNA, 24 bp, Artificial sequence
  SiRNA target sequence
ttagcttgctcacctgttaaaatt

SEQ ID NO: 29230 - DNA, 24 bp, Artificial sequence
  SiRNA target sequence
tagcttgctcacctgttaaaattt

SEQ ID NO: 29231 - DNA, 24 bp, Artificial sequence
  SiRNA target sequence
agcttgctcacctgttaaaatttt

SEQ ID NO: 29232 - DNA, 24 bp, Artificial sequence
  SiRNA target sequence
gcttgctcacctgttaaaatttta

SEQ ID NO: 29233 - DNA, 24 bp, Artificial sequence
  SiRNA target sequence
cttgctcacctgttaaaattttat

SEQ ID NO: 29234 - DNA, 24 bp, Artificial sequence
  SiRNA target sequence
ttgctcacctgttaaaattttatc

SEQ ID NO: 29235 - DNA, 24 bp, Artificial sequence
  SiRNA target sequence
tgctcacctgttaaaattttatct

SEQ ID NO: 29236 - DNA, 24 bp, Artificial sequence
  SiRNA target sequence
gctcacctgttaaaattttatctt

SEQ ID NO: 29237 - DNA, 24 bp, Artificial sequence
  SiRNA target sequence
ctcacctgttaaaattttatcttt

SEQ ID NO: 29238 - DNA, 24 bp, Artificial sequence
  SiRNA target sequence
tcacctgttaaaattttatcttta

SEQ ID NO: 29239 - DNA, 24 bp, Artificial sequence
  SiRNA target sequence
cacctgttaaaattttatctttaa

SEQ ID NO: 29240 - DNA, 24 bp, Artificial sequence
  SiRNA target sequence
acctgttaaaattttatctttaaa

SEQ ID NO: 29241 - DNA, 24 bp, Artificial sequence
  SiRNA target sequence
cctgttaaaattttatctttaaaa

SEQ ID NO: 29242 - DNA, 24 bp, Artificial sequence
  SiRNA target sequence
ctgttaaaattttatctttaaaaa

SEQ ID NO: 29243 - DNA, 24 bp, Artificial sequence
  SiRNA target sequence
tgttaaaattttatctttaaaaat

SEQ ID NO: 29244 - DNA, 24 bp, Artificial sequence
  SiRNA target sequence
gttaaaattttatctttaaaaatt

SEQ ID NO: 29245 - DNA, 24 bp, Artificial sequence
  SiRNA target sequence
ttaaaattttatctttaaaaattg

SEQ ID NO: 29246 - DNA, 24 bp, Artificial sequence
  SiRNA target sequence
taaaattttatctttaaaaattga

SEQ ID NO: 29247 - DNA, 24 bp, Artificial sequence
  SiRNA target sequence
aaaattttatctttaaaaattgat

SEQ ID NO: 29248 - DNA, 24 bp, Artificial sequence
  SiRNA target sequence
aaattttatctttaaaaattgata

SEQ ID NO: 29249 - DNA, 24 bp, Artificial sequence
  SiRNA target sequence
aattttatctttaaaaattgatac

SEQ ID NO: 29250 - DNA, 24 bp, Artificial sequence
  SiRNA target sequence
attttatctttaaaaattgatacc

SEQ ID NO: 29251 - DNA, 24 bp, Artificial sequence
  SiRNA target sequence
ttttatctttaaaaattgatacca

SEQ ID NO: 29252 - DNA, 24 bp, Artificial sequence
  SiRNA target sequence
tttatctttaaaaattgataccac

SEQ ID NO: 29253 - DNA, 24 bp, Artificial sequence
  SiRNA target sequence
ttatctttaaaaattgataccacc

SEQ ID NO: 29254 - DNA, 24 bp, Artificial sequence
  SiRNA target sequence
tatctttaaaaattgataccaccg

SEQ ID NO: 29255 - DNA, 24 bp, Artificial sequence
  SiRNA target sequence
atctttaaaaattgataccaccga

SEQ ID NO: 29256 - DNA, 24 bp, Artificial sequence
  SiRNA target sequence
tctttaaaaattgataccaccgat

SEQ ID NO: 29257 - DNA, 24 bp, Artificial sequence
  SiRNA target sequence
ctttaaaaattgataccaccgatg

SEQ ID NO: 29258 - DNA, 24 bp, Artificial sequence
  SiRNA target sequence
tttaaaaattgataccaccgatgg

SEQ ID NO: 29259 - DNA, 24 bp, Artificial sequence
  SiRNA target sequence
ttaaaaattgataccaccgatggt

SEQ ID NO: 29260 - DNA, 24 bp, Artificial sequence
  SiRNA target sequence
taaaaattgataccaccgatggtg

SEQ ID NO: 29261 - DNA, 24 bp, Artificial sequence
  SiRNA target sequence
aaaaattgataccaccgatggtgt

SEQ ID NO: 29262 - DNA, 24 bp, Artificial sequence
  SiRNA target sequence
aaaattgataccaccgatggtgta

SEQ ID NO: 29263 - DNA, 24 bp, Artificial sequence
  SiRNA target sequence
aaattgataccaccgatggtgtag

SEQ ID NO: 29264 - DNA, 24 bp, Artificial sequence
  SiRNA target sequence
aattgataccaccgatggtgtagt

SEQ ID NO: 29265 - DNA, 24 bp, Artificial sequence
  SiRNA target sequence
attgataccaccgatggtgtagtt

SEQ ID NO: 29266 - DNA, 24 bp, Artificial sequence
  SiRNA target sequence
ttgataccaccgatggtgtagttc

SEQ ID NO: 29267 - DNA, 24 bp, Artificial sequence
  SiRNA target sequence
tgataccaccgatggtgtagttct

SEQ ID NO: 29268 - DNA, 24 bp, Artificial sequence
  SiRNA target sequence
gataccaccgatggtgtagttcta

SEQ ID NO: 29269 - DNA, 24 bp, Artificial sequence
  SiRNA target sequence
ataccaccgatggtgtagttctac

SEQ ID NO: 29270 - DNA, 24 bp, Artificial sequence
  SiRNA target sequence
taccaccgatggtgtagttctacc

SEQ ID NO: 29271 - DNA, 24 bp, Artificial sequence
  SiRNA target sequence
accaccgatggtgtagttctacca

SEQ ID NO: 29272 - DNA, 24 bp, Artificial sequence
  SiRNA target sequence
ccaccgatggtgtagttctaccac

SEQ ID NO: 29273 - DNA, 24 bp, Artificial sequence
  SiRNA target sequence
caccgatggtgtagttctaccacc

SEQ ID NO: 29274 - DNA, 24 bp, Artificial sequence
  SiRNA target sequence
accgatggtgtagttctaccacct

SEQ ID NO: 29275 - DNA, 24 bp, Artificial sequence
  SiRNA target sequence
ccgatggtgtagttctaccacctt

SEQ ID NO: 29276 - DNA, 24 bp, Artificial sequence
  SiRNA target sequence
cgatggtgtagttctaccaccttc

SEQ ID NO: 29277 - DNA, 24 bp, Artificial sequence
  SiRNA target sequence
gatggtgtagttctaccaccttct

SEQ ID NO: 29278 - DNA, 24 bp, Artificial sequence
  SiRNA target sequence
atggtgtagttctaccaccttctt

SEQ ID NO: 29279 - DNA, 24 bp, Artificial sequence
  SiRNA target sequence
tggtgtagttctaccaccttcttc

SEQ ID NO: 29280 - DNA, 24 bp, Artificial sequence
  SiRNA target sequence
ggtgtagttctaccaccttcttcg

SEQ ID NO: 29281 - DNA, 24 bp, Artificial sequence
  SiRNA target sequence
gtgtagttctaccaccttcttcgt

SEQ ID NO: 29282 - DNA, 24 bp, Artificial sequence
  SiRNA target sequence
tgtagttctaccaccttcttcgtt

SEQ ID NO: 29283 - DNA, 24 bp, Artificial sequence
  SiRNA target sequence
gtagttctaccaccttcttcgttt

SEQ ID NO: 29284 - DNA, 24 bp, Artificial sequence
  SiRNA target sequence
tagttctaccaccttcttcgtttt

SEQ ID NO: 29285 - DNA, 24 bp, Artificial sequence
  SiRNA target sequence
agttctaccaccttcttcgttttc

SEQ ID NO: 29286 - DNA, 24 bp, Artificial sequence
  SiRNA target sequence
gttctaccaccttcttcgttttca

SEQ ID NO: 29287 - DNA, 24 bp, Artificial sequence
  SiRNA target sequence
ttctaccaccttcttcgttttcaa

SEQ ID NO: 29288 - DNA, 24 bp, Artificial sequence
  SiRNA target sequence
tctaccaccttcttcgttttcaat

SEQ ID NO: 29289 - DNA, 24 bp, Artificial sequence
  SiRNA target sequence
ctaccaccttcttcgttttcaata

SEQ ID NO: 29290 - DNA, 24 bp, Artificial sequence
  SiRNA target sequence
taccaccttcttcgttttcaataa

SEQ ID NO: 29291 - DNA, 24 bp, Artificial sequence
  SiRNA target sequence
accaccttcttcgttttcaataat

SEQ ID NO: 29292 - DNA, 24 bp, Artificial sequence
  SiRNA target sequence
ccaccttcttcgttttcaataatt

SEQ ID NO: 29293 - DNA, 24 bp, Artificial sequence
  SiRNA target sequence
caccttcttcgttttcaataattt

SEQ ID NO: 29294 - DNA, 24 bp, Artificial sequence
  SiRNA target sequence
accttcttcgttttcaataatttg

SEQ ID NO: 29295 - DNA, 24 bp, Artificial sequence
  SiRNA target sequence
ccttcttcgttttcaataatttgt

SEQ ID NO: 29296 - DNA, 24 bp, Artificial sequence
  SiRNA target sequence
cttcttcgttttcaataatttgtg

SEQ ID NO: 29297 - DNA, 24 bp, Artificial sequence
  SiRNA target sequence
ttcttcgttttcaataatttgtgg

SEQ ID NO: 29298 - DNA, 24 bp, Artificial sequence
  SiRNA target sequence
tcttcgttttcaataatttgtggg

SEQ ID NO: 29299 - DNA, 24 bp, Artificial sequence
  SiRNA target sequence
cttcgttttcaataatttgtggga

SEQ ID NO: 29300 - DNA, 24 bp, Artificial sequence
  SiRNA target sequence
ttcgttttcaataatttgtgggat

SEQ ID NO: 29301 - DNA, 24 bp, Artificial sequence
  SiRNA target sequence
tcgttttcaataatttgtgggata

SEQ ID NO: 29302 - DNA, 24 bp, Artificial sequence
  SiRNA target sequence
cgttttcaataatttgtgggatat

SEQ ID NO: 29303 - DNA, 24 bp, Artificial sequence
  SiRNA target sequence
gttttcaataatttgtgggatatt

SEQ ID NO: 29304 - DNA, 24 bp, Artificial sequence
  SiRNA target sequence
ttttcaataatttgtgggatattg

SEQ ID NO: 29305 - DNA, 24 bp, Artificial sequence
  SiRNA target sequence
tttcaataatttgtgggatattgt

SEQ ID NO: 29306 - DNA, 24 bp, Artificial sequence
  SiRNA target sequence
ttcaataatttgtgggatattgtt

SEQ ID NO: 29307 - DNA, 24 bp, Artificial sequence
  SiRNA target sequence
tcaataatttgtgggatattgtta

SEQ ID NO: 29308 - DNA, 24 bp, Artificial sequence
  SiRNA target sequence
caataatttgtgggatattgttat

SEQ ID NO: 29309 - DNA, 24 bp, Artificial sequence
  SiRNA target sequence
aataatttgtgggatattgttatg

SEQ ID NO: 29310 - DNA, 24 bp, Artificial sequence
  SiRNA target sequence
ataatttgtgggatattgttatgt

SEQ ID NO: 29311 - DNA, 24 bp, Artificial sequence
  SiRNA target sequence
taatttgtgggatattgttatgta

SEQ ID NO: 29312 - DNA, 24 bp, Artificial sequence
  SiRNA target sequence
aatttgtgggatattgttatgtat

SEQ ID NO: 29313 - DNA, 24 bp, Artificial sequence
  SiRNA target sequence
atttgtgggatattgttatgtata

SEQ ID NO: 29314 - DNA, 24 bp, Artificial sequence
  SiRNA target sequence
tttgtgggatattgttatgtataa

SEQ ID NO: 29315 - DNA, 24 bp, Artificial sequence
  SiRNA target sequence
ttgtgggatattgttatgtataag

SEQ ID NO: 29316 - DNA, 24 bp, Artificial sequence
  SiRNA target sequence
tgtgggatattgttatgtataaga

SEQ ID NO: 29317 - DNA, 24 bp, Artificial sequence
  SiRNA target sequence
gtgggatattgttatgtataagag

SEQ ID NO: 29318 - DNA, 24 bp, Artificial sequence
  SiRNA target sequence
tgggatattgttatgtataagaga

SEQ ID NO: 29319 - DNA, 24 bp, Artificial sequence
  SiRNA target sequence
gggatattgttatgtataagagac

SEQ ID NO: 29320 - DNA, 24 bp, Artificial sequence
  SiRNA target sequence
ggatattgttatgtataagagaca

SEQ ID NO: 29321 - DNA, 24 bp, Artificial sequence
  SiRNA target sequence
gatattgttatgtataagagacac

SEQ ID NO: 29322 - DNA, 24 bp, Artificial sequence
  SiRNA target sequence
atattgttatgtataagagacaca

SEQ ID NO: 29323 - DNA, 24 bp, Artificial sequence
  SiRNA target sequence
tattgttatgtataagagacacac

SEQ ID NO: 29324 - DNA, 24 bp, Artificial sequence
  SiRNA target sequence
attgttatgtataagagacacaca

SEQ ID NO: 29325 - DNA, 24 bp, Artificial sequence
  SiRNA target sequence
ttgttatgtataagagacacacaa

SEQ ID NO: 29326 - DNA, 24 bp, Artificial sequence
  SiRNA target sequence
tgttatgtataagagacacacaag

SEQ ID NO: 29327 - DNA, 24 bp, Artificial sequence
  SiRNA target sequence
gttatgtataagagacacacaaga

SEQ ID NO: 29328 - DNA, 24 bp, Artificial sequence
  SiRNA target sequence
ttatgtataagagacacacaagaa

SEQ ID NO: 29329 - DNA, 24 bp, Artificial sequence
  SiRNA target sequence
tatgtataagagacacacaagaat

SEQ ID NO: 29330 - DNA, 24 bp, Artificial sequence
  SiRNA target sequence
atgtataagagacacacaagaatt

SEQ ID NO: 29331 - DNA, 24 bp, Artificial sequence
  SiRNA target sequence
tgtataagagacacacaagaattg

SEQ ID NO: 29332 - DNA, 24 bp, Artificial sequence
  SiRNA target sequence
gtataagagacacacaagaattgg

SEQ ID NO: 29333 - DNA, 24 bp, Artificial sequence
  SiRNA target sequence
tataagagacacacaagaattggt

SEQ ID NO: 29334 - DNA, 24 bp, Artificial sequence
  SiRNA target sequence
ataagagacacacaagaattggtt

SEQ ID NO: 29335 - DNA, 24 bp, Artificial sequence
  SiRNA target sequence
taagagacacacaagaattggttg

SEQ ID NO: 29336 - DNA, 24 bp, Artificial sequence
  SiRNA target sequence
aagagacacacaagaattggttgt

SEQ ID NO: 29337 - DNA, 24 bp, Artificial sequence
  SiRNA target sequence
agagacacacaagaattggttgtt

SEQ ID NO: 29338 - DNA, 24 bp, Artificial sequence
  SiRNA target sequence
gagacacacaagaattggttgttc

SEQ ID NO: 29339 - DNA, 24 bp, Artificial sequence
  SiRNA target sequence
agacacacaagaattggttgttcc

SEQ ID NO: 29340 - DNA, 24 bp, Artificial sequence
  SiRNA target sequence
gacacacaagaattggttgttcct

SEQ ID NO: 29341 - DNA, 24 bp, Artificial sequence
  SiRNA target sequence
acacacaagaattggttgttccta

SEQ ID NO: 29342 - DNA, 24 bp, Artificial sequence
  SiRNA target sequence
cacacaagaattggttgttcctag

SEQ ID NO: 29343 - DNA, 24 bp, Artificial sequence
  SiRNA target sequence
acacaagaattggttgttcctaga

SEQ ID NO: 29344 - DNA, 24 bp, Artificial sequence
  SiRNA target sequence
cacaagaattggttgttcctagat

SEQ ID NO: 29345 - DNA, 24 bp, Artificial sequence
  SiRNA target sequence
acaagaattggttgttcctagatc

SEQ ID NO: 29346 - DNA, 24 bp, Artificial sequence
  SiRNA target sequence
caagaattggttgttcctagatca

SEQ ID NO: 29347 - DNA, 24 bp, Artificial sequence
  SiRNA target sequence
aagaattggttgttcctagatcaa

SEQ ID NO: 29348 - DNA, 24 bp, Artificial sequence
  SiRNA target sequence
agaattggttgttcctagatcaat

SEQ ID NO: 29349 - DNA, 24 bp, Artificial sequence
  SiRNA target sequence
gaattggttgttcctagatcaatt

SEQ ID NO: 29350 - DNA, 24 bp, Artificial sequence
  SiRNA target sequence
aattggttgttcctagatcaattc

SEQ ID NO: 29351 - DNA, 24 bp, Artificial sequence
  SiRNA target sequence
attggttgttcctagatcaattcc

SEQ ID NO: 29352 - DNA, 24 bp, Artificial sequence
  SiRNA target sequence
ttggttgttcctagatcaattcct

SEQ ID NO: 29353 - DNA, 24 bp, Artificial sequence
  SiRNA target sequence
tggttgttcctagatcaattccta

SEQ ID NO: 29354 - DNA, 24 bp, Artificial sequence
  SiRNA target sequence
ggttgttcctagatcaattcctat

SEQ ID NO: 29355 - DNA, 24 bp, Artificial sequence
  SiRNA target sequence
gttgttcctagatcaattcctatt

SEQ ID NO: 29356 - DNA, 24 bp, Artificial sequence
  SiRNA target sequence
ttgttcctagatcaattcctatta

SEQ ID NO: 29357 - DNA, 24 bp, Artificial sequence
  SiRNA target sequence
tgttcctagatcaattcctattat

SEQ ID NO: 29358 - DNA, 24 bp, Artificial sequence
  SiRNA target sequence
gttcctagatcaattcctattatt

SEQ ID NO: 29359 - DNA, 24 bp, Artificial sequence
  SiRNA target sequence
ttcctagatcaattcctattattt

SEQ ID NO: 29360 - DNA, 24 bp, Artificial sequence
  SiRNA target sequence
tcctagatcaattcctattatttt

SEQ ID NO: 29361 - DNA, 24 bp, Artificial sequence
  SiRNA target sequence
cctagatcaattcctattatttta

SEQ ID NO: 29362 - DNA, 24 bp, Artificial sequence
  SiRNA target sequence
ctagatcaattcctattattttag

SEQ ID NO: 29363 - DNA, 24 bp, Artificial sequence
  SiRNA target sequence
tagatcaattcctattattttaga

SEQ ID NO: 29364 - DNA, 24 bp, Artificial sequence
  SiRNA target sequence
agatcaattcctattattttagag

SEQ ID NO: 29365 - DNA, 24 bp, Artificial sequence
  SiRNA target sequence
gatcaattcctattattttagagc

SEQ ID NO: 29366 - DNA, 24 bp, Artificial sequence
  SiRNA target sequence
atcaattcctattattttagagct

SEQ ID NO: 29367 - DNA, 24 bp, Artificial sequence
  SiRNA target sequence
tcaattcctattattttagagcta

SEQ ID NO: 29368 - DNA, 24 bp, Artificial sequence
  SiRNA target sequence
caattcctattattttagagctaa

SEQ ID NO: 29369 - DNA, 24 bp, Artificial sequence
  SiRNA target sequence
aattcctattattttagagctaat

SEQ ID NO: 29370 - DNA, 24 bp, Artificial sequence
  SiRNA target sequence
attcctattattttagagctaatt

SEQ ID NO: 29371 - DNA, 24 bp, Artificial sequence
  SiRNA target sequence
ttcctattattttagagctaattt

SEQ ID NO: 29372 - DNA, 24 bp, Artificial sequence
  SiRNA target sequence
tcctattattttagagctaatttc

SEQ ID NO: 29373 - DNA, 24 bp, Artificial sequence
  SiRNA target sequence
cctattattttagagctaatttct

SEQ ID NO: 29374 - DNA, 24 bp, Artificial sequence
  SiRNA target sequence
ctattattttagagctaatttctt

SEQ ID NO: 29375 - DNA, 24 bp, Artificial sequence
  SiRNA target sequence
tattattttagagctaatttcttc

SEQ ID NO: 29376 - DNA, 24 bp, Artificial sequence
  SiRNA target sequence
attattttagagctaatttcttct

SEQ ID NO: 29377 - DNA, 24 bp, Artificial sequence
  SiRNA target sequence
ttattttagagctaatttcttctt

SEQ ID NO: 29378 - DNA, 24 bp, Artificial sequence
  SiRNA target sequence
tattttagagctaatttcttcttt

SEQ ID NO: 29379 - DNA, 24 bp, Artificial sequence
  SiRNA target sequence
attttagagctaatttcttcttta

SEQ ID NO: 29380 - DNA, 24 bp, Artificial sequence
  SiRNA target sequence
ttttagagctaatttcttctttag

SEQ ID NO: 29381 - DNA, 24 bp, Artificial sequence
  SiRNA target sequence
tttagagctaatttcttctttaga

SEQ ID NO: 29382 - DNA, 24 bp, Artificial sequence
  SiRNA target sequence
ttagagctaatttcttctttagac

SEQ ID NO: 29383 - DNA, 24 bp, Artificial sequence
  SiRNA target sequence
tagagctaatttcttctttagaca

SEQ ID NO: 29384 - DNA, 24 bp, Artificial sequence
  SiRNA target sequence
agagctaatttcttctttagacat

SEQ ID NO: 29385 - DNA, 25 bp, Artificial sequence
  SiRNA target sequence
ttaagaatttttcaatatttttttt

SEQ ID NO: 29386 - DNA, 25 bp, Artificial sequence
  SiRNA target sequence
taagaatttttcaatattttttttg

SEQ ID NO: 29387 - DNA, 25 bp, Artificial sequence
  SiRNA target sequence
aagaatttttcaatattttttttgc

SEQ ID NO: 29388 - DNA, 25 bp, Artificial sequence
  SiRNA target sequence
agaatttttcaatattttttttgct

SEQ ID NO: 29389 - DNA, 25 bp, Artificial sequence
  SiRNA target sequence
gaatttttcaatattttttttgctt

SEQ ID NO: 29390 - DNA, 25 bp, Artificial sequence
  SiRNA target sequence
aatttttcaatattttttttgcttg

SEQ ID NO: 29391 - DNA, 25 bp, Artificial sequence
  SiRNA target sequence
atttttcaatattttttttgcttgt

SEQ ID NO: 29392 - DNA, 25 bp, Artificial sequence
  SiRNA target sequence
tttttcaatattttttttgcttgtt

SEQ ID NO: 29393 - DNA, 25 bp, Artificial sequence
  SiRNA target sequence
ttttcaatattttttttgcttgttc

SEQ ID NO: 29394 - DNA, 25 bp, Artificial sequence
  SiRNA target sequence
tttcaatattttttttgcttgttct

SEQ ID NO: 29395 - DNA, 25 bp, Artificial sequence
  SiRNA target sequence
ttcaatattttttttgcttgttcta

SEQ ID NO: 29396 - DNA, 25 bp, Artificial sequence
  SiRNA target sequence
tcaatattttttttgcttgttctaa

SEQ ID NO: 29397 - DNA, 25 bp, Artificial sequence
  SiRNA target sequence
caatattttttttgcttgttctaag

SEQ ID NO: 29398 - DNA, 25 bp, Artificial sequence
  SiRNA target sequence
aatattttttttgcttgttctaagt

SEQ ID NO: 29399 - DNA, 25 bp, Artificial sequence
  SiRNA target sequence
atattttttttgcttgttctaagtc

SEQ ID NO: 29400 - DNA, 25 bp, Artificial sequence
  SiRNA target sequence
tattttttttgcttgttctaagtca

SEQ ID NO: 29401 - DNA, 25 bp, Artificial sequence
  SiRNA target sequence
attttttttgcttgttctaagtcat

SEQ ID NO: 29402 - DNA, 25 bp, Artificial sequence
  SiRNA target sequence
ttttttttgcttgttctaagtcata

SEQ ID NO: 29403 - DNA, 25 bp, Artificial sequence
  SiRNA target sequence
tttttttgcttgttctaagtcataa

SEQ ID NO: 29404 - DNA, 25 bp, Artificial sequence
  SiRNA target sequence
ttttttgcttgttctaagtcataaa

SEQ ID NO: 29405 - DNA, 25 bp, Artificial sequence
  SiRNA target sequence
tttttgcttgttctaagtcataaat

SEQ ID NO: 29406 - DNA, 25 bp, Artificial sequence
  SiRNA target sequence
ttttgcttgttctaagtcataaatt

SEQ ID NO: 29407 - DNA, 25 bp, Artificial sequence
  SiRNA target sequence
tttgcttgttctaagtcataaattt

SEQ ID NO: 29408 - DNA, 25 bp, Artificial sequence
  SiRNA target sequence
ttgcttgttctaagtcataaatttt

SEQ ID NO: 29409 - DNA, 25 bp, Artificial sequence
  SiRNA target sequence
tgcttgttctaagtcataaattttt

SEQ ID NO: 29410 - DNA, 25 bp, Artificial sequence
  SiRNA target sequence
gcttgttctaagtcataaatttttt

SEQ ID NO: 29411 - DNA, 25 bp, Artificial sequence
  SiRNA target sequence
cttgttctaagtcataaattttttt

SEQ ID NO: 29412 - DNA, 25 bp, Artificial sequence
  SiRNA target sequence
ttgttctaagtcataaattttttta

SEQ ID NO: 29413 - DNA, 25 bp, Artificial sequence
  SiRNA target sequence
tgttctaagtcataaatttttttag

SEQ ID NO: 29414 - DNA, 25 bp, Artificial sequence
  SiRNA target sequence
gttctaagtcataaatttttttagt

SEQ ID NO: 29415 - DNA, 25 bp, Artificial sequence
  SiRNA target sequence
ttctaagtcataaatttttttagtc

SEQ ID NO: 29416 - DNA, 25 bp, Artificial sequence
  SiRNA target sequence
tctaagtcataaatttttttagtca

SEQ ID NO: 29417 - DNA, 25 bp, Artificial sequence
  SiRNA target sequence
ctaagtcataaatttttttagtcaa

SEQ ID NO: 29418 - DNA, 25 bp, Artificial sequence
  SiRNA target sequence
taagtcataaatttttttagtcaaa

SEQ ID NO: 29419 - DNA, 25 bp, Artificial sequence
  SiRNA target sequence
aagtcataaatttttttagtcaaat

SEQ ID NO: 29420 - DNA, 25 bp, Artificial sequence
  SiRNA target sequence
agtcataaatttttttagtcaaata

SEQ ID NO: 29421 - DNA, 25 bp, Artificial sequence
  SiRNA target sequence
gtcataaatttttttagtcaaatat

SEQ ID NO: 29422 - DNA, 25 bp, Artificial sequence
  SiRNA target sequence
tcataaatttttttagtcaaatatg

SEQ ID NO: 29423 - DNA, 25 bp, Artificial sequence
  SiRNA target sequence
cataaatttttttagtcaaatatga

SEQ ID NO: 29424 - DNA, 25 bp, Artificial sequence
  SiRNA target sequence
ataaatttttttagtcaaatatgac

SEQ ID NO: 29425 - DNA, 25 bp, Artificial sequence
  SiRNA target sequence
taaatttttttagtcaaatatgact

SEQ ID NO: 29426 - DNA, 25 bp, Artificial sequence
  SiRNA target sequence
aaatttttttagtcaaatatgactt

SEQ ID NO: 29427 - DNA, 25 bp, Artificial sequence
  SiRNA target sequence
aatttttttagtcaaatatgacttt

SEQ ID NO: 29428 - DNA, 25 bp, Artificial sequence
  SiRNA target sequence
atttttttagtcaaatatgacttta

SEQ ID NO: 29429 - DNA, 25 bp, Artificial sequence
  SiRNA target sequence
tttttttagtcaaatatgactttaa

SEQ ID NO: 29430 - DNA, 25 bp, Artificial sequence
  SiRNA target sequence
ttttttagtcaaatatgactttaaa

SEQ ID NO: 29431 - DNA, 25 bp, Artificial sequence
  SiRNA target sequence
tttttagtcaaatatgactttaaaa

SEQ ID NO: 29432 - DNA, 25 bp, Artificial sequence
  SiRNA target sequence
ttttagtcaaatatgactttaaaat

SEQ ID NO: 29433 - DNA, 25 bp, Artificial sequence
  SiRNA target sequence
tttagtcaaatatgactttaaaatc

SEQ ID NO: 29434 - DNA, 25 bp, Artificial sequence
  SiRNA target sequence
ttagtcaaatatgactttaaaatct

SEQ ID NO: 29435 - DNA, 25 bp, Artificial sequence
  SiRNA target sequence
tagtcaaatatgactttaaaatctc

SEQ ID NO: 29436 - DNA, 25 bp, Artificial sequence
  SiRNA target sequence
agtcaaatatgactttaaaatctct

SEQ ID NO: 29437 - DNA, 25 bp, Artificial sequence
  SiRNA target sequence
gtcaaatatgactttaaaatctctt

SEQ ID NO: 29438 - DNA, 25 bp, Artificial sequence
  SiRNA target sequence
tcaaatatgactttaaaatctcttt

SEQ ID NO: 29439 - DNA, 25 bp, Artificial sequence
  SiRNA target sequence
caaatatgactttaaaatctctttt

SEQ ID NO: 29440 - DNA, 25 bp, Artificial sequence
  SiRNA target sequence
aaatatgactttaaaatctcttttg

SEQ ID NO: 29441 - DNA, 25 bp, Artificial sequence
  SiRNA target sequence
aatatgactttaaaatctcttttgt

SEQ ID NO: 29442 - DNA, 25 bp, Artificial sequence
  SiRNA target sequence
atatgactttaaaatctcttttgtt

SEQ ID NO: 29443 - DNA, 25 bp, Artificial sequence
  SiRNA target sequence
tatgactttaaaatctcttttgttt

SEQ ID NO: 29444 - DNA, 25 bp, Artificial sequence
  SiRNA target sequence
atgactttaaaatctcttttgtttc

SEQ ID NO: 29445 - DNA, 25 bp, Artificial sequence
  SiRNA target sequence
tgactttaaaatctcttttgtttca

SEQ ID NO: 29446 - DNA, 25 bp, Artificial sequence
  SiRNA target sequence
gactttaaaatctcttttgtttcat

SEQ ID NO: 29447 - DNA, 25 bp, Artificial sequence
  SiRNA target sequence
actttaaaatctcttttgtttcatc

SEQ ID NO: 29448 - DNA, 25 bp, Artificial sequence
  SiRNA target sequence
ctttaaaatctcttttgtttcatct

SEQ ID NO: 29449 - DNA, 25 bp, Artificial sequence
  SiRNA target sequence
tttaaaatctcttttgtttcatctg

SEQ ID NO: 29450 - DNA, 25 bp, Artificial sequence
  SiRNA target sequence
ttaaaatctcttttgtttcatctgt

SEQ ID NO: 29451 - DNA, 25 bp, Artificial sequence
  SiRNA target sequence
taaaatctcttttgtttcatctgtt

SEQ ID NO: 29452 - DNA, 25 bp, Artificial sequence
  SiRNA target sequence
aaaatctcttttgtttcatctgtta

SEQ ID NO: 29453 - DNA, 25 bp, Artificial sequence
  SiRNA target sequence
aaatctcttttgtttcatctgttac

SEQ ID NO: 29454 - DNA, 25 bp, Artificial sequence
  SiRNA target sequence
aatctcttttgtttcatctgttact

SEQ ID NO: 29455 - DNA, 25 bp, Artificial sequence
  SiRNA target sequence
atctcttttgtttcatctgttactt

SEQ ID NO: 29456 - DNA, 25 bp, Artificial sequence
  SiRNA target sequence
tctcttttgtttcatctgttacttg

SEQ ID NO: 29457 - DNA, 25 bp, Artificial sequence
  SiRNA target sequence
ctcttttgtttcatctgttacttgt

SEQ ID NO: 29458 - DNA, 25 bp, Artificial sequence
  SiRNA target sequence
tcttttgtttcatctgttacttgtt

SEQ ID NO: 29459 - DNA, 25 bp, Artificial sequence
  SiRNA target sequence
cttttgtttcatctgttacttgttt

SEQ ID NO: 29460 - DNA, 25 bp, Artificial sequence
  SiRNA target sequence
ttttgtttcatctgttacttgtttg

SEQ ID NO: 29461 - DNA, 25 bp, Artificial sequence
  SiRNA target sequence
tttgtttcatctgttacttgtttgt

SEQ ID NO: 29462 - DNA, 25 bp, Artificial sequence
  SiRNA target sequence
ttgtttcatctgttacttgtttgta

SEQ ID NO: 29463 - DNA, 25 bp, Artificial sequence
  SiRNA target sequence
tgtttcatctgttacttgtttgtac

SEQ ID NO: 29464 - DNA, 25 bp, Artificial sequence
  SiRNA target sequence
gtttcatctgttacttgtttgtact

SEQ ID NO: 29465 - DNA, 25 bp, Artificial sequence
  SiRNA target sequence
tttcatctgttacttgtttgtactt

SEQ ID NO: 29466 - DNA, 25 bp, Artificial sequence
  SiRNA target sequence
ttcatctgttacttgtttgtacttt

SEQ ID NO: 29467 - DNA, 25 bp, Artificial sequence
  SiRNA target sequence
tcatctgttacttgtttgtacttta

SEQ ID NO: 29468 - DNA, 25 bp, Artificial sequence
  SiRNA target sequence
catctgttacttgtttgtactttaa

SEQ ID NO: 29469 - DNA, 25 bp, Artificial sequence
  SiRNA target sequence
atctgttacttgtttgtactttaaa

SEQ ID NO: 29470 - DNA, 25 bp, Artificial sequence
  SiRNA target sequence
tctgttacttgtttgtactttaaaa

SEQ ID NO: 29471 - DNA, 25 bp, Artificial sequence
  SiRNA target sequence
ctgttacttgtttgtactttaaaaa

SEQ ID NO: 29472 - DNA, 25 bp, Artificial sequence
  SiRNA target sequence
tgttacttgtttgtactttaaaaat

SEQ ID NO: 29473 - DNA, 25 bp, Artificial sequence
  SiRNA target sequence
gttacttgtttgtactttaaaaatt

SEQ ID NO: 29474 - DNA, 25 bp, Artificial sequence
  SiRNA target sequence
ttacttgtttgtactttaaaaattg

SEQ ID NO: 29475 - DNA, 25 bp, Artificial sequence
  SiRNA target sequence
tacttgtttgtactttaaaaattgt

SEQ ID NO: 29476 - DNA, 25 bp, Artificial sequence
  SiRNA target sequence
acttgtttgtactttaaaaattgtt

SEQ ID NO: 29477 - DNA, 25 bp, Artificial sequence
  SiRNA target sequence
cttgtttgtactttaaaaattgttg

SEQ ID NO: 29478 - DNA, 25 bp, Artificial sequence
  SiRNA target sequence
ttgtttgtactttaaaaattgttga

SEQ ID NO: 29479 - DNA, 25 bp, Artificial sequence
  SiRNA target sequence
tgtttgtactttaaaaattgttgaa

SEQ ID NO: 29480 - DNA, 25 bp, Artificial sequence
  SiRNA target sequence
gtttgtactttaaaaattgttgaat

SEQ ID NO: 29481 - DNA, 25 bp, Artificial sequence
  SiRNA target sequence
tttgtactttaaaaattgttgaatt

SEQ ID NO: 29482 - DNA, 25 bp, Artificial sequence
  SiRNA target sequence
ttgtactttaaaaattgttgaattt

SEQ ID NO: 29483 - DNA, 25 bp, Artificial sequence
  SiRNA target sequence
tgtactttaaaaattgttgaatttc

SEQ ID NO: 29484 - DNA, 25 bp, Artificial sequence
  SiRNA target sequence
gtactttaaaaattgttgaatttca

SEQ ID NO: 29485 - DNA, 25 bp, Artificial sequence
  SiRNA target sequence
tactttaaaaattgttgaatttcaa

SEQ ID NO: 29486 - DNA, 25 bp, Artificial sequence
  SiRNA target sequence
actttaaaaattgttgaatttcaat

SEQ ID NO: 29487 - DNA, 25 bp, Artificial sequence
  SiRNA target sequence
ctttaaaaattgttgaatttcaatt

SEQ ID NO: 29488 - DNA, 25 bp, Artificial sequence
  SiRNA target sequence
tttaaaaattgttgaatttcaattt

SEQ ID NO: 29489 - DNA, 25 bp, Artificial sequence
  SiRNA target sequence
ttaaaaattgttgaatttcaatttt

SEQ ID NO: 29490 - DNA, 25 bp, Artificial sequence
  SiRNA target sequence
taaaaattgttgaatttcaatttta

SEQ ID NO: 29491 - DNA, 25 bp, Artificial sequence
  SiRNA target sequence
aaaaattgttgaatttcaattttaa

SEQ ID NO: 29492 - DNA, 25 bp, Artificial sequence
  SiRNA target sequence
aaaattgttgaatttcaattttaaa

SEQ ID NO: 29493 - DNA, 25 bp, Artificial sequence
  SiRNA target sequence
aaattgttgaatttcaattttaaat

SEQ ID NO: 29494 - DNA, 25 bp, Artificial sequence
  SiRNA target sequence
aattgttgaatttcaattttaaatt

SEQ ID NO: 29495 - DNA, 25 bp, Artificial sequence
  SiRNA target sequence
attgttgaatttcaattttaaattc

SEQ ID NO: 29496 - DNA, 25 bp, Artificial sequence
  SiRNA target sequence
ttgttgaatttcaattttaaattcg

SEQ ID NO: 29497 - DNA, 25 bp, Artificial sequence
  SiRNA target sequence
tgttgaatttcaattttaaattcgg

SEQ ID NO: 29498 - DNA, 25 bp, Artificial sequence
  SiRNA target sequence
gttgaatttcaattttaaattcggc

SEQ ID NO: 29499 - DNA, 25 bp, Artificial sequence
  SiRNA target sequence
ttgaatttcaattttaaattcggca

SEQ ID NO: 29500 - DNA, 25 bp, Artificial sequence
  SiRNA target sequence
tgaatttcaattttaaattcggcac

SEQ ID NO: 29501 - DNA, 25 bp, Artificial sequence
  SiRNA target sequence
gaatttcaattttaaattcggcaca

SEQ ID NO: 29502 - DNA, 25 bp, Artificial sequence
  SiRNA target sequence
aatttcaattttaaattcggcacaa

SEQ ID NO: 29503 - DNA, 25 bp, Artificial sequence
  SiRNA target sequence
atttcaattttaaattcggcacaat

SEQ ID NO: 29504 - DNA, 25 bp, Artificial sequence
  SiRNA target sequence
tttcaattttaaattcggcacaatt

SEQ ID NO: 29505 - DNA, 25 bp, Artificial sequence
  SiRNA target sequence
ttcaattttaaattcggcacaattt

SEQ ID NO: 29506 - DNA, 25 bp, Artificial sequence
  SiRNA target sequence
tcaattttaaattcggcacaatttt

SEQ ID NO: 29507 - DNA, 25 bp, Artificial sequence
  SiRNA target sequence
caattttaaattcggcacaattttt

SEQ ID NO: 29508 - DNA, 25 bp, Artificial sequence
  SiRNA target sequence
aattttaaattcggcacaatttttt

SEQ ID NO: 29509 - DNA, 25 bp, Artificial sequence
  SiRNA target sequence
attttaaattcggcacaattttttt

SEQ ID NO: 29510 - DNA, 25 bp, Artificial sequence
  SiRNA target sequence
ttttaaattcggcacaatttttttc

SEQ ID NO: 29511 - DNA, 25 bp, Artificial sequence
  SiRNA target sequence
tttaaattcggcacaatttttttca

SEQ ID NO: 29512 - DNA, 25 bp, Artificial sequence
  SiRNA target sequence
ttaaattcggcacaatttttttcaa

SEQ ID NO: 29513 - DNA, 25 bp, Artificial sequence
  SiRNA target sequence
taaattcggcacaatttttttcaat

SEQ ID NO: 29514 - DNA, 25 bp, Artificial sequence
  SiRNA target sequence
aaattcggcacaatttttttcaatt

SEQ ID NO: 29515 - DNA, 25 bp, Artificial sequence
  SiRNA target sequence
aattcggcacaatttttttcaattt

SEQ ID NO: 29516 - DNA, 25 bp, Artificial sequence
  SiRNA target sequence
attcggcacaatttttttcaatttc

SEQ ID NO: 29517 - DNA, 25 bp, Artificial sequence
  SiRNA target sequence
ttcggcacaatttttttcaatttca

SEQ ID NO: 29518 - DNA, 25 bp, Artificial sequence
  SiRNA target sequence
tcggcacaatttttttcaatttcat

SEQ ID NO: 29519 - DNA, 25 bp, Artificial sequence
  SiRNA target sequence
cggcacaatttttttcaatttcatc

SEQ ID NO: 29520 - DNA, 25 bp, Artificial sequence
  SiRNA target sequence
ggcacaatttttttcaatttcatct

SEQ ID NO: 29521 - DNA, 25 bp, Artificial sequence
  SiRNA target sequence
gcacaatttttttcaatttcatctt

SEQ ID NO: 29522 - DNA, 25 bp, Artificial sequence
  SiRNA target sequence
cacaatttttttcaatttcatcttt

SEQ ID NO: 29523 - DNA, 25 bp, Artificial sequence
  SiRNA target sequence
acaatttttttcaatttcatctttt

SEQ ID NO: 29524 - DNA, 25 bp, Artificial sequence
  SiRNA target sequence
caatttttttcaatttcatcttttt

SEQ ID NO: 29525 - DNA, 25 bp, Artificial sequence
  SiRNA target sequence
aatttttttcaatttcatctttttt

SEQ ID NO: 29526 - DNA, 25 bp, Artificial sequence
  SiRNA target sequence
atttttttcaatttcatcttttttc

SEQ ID NO: 29527 - DNA, 25 bp, Artificial sequence
  SiRNA target sequence
tttttttcaatttcatcttttttcg

SEQ ID NO: 29528 - DNA, 25 bp, Artificial sequence
  SiRNA target sequence
ttttttcaatttcatcttttttcga

SEQ ID NO: 29529 - DNA, 25 bp, Artificial sequence
  SiRNA target sequence
tttttcaatttcatcttttttcgaa

SEQ ID NO: 29530 - DNA, 25 bp, Artificial sequence
  SiRNA target sequence
ttttcaatttcatcttttttcgaat

SEQ ID NO: 29531 - DNA, 25 bp, Artificial sequence
  SiRNA target sequence
tttcaatttcatcttttttcgaatt

SEQ ID NO: 29532 - DNA, 25 bp, Artificial sequence
  SiRNA target sequence
ttcaatttcatcttttttcgaattt

SEQ ID NO: 29533 - DNA, 25 bp, Artificial sequence
  SiRNA target sequence
tcaatttcatcttttttcgaatttt

SEQ ID NO: 29534 - DNA, 25 bp, Artificial sequence
  SiRNA target sequence
caatttcatcttttttcgaattttc

SEQ ID NO: 29535 - DNA, 25 bp, Artificial sequence
  SiRNA target sequence
aatttcatcttttttcgaattttct

SEQ ID NO: 29536 - DNA, 25 bp, Artificial sequence
  SiRNA target sequence
atttcatcttttttcgaattttctt

SEQ ID NO: 29537 - DNA, 25 bp, Artificial sequence
  SiRNA target sequence
tttcatcttttttcgaattttcttc

SEQ ID NO: 29538 - DNA, 25 bp, Artificial sequence
  SiRNA target sequence
ttcatcttttttcgaattttcttcg

SEQ ID NO: 29539 - DNA, 25 bp, Artificial sequence
  SiRNA target sequence
tcatcttttttcgaattttcttcgg

SEQ ID NO: 29540 - DNA, 25 bp, Artificial sequence
  SiRNA target sequence
catcttttttcgaattttcttcggc

SEQ ID NO: 29541 - DNA, 25 bp, Artificial sequence
  SiRNA target sequence
atcttttttcgaattttcttcggct

SEQ ID NO: 29542 - DNA, 25 bp, Artificial sequence
  SiRNA target sequence
tcttttttcgaattttcttcggctt

SEQ ID NO: 29543 - DNA, 25 bp, Artificial sequence
  SiRNA target sequence
cttttttcgaattttcttcggcttc

SEQ ID NO: 29544 - DNA, 25 bp, Artificial sequence
  SiRNA target sequence
ttttttcgaattttcttcggcttct

SEQ ID NO: 29545 - DNA, 25 bp, Artificial sequence
  SiRNA target sequence
tttttcgaattttcttcggcttctc

SEQ ID NO: 29546 - DNA, 25 bp, Artificial sequence
  SiRNA target sequence
ttttcgaattttcttcggcttctcg

SEQ ID NO: 29547 - DNA, 25 bp, Artificial sequence
  SiRNA target sequence
tttcgaattttcttcggcttctcgt

SEQ ID NO: 29548 - DNA, 25 bp, Artificial sequence
  SiRNA target sequence
ttcgaattttcttcggcttctcgta

SEQ ID NO: 29549 - DNA, 25 bp, Artificial sequence
  SiRNA target sequence
tcgaattttcttcggcttctcgtat

SEQ ID NO: 29550 - DNA, 25 bp, Artificial sequence
  SiRNA target sequence
cgaattttcttcggcttctcgtatc

SEQ ID NO: 29551 - DNA, 25 bp, Artificial sequence
  SiRNA target sequence
gaattttcttcggcttctcgtatca

SEQ ID NO: 29552 - DNA, 25 bp, Artificial sequence
  SiRNA target sequence
aattttcttcggcttctcgtatcat

SEQ ID NO: 29553 - DNA, 25 bp, Artificial sequence
  SiRNA target sequence
attttcttcggcttctcgtatcatt

SEQ ID NO: 29554 - DNA, 25 bp, Artificial sequence
  SiRNA target sequence
ttttcttcggcttctcgtatcattt

SEQ ID NO: 29555 - DNA, 25 bp, Artificial sequence
  SiRNA target sequence
tttcttcggcttctcgtatcatttg

SEQ ID NO: 29556 - DNA, 25 bp, Artificial sequence
  SiRNA target sequence
ttcttcggcttctcgtatcatttgc

SEQ ID NO: 29557 - DNA, 25 bp, Artificial sequence
  SiRNA target sequence
tcttcggcttctcgtatcatttgcg

SEQ ID NO: 29558 - DNA, 25 bp, Artificial sequence
  SiRNA target sequence
cttcggcttctcgtatcatttgcga

SEQ ID NO: 29559 - DNA, 25 bp, Artificial sequence
  SiRNA target sequence
ttcggcttctcgtatcatttgcgaa

SEQ ID NO: 29560 - DNA, 25 bp, Artificial sequence
  SiRNA target sequence
tcggcttctcgtatcatttgcgaaa

SEQ ID NO: 29561 - DNA, 25 bp, Artificial sequence
  SiRNA target sequence
cggcttctcgtatcatttgcgaaat

SEQ ID NO: 29562 - DNA, 25 bp, Artificial sequence
  SiRNA target sequence
ggcttctcgtatcatttgcgaaatt

SEQ ID NO: 29563 - DNA, 25 bp, Artificial sequence
  SiRNA target sequence
gcttctcgtatcatttgcgaaattt

SEQ ID NO: 29564 - DNA, 25 bp, Artificial sequence
  SiRNA target sequence
cttctcgtatcatttgcgaaatttc

SEQ ID NO: 29565 - DNA, 25 bp, Artificial sequence
  SiRNA target sequence
ttctcgtatcatttgcgaaatttca

SEQ ID NO: 29566 - DNA, 25 bp, Artificial sequence
  SiRNA target sequence
tctcgtatcatttgcgaaatttcac

SEQ ID NO: 29567 - DNA, 25 bp, Artificial sequence
  SiRNA target sequence
ctcgtatcatttgcgaaatttcacc

SEQ ID NO: 29568 - DNA, 25 bp, Artificial sequence
  SiRNA target sequence
tcgtatcatttgcgaaatttcacct

SEQ ID NO: 29569 - DNA, 25 bp, Artificial sequence
  SiRNA target sequence
cgtatcatttgcgaaatttcacctt

SEQ ID NO: 29570 - DNA, 25 bp, Artificial sequence
  SiRNA target sequence
gtatcatttgcgaaatttcaccttc

SEQ ID NO: 29571 - DNA, 25 bp, Artificial sequence
  SiRNA target sequence
tatcatttgcgaaatttcaccttca

SEQ ID NO: 29572 - DNA, 25 bp, Artificial sequence
  SiRNA target sequence
atcatttgcgaaatttcaccttcat

SEQ ID NO: 29573 - DNA, 25 bp, Artificial sequence
  SiRNA target sequence
tcatttgcgaaatttcaccttcatt

SEQ ID NO: 29574 - DNA, 25 bp, Artificial sequence
  SiRNA target sequence
catttgcgaaatttcaccttcattt

SEQ ID NO: 29575 - DNA, 25 bp, Artificial sequence
  SiRNA target sequence
atttgcgaaatttcaccttcattta

SEQ ID NO: 29576 - DNA, 25 bp, Artificial sequence
  SiRNA target sequence
tttgcgaaatttcaccttcatttaa

SEQ ID NO: 29577 - DNA, 25 bp, Artificial sequence
  SiRNA target sequence
ttgcgaaatttcaccttcatttaat

SEQ ID NO: 29578 - DNA, 25 bp, Artificial sequence
  SiRNA target sequence
tgcgaaatttcaccttcatttaatc

SEQ ID NO: 29579 - DNA, 25 bp, Artificial sequence
  SiRNA target sequence
gcgaaatttcaccttcatttaatcc

SEQ ID NO: 29580 - DNA, 25 bp, Artificial sequence
  SiRNA target sequence
cgaaatttcaccttcatttaatcca

SEQ ID NO: 29581 - DNA, 25 bp, Artificial sequence
  SiRNA target sequence
gaaatttcaccttcatttaatccac

SEQ ID NO: 29582 - DNA, 25 bp, Artificial sequence
  SiRNA target sequence
aaatttcaccttcatttaatccact

SEQ ID NO: 29583 - DNA, 25 bp, Artificial sequence
  SiRNA target sequence
aatttcaccttcatttaatccactt

SEQ ID NO: 29584 - DNA, 25 bp, Artificial sequence
  SiRNA target sequence
atttcaccttcatttaatccacttg

SEQ ID NO: 29585 - DNA, 25 bp, Artificial sequence
  SiRNA target sequence
tttcaccttcatttaatccacttga

SEQ ID NO: 29586 - DNA, 25 bp, Artificial sequence
  SiRNA target sequence
ttcaccttcatttaatccacttgaa

SEQ ID NO: 29587 - DNA, 25 bp, Artificial sequence
  SiRNA target sequence
tcaccttcatttaatccacttgaag

SEQ ID NO: 29588 - DNA, 25 bp, Artificial sequence
  SiRNA target sequence
caccttcatttaatccacttgaagg

SEQ ID NO: 29589 - DNA, 25 bp, Artificial sequence
  SiRNA target sequence
accttcatttaatccacttgaaggc

SEQ ID NO: 29590 - DNA, 25 bp, Artificial sequence
  SiRNA target sequence
ccttcatttaatccacttgaaggca

SEQ ID NO: 29591 - DNA, 25 bp, Artificial sequence
  SiRNA target sequence
cttcatttaatccacttgaaggcac

SEQ ID NO: 29592 - DNA, 25 bp, Artificial sequence
  SiRNA target sequence
ttcatttaatccacttgaaggcaca

SEQ ID NO: 29593 - DNA, 25 bp, Artificial sequence
  SiRNA target sequence
tcatttaatccacttgaaggcacaa

SEQ ID NO: 29594 - DNA, 25 bp, Artificial sequence
  SiRNA target sequence
catttaatccacttgaaggcacaat

SEQ ID NO: 29595 - DNA, 25 bp, Artificial sequence
  SiRNA target sequence
atttaatccacttgaaggcacaatt

SEQ ID NO: 29596 - DNA, 25 bp, Artificial sequence
  SiRNA target sequence
tttaatccacttgaaggcacaattt

SEQ ID NO: 29597 - DNA, 25 bp, Artificial sequence
  SiRNA target sequence
ttaatccacttgaaggcacaatttc

SEQ ID NO: 29598 - DNA, 25 bp, Artificial sequence
  SiRNA target sequence
taatccacttgaaggcacaatttcg

SEQ ID NO: 29599 - DNA, 25 bp, Artificial sequence
  SiRNA target sequence
aatccacttgaaggcacaatttcga

SEQ ID NO: 29600 - DNA, 25 bp, Artificial sequence
  SiRNA target sequence
atccacttgaaggcacaatttcgat

SEQ ID NO: 29601 - DNA, 25 bp, Artificial sequence
  SiRNA target sequence
tccacttgaaggcacaatttcgatt

SEQ ID NO: 29602 - DNA, 25 bp, Artificial sequence
  SiRNA target sequence
ccacttgaaggcacaatttcgattt

SEQ ID NO: 29603 - DNA, 25 bp, Artificial sequence
  SiRNA target sequence
cacttgaaggcacaatttcgatttc

SEQ ID NO: 29604 - DNA, 25 bp, Artificial sequence
  SiRNA target sequence
acttgaaggcacaatttcgatttct

SEQ ID NO: 29605 - DNA, 25 bp, Artificial sequence
  SiRNA target sequence
cttgaaggcacaatttcgatttctt

SEQ ID NO: 29606 - DNA, 25 bp, Artificial sequence
  SiRNA target sequence
ttgaaggcacaatttcgatttcttg

SEQ ID NO: 29607 - DNA, 25 bp, Artificial sequence
  SiRNA target sequence
tgaaggcacaatttcgatttcttgc

SEQ ID NO: 29608 - DNA, 25 bp, Artificial sequence
  SiRNA target sequence
gaaggcacaatttcgatttcttgct

SEQ ID NO: 29609 - DNA, 25 bp, Artificial sequence
  SiRNA target sequence
aaggcacaatttcgatttcttgctt

SEQ ID NO: 29610 - DNA, 25 bp, Artificial sequence
  SiRNA target sequence
aggcacaatttcgatttcttgcttt

SEQ ID NO: 29611 - DNA, 25 bp, Artificial sequence
  SiRNA target sequence
ggcacaatttcgatttcttgctttt

SEQ ID NO: 29612 - DNA, 25 bp, Artificial sequence
  SiRNA target sequence
gcacaatttcgatttcttgcttttt

SEQ ID NO: 29613 - DNA, 25 bp, Artificial sequence
  SiRNA target sequence
cacaatttcgatttcttgctttttt

SEQ ID NO: 29614 - DNA, 25 bp, Artificial sequence
  SiRNA target sequence
acaatttcgatttcttgcttttttt

SEQ ID NO: 29615 - DNA, 25 bp, Artificial sequence
  SiRNA target sequence
caatttcgatttcttgctttttttt

SEQ ID NO: 29616 - DNA, 25 bp, Artificial sequence
  SiRNA target sequence
aatttcgatttcttgcttttttttc

SEQ ID NO: 29617 - DNA, 25 bp, Artificial sequence
  SiRNA target sequence
atttcgatttcttgcttttttttcg

SEQ ID NO: 29618 - DNA, 25 bp, Artificial sequence
  SiRNA target sequence
tttcgatttcttgcttttttttcgt

SEQ ID NO: 29619 - DNA, 25 bp, Artificial sequence
  SiRNA target sequence
ttcgatttcttgcttttttttcgtt

SEQ ID NO: 29620 - DNA, 25 bp, Artificial sequence
  SiRNA target sequence
tcgatttcttgcttttttttcgtta

SEQ ID NO: 29621 - DNA, 25 bp, Artificial sequence
  SiRNA target sequence
cgatttcttgcttttttttcgttat

SEQ ID NO: 29622 - DNA, 25 bp, Artificial sequence
  SiRNA target sequence
gatttcttgcttttttttcgttatc

SEQ ID NO: 29623 - DNA, 25 bp, Artificial sequence
  SiRNA target sequence
atttcttgcttttttttcgttatcc

SEQ ID NO: 29624 - DNA, 25 bp, Artificial sequence
  SiRNA target sequence
tttcttgcttttttttcgttatccc

SEQ ID NO: 29625 - DNA, 25 bp, Artificial sequence
  SiRNA target sequence
ttcttgcttttttttcgttatcccg

SEQ ID NO: 29626 - DNA, 25 bp, Artificial sequence
  SiRNA target sequence
tcttgcttttttttcgttatcccgt

SEQ ID NO: 29627 - DNA, 25 bp, Artificial sequence
  SiRNA target sequence
cttgcttttttttcgttatcccgtc

SEQ ID NO: 29628 - DNA, 25 bp, Artificial sequence
  SiRNA target sequence
ttgcttttttttcgttatcccgtct

SEQ ID NO: 29629 - DNA, 25 bp, Artificial sequence
  SiRNA target sequence
tgcttttttttcgttatcccgtctt

SEQ ID NO: 29630 - DNA, 25 bp, Artificial sequence
  SiRNA target sequence
gcttttttttcgttatcccgtcttg

SEQ ID NO: 29631 - DNA, 25 bp, Artificial sequence
  SiRNA target sequence
cttttttttcgttatcccgtcttgc

SEQ ID NO: 29632 - DNA, 25 bp, Artificial sequence
  SiRNA target sequence
ttttttttcgttatcccgtcttgcg

SEQ ID NO: 29633 - DNA, 25 bp, Artificial sequence
  SiRNA target sequence
tttttttcgttatcccgtcttgcgc

SEQ ID NO: 29634 - DNA, 25 bp, Artificial sequence
  SiRNA target sequence
ttttttcgttatcccgtcttgcgca

SEQ ID NO: 29635 - DNA, 25 bp, Artificial sequence
  SiRNA target sequence
tttttcgttatcccgtcttgcgcag

SEQ ID NO: 29636 - DNA, 25 bp, Artificial sequence
  SiRNA target sequence
ttttcgttatcccgtcttgcgcaga

SEQ ID NO: 29637 - DNA, 25 bp, Artificial sequence
  SiRNA target sequence
tttcgttatcccgtcttgcgcagat

SEQ ID NO: 29638 - DNA, 25 bp, Artificial sequence
  SiRNA target sequence
ttcgttatcccgtcttgcgcagata

SEQ ID NO: 29639 - DNA, 25 bp, Artificial sequence
  SiRNA target sequence
tcgttatcccgtcttgcgcagatac

SEQ ID NO: 29640 - DNA, 25 bp, Artificial sequence
  SiRNA target sequence
cgttatcccgtcttgcgcagatact

SEQ ID NO: 29641 - DNA, 25 bp, Artificial sequence
  SiRNA target sequence
gttatcccgtcttgcgcagatactt

SEQ ID NO: 29642 - DNA, 25 bp, Artificial sequence
  SiRNA target sequence
ttatcccgtcttgcgcagatacttt

SEQ ID NO: 29643 - DNA, 25 bp, Artificial sequence
  SiRNA target sequence
tatcccgtcttgcgcagatactttg

SEQ ID NO: 29644 - DNA, 25 bp, Artificial sequence
  SiRNA target sequence
atcccgtcttgcgcagatactttgt

SEQ ID NO: 29645 - DNA, 25 bp, Artificial sequence
  SiRNA target sequence
tcccgtcttgcgcagatactttgta

SEQ ID NO: 29646 - DNA, 25 bp, Artificial sequence
  SiRNA target sequence
cccgtcttgcgcagatactttgtat

SEQ ID NO: 29647 - DNA, 25 bp, Artificial sequence
  SiRNA target sequence
ccgtcttgcgcagatactttgtata

SEQ ID NO: 29648 - DNA, 25 bp, Artificial sequence
  SiRNA target sequence
cgtcttgcgcagatactttgtatat

SEQ ID NO: 29649 - DNA, 25 bp, Artificial sequence
  SiRNA target sequence
gtcttgcgcagatactttgtatatt

SEQ ID NO: 29650 - DNA, 25 bp, Artificial sequence
  SiRNA target sequence
tcttgcgcagatactttgtatattc

SEQ ID NO: 29651 - DNA, 25 bp, Artificial sequence
  SiRNA target sequence
cttgcgcagatactttgtatattcc

SEQ ID NO: 29652 - DNA, 25 bp, Artificial sequence
  SiRNA target sequence
ttgcgcagatactttgtatattccg

SEQ ID NO: 29653 - DNA, 25 bp, Artificial sequence
  SiRNA target sequence
tgcgcagatactttgtatattccgt

SEQ ID NO: 29654 - DNA, 25 bp, Artificial sequence
  SiRNA target sequence
gcgcagatactttgtatattccgtt

SEQ ID NO: 29655 - DNA, 25 bp, Artificial sequence
  SiRNA target sequence
cgcagatactttgtatattccgtta

SEQ ID NO: 29656 - DNA, 25 bp, Artificial sequence
  SiRNA target sequence
gcagatactttgtatattccgttag

SEQ ID NO: 29657 - DNA, 25 bp, Artificial sequence
  SiRNA target sequence
cagatactttgtatattccgttagc

SEQ ID NO: 29658 - DNA, 25 bp, Artificial sequence
  SiRNA target sequence
agatactttgtatattccgttagca

SEQ ID NO: 29659 - DNA, 25 bp, Artificial sequence
  SiRNA target sequence
gatactttgtatattccgttagcat

SEQ ID NO: 29660 - DNA, 25 bp, Artificial sequence
  SiRNA target sequence
atactttgtatattccgttagcatc

SEQ ID NO: 29661 - DNA, 25 bp, Artificial sequence
  SiRNA target sequence
tactttgtatattccgttagcatcg

SEQ ID NO: 29662 - DNA, 25 bp, Artificial sequence
  SiRNA target sequence
actttgtatattccgttagcatcgg

SEQ ID NO: 29663 - DNA, 25 bp, Artificial sequence
  SiRNA target sequence
ctttgtatattccgttagcatcggc

SEQ ID NO: 29664 - DNA, 25 bp, Artificial sequence
  SiRNA target sequence
tttgtatattccgttagcatcggct

SEQ ID NO: 29665 - DNA, 25 bp, Artificial sequence
  SiRNA target sequence
ttgtatattccgttagcatcggctt

SEQ ID NO: 29666 - DNA, 25 bp, Artificial sequence
  SiRNA target sequence
tgtatattccgttagcatcggcttc

SEQ ID NO: 29667 - DNA, 25 bp, Artificial sequence
  SiRNA target sequence
gtatattccgttagcatcggcttca

SEQ ID NO: 29668 - DNA, 25 bp, Artificial sequence
  SiRNA target sequence
tatattccgttagcatcggcttcaa

SEQ ID NO: 29669 - DNA, 25 bp, Artificial sequence
  SiRNA target sequence
atattccgttagcatcggcttcaaa

SEQ ID NO: 29670 - DNA, 25 bp, Artificial sequence
  SiRNA target sequence
tattccgttagcatcggcttcaaat

SEQ ID NO: 29671 - DNA, 25 bp, Artificial sequence
  SiRNA target sequence
attccgttagcatcggcttcaaatg

SEQ ID NO: 29672 - DNA, 25 bp, Artificial sequence
  SiRNA target sequence
ttccgttagcatcggcttcaaatgt

SEQ ID NO: 29673 - DNA, 25 bp, Artificial sequence
  SiRNA target sequence
tccgttagcatcggcttcaaatgta

SEQ ID NO: 29674 - DNA, 25 bp, Artificial sequence
  SiRNA target sequence
ccgttagcatcggcttcaaatgtaa

SEQ ID NO: 29675 - DNA, 25 bp, Artificial sequence
  SiRNA target sequence
cgttagcatcggcttcaaatgtaac

SEQ ID NO: 29676 - DNA, 25 bp, Artificial sequence
  SiRNA target sequence
gttagcatcggcttcaaatgtaaca

SEQ ID NO: 29677 - DNA, 25 bp, Artificial sequence
  SiRNA target sequence
ttagcatcggcttcaaatgtaacat

SEQ ID NO: 29678 - DNA, 25 bp, Artificial sequence
  SiRNA target sequence
tagcatcggcttcaaatgtaacatc

SEQ ID NO: 29679 - DNA, 25 bp, Artificial sequence
  SiRNA target sequence
agcatcggcttcaaatgtaacatct

SEQ ID NO: 29680 - DNA, 25 bp, Artificial sequence
  SiRNA target sequence
gcatcggcttcaaatgtaacatcta

SEQ ID NO: 29681 - DNA, 25 bp, Artificial sequence
  SiRNA target sequence
catcggcttcaaatgtaacatctat

SEQ ID NO: 29682 - DNA, 25 bp, Artificial sequence
  SiRNA target sequence
atcggcttcaaatgtaacatctatc

SEQ ID NO: 29683 - DNA, 25 bp, Artificial sequence
  SiRNA target sequence
tcggcttcaaatgtaacatctatct

SEQ ID NO: 29684 - DNA, 25 bp, Artificial sequence
  SiRNA target sequence
cggcttcaaatgtaacatctatctt

SEQ ID NO: 29685 - DNA, 25 bp, Artificial sequence
  SiRNA target sequence
ggcttcaaatgtaacatctatcttt

SEQ ID NO: 29686 - DNA, 25 bp, Artificial sequence
  SiRNA target sequence
gcttcaaatgtaacatctatctttg

SEQ ID NO: 29687 - DNA, 25 bp, Artificial sequence
  SiRNA target sequence
cttcaaatgtaacatctatctttgg

SEQ ID NO: 29688 - DNA, 25 bp, Artificial sequence
  SiRNA target sequence
ttcaaatgtaacatctatctttgga

SEQ ID NO: 29689 - DNA, 25 bp, Artificial sequence
  SiRNA target sequence
tcaaatgtaacatctatctttggaa

SEQ ID NO: 29690 - DNA, 25 bp, Artificial sequence
  SiRNA target sequence
caaatgtaacatctatctttggaat

SEQ ID NO: 29691 - DNA, 25 bp, Artificial sequence
  SiRNA target sequence
aaatgtaacatctatctttggaata

SEQ ID NO: 29692 - DNA, 25 bp, Artificial sequence
  SiRNA target sequence
aatgtaacatctatctttggaatac

SEQ ID NO: 29693 - DNA, 25 bp, Artificial sequence
  SiRNA target sequence
atgtaacatctatctttggaatacc

SEQ ID NO: 29694 - DNA, 25 bp, Artificial sequence
  SiRNA target sequence
tgtaacatctatctttggaatacct

SEQ ID NO: 29695 - DNA, 25 bp, Artificial sequence
  SiRNA target sequence
gtaacatctatctttggaatacctg

SEQ ID NO: 29696 - DNA, 25 bp, Artificial sequence
  SiRNA target sequence
taacatctatctttggaatacctgc

SEQ ID NO: 29697 - DNA, 25 bp, Artificial sequence
  SiRNA target sequence
aacatctatctttggaatacctgca

SEQ ID NO: 29698 - DNA, 25 bp, Artificial sequence
  SiRNA target sequence
acatctatctttggaatacctgcag

SEQ ID NO: 29699 - DNA, 25 bp, Artificial sequence
  SiRNA target sequence
catctatctttggaatacctgcagg

SEQ ID NO: 29700 - DNA, 25 bp, Artificial sequence
  SiRNA target sequence
atctatctttggaatacctgcaggt

SEQ ID NO: 29701 - DNA, 25 bp, Artificial sequence
  SiRNA target sequence
tctatctttggaatacctgcaggtg

SEQ ID NO: 29702 - DNA, 25 bp, Artificial sequence
  SiRNA target sequence
ctatctttggaatacctgcaggtgc

SEQ ID NO: 29703 - DNA, 25 bp, Artificial sequence
  SiRNA target sequence
tatctttggaatacctgcaggtgct

SEQ ID NO: 29704 - DNA, 25 bp, Artificial sequence
  SiRNA target sequence
atctttggaatacctgcaggtgctt

SEQ ID NO: 29705 - DNA, 25 bp, Artificial sequence
  SiRNA target sequence
tctttggaatacctgcaggtgcttt

SEQ ID NO: 29706 - DNA, 25 bp, Artificial sequence
  SiRNA target sequence
ctttggaatacctgcaggtgcttta

SEQ ID NO: 29707 - DNA, 25 bp, Artificial sequence
  SiRNA target sequence
tttggaatacctgcaggtgctttag

SEQ ID NO: 29708 - DNA, 25 bp, Artificial sequence
  SiRNA target sequence
ttggaatacctgcaggtgctttagg

SEQ ID NO: 29709 - DNA, 25 bp, Artificial sequence
  SiRNA target sequence
tggaatacctgcaggtgctttagga

SEQ ID NO: 29710 - DNA, 25 bp, Artificial sequence
  SiRNA target sequence
ggaatacctgcaggtgctttaggaa

SEQ ID NO: 29711 - DNA, 25 bp, Artificial sequence
  SiRNA target sequence
gaatacctgcaggtgctttaggaat

SEQ ID NO: 29712 - DNA, 25 bp, Artificial sequence
  SiRNA target sequence
aatacctgcaggtgctttaggaatg

SEQ ID NO: 29713 - DNA, 25 bp, Artificial sequence
  SiRNA target sequence
atacctgcaggtgctttaggaatgt

SEQ ID NO: 29714 - DNA, 25 bp, Artificial sequence
  SiRNA target sequence
tacctgcaggtgctttaggaatgtt

SEQ ID NO: 29715 - DNA, 25 bp, Artificial sequence
  SiRNA target sequence
acctgcaggtgctttaggaatgttt

SEQ ID NO: 29716 - DNA, 25 bp, Artificial sequence
  SiRNA target sequence
cctgcaggtgctttaggaatgtttt

SEQ ID NO: 29717 - DNA, 25 bp, Artificial sequence
  SiRNA target sequence
ctgcaggtgctttaggaatgttttt

SEQ ID NO: 29718 - DNA, 25 bp, Artificial sequence
  SiRNA target sequence
tgcaggtgctttaggaatgtttttg

SEQ ID NO: 29719 - DNA, 25 bp, Artificial sequence
  SiRNA target sequence
gcaggtgctttaggaatgtttttga

SEQ ID NO: 29720 - DNA, 25 bp, Artificial sequence
  SiRNA target sequence
caggtgctttaggaatgtttttgag

SEQ ID NO: 29721 - DNA, 25 bp, Artificial sequence
  SiRNA target sequence
aggtgctttaggaatgtttttgagc

SEQ ID NO: 29722 - DNA, 25 bp, Artificial sequence
  SiRNA target sequence
ggtgctttaggaatgtttttgagct

SEQ ID NO: 29723 - DNA, 25 bp, Artificial sequence
  SiRNA target sequence
gtgctttaggaatgtttttgagctt

SEQ ID NO: 29724 - DNA, 25 bp, Artificial sequence
  SiRNA target sequence
tgctttaggaatgtttttgagcttt

SEQ ID NO: 29725 - DNA, 25 bp, Artificial sequence
  SiRNA target sequence
gctttaggaatgtttttgagcttta

SEQ ID NO: 29726 - DNA, 25 bp, Artificial sequence
  SiRNA target sequence
ctttaggaatgtttttgagctttat

SEQ ID NO: 29727 - DNA, 25 bp, Artificial sequence
  SiRNA target sequence
tttaggaatgtttttgagctttata

SEQ ID NO: 29728 - DNA, 25 bp, Artificial sequence
  SiRNA target sequence
ttaggaatgtttttgagctttatag

SEQ ID NO: 29729 - DNA, 25 bp, Artificial sequence
  SiRNA target sequence
taggaatgtttttgagctttatagc

SEQ ID NO: 29730 - DNA, 25 bp, Artificial sequence
  SiRNA target sequence
aggaatgtttttgagctttatagct

SEQ ID NO: 29731 - DNA, 25 bp, Artificial sequence
  SiRNA target sequence
ggaatgtttttgagctttatagctc

SEQ ID NO: 29732 - DNA, 25 bp, Artificial sequence
  SiRNA target sequence
gaatgtttttgagctttatagctcc

SEQ ID NO: 29733 - DNA, 25 bp, Artificial sequence
  SiRNA target sequence
aatgtttttgagctttatagctcct

SEQ ID NO: 29734 - DNA, 25 bp, Artificial sequence
  SiRNA target sequence
atgtttttgagctttatagctccta

SEQ ID NO: 29735 - DNA, 25 bp, Artificial sequence
  SiRNA target sequence
tgtttttgagctttatagctcctaa

SEQ ID NO: 29736 - DNA, 25 bp, Artificial sequence
  SiRNA target sequence
gtttttgagctttatagctcctaaa

SEQ ID NO: 29737 - DNA, 25 bp, Artificial sequence
  SiRNA target sequence
tttttgagctttatagctcctaaat

SEQ ID NO: 29738 - DNA, 25 bp, Artificial sequence
  SiRNA target sequence
ttttgagctttatagctcctaaata

SEQ ID NO: 29739 - DNA, 25 bp, Artificial sequence
  SiRNA target sequence
tttgagctttatagctcctaaatat

SEQ ID NO: 29740 - DNA, 25 bp, Artificial sequence
  SiRNA target sequence
ttgagctttatagctcctaaatatt

SEQ ID NO: 29741 - DNA, 25 bp, Artificial sequence
  SiRNA target sequence
tgagctttatagctcctaaatattt

SEQ ID NO: 29742 - DNA, 25 bp, Artificial sequence
  SiRNA target sequence
gagctttatagctcctaaatattta

SEQ ID NO: 29743 - DNA, 25 bp, Artificial sequence
  SiRNA target sequence
agctttatagctcctaaatatttat

SEQ ID NO: 29744 - DNA, 25 bp, Artificial sequence
  SiRNA target sequence
gctttatagctcctaaatatttatt

SEQ ID NO: 29745 - DNA, 25 bp, Artificial sequence
  SiRNA target sequence
ctttatagctcctaaatatttattg

SEQ ID NO: 29746 - DNA, 25 bp, Artificial sequence
  SiRNA target sequence
tttatagctcctaaatatttattgt

SEQ ID NO: 29747 - DNA, 25 bp, Artificial sequence
  SiRNA target sequence
ttatagctcctaaatatttattgtc

SEQ ID NO: 29748 - DNA, 25 bp, Artificial sequence
  SiRNA target sequence
tatagctcctaaatatttattgtct

SEQ ID NO: 29749 - DNA, 25 bp, Artificial sequence
  SiRNA target sequence
atagctcctaaatatttattgtctt

SEQ ID NO: 29750 - DNA, 25 bp, Artificial sequence
  SiRNA target sequence
tagctcctaaatatttattgtcttt

SEQ ID NO: 29751 - DNA, 25 bp, Artificial sequence
  SiRNA target sequence
agctcctaaatatttattgtctttt

SEQ ID NO: 29752 - DNA, 25 bp, Artificial sequence
  SiRNA target sequence
gctcctaaatatttattgtctttta

SEQ ID NO: 29753 - DNA, 25 bp, Artificial sequence
  SiRNA target sequence
ctcctaaatatttattgtcttttac

SEQ ID NO: 29754 - DNA, 25 bp, Artificial sequence
  SiRNA target sequence
tcctaaatatttattgtcttttacc

SEQ ID NO: 29755 - DNA, 25 bp, Artificial sequence
  SiRNA target sequence
cctaaatatttattgtcttttacca

SEQ ID NO: 29756 - DNA, 25 bp, Artificial sequence
  SiRNA target sequence
ctaaatatttattgtcttttaccat

SEQ ID NO: 29757 - DNA, 25 bp, Artificial sequence
  SiRNA target sequence
taaatatttattgtcttttaccatc

SEQ ID NO: 29758 - DNA, 25 bp, Artificial sequence
  SiRNA target sequence
aaatatttattgtcttttaccatct

SEQ ID NO: 29759 - DNA, 25 bp, Artificial sequence
  SiRNA target sequence
aatatttattgtcttttaccatctt

SEQ ID NO: 29760 - DNA, 25 bp, Artificial sequence
  SiRNA target sequence
atatttattgtcttttaccatcttt

SEQ ID NO: 29761 - DNA, 25 bp, Artificial sequence
  SiRNA target sequence
tatttattgtcttttaccatctttc

SEQ ID NO: 29762 - DNA, 25 bp, Artificial sequence
  SiRNA target sequence
atttattgtcttttaccatctttct

SEQ ID NO: 29763 - DNA, 25 bp, Artificial sequence
  SiRNA target sequence
tttattgtcttttaccatctttctt

SEQ ID NO: 29764 - DNA, 25 bp, Artificial sequence
  SiRNA target sequence
ttattgtcttttaccatctttcttt

SEQ ID NO: 29765 - DNA, 25 bp, Artificial sequence
  SiRNA target sequence
tattgtcttttaccatctttctttc

SEQ ID NO: 29766 - DNA, 25 bp, Artificial sequence
  SiRNA target sequence
attgtcttttaccatctttctttct

SEQ ID NO: 29767 - DNA, 25 bp, Artificial sequence
  SiRNA target sequence
ttgtcttttaccatctttctttctc

SEQ ID NO: 29768 - DNA, 25 bp, Artificial sequence
  SiRNA target sequence
tgtcttttaccatctttctttctcc

SEQ ID NO: 29769 - DNA, 25 bp, Artificial sequence
  SiRNA target sequence
gtcttttaccatctttctttctcct

SEQ ID NO: 29770 - DNA, 25 bp, Artificial sequence
  SiRNA target sequence
tcttttaccatctttctttctcctt

SEQ ID NO: 29771 - DNA, 25 bp, Artificial sequence
  SiRNA target sequence
cttttaccatctttctttctccttg

SEQ ID NO: 29772 - DNA, 25 bp, Artificial sequence
  SiRNA target sequence
ttttaccatctttctttctccttga

SEQ ID NO: 29773 - DNA, 25 bp, Artificial sequence
  SiRNA target sequence
tttaccatctttctttctccttgat

SEQ ID NO: 29774 - DNA, 25 bp, Artificial sequence
  SiRNA target sequence
ttaccatctttctttctccttgata

SEQ ID NO: 29775 - DNA, 25 bp, Artificial sequence
  SiRNA target sequence
taccatctttctttctccttgatat

SEQ ID NO: 29776 - DNA, 25 bp, Artificial sequence
  SiRNA target sequence
accatctttctttctccttgatata

SEQ ID NO: 29777 - DNA, 25 bp, Artificial sequence
  SiRNA target sequence
ccatctttctttctccttgatatat

SEQ ID NO: 29778 - DNA, 25 bp, Artificial sequence
  SiRNA target sequence
catctttctttctccttgatatatt

SEQ ID NO: 29779 - DNA, 25 bp, Artificial sequence
  SiRNA target sequence
atctttctttctccttgatatattc

SEQ ID NO: 29780 - DNA, 25 bp, Artificial sequence
  SiRNA target sequence
tctttctttctccttgatatattct

SEQ ID NO: 29781 - DNA, 25 bp, Artificial sequence
  SiRNA target sequence
ctttctttctccttgatatattcta

SEQ ID NO: 29782 - DNA, 25 bp, Artificial sequence
  SiRNA target sequence
tttctttctccttgatatattctaa

SEQ ID NO: 29783 - DNA, 25 bp, Artificial sequence
  SiRNA target sequence
ttctttctccttgatatattctaat

SEQ ID NO: 29784 - DNA, 25 bp, Artificial sequence
  SiRNA target sequence
tctttctccttgatatattctaata

SEQ ID NO: 29785 - DNA, 25 bp, Artificial sequence
  SiRNA target sequence
ctttctccttgatatattctaatat

SEQ ID NO: 29786 - DNA, 25 bp, Artificial sequence
  SiRNA target sequence
tttctccttgatatattctaatatc

SEQ ID NO: 29787 - DNA, 25 bp, Artificial sequence
  SiRNA target sequence
ttctccttgatatattctaatatct

SEQ ID NO: 29788 - DNA, 25 bp, Artificial sequence
  SiRNA target sequence
tctccttgatatattctaatatcta

SEQ ID NO: 29789 - DNA, 25 bp, Artificial sequence
  SiRNA target sequence
ctccttgatatattctaatatctac

SEQ ID NO: 29790 - DNA, 25 bp, Artificial sequence
  SiRNA target sequence
tccttgatatattctaatatctact

SEQ ID NO: 29791 - DNA, 25 bp, Artificial sequence
  SiRNA target sequence
ccttgatatattctaatatctactt

SEQ ID NO: 29792 - DNA, 25 bp, Artificial sequence
  SiRNA target sequence
cttgatatattctaatatctacttc

SEQ ID NO: 29793 - DNA, 25 bp, Artificial sequence
  SiRNA target sequence
ttgatatattctaatatctacttcg

SEQ ID NO: 29794 - DNA, 25 bp, Artificial sequence
  SiRNA target sequence
tgatatattctaatatctacttcgg

SEQ ID NO: 29795 - DNA, 25 bp, Artificial sequence
  SiRNA target sequence
gatatattctaatatctacttcgga

SEQ ID NO: 29796 - DNA, 25 bp, Artificial sequence
  SiRNA target sequence
atatattctaatatctacttcggat

SEQ ID NO: 29797 - DNA, 25 bp, Artificial sequence
  SiRNA target sequence
tatattctaatatctacttcggatt

SEQ ID NO: 29798 - DNA, 25 bp, Artificial sequence
  SiRNA target sequence
atattctaatatctacttcggattg

SEQ ID NO: 29799 - DNA, 25 bp, Artificial sequence
  SiRNA target sequence
tattctaatatctacttcggattga

SEQ ID NO: 29800 - DNA, 25 bp, Artificial sequence
  SiRNA target sequence
attctaatatctacttcggattgat

SEQ ID NO: 29801 - DNA, 25 bp, Artificial sequence
  SiRNA target sequence
ttctaatatctacttcggattgatt

SEQ ID NO: 29802 - DNA, 25 bp, Artificial sequence
  SiRNA target sequence
tctaatatctacttcggattgatta

SEQ ID NO: 29803 - DNA, 25 bp, Artificial sequence
  SiRNA target sequence
ctaatatctacttcggattgattat

SEQ ID NO: 29804 - DNA, 25 bp, Artificial sequence
  SiRNA target sequence
taatatctacttcggattgattatc

SEQ ID NO: 29805 - DNA, 25 bp, Artificial sequence
  SiRNA target sequence
aatatctacttcggattgattatct

SEQ ID NO: 29806 - DNA, 25 bp, Artificial sequence
  SiRNA target sequence
atatctacttcggattgattatctt

SEQ ID NO: 29807 - DNA, 25 bp, Artificial sequence
  SiRNA target sequence
tatctacttcggattgattatcttc

SEQ ID NO: 29808 - DNA, 25 bp, Artificial sequence
  SiRNA target sequence
atctacttcggattgattatcttca

SEQ ID NO: 29809 - DNA, 25 bp, Artificial sequence
  SiRNA target sequence
tctacttcggattgattatcttcag

SEQ ID NO: 29810 - DNA, 25 bp, Artificial sequence
  SiRNA target sequence
ctacttcggattgattatcttcaga

SEQ ID NO: 29811 - DNA, 25 bp, Artificial sequence
  SiRNA target sequence
tacttcggattgattatcttcagag

SEQ ID NO: 29812 - DNA, 25 bp, Artificial sequence
  SiRNA target sequence
acttcggattgattatcttcagagg

SEQ ID NO: 29813 - DNA, 25 bp, Artificial sequence
  SiRNA target sequence
cttcggattgattatcttcagaggt

SEQ ID NO: 29814 - DNA, 25 bp, Artificial sequence
  SiRNA target sequence
ttcggattgattatcttcagaggta

SEQ ID NO: 29815 - DNA, 25 bp, Artificial sequence
  SiRNA target sequence
tcggattgattatcttcagaggtag

SEQ ID NO: 29816 - DNA, 25 bp, Artificial sequence
  SiRNA target sequence
cggattgattatcttcagaggtaga

SEQ ID NO: 29817 - DNA, 25 bp, Artificial sequence
  SiRNA target sequence
ggattgattatcttcagaggtagaa

SEQ ID NO: 29818 - DNA, 25 bp, Artificial sequence
  SiRNA target sequence
gattgattatcttcagaggtagaaa

SEQ ID NO: 29819 - DNA, 25 bp, Artificial sequence
  SiRNA target sequence
attgattatcttcagaggtagaaaa

SEQ ID NO: 29820 - DNA, 25 bp, Artificial sequence
  SiRNA target sequence
ttgattatcttcagaggtagaaaaa

SEQ ID NO: 29821 - DNA, 25 bp, Artificial sequence
  SiRNA target sequence
tgattatcttcagaggtagaaaaac

SEQ ID NO: 29822 - DNA, 25 bp, Artificial sequence
  SiRNA target sequence
gattatcttcagaggtagaaaaact

SEQ ID NO: 29823 - DNA, 25 bp, Artificial sequence
  SiRNA target sequence
attatcttcagaggtagaaaaactg

SEQ ID NO: 29824 - DNA, 25 bp, Artificial sequence
  SiRNA target sequence
ttatcttcagaggtagaaaaactgt

SEQ ID NO: 29825 - DNA, 25 bp, Artificial sequence
  SiRNA target sequence
tatcttcagaggtagaaaaactgtg

SEQ ID NO: 29826 - DNA, 25 bp, Artificial sequence
  SiRNA target sequence
atcttcagaggtagaaaaactgtgt

SEQ ID NO: 29827 - DNA, 25 bp, Artificial sequence
  SiRNA target sequence
tcttcagaggtagaaaaactgtgtg

SEQ ID NO: 29828 - DNA, 25 bp, Artificial sequence
  SiRNA target sequence
cttcagaggtagaaaaactgtgtgt

SEQ ID NO: 29829 - DNA, 25 bp, Artificial sequence
  SiRNA target sequence
ttcagaggtagaaaaactgtgtgtt

SEQ ID NO: 29830 - DNA, 25 bp, Artificial sequence
  SiRNA target sequence
tcagaggtagaaaaactgtgtgttt

SEQ ID NO: 29831 - DNA, 25 bp, Artificial sequence
  SiRNA target sequence
cagaggtagaaaaactgtgtgtttc

SEQ ID NO: 29832 - DNA, 25 bp, Artificial sequence
  SiRNA target sequence
agaggtagaaaaactgtgtgtttcc

SEQ ID NO: 29833 - DNA, 25 bp, Artificial sequence
  SiRNA target sequence
gaggtagaaaaactgtgtgtttcct

SEQ ID NO: 29834 - DNA, 25 bp, Artificial sequence
  SiRNA target sequence
aggtagaaaaactgtgtgtttcctt

SEQ ID NO: 29835 - DNA, 25 bp, Artificial sequence
  SiRNA target sequence
ggtagaaaaactgtgtgtttcctta

SEQ ID NO: 29836 - DNA, 25 bp, Artificial sequence
  SiRNA target sequence
gtagaaaaactgtgtgtttccttaa

SEQ ID NO: 29837 - DNA, 25 bp, Artificial sequence
  SiRNA target sequence
tagaaaaactgtgtgtttccttaaa

SEQ ID NO: 29838 - DNA, 25 bp, Artificial sequence
  SiRNA target sequence
agaaaaactgtgtgtttccttaaat

SEQ ID NO: 29839 - DNA, 25 bp, Artificial sequence
  SiRNA target sequence
gaaaaactgtgtgtttccttaaatg

SEQ ID NO: 29840 - DNA, 25 bp, Artificial sequence
  SiRNA target sequence
aaaaactgtgtgtttccttaaatgg

SEQ ID NO: 29841 - DNA, 25 bp, Artificial sequence
  SiRNA target sequence
aaaactgtgtgtttccttaaatgga

SEQ ID NO: 29842 - DNA, 25 bp, Artificial sequence
  SiRNA target sequence
aaactgtgtgtttccttaaatggaa

SEQ ID NO: 29843 - DNA, 25 bp, Artificial sequence
  SiRNA target sequence
aactgtgtgtttccttaaatggaat

SEQ ID NO: 29844 - DNA, 25 bp, Artificial sequence
  SiRNA target sequence
actgtgtgtttccttaaatggaata

SEQ ID NO: 29845 - DNA, 25 bp, Artificial sequence
  SiRNA target sequence
ctgtgtgtttccttaaatggaatag

SEQ ID NO: 29846 - DNA, 25 bp, Artificial sequence
  SiRNA target sequence
tgtgtgtttccttaaatggaatagt

SEQ ID NO: 29847 - DNA, 25 bp, Artificial sequence
  SiRNA target sequence
gtgtgtttccttaaatggaatagta

SEQ ID NO: 29848 - DNA, 25 bp, Artificial sequence
  SiRNA target sequence
tgtgtttccttaaatggaatagtag

SEQ ID NO: 29849 - DNA, 25 bp, Artificial sequence
  SiRNA target sequence
gtgtttccttaaatggaatagtaga

SEQ ID NO: 29850 - DNA, 25 bp, Artificial sequence
  SiRNA target sequence
tgtttccttaaatggaatagtagaa

SEQ ID NO: 29851 - DNA, 25 bp, Artificial sequence
  SiRNA target sequence
gtttccttaaatggaatagtagaat

SEQ ID NO: 29852 - DNA, 25 bp, Artificial sequence
  SiRNA target sequence
tttccttaaatggaatagtagaatt

SEQ ID NO: 29853 - DNA, 25 bp, Artificial sequence
  SiRNA target sequence
ttccttaaatggaatagtagaattt

SEQ ID NO: 29854 - DNA, 25 bp, Artificial sequence
  SiRNA target sequence
tccttaaatggaatagtagaatttc

SEQ ID NO: 29855 - DNA, 25 bp, Artificial sequence
  SiRNA target sequence
ccttaaatggaatagtagaatttct

SEQ ID NO: 29856 - DNA, 25 bp, Artificial sequence
  SiRNA target sequence
cttaaatggaatagtagaatttcta

SEQ ID NO: 29857 - DNA, 25 bp, Artificial sequence
  SiRNA target sequence
ttaaatggaatagtagaatttctat

SEQ ID NO: 29858 - DNA, 25 bp, Artificial sequence
  SiRNA target sequence
taaatggaatagtagaatttctatg

SEQ ID NO: 29859 - DNA, 25 bp, Artificial sequence
  SiRNA target sequence
aaatggaatagtagaatttctatga

SEQ ID NO: 29860 - DNA, 25 bp, Artificial sequence
  SiRNA target sequence
aatggaatagtagaatttctatgaa

SEQ ID NO: 29861 - DNA, 25 bp, Artificial sequence
  SiRNA target sequence
atggaatagtagaatttctatgaat

SEQ ID NO: 29862 - DNA, 25 bp, Artificial sequence
  SiRNA target sequence
tggaatagtagaatttctatgaatt

SEQ ID NO: 29863 - DNA, 25 bp, Artificial sequence
  SiRNA target sequence
ggaatagtagaatttctatgaatta

SEQ ID NO: 29864 - DNA, 25 bp, Artificial sequence
  SiRNA target sequence
gaatagtagaatttctatgaattat

SEQ ID NO: 29865 - DNA, 25 bp, Artificial sequence
  SiRNA target sequence
aatagtagaatttctatgaattatc

SEQ ID NO: 29866 - DNA, 25 bp, Artificial sequence
  SiRNA target sequence
atagtagaatttctatgaattatct

SEQ ID NO: 29867 - DNA, 25 bp, Artificial sequence
  SiRNA target sequence
tagtagaatttctatgaattatctt

SEQ ID NO: 29868 - DNA, 25 bp, Artificial sequence
  SiRNA target sequence
agtagaatttctatgaattatctta

SEQ ID NO: 29869 - DNA, 25 bp, Artificial sequence
  SiRNA target sequence
gtagaatttctatgaattatcttat

SEQ ID NO: 29870 - DNA, 25 bp, Artificial sequence
  SiRNA target sequence
tagaatttctatgaattatcttatt

SEQ ID NO: 29871 - DNA, 25 bp, Artificial sequence
  SiRNA target sequence
agaatttctatgaattatcttatta

SEQ ID NO: 29872 - DNA, 25 bp, Artificial sequence
  SiRNA target sequence
gaatttctatgaattatcttattaa

SEQ ID NO: 29873 - DNA, 25 bp, Artificial sequence
  SiRNA target sequence
aatttctatgaattatcttattaaa

SEQ ID NO: 29874 - DNA, 25 bp, Artificial sequence
  SiRNA target sequence
atttctatgaattatcttattaaaa

SEQ ID NO: 29875 - DNA, 25 bp, Artificial sequence
  SiRNA target sequence
tttctatgaattatcttattaaaaa

SEQ ID NO: 29876 - DNA, 25 bp, Artificial sequence
  SiRNA target sequence
ttctatgaattatcttattaaaaat

SEQ ID NO: 29877 - DNA, 25 bp, Artificial sequence
  SiRNA target sequence
tctatgaattatcttattaaaaatc

SEQ ID NO: 29878 - DNA, 25 bp, Artificial sequence
  SiRNA target sequence
ctatgaattatcttattaaaaatcc

SEQ ID NO: 29879 - DNA, 25 bp, Artificial sequence
  SiRNA target sequence
tatgaattatcttattaaaaatccc

SEQ ID NO: 29880 - DNA, 25 bp, Artificial sequence
  SiRNA target sequence
atgaattatcttattaaaaatcccg

SEQ ID NO: 29881 - DNA, 25 bp, Artificial sequence
  SiRNA target sequence
tgaattatcttattaaaaatcccgc

SEQ ID NO: 29882 - DNA, 25 bp, Artificial sequence
  SiRNA target sequence
gaattatcttattaaaaatcccgcc

SEQ ID NO: 29883 - DNA, 25 bp, Artificial sequence
  SiRNA target sequence
aattatcttattaaaaatcccgccc

SEQ ID NO: 29884 - DNA, 25 bp, Artificial sequence
  SiRNA target sequence
attatcttattaaaaatcccgccca

SEQ ID NO: 29885 - DNA, 25 bp, Artificial sequence
  SiRNA target sequence
ttatcttattaaaaatcccgcccaa

SEQ ID NO: 29886 - DNA, 25 bp, Artificial sequence
  SiRNA target sequence
tatcttattaaaaatcccgcccaaa

SEQ ID NO: 29887 - DNA, 25 bp, Artificial sequence
  SiRNA target sequence
atcttattaaaaatcccgcccaaaa

SEQ ID NO: 29888 - DNA, 25 bp, Artificial sequence
  SiRNA target sequence
tcttattaaaaatcccgcccaaaag

SEQ ID NO: 29889 - DNA, 25 bp, Artificial sequence
  SiRNA target sequence
cttattaaaaatcccgcccaaaagc

SEQ ID NO: 29890 - DNA, 25 bp, Artificial sequence
  SiRNA target sequence
ttattaaaaatcccgcccaaaagct

SEQ ID NO: 29891 - DNA, 25 bp, Artificial sequence
  SiRNA target sequence
tattaaaaatcccgcccaaaagctc

SEQ ID NO: 29892 - DNA, 25 bp, Artificial sequence
  SiRNA target sequence
attaaaaatcccgcccaaaagctct

SEQ ID NO: 29893 - DNA, 25 bp, Artificial sequence
  SiRNA target sequence
ttaaaaatcccgcccaaaagctcta

SEQ ID NO: 29894 - DNA, 25 bp, Artificial sequence
  SiRNA target sequence
taaaaatcccgcccaaaagctctat

SEQ ID NO: 29895 - DNA, 25 bp, Artificial sequence
  SiRNA target sequence
aaaaatcccgcccaaaagctctata

SEQ ID NO: 29896 - DNA, 25 bp, Artificial sequence
  SiRNA target sequence
aaaatcccgcccaaaagctctatac

SEQ ID NO: 29897 - DNA, 25 bp, Artificial sequence
  SiRNA target sequence
aaatcccgcccaaaagctctatacc

SEQ ID NO: 29898 - DNA, 25 bp, Artificial sequence
  SiRNA target sequence
aatcccgcccaaaagctctatacct

SEQ ID NO: 29899 - DNA, 25 bp, Artificial sequence
  SiRNA target sequence
atcccgcccaaaagctctataccta

SEQ ID NO: 29900 - DNA, 25 bp, Artificial sequence
  SiRNA target sequence
tcccgcccaaaagctctatacctaa

SEQ ID NO: 29901 - DNA, 25 bp, Artificial sequence
  SiRNA target sequence
cccgcccaaaagctctatacctaaa

SEQ ID NO: 29902 - DNA, 25 bp, Artificial sequence
  SiRNA target sequence
ccgcccaaaagctctatacctaaac

SEQ ID NO: 29903 - DNA, 25 bp, Artificial sequence
  SiRNA target sequence
cgcccaaaagctctatacctaaact

SEQ ID NO: 29904 - DNA, 25 bp, Artificial sequence
  SiRNA target sequence
gcccaaaagctctatacctaaactc

SEQ ID NO: 29905 - DNA, 25 bp, Artificial sequence
  SiRNA target sequence
cccaaaagctctatacctaaactca

SEQ ID NO: 29906 - DNA, 25 bp, Artificial sequence
  SiRNA target sequence
ccaaaagctctatacctaaactcaa

SEQ ID NO: 29907 - DNA, 25 bp, Artificial sequence
  SiRNA target sequence
caaaagctctatacctaaactcaat

SEQ ID NO: 29908 - DNA, 25 bp, Artificial sequence
  SiRNA target sequence
aaaagctctatacctaaactcaatg

SEQ ID NO: 29909 - DNA, 25 bp, Artificial sequence
  SiRNA target sequence
aaagctctatacctaaactcaatgg

SEQ ID NO: 29910 - DNA, 25 bp, Artificial sequence
  SiRNA target sequence
aagctctatacctaaactcaatggt

SEQ ID NO: 29911 - DNA, 25 bp, Artificial sequence
  SiRNA target sequence
agctctatacctaaactcaatggta

SEQ ID NO: 29912 - DNA, 25 bp, Artificial sequence
  SiRNA target sequence
gctctatacctaaactcaatggtac

SEQ ID NO: 29913 - DNA, 25 bp, Artificial sequence
  SiRNA target sequence
ctctatacctaaactcaatggtact

SEQ ID NO: 29914 - DNA, 25 bp, Artificial sequence
  SiRNA target sequence
tctatacctaaactcaatggtacta

SEQ ID NO: 29915 - DNA, 25 bp, Artificial sequence
  SiRNA target sequence
ctatacctaaactcaatggtactac

SEQ ID NO: 29916 - DNA, 25 bp, Artificial sequence
  SiRNA target sequence
tatacctaaactcaatggtactaca

SEQ ID NO: 29917 - DNA, 25 bp, Artificial sequence
  SiRNA target sequence
atacctaaactcaatggtactacat

SEQ ID NO: 29918 - DNA, 25 bp, Artificial sequence
  SiRNA target sequence
tacctaaactcaatggtactacatc

SEQ ID NO: 29919 - DNA, 25 bp, Artificial sequence
  SiRNA target sequence
acctaaactcaatggtactacatcc

SEQ ID NO: 29920 - DNA, 25 bp, Artificial sequence
  SiRNA target sequence
cctaaactcaatggtactacatcca

SEQ ID NO: 29921 - DNA, 25 bp, Artificial sequence
  SiRNA target sequence
ctaaactcaatggtactacatccaa

SEQ ID NO: 29922 - DNA, 25 bp, Artificial sequence
  SiRNA target sequence
taaactcaatggtactacatccaat

SEQ ID NO: 29923 - DNA, 25 bp, Artificial sequence
  SiRNA target sequence
aaactcaatggtactacatccaata

SEQ ID NO: 29924 - DNA, 25 bp, Artificial sequence
  SiRNA target sequence
aactcaatggtactacatccaataa

SEQ ID NO: 29925 - DNA, 25 bp, Artificial sequence
  SiRNA target sequence
actcaatggtactacatccaataat

SEQ ID NO: 29926 - DNA, 25 bp, Artificial sequence
  SiRNA target sequence
ctcaatggtactacatccaataata

SEQ ID NO: 29927 - DNA, 25 bp, Artificial sequence
  SiRNA target sequence
tcaatggtactacatccaataatag

SEQ ID NO: 29928 - DNA, 25 bp, Artificial sequence
  SiRNA target sequence
caatggtactacatccaataatagg

SEQ ID NO: 29929 - DNA, 25 bp, Artificial sequence
  SiRNA target sequence
aatggtactacatccaataatagga

SEQ ID NO: 29930 - DNA, 25 bp, Artificial sequence
  SiRNA target sequence
atggtactacatccaataataggac

SEQ ID NO: 29931 - DNA, 25 bp, Artificial sequence
  SiRNA target sequence
tggtactacatccaataataggaca

SEQ ID NO: 29932 - DNA, 25 bp, Artificial sequence
  SiRNA target sequence
ggtactacatccaataataggacat

SEQ ID NO: 29933 - DNA, 25 bp, Artificial sequence
  SiRNA target sequence
gtactacatccaataataggacatc

SEQ ID NO: 29934 - DNA, 25 bp, Artificial sequence
  SiRNA target sequence
tactacatccaataataggacatct

SEQ ID NO: 29935 - DNA, 25 bp, Artificial sequence
  SiRNA target sequence
actacatccaataataggacatctt

SEQ ID NO: 29936 - DNA, 25 bp, Artificial sequence
  SiRNA target sequence
ctacatccaataataggacatcttt

SEQ ID NO: 29937 - DNA, 25 bp, Artificial sequence
  SiRNA target sequence
tacatccaataataggacatctttt

SEQ ID NO: 29938 - DNA, 25 bp, Artificial sequence
  SiRNA target sequence
acatccaataataggacatctttta

SEQ ID NO: 29939 - DNA, 25 bp, Artificial sequence
  SiRNA target sequence
catccaataataggacatcttttat

SEQ ID NO: 29940 - DNA, 25 bp, Artificial sequence
  SiRNA target sequence
atccaataataggacatcttttatt

SEQ ID NO: 29941 - DNA, 25 bp, Artificial sequence
  SiRNA target sequence
tccaataataggacatcttttattt

SEQ ID NO: 29942 - DNA, 25 bp, Artificial sequence
  SiRNA target sequence
ccaataataggacatcttttatttt

SEQ ID NO: 29943 - DNA, 25 bp, Artificial sequence
  SiRNA target sequence
caataataggacatcttttattttt

SEQ ID NO: 29944 - DNA, 25 bp, Artificial sequence
  SiRNA target sequence
aataataggacatcttttatttttc

SEQ ID NO: 29945 - DNA, 25 bp, Artificial sequence
  SiRNA target sequence
ataataggacatcttttatttttcc

SEQ ID NO: 29946 - DNA, 25 bp, Artificial sequence
  SiRNA target sequence
taataggacatcttttatttttcct

SEQ ID NO: 29947 - DNA, 25 bp, Artificial sequence
  SiRNA target sequence
aataggacatcttttatttttcctt

SEQ ID NO: 29948 - DNA, 25 bp, Artificial sequence
  SiRNA target sequence
ataggacatcttttatttttccttc

SEQ ID NO: 29949 - DNA, 25 bp, Artificial sequence
  SiRNA target sequence
taggacatcttttatttttccttct

SEQ ID NO: 29950 - DNA, 25 bp, Artificial sequence
  SiRNA target sequence
aggacatcttttatttttccttcta

SEQ ID NO: 29951 - DNA, 25 bp, Artificial sequence
  SiRNA target sequence
ggacatcttttatttttccttctaa

SEQ ID NO: 29952 - DNA, 25 bp, Artificial sequence
  SiRNA target sequence
gacatcttttatttttccttctaac

SEQ ID NO: 29953 - DNA, 25 bp, Artificial sequence
  SiRNA target sequence
acatcttttatttttccttctaaca

SEQ ID NO: 29954 - DNA, 25 bp, Artificial sequence
  SiRNA target sequence
catcttttatttttccttctaacac

SEQ ID NO: 29955 - DNA, 25 bp, Artificial sequence
  SiRNA target sequence
atcttttatttttccttctaacacg

SEQ ID NO: 29956 - DNA, 25 bp, Artificial sequence
  SiRNA target sequence
tcttttatttttccttctaacacgc

SEQ ID NO: 29957 - DNA, 25 bp, Artificial sequence
  SiRNA target sequence
cttttatttttccttctaacacgcc

SEQ ID NO: 29958 - DNA, 25 bp, Artificial sequence
  SiRNA target sequence
ttttatttttccttctaacacgcct

SEQ ID NO: 29959 - DNA, 25 bp, Artificial sequence
  SiRNA target sequence
tttatttttccttctaacacgcctg

SEQ ID NO: 29960 - DNA, 25 bp, Artificial sequence
  SiRNA target sequence
ttatttttccttctaacacgcctgc

SEQ ID NO: 29961 - DNA, 25 bp, Artificial sequence
  SiRNA target sequence
tatttttccttctaacacgcctgct

SEQ ID NO: 29962 - DNA, 25 bp, Artificial sequence
  SiRNA target sequence
atttttccttctaacacgcctgctt

SEQ ID NO: 29963 - DNA, 25 bp, Artificial sequence
  SiRNA target sequence
tttttccttctaacacgcctgcttg

SEQ ID NO: 29964 - DNA, 25 bp, Artificial sequence
  SiRNA target sequence
ttttccttctaacacgcctgcttgt

SEQ ID NO: 29965 - DNA, 25 bp, Artificial sequence
  SiRNA target sequence
tttccttctaacacgcctgcttgta

SEQ ID NO: 29966 - DNA, 25 bp, Artificial sequence
  SiRNA target sequence
ttccttctaacacgcctgcttgtag

SEQ ID NO: 29967 - DNA, 25 bp, Artificial sequence
  SiRNA target sequence
tccttctaacacgcctgcttgtaga

SEQ ID NO: 29968 - DNA, 25 bp, Artificial sequence
  SiRNA target sequence
ccttctaacacgcctgcttgtagag

SEQ ID NO: 29969 - DNA, 25 bp, Artificial sequence
  SiRNA target sequence
cttctaacacgcctgcttgtagagc

SEQ ID NO: 29970 - DNA, 25 bp, Artificial sequence
  SiRNA target sequence
ttctaacacgcctgcttgtagagcg

SEQ ID NO: 29971 - DNA, 25 bp, Artificial sequence
  SiRNA target sequence
tctaacacgcctgcttgtagagcgg

SEQ ID NO: 29972 - DNA, 25 bp, Artificial sequence
  SiRNA target sequence
ctaacacgcctgcttgtagagcggc

SEQ ID NO: 29973 - DNA, 25 bp, Artificial sequence
  SiRNA target sequence
taacacgcctgcttgtagagcggcc

SEQ ID NO: 29974 - DNA, 25 bp, Artificial sequence
  SiRNA target sequence
aacacgcctgcttgtagagcggccc

SEQ ID NO: 29975 - DNA, 25 bp, Artificial sequence
  SiRNA target sequence
acacgcctgcttgtagagcggcccc

SEQ ID NO: 29976 - DNA, 25 bp, Artificial sequence
  SiRNA target sequence
cacgcctgcttgtagagcggcccct

SEQ ID NO: 29977 - DNA, 25 bp, Artificial sequence
  SiRNA target sequence
acgcctgcttgtagagcggcccctt

SEQ ID NO: 29978 - DNA, 25 bp, Artificial sequence
  SiRNA target sequence
cgcctgcttgtagagcggccccttt

SEQ ID NO: 29979 - DNA, 25 bp, Artificial sequence
  SiRNA target sequence
gcctgcttgtagagcggccccttta

SEQ ID NO: 29980 - DNA, 25 bp, Artificial sequence
  SiRNA target sequence
cctgcttgtagagcggcccctttag

SEQ ID NO: 29981 - DNA, 25 bp, Artificial sequence
  SiRNA target sequence
ctgcttgtagagcggcccctttagc

SEQ ID NO: 29982 - DNA, 25 bp, Artificial sequence
  SiRNA target sequence
tgcttgtagagcggcccctttagca

SEQ ID NO: 29983 - DNA, 25 bp, Artificial sequence
  SiRNA target sequence
gcttgtagagcggcccctttagcaa

SEQ ID NO: 29984 - DNA, 25 bp, Artificial sequence
  SiRNA target sequence
cttgtagagcggcccctttagcaac

SEQ ID NO: 29985 - DNA, 25 bp, Artificial sequence
  SiRNA target sequence
ttgtagagcggcccctttagcaaca

SEQ ID NO: 29986 - DNA, 25 bp, Artificial sequence
  SiRNA target sequence
tgtagagcggcccctttagcaacag

SEQ ID NO: 29987 - DNA, 25 bp, Artificial sequence
  SiRNA target sequence
gtagagcggcccctttagcaacagc

SEQ ID NO: 29988 - DNA, 25 bp, Artificial sequence
  SiRNA target sequence
tagagcggcccctttagcaacagct

SEQ ID NO: 29989 - DNA, 25 bp, Artificial sequence
  SiRNA target sequence
agagcggcccctttagcaacagctt

SEQ ID NO: 29990 - DNA, 25 bp, Artificial sequence
  SiRNA target sequence
gagcggcccctttagcaacagcttc

SEQ ID NO: 29991 - DNA, 25 bp, Artificial sequence
  SiRNA target sequence
agcggcccctttagcaacagcttca

SEQ ID NO: 29992 - DNA, 25 bp, Artificial sequence
  SiRNA target sequence
gcggcccctttagcaacagcttcat

SEQ ID NO: 29993 - DNA, 25 bp, Artificial sequence
  SiRNA target sequence
cggcccctttagcaacagcttcatc

SEQ ID NO: 29994 - DNA, 25 bp, Artificial sequence
  SiRNA target sequence
ggcccctttagcaacagcttcatct

SEQ ID NO: 29995 - DNA, 25 bp, Artificial sequence
  SiRNA target sequence
gcccctttagcaacagcttcatctg

SEQ ID NO: 29996 - DNA, 25 bp, Artificial sequence
  SiRNA target sequence
cccctttagcaacagcttcatctgg

SEQ ID NO: 29997 - DNA, 25 bp, Artificial sequence
  SiRNA target sequence
ccctttagcaacagcttcatctgga

SEQ ID NO: 29998 - DNA, 25 bp, Artificial sequence
  SiRNA target sequence
cctttagcaacagcttcatctggat

SEQ ID NO: 29999 - DNA, 25 bp, Artificial sequence
  SiRNA target sequence
ctttagcaacagcttcatctggatt

SEQ ID NO: 30000 - DNA, 25 bp, Artificial sequence
  SiRNA target sequence
tttagcaacagcttcatctggatta

SEQ ID NO: 30001 - DNA, 25 bp, Artificial sequence
  SiRNA target sequence
ttagcaacagcttcatctggattaa

SEQ ID NO: 30002 - DNA, 25 bp, Artificial sequence
  SiRNA target sequence
tagcaacagcttcatctggattaat

SEQ ID NO: 30003 - DNA, 25 bp, Artificial sequence
  SiRNA target sequence
agcaacagcttcatctggattaata

SEQ ID NO: 30004 - DNA, 25 bp, Artificial sequence
  SiRNA target sequence
gcaacagcttcatctggattaatat

SEQ ID NO: 30005 - DNA, 25 bp, Artificial sequence
  SiRNA target sequence
caacagcttcatctggattaatatt

SEQ ID NO: 30006 - DNA, 25 bp, Artificial sequence
  SiRNA target sequence
aacagcttcatctggattaatattt

SEQ ID NO: 30007 - DNA, 25 bp, Artificial sequence
  SiRNA target sequence
acagcttcatctggattaatatttg

SEQ ID NO: 30008 - DNA, 25 bp, Artificial sequence
  SiRNA target sequence
cagcttcatctggattaatatttgt

SEQ ID NO: 30009 - DNA, 25 bp, Artificial sequence
  SiRNA target sequence
agcttcatctggattaatatttgta

SEQ ID NO: 30010 - DNA, 25 bp, Artificial sequence
  SiRNA target sequence
gcttcatctggattaatatttgtag

SEQ ID NO: 30011 - DNA, 25 bp, Artificial sequence
  SiRNA target sequence
cttcatctggattaatatttgtaga

SEQ ID NO: 30012 - DNA, 25 bp, Artificial sequence
  SiRNA target sequence
ttcatctggattaatatttgtagaa

SEQ ID NO: 30013 - DNA, 25 bp, Artificial sequence
  SiRNA target sequence
tcatctggattaatatttgtagaag

SEQ ID NO: 30014 - DNA, 25 bp, Artificial sequence
  SiRNA target sequence
catctggattaatatttgtagaagg

SEQ ID NO: 30015 - DNA, 25 bp, Artificial sequence
  SiRNA target sequence
atctggattaatatttgtagaaggc

SEQ ID NO: 30016 - DNA, 25 bp, Artificial sequence
  SiRNA target sequence
tctggattaatatttgtagaaggct

SEQ ID NO: 30017 - DNA, 25 bp, Artificial sequence
  SiRNA target sequence
ctggattaatatttgtagaaggctc

SEQ ID NO: 30018 - DNA, 25 bp, Artificial sequence
  SiRNA target sequence
tggattaatatttgtagaaggctcg

SEQ ID NO: 30019 - DNA, 25 bp, Artificial sequence
  SiRNA target sequence
ggattaatatttgtagaaggctcga

SEQ ID NO: 30020 - DNA, 25 bp, Artificial sequence
  SiRNA target sequence
gattaatatttgtagaaggctcgat

SEQ ID NO: 30021 - DNA, 25 bp, Artificial sequence
  SiRNA target sequence
attaatatttgtagaaggctcgata

SEQ ID NO: 30022 - DNA, 25 bp, Artificial sequence
  SiRNA target sequence
ttaatatttgtagaaggctcgatac

SEQ ID NO: 30023 - DNA, 25 bp, Artificial sequence
  SiRNA target sequence
taatatttgtagaaggctcgatacc

SEQ ID NO: 30024 - DNA, 25 bp, Artificial sequence
  SiRNA target sequence
aatatttgtagaaggctcgatacca

SEQ ID NO: 30025 - DNA, 25 bp, Artificial sequence
  SiRNA target sequence
atatttgtagaaggctcgataccaa

SEQ ID NO: 30026 - DNA, 25 bp, Artificial sequence
  SiRNA target sequence
tatttgtagaaggctcgataccaaa

SEQ ID NO: 30027 - DNA, 25 bp, Artificial sequence
  SiRNA target sequence
atttgtagaaggctcgataccaaaa

SEQ ID NO: 30028 - DNA, 25 bp, Artificial sequence
  SiRNA target sequence
tttgtagaaggctcgataccaaaaa

SEQ ID NO: 30029 - DNA, 25 bp, Artificial sequence
  SiRNA target sequence
ttgtagaaggctcgataccaaaaat

SEQ ID NO: 30030 - DNA, 25 bp, Artificial sequence
  SiRNA target sequence
tgtagaaggctcgataccaaaaatc

SEQ ID NO: 30031 - DNA, 25 bp, Artificial sequence
  SiRNA target sequence
gtagaaggctcgataccaaaaatct

SEQ ID NO: 30032 - DNA, 25 bp, Artificial sequence
  SiRNA target sequence
tagaaggctcgataccaaaaatctt

SEQ ID NO: 30033 - DNA, 25 bp, Artificial sequence
  SiRNA target sequence
agaaggctcgataccaaaaatcttc

SEQ ID NO: 30034 - DNA, 25 bp, Artificial sequence
  SiRNA target sequence
gaaggctcgataccaaaaatcttct

SEQ ID NO: 30035 - DNA, 25 bp, Artificial sequence
  SiRNA target sequence
aaggctcgataccaaaaatcttctt

SEQ ID NO: 30036 - DNA, 25 bp, Artificial sequence
  SiRNA target sequence
aggctcgataccaaaaatcttctta

SEQ ID NO: 30037 - DNA, 25 bp, Artificial sequence
  SiRNA target sequence
ggctcgataccaaaaatcttcttaa

SEQ ID NO: 30038 - DNA, 25 bp, Artificial sequence
  SiRNA target sequence
gctcgataccaaaaatcttcttaac

SEQ ID NO: 30039 - DNA, 25 bp, Artificial sequence
  SiRNA target sequence
ctcgataccaaaaatcttcttaaca

SEQ ID NO: 30040 - DNA, 25 bp, Artificial sequence
  SiRNA target sequence
tcgataccaaaaatcttcttaacaa

SEQ ID NO: 30041 - DNA, 25 bp, Artificial sequence
  SiRNA target sequence
cgataccaaaaatcttcttaacaag

SEQ ID NO: 30042 - DNA, 25 bp, Artificial sequence
  SiRNA target sequence
gataccaaaaatcttcttaacaagt

SEQ ID NO: 30043 - DNA, 25 bp, Artificial sequence
  SiRNA target sequence
ataccaaaaatcttcttaacaagtt

SEQ ID NO: 30044 - DNA, 25 bp, Artificial sequence
  SiRNA target sequence
taccaaaaatcttcttaacaagttt

SEQ ID NO: 30045 - DNA, 25 bp, Artificial sequence
  SiRNA target sequence
accaaaaatcttcttaacaagtttt

SEQ ID NO: 30046 - DNA, 25 bp, Artificial sequence
  SiRNA target sequence
ccaaaaatcttcttaacaagttttc

SEQ ID NO: 30047 - DNA, 25 bp, Artificial sequence
  SiRNA target sequence
caaaaatcttcttaacaagttttct

SEQ ID NO: 30048 - DNA, 25 bp, Artificial sequence
  SiRNA target sequence
aaaaatcttcttaacaagttttcta

SEQ ID NO: 30049 - DNA, 25 bp, Artificial sequence
  SiRNA target sequence
aaaatcttcttaacaagttttctaa

SEQ ID NO: 30050 - DNA, 25 bp, Artificial sequence
  SiRNA target sequence
aaatcttcttaacaagttttctaac

SEQ ID NO: 30051 - DNA, 25 bp, Artificial sequence
  SiRNA target sequence
aatcttcttaacaagttttctaaca

SEQ ID NO: 30052 - DNA, 25 bp, Artificial sequence
  SiRNA target sequence
atcttcttaacaagttttctaacat

SEQ ID NO: 30053 - DNA, 25 bp, Artificial sequence
  SiRNA target sequence
tcttcttaacaagttttctaacata

SEQ ID NO: 30054 - DNA, 25 bp, Artificial sequence
  SiRNA target sequence
cttcttaacaagttttctaacatac

SEQ ID NO: 30055 - DNA, 25 bp, Artificial sequence
  SiRNA target sequence
ttcttaacaagttttctaacatacg

SEQ ID NO: 30056 - DNA, 25 bp, Artificial sequence
  SiRNA target sequence
tcttaacaagttttctaacatacgg

SEQ ID NO: 30057 - DNA, 25 bp, Artificial sequence
  SiRNA target sequence
cttaacaagttttctaacatacggc

SEQ ID NO: 30058 - DNA, 25 bp, Artificial sequence
  SiRNA target sequence
ttaacaagttttctaacatacggca

SEQ ID NO: 30059 - DNA, 25 bp, Artificial sequence
  SiRNA target sequence
taacaagttttctaacatacggcat

SEQ ID NO: 30060 - DNA, 25 bp, Artificial sequence
  SiRNA target sequence
aacaagttttctaacatacggcatt

SEQ ID NO: 30061 - DNA, 25 bp, Artificial sequence
  SiRNA target sequence
acaagttttctaacatacggcattc

SEQ ID NO: 30062 - DNA, 25 bp, Artificial sequence
  SiRNA target sequence
caagttttctaacatacggcattcg

SEQ ID NO: 30063 - DNA, 25 bp, Artificial sequence
  SiRNA target sequence
aagttttctaacatacggcattcgt

SEQ ID NO: 30064 - DNA, 25 bp, Artificial sequence
  SiRNA target sequence
agttttctaacatacggcattcgtg

SEQ ID NO: 30065 - DNA, 25 bp, Artificial sequence
  SiRNA target sequence
gttttctaacatacggcattcgtgt

SEQ ID NO: 30066 - DNA, 25 bp, Artificial sequence
  SiRNA target sequence
ttttctaacatacggcattcgtgtc

SEQ ID NO: 30067 - DNA, 25 bp, Artificial sequence
  SiRNA target sequence
tttctaacatacggcattcgtgtca

SEQ ID NO: 30068 - DNA, 25 bp, Artificial sequence
  SiRNA target sequence
ttctaacatacggcattcgtgtcat

SEQ ID NO: 30069 - DNA, 25 bp, Artificial sequence
  SiRNA target sequence
tctaacatacggcattcgtgtcatt

SEQ ID NO: 30070 - DNA, 25 bp, Artificial sequence
  SiRNA target sequence
ctaacatacggcattcgtgtcattc

SEQ ID NO: 30071 - DNA, 25 bp, Artificial sequence
  SiRNA target sequence
taacatacggcattcgtgtcattcc

SEQ ID NO: 30072 - DNA, 25 bp, Artificial sequence
  SiRNA target sequence
aacatacggcattcgtgtcattcca

SEQ ID NO: 30073 - DNA, 25 bp, Artificial sequence
  SiRNA target sequence
acatacggcattcgtgtcattccac

SEQ ID NO: 30074 - DNA, 25 bp, Artificial sequence
  SiRNA target sequence
catacggcattcgtgtcattccacc

SEQ ID NO: 30075 - DNA, 25 bp, Artificial sequence
  SiRNA target sequence
atacggcattcgtgtcattccaccc

SEQ ID NO: 30076 - DNA, 25 bp, Artificial sequence
  SiRNA target sequence
tacggcattcgtgtcattccaccca

SEQ ID NO: 30077 - DNA, 25 bp, Artificial sequence
  SiRNA target sequence
acggcattcgtgtcattccacccac

SEQ ID NO: 30078 - DNA, 25 bp, Artificial sequence
  SiRNA target sequence
cggcattcgtgtcattccacccaca

SEQ ID NO: 30079 - DNA, 25 bp, Artificial sequence
  SiRNA target sequence
ggcattcgtgtcattccacccacaa

SEQ ID NO: 30080 - DNA, 25 bp, Artificial sequence
  SiRNA target sequence
gcattcgtgtcattccacccacaag

SEQ ID NO: 30081 - DNA, 25 bp, Artificial sequence
  SiRNA target sequence
cattcgtgtcattccacccacaagt

SEQ ID NO: 30082 - DNA, 25 bp, Artificial sequence
  SiRNA target sequence
attcgtgtcattccacccacaagta

SEQ ID NO: 30083 - DNA, 25 bp, Artificial sequence
  SiRNA target sequence
ttcgtgtcattccacccacaagtat

SEQ ID NO: 30084 - DNA, 25 bp, Artificial sequence
  SiRNA target sequence
tcgtgtcattccacccacaagtata

SEQ ID NO: 30085 - DNA, 25 bp, Artificial sequence
  SiRNA target sequence
cgtgtcattccacccacaagtataa

SEQ ID NO: 30086 - DNA, 25 bp, Artificial sequence
  SiRNA target sequence
gtgtcattccacccacaagtataac

SEQ ID NO: 30087 - DNA, 25 bp, Artificial sequence
  SiRNA target sequence
tgtcattccacccacaagtataacg

SEQ ID NO: 30088 - DNA, 25 bp, Artificial sequence
  SiRNA target sequence
gtcattccacccacaagtataacgt

SEQ ID NO: 30089 - DNA, 25 bp, Artificial sequence
  SiRNA target sequence
tcattccacccacaagtataacgtg

SEQ ID NO: 30090 - DNA, 25 bp, Artificial sequence
  SiRNA target sequence
cattccacccacaagtataacgtgt

SEQ ID NO: 30091 - DNA, 25 bp, Artificial sequence
  SiRNA target sequence
attccacccacaagtataacgtgtt

SEQ ID NO: 30092 - DNA, 25 bp, Artificial sequence
  SiRNA target sequence
ttccacccacaagtataacgtgttt

SEQ ID NO: 30093 - DNA, 25 bp, Artificial sequence
  SiRNA target sequence
tccacccacaagtataacgtgttta

SEQ ID NO: 30094 - DNA, 25 bp, Artificial sequence
  SiRNA target sequence
ccacccacaagtataacgtgtttaa

SEQ ID NO: 30095 - DNA, 25 bp, Artificial sequence
  SiRNA target sequence
cacccacaagtataacgtgtttaat

SEQ ID NO: 30096 - DNA, 25 bp, Artificial sequence
  SiRNA target sequence
acccacaagtataacgtgtttaata

SEQ ID NO: 30097 - DNA, 25 bp, Artificial sequence
  SiRNA target sequence
cccacaagtataacgtgtttaatat

SEQ ID NO: 30098 - DNA, 25 bp, Artificial sequence
  SiRNA target sequence
ccacaagtataacgtgtttaatatc

SEQ ID NO: 30099 - DNA, 25 bp, Artificial sequence
  SiRNA target sequence
cacaagtataacgtgtttaatatca

SEQ ID NO: 30100 - DNA, 25 bp, Artificial sequence
  SiRNA target sequence
acaagtataacgtgtttaatatcac

SEQ ID NO: 30101 - DNA, 25 bp, Artificial sequence
  SiRNA target sequence
caagtataacgtgtttaatatcact

SEQ ID NO: 30102 - DNA, 25 bp, Artificial sequence
  SiRNA target sequence
aagtataacgtgtttaatatcactt

SEQ ID NO: 30103 - DNA, 25 bp, Artificial sequence
  SiRNA target sequence
agtataacgtgtttaatatcacttt

SEQ ID NO: 30104 - DNA, 25 bp, Artificial sequence
  SiRNA target sequence
gtataacgtgtttaatatcactttt

SEQ ID NO: 30105 - DNA, 25 bp, Artificial sequence
  SiRNA target sequence
tataacgtgtttaatatcactttta

SEQ ID NO: 30106 - DNA, 25 bp, Artificial sequence
  SiRNA target sequence
ataacgtgtttaatatcacttttag

SEQ ID NO: 30107 - DNA, 25 bp, Artificial sequence
  SiRNA target sequence
taacgtgtttaatatcacttttagt

SEQ ID NO: 30108 - DNA, 25 bp, Artificial sequence
  SiRNA target sequence
aacgtgtttaatatcacttttagtt

SEQ ID NO: 30109 - DNA, 25 bp, Artificial sequence
  SiRNA target sequence
acgtgtttaatatcacttttagtta

SEQ ID NO: 30110 - DNA, 25 bp, Artificial sequence
  SiRNA target sequence
cgtgtttaatatcacttttagttat

SEQ ID NO: 30111 - DNA, 25 bp, Artificial sequence
  SiRNA target sequence
gtgtttaatatcacttttagttata

SEQ ID NO: 30112 - DNA, 25 bp, Artificial sequence
  SiRNA target sequence
tgtttaatatcacttttagttatat

SEQ ID NO: 30113 - DNA, 25 bp, Artificial sequence
  SiRNA target sequence
gtttaatatcacttttagttatatt

SEQ ID NO: 30114 - DNA, 25 bp, Artificial sequence
  SiRNA target sequence
tttaatatcacttttagttatattg

SEQ ID NO: 30115 - DNA, 25 bp, Artificial sequence
  SiRNA target sequence
ttaatatcacttttagttatattgg

SEQ ID NO: 30116 - DNA, 25 bp, Artificial sequence
  SiRNA target sequence
taatatcacttttagttatattggc

SEQ ID NO: 30117 - DNA, 25 bp, Artificial sequence
  SiRNA target sequence
aatatcacttttagttatattggca

SEQ ID NO: 30118 - DNA, 25 bp, Artificial sequence
  SiRNA target sequence
atatcacttttagttatattggcat

SEQ ID NO: 30119 - DNA, 25 bp, Artificial sequence
  SiRNA target sequence
tatcacttttagttatattggcatc

SEQ ID NO: 30120 - DNA, 25 bp, Artificial sequence
  SiRNA target sequence
atcacttttagttatattggcatct

SEQ ID NO: 30121 - DNA, 25 bp, Artificial sequence
  SiRNA target sequence
tcacttttagttatattggcatctc

SEQ ID NO: 30122 - DNA, 25 bp, Artificial sequence
  SiRNA target sequence
cacttttagttatattggcatctct

SEQ ID NO: 30123 - DNA, 25 bp, Artificial sequence
  SiRNA target sequence
acttttagttatattggcatctcta

SEQ ID NO: 30124 - DNA, 25 bp, Artificial sequence
  SiRNA target sequence
cttttagttatattggcatctctaa

SEQ ID NO: 30125 - DNA, 25 bp, Artificial sequence
  SiRNA target sequence
ttttagttatattggcatctctaat

SEQ ID NO: 30126 - DNA, 25 bp, Artificial sequence
  SiRNA target sequence
tttagttatattggcatctctaata

SEQ ID NO: 30127 - DNA, 25 bp, Artificial sequence
  SiRNA target sequence
ttagttatattggcatctctaatag

SEQ ID NO: 30128 - DNA, 25 bp, Artificial sequence
  SiRNA target sequence
tagttatattggcatctctaatagc

SEQ ID NO: 30129 - DNA, 25 bp, Artificial sequence
  SiRNA target sequence
agttatattggcatctctaatagct

SEQ ID NO: 30130 - DNA, 25 bp, Artificial sequence
  SiRNA target sequence
gttatattggcatctctaatagctt

SEQ ID NO: 30131 - DNA, 25 bp, Artificial sequence
  SiRNA target sequence
ttatattggcatctctaatagcttt

SEQ ID NO: 30132 - DNA, 25 bp, Artificial sequence
  SiRNA target sequence
tatattggcatctctaatagcttta

SEQ ID NO: 30133 - DNA, 25 bp, Artificial sequence
  SiRNA target sequence
atattggcatctctaatagctttaa

SEQ ID NO: 30134 - DNA, 25 bp, Artificial sequence
  SiRNA target sequence
tattggcatctctaatagctttaag

SEQ ID NO: 30135 - DNA, 25 bp, Artificial sequence
  SiRNA target sequence
attggcatctctaatagctttaaga

SEQ ID NO: 30136 - DNA, 25 bp, Artificial sequence
  SiRNA target sequence
ttggcatctctaatagctttaagac

SEQ ID NO: 30137 - DNA, 25 bp, Artificial sequence
  SiRNA target sequence
tggcatctctaatagctttaagaca

SEQ ID NO: 30138 - DNA, 25 bp, Artificial sequence
  SiRNA target sequence
ggcatctctaatagctttaagacag

SEQ ID NO: 30139 - DNA, 25 bp, Artificial sequence
  SiRNA target sequence
gcatctctaatagctttaagacagg

SEQ ID NO: 30140 - DNA, 25 bp, Artificial sequence
  SiRNA target sequence
catctctaatagctttaagacaggg

SEQ ID NO: 30141 - DNA, 25 bp, Artificial sequence
  SiRNA target sequence
atctctaatagctttaagacagggg

SEQ ID NO: 30142 - DNA, 25 bp, Artificial sequence
  SiRNA target sequence
tctctaatagctttaagacaggggt

SEQ ID NO: 30143 - DNA, 25 bp, Artificial sequence
  SiRNA target sequence
ctctaatagctttaagacaggggtt

SEQ ID NO: 30144 - DNA, 25 bp, Artificial sequence
  SiRNA target sequence
tctaatagctttaagacaggggttt

SEQ ID NO: 30145 - DNA, 25 bp, Artificial sequence
  SiRNA target sequence
ctaatagctttaagacaggggttta

SEQ ID NO: 30146 - DNA, 25 bp, Artificial sequence
  SiRNA target sequence
taatagctttaagacaggggtttat

SEQ ID NO: 30147 - DNA, 25 bp, Artificial sequence
  SiRNA target sequence
aatagctttaagacaggggtttatt

SEQ ID NO: 30148 - DNA, 25 bp, Artificial sequence
  SiRNA target sequence
atagctttaagacaggggtttattg

SEQ ID NO: 30149 - DNA, 25 bp, Artificial sequence
  SiRNA target sequence
tagctttaagacaggggtttattgt

SEQ ID NO: 30150 - DNA, 25 bp, Artificial sequence
  SiRNA target sequence
agctttaagacaggggtttattgtt

SEQ ID NO: 30151 - DNA, 25 bp, Artificial sequence
  SiRNA target sequence
gctttaagacaggggtttattgttt

SEQ ID NO: 30152 - DNA, 25 bp, Artificial sequence
  SiRNA target sequence
ctttaagacaggggtttattgtttt

SEQ ID NO: 30153 - DNA, 25 bp, Artificial sequence
  SiRNA target sequence
tttaagacaggggtttattgttttg

SEQ ID NO: 30154 - DNA, 25 bp, Artificial sequence
  SiRNA target sequence
ttaagacaggggtttattgttttgt

SEQ ID NO: 30155 - DNA, 25 bp, Artificial sequence
  SiRNA target sequence
taagacaggggtttattgttttgtc

SEQ ID NO: 30156 - DNA, 25 bp, Artificial sequence
  SiRNA target sequence
aagacaggggtttattgttttgtct

SEQ ID NO: 30157 - DNA, 25 bp, Artificial sequence
  SiRNA target sequence
agacaggggtttattgttttgtcta

SEQ ID NO: 30158 - DNA, 25 bp, Artificial sequence
  SiRNA target sequence
gacaggggtttattgttttgtctat

SEQ ID NO: 30159 - DNA, 25 bp, Artificial sequence
  SiRNA target sequence
acaggggtttattgttttgtctatt

SEQ ID NO: 30160 - DNA, 25 bp, Artificial sequence
  SiRNA target sequence
caggggtttattgttttgtctatta

SEQ ID NO: 30161 - DNA, 25 bp, Artificial sequence
  SiRNA target sequence
aggggtttattgttttgtctattaa

SEQ ID NO: 30162 - DNA, 25 bp, Artificial sequence
  SiRNA target sequence
ggggtttattgttttgtctattaac

SEQ ID NO: 30163 - DNA, 25 bp, Artificial sequence
  SiRNA target sequence
gggtttattgttttgtctattaact

SEQ ID NO: 30164 - DNA, 25 bp, Artificial sequence
  SiRNA target sequence
ggtttattgttttgtctattaactt

SEQ ID NO: 30165 - DNA, 25 bp, Artificial sequence
  SiRNA target sequence
gtttattgttttgtctattaacttt

SEQ ID NO: 30166 - DNA, 25 bp, Artificial sequence
  SiRNA target sequence
tttattgttttgtctattaactttt

SEQ ID NO: 30167 - DNA, 25 bp, Artificial sequence
  SiRNA target sequence
ttattgttttgtctattaacttttt

SEQ ID NO: 30168 - DNA, 25 bp, Artificial sequence
  SiRNA target sequence
tattgttttgtctattaactttttt

SEQ ID NO: 30169 - DNA, 25 bp, Artificial sequence
  SiRNA target sequence
attgttttgtctattaacttttttg

SEQ ID NO: 30170 - DNA, 25 bp, Artificial sequence
  SiRNA target sequence
ttgttttgtctattaacttttttgt

SEQ ID NO: 30171 - DNA, 25 bp, Artificial sequence
  SiRNA target sequence
tgttttgtctattaacttttttgta

SEQ ID NO: 30172 - DNA, 25 bp, Artificial sequence
  SiRNA target sequence
gttttgtctattaacttttttgtaa

SEQ ID NO: 30173 - DNA, 25 bp, Artificial sequence
  SiRNA target sequence
ttttgtctattaacttttttgtaat

SEQ ID NO: 30174 - DNA, 25 bp, Artificial sequence
  SiRNA target sequence
tttgtctattaacttttttgtaatt

SEQ ID NO: 30175 - DNA, 25 bp, Artificial sequence
  SiRNA target sequence
ttgtctattaacttttttgtaattt

SEQ ID NO: 30176 - DNA, 25 bp, Artificial sequence
  SiRNA target sequence
tgtctattaacttttttgtaatttt

SEQ ID NO: 30177 - DNA, 25 bp, Artificial sequence
  SiRNA target sequence
gtctattaacttttttgtaattttt

SEQ ID NO: 30178 - DNA, 25 bp, Artificial sequence
  SiRNA target sequence
tctattaacttttttgtaatttttt

SEQ ID NO: 30179 - DNA, 25 bp, Artificial sequence
  SiRNA target sequence
ctattaacttttttgtaattttttc

SEQ ID NO: 30180 - DNA, 25 bp, Artificial sequence
  SiRNA target sequence
tattaacttttttgtaattttttca

SEQ ID NO: 30181 - DNA, 25 bp, Artificial sequence
  SiRNA target sequence
attaacttttttgtaattttttcaa

SEQ ID NO: 30182 - DNA, 25 bp, Artificial sequence
  SiRNA target sequence
ttaacttttttgtaattttttcaaa

SEQ ID NO: 30183 - DNA, 25 bp, Artificial sequence
  SiRNA target sequence
taacttttttgtaattttttcaaat

SEQ ID NO: 30184 - DNA, 25 bp, Artificial sequence
  SiRNA target sequence
aacttttttgtaattttttcaaatt

SEQ ID NO: 30185 - DNA, 25 bp, Artificial sequence
  SiRNA target sequence
acttttttgtaattttttcaaattc

SEQ ID NO: 30186 - DNA, 25 bp, Artificial sequence
  SiRNA target sequence
cttttttgtaattttttcaaattcg

SEQ ID NO: 30187 - DNA, 25 bp, Artificial sequence
  SiRNA target sequence
ttttttgtaattttttcaaattcgt

SEQ ID NO: 30188 - DNA, 25 bp, Artificial sequence
  SiRNA target sequence
tttttgtaattttttcaaattcgtc

SEQ ID NO: 30189 - DNA, 25 bp, Artificial sequence
  SiRNA target sequence
ttttgtaattttttcaaattcgtcg

SEQ ID NO: 30190 - DNA, 25 bp, Artificial sequence
  SiRNA target sequence
tttgtaattttttcaaattcgtcgc

SEQ ID NO: 30191 - DNA, 25 bp, Artificial sequence
  SiRNA target sequence
ttgtaattttttcaaattcgtcgcg

SEQ ID NO: 30192 - DNA, 25 bp, Artificial sequence
  SiRNA target sequence
tgtaattttttcaaattcgtcgcgt

SEQ ID NO: 30193 - DNA, 25 bp, Artificial sequence
  SiRNA target sequence
gtaattttttcaaattcgtcgcgtg

SEQ ID NO: 30194 - DNA, 25 bp, Artificial sequence
  SiRNA target sequence
taattttttcaaattcgtcgcgtgt

SEQ ID NO: 30195 - DNA, 25 bp, Artificial sequence
  SiRNA target sequence
aattttttcaaattcgtcgcgtgta

SEQ ID NO: 30196 - DNA, 25 bp, Artificial sequence
  SiRNA target sequence
attttttcaaattcgtcgcgtgtaa

SEQ ID NO: 30197 - DNA, 25 bp, Artificial sequence
  SiRNA target sequence
ttttttcaaattcgtcgcgtgtaat

SEQ ID NO: 30198 - DNA, 25 bp, Artificial sequence
  SiRNA target sequence
tttttcaaattcgtcgcgtgtaatt

SEQ ID NO: 30199 - DNA, 25 bp, Artificial sequence
  SiRNA target sequence
ttttcaaattcgtcgcgtgtaatta

SEQ ID NO: 30200 - DNA, 25 bp, Artificial sequence
  SiRNA target sequence
tttcaaattcgtcgcgtgtaattac

SEQ ID NO: 30201 - DNA, 25 bp, Artificial sequence
  SiRNA target sequence
ttcaaattcgtcgcgtgtaattacc

SEQ ID NO: 30202 - DNA, 25 bp, Artificial sequence
  SiRNA target sequence
tcaaattcgtcgcgtgtaattacct

SEQ ID NO: 30203 - DNA, 25 bp, Artificial sequence
  SiRNA target sequence
caaattcgtcgcgtgtaattacctc

SEQ ID NO: 30204 - DNA, 25 bp, Artificial sequence
  SiRNA target sequence
aaattcgtcgcgtgtaattacctct

SEQ ID NO: 30205 - DNA, 25 bp, Artificial sequence
  SiRNA target sequence
aattcgtcgcgtgtaattacctctt

SEQ ID NO: 30206 - DNA, 25 bp, Artificial sequence
  SiRNA target sequence
attcgtcgcgtgtaattacctcttt

SEQ ID NO: 30207 - DNA, 25 bp, Artificial sequence
  SiRNA target sequence
ttcgtcgcgtgtaattacctctttt

SEQ ID NO: 30208 - DNA, 25 bp, Artificial sequence
  SiRNA target sequence
tcgtcgcgtgtaattacctctttta

SEQ ID NO: 30209 - DNA, 25 bp, Artificial sequence
  SiRNA target sequence
cgtcgcgtgtaattacctcttttaa

SEQ ID NO: 30210 - DNA, 25 bp, Artificial sequence
  SiRNA target sequence
gtcgcgtgtaattacctcttttaag

SEQ ID NO: 30211 - DNA, 25 bp, Artificial sequence
  SiRNA target sequence
tcgcgtgtaattacctcttttaagt

SEQ ID NO: 30212 - DNA, 25 bp, Artificial sequence
  SiRNA target sequence
cgcgtgtaattacctcttttaagtg

SEQ ID NO: 30213 - DNA, 25 bp, Artificial sequence
  SiRNA target sequence
gcgtgtaattacctcttttaagtga

SEQ ID NO: 30214 - DNA, 25 bp, Artificial sequence
  SiRNA target sequence
cgtgtaattacctcttttaagtgat

SEQ ID NO: 30215 - DNA, 25 bp, Artificial sequence
  SiRNA target sequence
gtgtaattacctcttttaagtgata

SEQ ID NO: 30216 - DNA, 25 bp, Artificial sequence
  SiRNA target sequence
tgtaattacctcttttaagtgataa

SEQ ID NO: 30217 - DNA, 25 bp, Artificial sequence
  SiRNA target sequence
gtaattacctcttttaagtgataat

SEQ ID NO: 30218 - DNA, 25 bp, Artificial sequence
  SiRNA target sequence
taattacctcttttaagtgataatt

SEQ ID NO: 30219 - DNA, 25 bp, Artificial sequence
  SiRNA target sequence
aattacctcttttaagtgataattc

SEQ ID NO: 30220 - DNA, 25 bp, Artificial sequence
  SiRNA target sequence
attacctcttttaagtgataattct

SEQ ID NO: 30221 - DNA, 25 bp, Artificial sequence
  SiRNA target sequence
ttacctcttttaagtgataattctt

SEQ ID NO: 30222 - DNA, 25 bp, Artificial sequence
  SiRNA target sequence
tacctcttttaagtgataattcttt

SEQ ID NO: 30223 - DNA, 25 bp, Artificial sequence
  SiRNA target sequence
acctcttttaagtgataattctttt

SEQ ID NO: 30224 - DNA, 25 bp, Artificial sequence
  SiRNA target sequence
cctcttttaagtgataattcttttt

SEQ ID NO: 30225 - DNA, 25 bp, Artificial sequence
  SiRNA target sequence
ctcttttaagtgataattcttttta

SEQ ID NO: 30226 - DNA, 25 bp, Artificial sequence
  SiRNA target sequence
tcttttaagtgataattctttttac

SEQ ID NO: 30227 - DNA, 25 bp, Artificial sequence
  SiRNA target sequence
cttttaagtgataattctttttact

SEQ ID NO: 30228 - DNA, 25 bp, Artificial sequence
  SiRNA target sequence
ttttaagtgataattctttttacta

SEQ ID NO: 30229 - DNA, 25 bp, Artificial sequence
  SiRNA target sequence
tttaagtgataattctttttactat

SEQ ID NO: 30230 - DNA, 25 bp, Artificial sequence
  SiRNA target sequence
ttaagtgataattctttttactatc

SEQ ID NO: 30231 - DNA, 25 bp, Artificial sequence
  SiRNA target sequence
taagtgataattctttttactatcg

SEQ ID NO: 30232 - DNA, 25 bp, Artificial sequence
  SiRNA target sequence
aagtgataattctttttactatcgt

SEQ ID NO: 30233 - DNA, 25 bp, Artificial sequence
  SiRNA target sequence
agtgataattctttttactatcgtt

SEQ ID NO: 30234 - DNA, 25 bp, Artificial sequence
  SiRNA target sequence
gtgataattctttttactatcgtta

SEQ ID NO: 30235 - DNA, 25 bp, Artificial sequence
  SiRNA target sequence
tgataattctttttactatcgttat

SEQ ID NO: 30236 - DNA, 25 bp, Artificial sequence
  SiRNA target sequence
gataattctttttactatcgttata

SEQ ID NO: 30237 - DNA, 25 bp, Artificial sequence
  SiRNA target sequence
ataattctttttactatcgttataa

SEQ ID NO: 30238 - DNA, 25 bp, Artificial sequence
  SiRNA target sequence
taattctttttactatcgttataaa

SEQ ID NO: 30239 - DNA, 25 bp, Artificial sequence
  SiRNA target sequence
aattctttttactatcgttataaat

SEQ ID NO: 30240 - DNA, 25 bp, Artificial sequence
  SiRNA target sequence
attctttttactatcgttataaata

SEQ ID NO: 30241 - DNA, 25 bp, Artificial sequence
  SiRNA target sequence
ttctttttactatcgttataaatat

SEQ ID NO: 30242 - DNA, 25 bp, Artificial sequence
  SiRNA target sequence
tctttttactatcgttataaatata

SEQ ID NO: 30243 - DNA, 25 bp, Artificial sequence
  SiRNA target sequence
ctttttactatcgttataaatatac

SEQ ID NO: 30244 - DNA, 25 bp, Artificial sequence
  SiRNA target sequence
tttttactatcgttataaatatacg

SEQ ID NO: 30245 - DNA, 25 bp, Artificial sequence
  SiRNA target sequence
ttttactatcgttataaatatacgg

SEQ ID NO: 30246 - DNA, 25 bp, Artificial sequence
  SiRNA target sequence
tttactatcgttataaatatacgga

SEQ ID NO: 30247 - DNA, 25 bp, Artificial sequence
  SiRNA target sequence
ttactatcgttataaatatacggaa

SEQ ID NO: 30248 - DNA, 25 bp, Artificial sequence
  SiRNA target sequence
tactatcgttataaatatacggaat

SEQ ID NO: 30249 - DNA, 25 bp, Artificial sequence
  SiRNA target sequence
actatcgttataaatatacggaata

SEQ ID NO: 30250 - DNA, 25 bp, Artificial sequence
  SiRNA target sequence
ctatcgttataaatatacggaatat

SEQ ID NO: 30251 - DNA, 25 bp, Artificial sequence
  SiRNA target sequence
tatcgttataaatatacggaatatt

SEQ ID NO: 30252 - DNA, 25 bp, Artificial sequence
  SiRNA target sequence
atcgttataaatatacggaatatta

SEQ ID NO: 30253 - DNA, 25 bp, Artificial sequence
  SiRNA target sequence
tcgttataaatatacggaatattaa

SEQ ID NO: 30254 - DNA, 25 bp, Artificial sequence
  SiRNA target sequence
cgttataaatatacggaatattaat

SEQ ID NO: 30255 - DNA, 25 bp, Artificial sequence
  SiRNA target sequence
gttataaatatacggaatattaatt

SEQ ID NO: 30256 - DNA, 25 bp, Artificial sequence
  SiRNA target sequence
ttataaatatacggaatattaattt

SEQ ID NO: 30257 - DNA, 25 bp, Artificial sequence
  SiRNA target sequence
tataaatatacggaatattaatttc

SEQ ID NO: 30258 - DNA, 25 bp, Artificial sequence
  SiRNA target sequence
ataaatatacggaatattaatttca

SEQ ID NO: 30259 - DNA, 25 bp, Artificial sequence
  SiRNA target sequence
taaatatacggaatattaatttcag

SEQ ID NO: 30260 - DNA, 25 bp, Artificial sequence
  SiRNA target sequence
aaatatacggaatattaatttcaga

SEQ ID NO: 30261 - DNA, 25 bp, Artificial sequence
  SiRNA target sequence
aatatacggaatattaatttcagac

SEQ ID NO: 30262 - DNA, 25 bp, Artificial sequence
  SiRNA target sequence
atatacggaatattaatttcagacg

SEQ ID NO: 30263 - DNA, 25 bp, Artificial sequence
  SiRNA target sequence
tatacggaatattaatttcagacga

SEQ ID NO: 30264 - DNA, 25 bp, Artificial sequence
  SiRNA target sequence
atacggaatattaatttcagacgaa

SEQ ID NO: 30265 - DNA, 25 bp, Artificial sequence
  SiRNA target sequence
tacggaatattaatttcagacgaaa

SEQ ID NO: 30266 - DNA, 25 bp, Artificial sequence
  SiRNA target sequence
acggaatattaatttcagacgaaag

SEQ ID NO: 30267 - DNA, 25 bp, Artificial sequence
  SiRNA target sequence
cggaatattaatttcagacgaaaga

SEQ ID NO: 30268 - DNA, 25 bp, Artificial sequence
  SiRNA target sequence
ggaatattaatttcagacgaaagat

SEQ ID NO: 30269 - DNA, 25 bp, Artificial sequence
  SiRNA target sequence
gaatattaatttcagacgaaagatt

SEQ ID NO: 30270 - DNA, 25 bp, Artificial sequence
  SiRNA target sequence
aatattaatttcagacgaaagatta

SEQ ID NO: 30271 - DNA, 25 bp, Artificial sequence
  SiRNA target sequence
atattaatttcagacgaaagattag

SEQ ID NO: 30272 - DNA, 25 bp, Artificial sequence
  SiRNA target sequence
tattaatttcagacgaaagattaga

SEQ ID NO: 30273 - DNA, 25 bp, Artificial sequence
  SiRNA target sequence
attaatttcagacgaaagattagac

SEQ ID NO: 30274 - DNA, 25 bp, Artificial sequence
  SiRNA target sequence
ttaatttcagacgaaagattagacg

SEQ ID NO: 30275 - DNA, 25 bp, Artificial sequence
  SiRNA target sequence
taatttcagacgaaagattagacga

SEQ ID NO: 30276 - DNA, 25 bp, Artificial sequence
  SiRNA target sequence
aatttcagacgaaagattagacgac

SEQ ID NO: 30277 - DNA, 25 bp, Artificial sequence
  SiRNA target sequence
atttcagacgaaagattagacgaca

SEQ ID NO: 30278 - DNA, 25 bp, Artificial sequence
  SiRNA target sequence
tttcagacgaaagattagacgacag

SEQ ID NO: 30279 - DNA, 25 bp, Artificial sequence
  SiRNA target sequence
ttcagacgaaagattagacgacagt

SEQ ID NO: 30280 - DNA, 25 bp, Artificial sequence
  SiRNA target sequence
tcagacgaaagattagacgacagtt

SEQ ID NO: 30281 - DNA, 25 bp, Artificial sequence
  SiRNA target sequence
cagacgaaagattagacgacagttc

SEQ ID NO: 30282 - DNA, 25 bp, Artificial sequence
  SiRNA target sequence
agacgaaagattagacgacagttct

SEQ ID NO: 30283 - DNA, 25 bp, Artificial sequence
  SiRNA target sequence
gacgaaagattagacgacagttctt

SEQ ID NO: 30284 - DNA, 25 bp, Artificial sequence
  SiRNA target sequence
acgaaagattagacgacagttcttt

SEQ ID NO: 30285 - DNA, 25 bp, Artificial sequence
  SiRNA target sequence
cgaaagattagacgacagttctttt

SEQ ID NO: 30286 - DNA, 25 bp, Artificial sequence
  SiRNA target sequence
gaaagattagacgacagttcttttt

SEQ ID NO: 30287 - DNA, 25 bp, Artificial sequence
  SiRNA target sequence
aaagattagacgacagttctttttt

SEQ ID NO: 30288 - DNA, 25 bp, Artificial sequence
  SiRNA target sequence
aagattagacgacagttcttttttc

SEQ ID NO: 30289 - DNA, 25 bp, Artificial sequence
  SiRNA target sequence
agattagacgacagttcttttttca

SEQ ID NO: 30290 - DNA, 25 bp, Artificial sequence
  SiRNA target sequence
gattagacgacagttcttttttcat

SEQ ID NO: 30291 - DNA, 25 bp, Artificial sequence
  SiRNA target sequence
attagacgacagttcttttttcatt

SEQ ID NO: 30292 - DNA, 25 bp, Artificial sequence
  SiRNA target sequence
ttagacgacagttcttttttcattt

SEQ ID NO: 30293 - DNA, 25 bp, Artificial sequence
  SiRNA target sequence
tagacgacagttcttttttcatttt

SEQ ID NO: 30294 - DNA, 25 bp, Artificial sequence
  SiRNA target sequence
agacgacagttcttttttcattttt

SEQ ID NO: 30295 - DNA, 25 bp, Artificial sequence
  SiRNA target sequence
gacgacagttcttttttcatttttt

SEQ ID NO: 30296 - DNA, 25 bp, Artificial sequence
  SiRNA target sequence
acgacagttcttttttcattttttc

SEQ ID NO: 30297 - DNA, 25 bp, Artificial sequence
  SiRNA target sequence
cgacagttcttttttcattttttcc

SEQ ID NO: 30298 - DNA, 25 bp, Artificial sequence
  SiRNA target sequence
gacagttcttttttcattttttccg

SEQ ID NO: 30299 - DNA, 25 bp, Artificial sequence
  SiRNA target sequence
acagttcttttttcattttttccgc

SEQ ID NO: 30300 - DNA, 25 bp, Artificial sequence
  SiRNA target sequence
cagttcttttttcattttttccgct

SEQ ID NO: 30301 - DNA, 25 bp, Artificial sequence
  SiRNA target sequence
agttcttttttcattttttccgctg

SEQ ID NO: 30302 - DNA, 25 bp, Artificial sequence
  SiRNA target sequence
gttcttttttcattttttccgctgc

SEQ ID NO: 30303 - DNA, 25 bp, Artificial sequence
  SiRNA target sequence
ttcttttttcattttttccgctgct

SEQ ID NO: 30304 - DNA, 25 bp, Artificial sequence
  SiRNA target sequence
tcttttttcattttttccgctgctt

SEQ ID NO: 30305 - DNA, 25 bp, Artificial sequence
  SiRNA target sequence
cttttttcattttttccgctgcttc

SEQ ID NO: 30306 - DNA, 25 bp, Artificial sequence
  SiRNA target sequence
ttttttcattttttccgctgcttct

SEQ ID NO: 30307 - DNA, 25 bp, Artificial sequence
  SiRNA target sequence
tttttcattttttccgctgcttctt

SEQ ID NO: 30308 - DNA, 25 bp, Artificial sequence
  SiRNA target sequence
ttttcattttttccgctgcttcttt

SEQ ID NO: 30309 - DNA, 25 bp, Artificial sequence
  SiRNA target sequence
tttcattttttccgctgcttcttta

SEQ ID NO: 30310 - DNA, 25 bp, Artificial sequence
  SiRNA target sequence
ttcattttttccgctgcttctttaa

SEQ ID NO: 30311 - DNA, 25 bp, Artificial sequence
  SiRNA target sequence
tcattttttccgctgcttctttaat

SEQ ID NO: 30312 - DNA, 25 bp, Artificial sequence
  SiRNA target sequence
cattttttccgctgcttctttaatt

SEQ ID NO: 30313 - DNA, 25 bp, Artificial sequence
  SiRNA target sequence
attttttccgctgcttctttaattc

SEQ ID NO: 30314 - DNA, 25 bp, Artificial sequence
  SiRNA target sequence
ttttttccgctgcttctttaattct

SEQ ID NO: 30315 - DNA, 25 bp, Artificial sequence
  SiRNA target sequence
tttttccgctgcttctttaattcta

SEQ ID NO: 30316 - DNA, 25 bp, Artificial sequence
  SiRNA target sequence
ttttccgctgcttctttaattctat

SEQ ID NO: 30317 - DNA, 25 bp, Artificial sequence
  SiRNA target sequence
tttccgctgcttctttaattctatt

SEQ ID NO: 30318 - DNA, 25 bp, Artificial sequence
  SiRNA target sequence
ttccgctgcttctttaattctatta

SEQ ID NO: 30319 - DNA, 25 bp, Artificial sequence
  SiRNA target sequence
tccgctgcttctttaattctattat

SEQ ID NO: 30320 - DNA, 25 bp, Artificial sequence
  SiRNA target sequence
ccgctgcttctttaattctattata

SEQ ID NO: 30321 - DNA, 25 bp, Artificial sequence
  SiRNA target sequence
cgctgcttctttaattctattataa

SEQ ID NO: 30322 - DNA, 25 bp, Artificial sequence
  SiRNA target sequence
gctgcttctttaattctattataac

SEQ ID NO: 30323 - DNA, 25 bp, Artificial sequence
  SiRNA target sequence
ctgcttctttaattctattataaca

SEQ ID NO: 30324 - DNA, 25 bp, Artificial sequence
  SiRNA target sequence
tgcttctttaattctattataacaa

SEQ ID NO: 30325 - DNA, 25 bp, Artificial sequence
  SiRNA target sequence
gcttctttaattctattataacaag

SEQ ID NO: 30326 - DNA, 25 bp, Artificial sequence
  SiRNA target sequence
cttctttaattctattataacaaga

SEQ ID NO: 30327 - DNA, 25 bp, Artificial sequence
  SiRNA target sequence
ttctttaattctattataacaagaa

SEQ ID NO: 30328 - DNA, 25 bp, Artificial sequence
  SiRNA target sequence
tctttaattctattataacaagaat

SEQ ID NO: 30329 - DNA, 25 bp, Artificial sequence
  SiRNA target sequence
ctttaattctattataacaagaatc

SEQ ID NO: 30330 - DNA, 25 bp, Artificial sequence
  SiRNA target sequence
tttaattctattataacaagaatcg

SEQ ID NO: 30331 - DNA, 25 bp, Artificial sequence
  SiRNA target sequence
ttaattctattataacaagaatcgt

SEQ ID NO: 30332 - DNA, 25 bp, Artificial sequence
  SiRNA target sequence
taattctattataacaagaatcgtg

SEQ ID NO: 30333 - DNA, 25 bp, Artificial sequence
  SiRNA target sequence
aattctattataacaagaatcgtgt

SEQ ID NO: 30334 - DNA, 25 bp, Artificial sequence
  SiRNA target sequence
attctattataacaagaatcgtgtt

SEQ ID NO: 30335 - DNA, 25 bp, Artificial sequence
  SiRNA target sequence
ttctattataacaagaatcgtgttt

SEQ ID NO: 30336 - DNA, 25 bp, Artificial sequence
  SiRNA target sequence
tctattataacaagaatcgtgttta

SEQ ID NO: 30337 - DNA, 25 bp, Artificial sequence
  SiRNA target sequence
ctattataacaagaatcgtgtttaa

SEQ ID NO: 30338 - DNA, 25 bp, Artificial sequence
  SiRNA target sequence
tattataacaagaatcgtgtttaag

SEQ ID NO: 30339 - DNA, 25 bp, Artificial sequence
  SiRNA target sequence
attataacaagaatcgtgtttaagt

SEQ ID NO: 30340 - DNA, 25 bp, Artificial sequence
  SiRNA target sequence
ttataacaagaatcgtgtttaagta

SEQ ID NO: 30341 - DNA, 25 bp, Artificial sequence
  SiRNA target sequence
tataacaagaatcgtgtttaagtaa

SEQ ID NO: 30342 - DNA, 25 bp, Artificial sequence
  SiRNA target sequence
ataacaagaatcgtgtttaagtaaa

SEQ ID NO: 30343 - DNA, 25 bp, Artificial sequence
  SiRNA target sequence
taacaagaatcgtgtttaagtaaat

SEQ ID NO: 30344 - DNA, 25 bp, Artificial sequence
  SiRNA target sequence
aacaagaatcgtgtttaagtaaatc

SEQ ID NO: 30345 - DNA, 25 bp, Artificial sequence
  SiRNA target sequence
acaagaatcgtgtttaagtaaatca

SEQ ID NO: 30346 - DNA, 25 bp, Artificial sequence
  SiRNA target sequence
caagaatcgtgtttaagtaaatcaa

SEQ ID NO: 30347 - DNA, 25 bp, Artificial sequence
  SiRNA target sequence
aagaatcgtgtttaagtaaatcaat

SEQ ID NO: 30348 - DNA, 25 bp, Artificial sequence
  SiRNA target sequence
agaatcgtgtttaagtaaatcaatt

SEQ ID NO: 30349 - DNA, 25 bp, Artificial sequence
  SiRNA target sequence
gaatcgtgtttaagtaaatcaattc

SEQ ID NO: 30350 - DNA, 25 bp, Artificial sequence
  SiRNA target sequence
aatcgtgtttaagtaaatcaattcc

SEQ ID NO: 30351 - DNA, 25 bp, Artificial sequence
  SiRNA target sequence
atcgtgtttaagtaaatcaattcct

SEQ ID NO: 30352 - DNA, 25 bp, Artificial sequence
  SiRNA target sequence
tcgtgtttaagtaaatcaattcctg

SEQ ID NO: 30353 - DNA, 25 bp, Artificial sequence
  SiRNA target sequence
cgtgtttaagtaaatcaattcctgt

SEQ ID NO: 30354 - DNA, 25 bp, Artificial sequence
  SiRNA target sequence
gtgtttaagtaaatcaattcctgtt

SEQ ID NO: 30355 - DNA, 25 bp, Artificial sequence
  SiRNA target sequence
tgtttaagtaaatcaattcctgttc

SEQ ID NO: 30356 - DNA, 25 bp, Artificial sequence
  SiRNA target sequence
gtttaagtaaatcaattcctgttct

SEQ ID NO: 30357 - DNA, 25 bp, Artificial sequence
  SiRNA target sequence
tttaagtaaatcaattcctgttcta

SEQ ID NO: 30358 - DNA, 25 bp, Artificial sequence
  SiRNA target sequence
ttaagtaaatcaattcctgttctac

SEQ ID NO: 30359 - DNA, 25 bp, Artificial sequence
  SiRNA target sequence
taagtaaatcaattcctgttctact

SEQ ID NO: 30360 - DNA, 25 bp, Artificial sequence
  SiRNA target sequence
aagtaaatcaattcctgttctactt

SEQ ID NO: 30361 - DNA, 25 bp, Artificial sequence
  SiRNA target sequence
agtaaatcaattcctgttctacttt

SEQ ID NO: 30362 - DNA, 25 bp, Artificial sequence
  SiRNA target sequence
gtaaatcaattcctgttctactttt

SEQ ID NO: 30363 - DNA, 25 bp, Artificial sequence
  SiRNA target sequence
taaatcaattcctgttctactttta

SEQ ID NO: 30364 - DNA, 25 bp, Artificial sequence
  SiRNA target sequence
aaatcaattcctgttctacttttaa

SEQ ID NO: 30365 - DNA, 25 bp, Artificial sequence
  SiRNA target sequence
aatcaattcctgttctacttttaaa

SEQ ID NO: 30366 - DNA, 25 bp, Artificial sequence
  SiRNA target sequence
atcaattcctgttctacttttaaat

SEQ ID NO: 30367 - DNA, 25 bp, Artificial sequence
  SiRNA target sequence
tcaattcctgttctacttttaaatt

SEQ ID NO: 30368 - DNA, 25 bp, Artificial sequence
  SiRNA target sequence
caattcctgttctacttttaaattt

SEQ ID NO: 30369 - DNA, 25 bp, Artificial sequence
  SiRNA target sequence
aattcctgttctacttttaaatttt

SEQ ID NO: 30370 - DNA, 25 bp, Artificial sequence
  SiRNA target sequence
attcctgttctacttttaaattttt

SEQ ID NO: 30371 - DNA, 25 bp, Artificial sequence
  SiRNA target sequence
ttcctgttctacttttaaatttttc

SEQ ID NO: 30372 - DNA, 25 bp, Artificial sequence
  SiRNA target sequence
tcctgttctacttttaaatttttca

SEQ ID NO: 30373 - DNA, 25 bp, Artificial sequence
  SiRNA target sequence
cctgttctacttttaaatttttcat

SEQ ID NO: 30374 - DNA, 25 bp, Artificial sequence
  SiRNA target sequence
ctgttctacttttaaatttttcatt

SEQ ID NO: 30375 - DNA, 25 bp, Artificial sequence
  SiRNA target sequence
tgttctacttttaaatttttcatta

SEQ ID NO: 30376 - DNA, 25 bp, Artificial sequence
  SiRNA target sequence
gttctacttttaaatttttcattaa

SEQ ID NO: 30377 - DNA, 25 bp, Artificial sequence
  SiRNA target sequence
ttctacttttaaatttttcattaat

SEQ ID NO: 30378 - DNA, 25 bp, Artificial sequence
  SiRNA target sequence
tctacttttaaatttttcattaata

SEQ ID NO: 30379 - DNA, 25 bp, Artificial sequence
  SiRNA target sequence
ctacttttaaatttttcattaatat

SEQ ID NO: 30380 - DNA, 25 bp, Artificial sequence
  SiRNA target sequence
tacttttaaatttttcattaatata

SEQ ID NO: 30381 - DNA, 25 bp, Artificial sequence
  SiRNA target sequence
acttttaaatttttcattaatataa

SEQ ID NO: 30382 - DNA, 25 bp, Artificial sequence
  SiRNA target sequence
cttttaaatttttcattaatataat

SEQ ID NO: 30383 - DNA, 25 bp, Artificial sequence
  SiRNA target sequence
ttttaaatttttcattaatataatc

SEQ ID NO: 30384 - DNA, 25 bp, Artificial sequence
  SiRNA target sequence
tttaaatttttcattaatataatct

SEQ ID NO: 30385 - DNA, 25 bp, Artificial sequence
  SiRNA target sequence
ttaaatttttcattaatataatcta

SEQ ID NO: 30386 - DNA, 25 bp, Artificial sequence
  SiRNA target sequence
taaatttttcattaatataatctac

SEQ ID NO: 30387 - DNA, 25 bp, Artificial sequence
  SiRNA target sequence
aaatttttcattaatataatctact

SEQ ID NO: 30388 - DNA, 25 bp, Artificial sequence
  SiRNA target sequence
aatttttcattaatataatctacta

SEQ ID NO: 30389 - DNA, 25 bp, Artificial sequence
  SiRNA target sequence
atttttcattaatataatctactaa

SEQ ID NO: 30390 - DNA, 25 bp, Artificial sequence
  SiRNA target sequence
tttttcattaatataatctactaaa

SEQ ID NO: 30391 - DNA, 25 bp, Artificial sequence
  SiRNA target sequence
ttttcattaatataatctactaaag

SEQ ID NO: 30392 - DNA, 25 bp, Artificial sequence
  SiRNA target sequence
tttcattaatataatctactaaagt

SEQ ID NO: 30393 - DNA, 25 bp, Artificial sequence
  SiRNA target sequence
ttcattaatataatctactaaagta

SEQ ID NO: 30394 - DNA, 25 bp, Artificial sequence
  SiRNA target sequence
tcattaatataatctactaaagtat

SEQ ID NO: 30395 - DNA, 25 bp, Artificial sequence
  SiRNA target sequence
cattaatataatctactaaagtatt

SEQ ID NO: 30396 - DNA, 25 bp, Artificial sequence
  SiRNA target sequence
attaatataatctactaaagtatta

SEQ ID NO: 30397 - DNA, 25 bp, Artificial sequence
  SiRNA target sequence
ttaatataatctactaaagtattat

SEQ ID NO: 30398 - DNA, 25 bp, Artificial sequence
  SiRNA target sequence
taatataatctactaaagtattatc

SEQ ID NO: 30399 - DNA, 25 bp, Artificial sequence
  SiRNA target sequence
aatataatctactaaagtattatcc

SEQ ID NO: 30400 - DNA, 25 bp, Artificial sequence
  SiRNA target sequence
atataatctactaaagtattatcca

SEQ ID NO: 30401 - DNA, 25 bp, Artificial sequence
  SiRNA target sequence
tataatctactaaagtattatccaa

SEQ ID NO: 30402 - DNA, 25 bp, Artificial sequence
  SiRNA target sequence
ataatctactaaagtattatccaaa

SEQ ID NO: 30403 - DNA, 25 bp, Artificial sequence
  SiRNA target sequence
taatctactaaagtattatccaaat

SEQ ID NO: 30404 - DNA, 25 bp, Artificial sequence
  SiRNA target sequence
aatctactaaagtattatccaaatc

SEQ ID NO: 30405 - DNA, 25 bp, Artificial sequence
  SiRNA target sequence
atctactaaagtattatccaaatct

SEQ ID NO: 30406 - DNA, 25 bp, Artificial sequence
  SiRNA target sequence
tctactaaagtattatccaaatctt

SEQ ID NO: 30407 - DNA, 25 bp, Artificial sequence
  SiRNA target sequence
ctactaaagtattatccaaatcttc

SEQ ID NO: 30408 - DNA, 25 bp, Artificial sequence
  SiRNA target sequence
tactaaagtattatccaaatcttct

SEQ ID NO: 30409 - DNA, 25 bp, Artificial sequence
  SiRNA target sequence
actaaagtattatccaaatcttctc

SEQ ID NO: 30410 - DNA, 25 bp, Artificial sequence
  SiRNA target sequence
ctaaagtattatccaaatcttctcc

SEQ ID NO: 30411 - DNA, 25 bp, Artificial sequence
  SiRNA target sequence
taaagtattatccaaatcttctcct

SEQ ID NO: 30412 - DNA, 25 bp, Artificial sequence
  SiRNA target sequence
aaagtattatccaaatcttctcctc

SEQ ID NO: 30413 - DNA, 25 bp, Artificial sequence
  SiRNA target sequence
aagtattatccaaatcttctcctcc

SEQ ID NO: 30414 - DNA, 25 bp, Artificial sequence
  SiRNA target sequence
agtattatccaaatcttctcctcct

SEQ ID NO: 30415 - DNA, 25 bp, Artificial sequence
  SiRNA target sequence
gtattatccaaatcttctcctccta

SEQ ID NO: 30416 - DNA, 25 bp, Artificial sequence
  SiRNA target sequence
tattatccaaatcttctcctcctaa

SEQ ID NO: 30417 - DNA, 25 bp, Artificial sequence
  SiRNA target sequence
attatccaaatcttctcctcctaaa

SEQ ID NO: 30418 - DNA, 25 bp, Artificial sequence
  SiRNA target sequence
ttatccaaatcttctcctcctaaaa

SEQ ID NO: 30419 - DNA, 25 bp, Artificial sequence
  SiRNA target sequence
tatccaaatcttctcctcctaaaaa

SEQ ID NO: 30420 - DNA, 25 bp, Artificial sequence
  SiRNA target sequence
atccaaatcttctcctcctaaaaaa

SEQ ID NO: 30421 - DNA, 25 bp, Artificial sequence
  SiRNA target sequence
tccaaatcttctcctcctaaaaaag

SEQ ID NO: 30422 - DNA, 25 bp, Artificial sequence
  SiRNA target sequence
ccaaatcttctcctcctaaaaaagt

SEQ ID NO: 30423 - DNA, 25 bp, Artificial sequence
  SiRNA target sequence
caaatcttctcctcctaaaaaagta

SEQ ID NO: 30424 - DNA, 25 bp, Artificial sequence
  SiRNA target sequence
aaatcttctcctcctaaaaaagtat

SEQ ID NO: 30425 - DNA, 25 bp, Artificial sequence
  SiRNA target sequence
aatcttctcctcctaaaaaagtatt

SEQ ID NO: 30426 - DNA, 25 bp, Artificial sequence
  SiRNA target sequence
atcttctcctcctaaaaaagtattt

SEQ ID NO: 30427 - DNA, 25 bp, Artificial sequence
  SiRNA target sequence
tcttctcctcctaaaaaagtatttc

SEQ ID NO: 30428 - DNA, 25 bp, Artificial sequence
  SiRNA target sequence
cttctcctcctaaaaaagtatttcc

SEQ ID NO: 30429 - DNA, 25 bp, Artificial sequence
  SiRNA target sequence
ttctcctcctaaaaaagtatttccg

SEQ ID NO: 30430 - DNA, 25 bp, Artificial sequence
  SiRNA target sequence
tctcctcctaaaaaagtatttccgt

SEQ ID NO: 30431 - DNA, 25 bp, Artificial sequence
  SiRNA target sequence
ctcctcctaaaaaagtatttccgtt

SEQ ID NO: 30432 - DNA, 25 bp, Artificial sequence
  SiRNA target sequence
tcctcctaaaaaagtatttccgtta

SEQ ID NO: 30433 - DNA, 25 bp, Artificial sequence
  SiRNA target sequence
cctcctaaaaaagtatttccgttag

SEQ ID NO: 30434 - DNA, 25 bp, Artificial sequence
  SiRNA target sequence
ctcctaaaaaagtatttccgttagt

SEQ ID NO: 30435 - DNA, 25 bp, Artificial sequence
  SiRNA target sequence
tcctaaaaaagtatttccgttagta

SEQ ID NO: 30436 - DNA, 25 bp, Artificial sequence
  SiRNA target sequence
cctaaaaaagtatttccgttagtag

SEQ ID NO: 30437 - DNA, 25 bp, Artificial sequence
  SiRNA target sequence
ctaaaaaagtatttccgttagtaga

SEQ ID NO: 30438 - DNA, 25 bp, Artificial sequence
  SiRNA target sequence
taaaaaagtatttccgttagtagat

SEQ ID NO: 30439 - DNA, 25 bp, Artificial sequence
  SiRNA target sequence
aaaaaagtatttccgttagtagatt

SEQ ID NO: 30440 - DNA, 25 bp, Artificial sequence
  SiRNA target sequence
aaaaagtatttccgttagtagattt

SEQ ID NO: 30441 - DNA, 25 bp, Artificial sequence
  SiRNA target sequence
aaaagtatttccgttagtagatttt

SEQ ID NO: 30442 - DNA, 25 bp, Artificial sequence
  SiRNA target sequence
aaagtatttccgttagtagatttta

SEQ ID NO: 30443 - DNA, 25 bp, Artificial sequence
  SiRNA target sequence
aagtatttccgttagtagattttac

SEQ ID NO: 30444 - DNA, 25 bp, Artificial sequence
  SiRNA target sequence
agtatttccgttagtagattttaca

SEQ ID NO: 30445 - DNA, 25 bp, Artificial sequence
  SiRNA target sequence
gtatttccgttagtagattttacat

SEQ ID NO: 30446 - DNA, 25 bp, Artificial sequence
  SiRNA target sequence
tatttccgttagtagattttacatg

SEQ ID NO: 30447 - DNA, 25 bp, Artificial sequence
  SiRNA target sequence
atttccgttagtagattttacatga

SEQ ID NO: 30448 - DNA, 25 bp, Artificial sequence
  SiRNA target sequence
tttccgttagtagattttacatgaa

SEQ ID NO: 30449 - DNA, 25 bp, Artificial sequence
  SiRNA target sequence
ttccgttagtagattttacatgaaa

SEQ ID NO: 30450 - DNA, 25 bp, Artificial sequence
  SiRNA target sequence
tccgttagtagattttacatgaaaa

SEQ ID NO: 30451 - DNA, 25 bp, Artificial sequence
  SiRNA target sequence
ccgttagtagattttacatgaaaaa

SEQ ID NO: 30452 - DNA, 25 bp, Artificial sequence
  SiRNA target sequence
cgttagtagattttacatgaaaaat

SEQ ID NO: 30453 - DNA, 25 bp, Artificial sequence
  SiRNA target sequence
gttagtagattttacatgaaaaata

SEQ ID NO: 30454 - DNA, 25 bp, Artificial sequence
  SiRNA target sequence
ttagtagattttacatgaaaaatac

SEQ ID NO: 30455 - DNA, 25 bp, Artificial sequence
  SiRNA target sequence
tagtagattttacatgaaaaatacc

SEQ ID NO: 30456 - DNA, 25 bp, Artificial sequence
  SiRNA target sequence
agtagattttacatgaaaaatacca

SEQ ID NO: 30457 - DNA, 25 bp, Artificial sequence
  SiRNA target sequence
gtagattttacatgaaaaataccat

SEQ ID NO: 30458 - DNA, 25 bp, Artificial sequence
  SiRNA target sequence
tagattttacatgaaaaataccatt

SEQ ID NO: 30459 - DNA, 25 bp, Artificial sequence
  SiRNA target sequence
agattttacatgaaaaataccatta

SEQ ID NO: 30460 - DNA, 25 bp, Artificial sequence
  SiRNA target sequence
gattttacatgaaaaataccattat

SEQ ID NO: 30461 - DNA, 25 bp, Artificial sequence
  SiRNA target sequence
attttacatgaaaaataccattatc

SEQ ID NO: 30462 - DNA, 25 bp, Artificial sequence
  SiRNA target sequence
ttttacatgaaaaataccattatct

SEQ ID NO: 30463 - DNA, 25 bp, Artificial sequence
  SiRNA target sequence
tttacatgaaaaataccattatcta

SEQ ID NO: 30464 - DNA, 25 bp, Artificial sequence
  SiRNA target sequence
ttacatgaaaaataccattatctaa

SEQ ID NO: 30465 - DNA, 25 bp, Artificial sequence
  SiRNA target sequence
tacatgaaaaataccattatctaat

SEQ ID NO: 30466 - DNA, 25 bp, Artificial sequence
  SiRNA target sequence
acatgaaaaataccattatctaatt

SEQ ID NO: 30467 - DNA, 25 bp, Artificial sequence
  SiRNA target sequence
catgaaaaataccattatctaattc

SEQ ID NO: 30468 - DNA, 25 bp, Artificial sequence
  SiRNA target sequence
atgaaaaataccattatctaattct

SEQ ID NO: 30469 - DNA, 25 bp, Artificial sequence
  SiRNA target sequence
tgaaaaataccattatctaattcta

SEQ ID NO: 30470 - DNA, 25 bp, Artificial sequence
  SiRNA target sequence
gaaaaataccattatctaattctaa

SEQ ID NO: 30471 - DNA, 25 bp, Artificial sequence
  SiRNA target sequence
aaaaataccattatctaattctaat

SEQ ID NO: 30472 - DNA, 25 bp, Artificial sequence
  SiRNA target sequence
aaaataccattatctaattctaata

SEQ ID NO: 30473 - DNA, 25 bp, Artificial sequence
  SiRNA target sequence
aaataccattatctaattctaatat

SEQ ID NO: 30474 - DNA, 25 bp, Artificial sequence
  SiRNA target sequence
aataccattatctaattctaatata

SEQ ID NO: 30475 - DNA, 25 bp, Artificial sequence
  SiRNA target sequence
ataccattatctaattctaatatac

SEQ ID NO: 30476 - DNA, 25 bp, Artificial sequence
  SiRNA target sequence
taccattatctaattctaatatact

SEQ ID NO: 30477 - DNA, 25 bp, Artificial sequence
  SiRNA target sequence
accattatctaattctaatatacta

SEQ ID NO: 30478 - DNA, 25 bp, Artificial sequence
  SiRNA target sequence
ccattatctaattctaatatactaa

SEQ ID NO: 30479 - DNA, 25 bp, Artificial sequence
  SiRNA target sequence
cattatctaattctaatatactaat

SEQ ID NO: 30480 - DNA, 25 bp, Artificial sequence
  SiRNA target sequence
attatctaattctaatatactaatg

SEQ ID NO: 30481 - DNA, 25 bp, Artificial sequence
  SiRNA target sequence
ttatctaattctaatatactaatgt

SEQ ID NO: 30482 - DNA, 25 bp, Artificial sequence
  SiRNA target sequence
tatctaattctaatatactaatgtc

SEQ ID NO: 30483 - DNA, 25 bp, Artificial sequence
  SiRNA target sequence
atctaattctaatatactaatgtca

SEQ ID NO: 30484 - DNA, 25 bp, Artificial sequence
  SiRNA target sequence
tctaattctaatatactaatgtcaa

SEQ ID NO: 30485 - DNA, 25 bp, Artificial sequence
  SiRNA target sequence
ctaattctaatatactaatgtcaaa

SEQ ID NO: 30486 - DNA, 25 bp, Artificial sequence
  SiRNA target sequence
taattctaatatactaatgtcaaaa

SEQ ID NO: 30487 - DNA, 25 bp, Artificial sequence
  SiRNA target sequence
aattctaatatactaatgtcaaaag

SEQ ID NO: 30488 - DNA, 25 bp, Artificial sequence
  SiRNA target sequence
attctaatatactaatgtcaaaagt

SEQ ID NO: 30489 - DNA, 25 bp, Artificial sequence
  SiRNA target sequence
ttctaatatactaatgtcaaaagtt

SEQ ID NO: 30490 - DNA, 25 bp, Artificial sequence
  SiRNA target sequence
tctaatatactaatgtcaaaagttc

SEQ ID NO: 30491 - DNA, 25 bp, Artificial sequence
  SiRNA target sequence
ctaatatactaatgtcaaaagttcc

SEQ ID NO: 30492 - DNA, 25 bp, Artificial sequence
  SiRNA target sequence
taatatactaatgtcaaaagttcct

SEQ ID NO: 30493 - DNA, 25 bp, Artificial sequence
  SiRNA target sequence
aatatactaatgtcaaaagttcctc

SEQ ID NO: 30494 - DNA, 25 bp, Artificial sequence
  SiRNA target sequence
atatactaatgtcaaaagttcctcc

SEQ ID NO: 30495 - DNA, 25 bp, Artificial sequence
  SiRNA target sequence
tatactaatgtcaaaagttcctcct

SEQ ID NO: 30496 - DNA, 25 bp, Artificial sequence
  SiRNA target sequence
atactaatgtcaaaagttcctcctc

SEQ ID NO: 30497 - DNA, 25 bp, Artificial sequence
  SiRNA target sequence
tactaatgtcaaaagttcctcctcc

SEQ ID NO: 30498 - DNA, 25 bp, Artificial sequence
  SiRNA target sequence
actaatgtcaaaagttcctcctccc

SEQ ID NO: 30499 - DNA, 25 bp, Artificial sequence
  SiRNA target sequence
ctaatgtcaaaagttcctcctccca

SEQ ID NO: 30500 - DNA, 25 bp, Artificial sequence
  SiRNA target sequence
taatgtcaaaagttcctcctcccag

SEQ ID NO: 30501 - DNA, 25 bp, Artificial sequence
  SiRNA target sequence
aatgtcaaaagttcctcctcccaga

SEQ ID NO: 30502 - DNA, 25 bp, Artificial sequence
  SiRNA target sequence
atgtcaaaagttcctcctcccagat

SEQ ID NO: 30503 - DNA, 25 bp, Artificial sequence
  SiRNA target sequence
tgtcaaaagttcctcctcccagatc

SEQ ID NO: 30504 - DNA, 25 bp, Artificial sequence
  SiRNA target sequence
gtcaaaagttcctcctcccagatca

SEQ ID NO: 30505 - DNA, 25 bp, Artificial sequence
  SiRNA target sequence
tcaaaagttcctcctcccagatcat

SEQ ID NO: 30506 - DNA, 25 bp, Artificial sequence
  SiRNA target sequence
caaaagttcctcctcccagatcata

SEQ ID NO: 30507 - DNA, 25 bp, Artificial sequence
  SiRNA target sequence
aaaagttcctcctcccagatcataa

SEQ ID NO: 30508 - DNA, 25 bp, Artificial sequence
  SiRNA target sequence
aaagttcctcctcccagatcataaa

SEQ ID NO: 30509 - DNA, 25 bp, Artificial sequence
  SiRNA target sequence
aagttcctcctcccagatcataaac

SEQ ID NO: 30510 - DNA, 25 bp, Artificial sequence
  SiRNA target sequence
agttcctcctcccagatcataaaca

SEQ ID NO: 30511 - DNA, 25 bp, Artificial sequence
  SiRNA target sequence
gttcctcctcccagatcataaacag

SEQ ID NO: 30512 - DNA, 25 bp, Artificial sequence
  SiRNA target sequence
ttcctcctcccagatcataaacagc

SEQ ID NO: 30513 - DNA, 25 bp, Artificial sequence
  SiRNA target sequence
tcctcctcccagatcataaacagct

SEQ ID NO: 30514 - DNA, 25 bp, Artificial sequence
  SiRNA target sequence
cctcctcccagatcataaacagcta

SEQ ID NO: 30515 - DNA, 25 bp, Artificial sequence
  SiRNA target sequence
ctcctcccagatcataaacagctat

SEQ ID NO: 30516 - DNA, 25 bp, Artificial sequence
  SiRNA target sequence
tcctcccagatcataaacagctata

SEQ ID NO: 30517 - DNA, 25 bp, Artificial sequence
  SiRNA target sequence
cctcccagatcataaacagctataa

SEQ ID NO: 30518 - DNA, 25 bp, Artificial sequence
  SiRNA target sequence
ctcccagatcataaacagctataat

SEQ ID NO: 30519 - DNA, 25 bp, Artificial sequence
  SiRNA target sequence
tcccagatcataaacagctataata

SEQ ID NO: 30520 - DNA, 25 bp, Artificial sequence
  SiRNA target sequence
cccagatcataaacagctataatac

SEQ ID NO: 30521 - DNA, 25 bp, Artificial sequence
  SiRNA target sequence
ccagatcataaacagctataatacc

SEQ ID NO: 30522 - DNA, 25 bp, Artificial sequence
  SiRNA target sequence
cagatcataaacagctataataccc

SEQ ID NO: 30523 - DNA, 25 bp, Artificial sequence
  SiRNA target sequence
agatcataaacagctataataccct

SEQ ID NO: 30524 - DNA, 25 bp, Artificial sequence
  SiRNA target sequence
gatcataaacagctataataccctg

SEQ ID NO: 30525 - DNA, 25 bp, Artificial sequence
  SiRNA target sequence
atcataaacagctataataccctgt

SEQ ID NO: 30526 - DNA, 25 bp, Artificial sequence
  SiRNA target sequence
tcataaacagctataataccctgtg

SEQ ID NO: 30527 - DNA, 25 bp, Artificial sequence
  SiRNA target sequence
cataaacagctataataccctgtgc

SEQ ID NO: 30528 - DNA, 25 bp, Artificial sequence
  SiRNA target sequence
ataaacagctataataccctgtgca

SEQ ID NO: 30529 - DNA, 25 bp, Artificial sequence
  SiRNA target sequence
taaacagctataataccctgtgcag

SEQ ID NO: 30530 - DNA, 25 bp, Artificial sequence
  SiRNA target sequence
aaacagctataataccctgtgcaga

SEQ ID NO: 30531 - DNA, 25 bp, Artificial sequence
  SiRNA target sequence
aacagctataataccctgtgcagac

SEQ ID NO: 30532 - DNA, 25 bp, Artificial sequence
  SiRNA target sequence
acagctataataccctgtgcagact

SEQ ID NO: 30533 - DNA, 25 bp, Artificial sequence
  SiRNA target sequence
cagctataataccctgtgcagactt

SEQ ID NO: 30534 - DNA, 25 bp, Artificial sequence
  SiRNA target sequence
agctataataccctgtgcagacttg

SEQ ID NO: 30535 - DNA, 25 bp, Artificial sequence
  SiRNA target sequence
gctataataccctgtgcagacttgt

SEQ ID NO: 30536 - DNA, 25 bp, Artificial sequence
  SiRNA target sequence
ctataataccctgtgcagacttgtc

SEQ ID NO: 30537 - DNA, 25 bp, Artificial sequence
  SiRNA target sequence
tataataccctgtgcagacttgtca

SEQ ID NO: 30538 - DNA, 25 bp, Artificial sequence
  SiRNA target sequence
ataataccctgtgcagacttgtcaa

SEQ ID NO: 30539 - DNA, 25 bp, Artificial sequence
  SiRNA target sequence
taataccctgtgcagacttgtcaag

SEQ ID NO: 30540 - DNA, 25 bp, Artificial sequence
  SiRNA target sequence
aataccctgtgcagacttgtcaagc

SEQ ID NO: 30541 - DNA, 25 bp, Artificial sequence
  SiRNA target sequence
ataccctgtgcagacttgtcaagcc

SEQ ID NO: 30542 - DNA, 25 bp, Artificial sequence
  SiRNA target sequence
taccctgtgcagacttgtcaagccc

SEQ ID NO: 30543 - DNA, 25 bp, Artificial sequence
  SiRNA target sequence
accctgtgcagacttgtcaagccca

SEQ ID NO: 30544 - DNA, 25 bp, Artificial sequence
  SiRNA target sequence
ccctgtgcagacttgtcaagcccat

SEQ ID NO: 30545 - DNA, 25 bp, Artificial sequence
  SiRNA target sequence
cctgtgcagacttgtcaagcccata

SEQ ID NO: 30546 - DNA, 25 bp, Artificial sequence
  SiRNA target sequence
ctgtgcagacttgtcaagcccataa

SEQ ID NO: 30547 - DNA, 25 bp, Artificial sequence
  SiRNA target sequence
tgtgcagacttgtcaagcccataag

SEQ ID NO: 30548 - DNA, 25 bp, Artificial sequence
  SiRNA target sequence
gtgcagacttgtcaagcccataagc

SEQ ID NO: 30549 - DNA, 25 bp, Artificial sequence
  SiRNA target sequence
tgcagacttgtcaagcccataagca

SEQ ID NO: 30550 - DNA, 25 bp, Artificial sequence
  SiRNA target sequence
gcagacttgtcaagcccataagcaa

SEQ ID NO: 30551 - DNA, 25 bp, Artificial sequence
  SiRNA target sequence
cagacttgtcaagcccataagcaag

SEQ ID NO: 30552 - DNA, 25 bp, Artificial sequence
  SiRNA target sequence
agacttgtcaagcccataagcaagt

SEQ ID NO: 30553 - DNA, 25 bp, Artificial sequence
  SiRNA target sequence
gacttgtcaagcccataagcaagtg

SEQ ID NO: 30554 - DNA, 25 bp, Artificial sequence
  SiRNA target sequence
acttgtcaagcccataagcaagtgc

SEQ ID NO: 30555 - DNA, 25 bp, Artificial sequence
  SiRNA target sequence
cttgtcaagcccataagcaagtgct

SEQ ID NO: 30556 - DNA, 25 bp, Artificial sequence
  SiRNA target sequence
ttgtcaagcccataagcaagtgctg

SEQ ID NO: 30557 - DNA, 25 bp, Artificial sequence
  SiRNA target sequence
tgtcaagcccataagcaagtgctgc

SEQ ID NO: 30558 - DNA, 25 bp, Artificial sequence
  SiRNA target sequence
gtcaagcccataagcaagtgctgcc

SEQ ID NO: 30559 - DNA, 25 bp, Artificial sequence
  SiRNA target sequence
tcaagcccataagcaagtgctgccg

SEQ ID NO: 30560 - DNA, 25 bp, Artificial sequence
  SiRNA target sequence
caagcccataagcaagtgctgccgc

SEQ ID NO: 30561 - DNA, 25 bp, Artificial sequence
  SiRNA target sequence
aagcccataagcaagtgctgccgca

SEQ ID NO: 30562 - DNA, 25 bp, Artificial sequence
  SiRNA target sequence
agcccataagcaagtgctgccgcag

SEQ ID NO: 30563 - DNA, 25 bp, Artificial sequence
  SiRNA target sequence
gcccataagcaagtgctgccgcagt

SEQ ID NO: 30564 - DNA, 25 bp, Artificial sequence
  SiRNA target sequence
cccataagcaagtgctgccgcagta

SEQ ID NO: 30565 - DNA, 25 bp, Artificial sequence
  SiRNA target sequence
ccataagcaagtgctgccgcagtag

SEQ ID NO: 30566 - DNA, 25 bp, Artificial sequence
  SiRNA target sequence
cataagcaagtgctgccgcagtagg

SEQ ID NO: 30567 - DNA, 25 bp, Artificial sequence
  SiRNA target sequence
ataagcaagtgctgccgcagtaggc

SEQ ID NO: 30568 - DNA, 25 bp, Artificial sequence
  SiRNA target sequence
taagcaagtgctgccgcagtaggct

SEQ ID NO: 30569 - DNA, 25 bp, Artificial sequence
  SiRNA target sequence
aagcaagtgctgccgcagtaggctc

SEQ ID NO: 30570 - DNA, 25 bp, Artificial sequence
  SiRNA target sequence
agcaagtgctgccgcagtaggctca

SEQ ID NO: 30571 - DNA, 25 bp, Artificial sequence
  SiRNA target sequence
gcaagtgctgccgcagtaggctcat

SEQ ID NO: 30572 - DNA, 25 bp, Artificial sequence
  SiRNA target sequence
caagtgctgccgcagtaggctcatt

SEQ ID NO: 30573 - DNA, 25 bp, Artificial sequence
  SiRNA target sequence
aagtgctgccgcagtaggctcatta

SEQ ID NO: 30574 - DNA, 25 bp, Artificial sequence
  SiRNA target sequence
agtgctgccgcagtaggctcattaa

SEQ ID NO: 30575 - DNA, 25 bp, Artificial sequence
  SiRNA target sequence
gtgctgccgcagtaggctcattaat

SEQ ID NO: 30576 - DNA, 25 bp, Artificial sequence
  SiRNA target sequence
tgctgccgcagtaggctcattaatc

SEQ ID NO: 30577 - DNA, 25 bp, Artificial sequence
  SiRNA target sequence
gctgccgcagtaggctcattaatca

SEQ ID NO: 30578 - DNA, 25 bp, Artificial sequence
  SiRNA target sequence
ctgccgcagtaggctcattaatcac

SEQ ID NO: 30579 - DNA, 25 bp, Artificial sequence
  SiRNA target sequence
tgccgcagtaggctcattaatcact

SEQ ID NO: 30580 - DNA, 25 bp, Artificial sequence
  SiRNA target sequence
gccgcagtaggctcattaatcactc

SEQ ID NO: 30581 - DNA, 25 bp, Artificial sequence
  SiRNA target sequence
ccgcagtaggctcattaatcactct

SEQ ID NO: 30582 - DNA, 25 bp, Artificial sequence
  SiRNA target sequence
cgcagtaggctcattaatcactcta

SEQ ID NO: 30583 - DNA, 25 bp, Artificial sequence
  SiRNA target sequence
gcagtaggctcattaatcactctaa

SEQ ID NO: 30584 - DNA, 25 bp, Artificial sequence
  SiRNA target sequence
cagtaggctcattaatcactctaag

SEQ ID NO: 30585 - DNA, 25 bp, Artificial sequence
  SiRNA target sequence
agtaggctcattaatcactctaagc

SEQ ID NO: 30586 - DNA, 25 bp, Artificial sequence
  SiRNA target sequence
gtaggctcattaatcactctaagca

SEQ ID NO: 30587 - DNA, 25 bp, Artificial sequence
  SiRNA target sequence
taggctcattaatcactctaagcac

SEQ ID NO: 30588 - DNA, 25 bp, Artificial sequence
  SiRNA target sequence
aggctcattaatcactctaagcact

SEQ ID NO: 30589 - DNA, 25 bp, Artificial sequence
  SiRNA target sequence
ggctcattaatcactctaagcactt

SEQ ID NO: 30590 - DNA, 25 bp, Artificial sequence
  SiRNA target sequence
gctcattaatcactctaagcacttg

SEQ ID NO: 30591 - DNA, 25 bp, Artificial sequence
  SiRNA target sequence
ctcattaatcactctaagcacttgt

SEQ ID NO: 30592 - DNA, 25 bp, Artificial sequence
  SiRNA target sequence
tcattaatcactctaagcacttgta

SEQ ID NO: 30593 - DNA, 25 bp, Artificial sequence
  SiRNA target sequence
cattaatcactctaagcacttgtaa

SEQ ID NO: 30594 - DNA, 25 bp, Artificial sequence
  SiRNA target sequence
attaatcactctaagcacttgtaat

SEQ ID NO: 30595 - DNA, 25 bp, Artificial sequence
  SiRNA target sequence
ttaatcactctaagcacttgtaatc

SEQ ID NO: 30596 - DNA, 25 bp, Artificial sequence
  SiRNA target sequence
taatcactctaagcacttgtaatcc

SEQ ID NO: 30597 - DNA, 25 bp, Artificial sequence
  SiRNA target sequence
aatcactctaagcacttgtaatccc

SEQ ID NO: 30598 - DNA, 25 bp, Artificial sequence
  SiRNA target sequence
atcactctaagcacttgtaatcccg

SEQ ID NO: 30599 - DNA, 25 bp, Artificial sequence
  SiRNA target sequence
tcactctaagcacttgtaatcccgc

SEQ ID NO: 30600 - DNA, 25 bp, Artificial sequence
  SiRNA target sequence
cactctaagcacttgtaatcccgca

SEQ ID NO: 30601 - DNA, 25 bp, Artificial sequence
  SiRNA target sequence
actctaagcacttgtaatcccgcaa

SEQ ID NO: 30602 - DNA, 25 bp, Artificial sequence
  SiRNA target sequence
ctctaagcacttgtaatcccgcaat

SEQ ID NO: 30603 - DNA, 25 bp, Artificial sequence
  SiRNA target sequence
tctaagcacttgtaatcccgcaatc

SEQ ID NO: 30604 - DNA, 25 bp, Artificial sequence
  SiRNA target sequence
ctaagcacttgtaatcccgcaatcc

SEQ ID NO: 30605 - DNA, 25 bp, Artificial sequence
  SiRNA target sequence
taagcacttgtaatcccgcaatcct

SEQ ID NO: 30606 - DNA, 25 bp, Artificial sequence
  SiRNA target sequence
aagcacttgtaatcccgcaatcctt

SEQ ID NO: 30607 - DNA, 25 bp, Artificial sequence
  SiRNA target sequence
agcacttgtaatcccgcaatccttc

SEQ ID NO: 30608 - DNA, 25 bp, Artificial sequence
  SiRNA target sequence
gcacttgtaatcccgcaatccttcc

SEQ ID NO: 30609 - DNA, 25 bp, Artificial sequence
  SiRNA target sequence
cacttgtaatcccgcaatccttccc

SEQ ID NO: 30610 - DNA, 25 bp, Artificial sequence
  SiRNA target sequence
acttgtaatcccgcaatccttcccg

SEQ ID NO: 30611 - DNA, 25 bp, Artificial sequence
  SiRNA target sequence
cttgtaatcccgcaatccttcccgc

SEQ ID NO: 30612 - DNA, 25 bp, Artificial sequence
  SiRNA target sequence
ttgtaatcccgcaatccttcccgca

SEQ ID NO: 30613 - DNA, 25 bp, Artificial sequence
  SiRNA target sequence
tgtaatcccgcaatccttcccgcat

SEQ ID NO: 30614 - DNA, 25 bp, Artificial sequence
  SiRNA target sequence
gtaatcccgcaatccttcccgcatc

SEQ ID NO: 30615 - DNA, 25 bp, Artificial sequence
  SiRNA target sequence
taatcccgcaatccttcccgcatct

SEQ ID NO: 30616 - DNA, 25 bp, Artificial sequence
  SiRNA target sequence
aatcccgcaatccttcccgcatctt

SEQ ID NO: 30617 - DNA, 25 bp, Artificial sequence
  SiRNA target sequence
atcccgcaatccttcccgcatcttt

SEQ ID NO: 30618 - DNA, 25 bp, Artificial sequence
  SiRNA target sequence
tcccgcaatccttcccgcatcttta

SEQ ID NO: 30619 - DNA, 25 bp, Artificial sequence
  SiRNA target sequence
cccgcaatccttcccgcatctttag

SEQ ID NO: 30620 - DNA, 25 bp, Artificial sequence
  SiRNA target sequence
ccgcaatccttcccgcatctttagt

SEQ ID NO: 30621 - DNA, 25 bp, Artificial sequence
  SiRNA target sequence
cgcaatccttcccgcatctttagta

SEQ ID NO: 30622 - DNA, 25 bp, Artificial sequence
  SiRNA target sequence
gcaatccttcccgcatctttagtag

SEQ ID NO: 30623 - DNA, 25 bp, Artificial sequence
  SiRNA target sequence
caatccttcccgcatctttagtagc

SEQ ID NO: 30624 - DNA, 25 bp, Artificial sequence
  SiRNA target sequence
aatccttcccgcatctttagtagct

SEQ ID NO: 30625 - DNA, 25 bp, Artificial sequence
  SiRNA target sequence
atccttcccgcatctttagtagctt

SEQ ID NO: 30626 - DNA, 25 bp, Artificial sequence
  SiRNA target sequence
tccttcccgcatctttagtagcttg

SEQ ID NO: 30627 - DNA, 25 bp, Artificial sequence
  SiRNA target sequence
ccttcccgcatctttagtagcttgc

SEQ ID NO: 30628 - DNA, 25 bp, Artificial sequence
  SiRNA target sequence
cttcccgcatctttagtagcttgcc

SEQ ID NO: 30629 - DNA, 25 bp, Artificial sequence
  SiRNA target sequence
ttcccgcatctttagtagcttgcct

SEQ ID NO: 30630 - DNA, 25 bp, Artificial sequence
  SiRNA target sequence
tcccgcatctttagtagcttgcctt

SEQ ID NO: 30631 - DNA, 25 bp, Artificial sequence
  SiRNA target sequence
cccgcatctttagtagcttgccttt

SEQ ID NO: 30632 - DNA, 25 bp, Artificial sequence
  SiRNA target sequence
ccgcatctttagtagcttgcctttg

SEQ ID NO: 30633 - DNA, 25 bp, Artificial sequence
  SiRNA target sequence
cgcatctttagtagcttgcctttgc

SEQ ID NO: 30634 - DNA, 25 bp, Artificial sequence
  SiRNA target sequence
gcatctttagtagcttgcctttgca

SEQ ID NO: 30635 - DNA, 25 bp, Artificial sequence
  SiRNA target sequence
catctttagtagcttgcctttgcat

SEQ ID NO: 30636 - DNA, 25 bp, Artificial sequence
  SiRNA target sequence
atctttagtagcttgcctttgcatg

SEQ ID NO: 30637 - DNA, 25 bp, Artificial sequence
  SiRNA target sequence
tctttagtagcttgcctttgcatgt

SEQ ID NO: 30638 - DNA, 25 bp, Artificial sequence
  SiRNA target sequence
ctttagtagcttgcctttgcatgtc

SEQ ID NO: 30639 - DNA, 25 bp, Artificial sequence
  SiRNA target sequence
tttagtagcttgcctttgcatgtca

SEQ ID NO: 30640 - DNA, 25 bp, Artificial sequence
  SiRNA target sequence
ttagtagcttgcctttgcatgtcat

SEQ ID NO: 30641 - DNA, 25 bp, Artificial sequence
  SiRNA target sequence
tagtagcttgcctttgcatgtcatc

SEQ ID NO: 30642 - DNA, 25 bp, Artificial sequence
  SiRNA target sequence
agtagcttgcctttgcatgtcatca

SEQ ID NO: 30643 - DNA, 25 bp, Artificial sequence
  SiRNA target sequence
gtagcttgcctttgcatgtcatcaa

SEQ ID NO: 30644 - DNA, 25 bp, Artificial sequence
  SiRNA target sequence
tagcttgcctttgcatgtcatcaaa

SEQ ID NO: 30645 - DNA, 25 bp, Artificial sequence
  SiRNA target sequence
agcttgcctttgcatgtcatcaaaa

SEQ ID NO: 30646 - DNA, 25 bp, Artificial sequence
  SiRNA target sequence
gcttgcctttgcatgtcatcaaaat

SEQ ID NO: 30647 - DNA, 25 bp, Artificial sequence
  SiRNA target sequence
cttgcctttgcatgtcatcaaaata

SEQ ID NO: 30648 - DNA, 25 bp, Artificial sequence
  SiRNA target sequence
ttgcctttgcatgtcatcaaaatat

SEQ ID NO: 30649 - DNA, 25 bp, Artificial sequence
  SiRNA target sequence
tgcctttgcatgtcatcaaaatatg

SEQ ID NO: 30650 - DNA, 25 bp, Artificial sequence
  SiRNA target sequence
gcctttgcatgtcatcaaaatatgc

SEQ ID NO: 30651 - DNA, 25 bp, Artificial sequence
  SiRNA target sequence
cctttgcatgtcatcaaaatatgcg

SEQ ID NO: 30652 - DNA, 25 bp, Artificial sequence
  SiRNA target sequence
ctttgcatgtcatcaaaatatgcgg

SEQ ID NO: 30653 - DNA, 25 bp, Artificial sequence
  SiRNA target sequence
tttgcatgtcatcaaaatatgcggg

SEQ ID NO: 30654 - DNA, 25 bp, Artificial sequence
  SiRNA target sequence
ttgcatgtcatcaaaatatgcgggc

SEQ ID NO: 30655 - DNA, 25 bp, Artificial sequence
  SiRNA target sequence
tgcatgtcatcaaaatatgcgggca

SEQ ID NO: 30656 - DNA, 25 bp, Artificial sequence
  SiRNA target sequence
gcatgtcatcaaaatatgcgggcac

SEQ ID NO: 30657 - DNA, 25 bp, Artificial sequence
  SiRNA target sequence
catgtcatcaaaatatgcgggcact

SEQ ID NO: 30658 - DNA, 25 bp, Artificial sequence
  SiRNA target sequence
atgtcatcaaaatatgcgggcactg

SEQ ID NO: 30659 - DNA, 25 bp, Artificial sequence
  SiRNA target sequence
tgtcatcaaaatatgcgggcactgt

SEQ ID NO: 30660 - DNA, 25 bp, Artificial sequence
  SiRNA target sequence
gtcatcaaaatatgcgggcactgtt

SEQ ID NO: 30661 - DNA, 25 bp, Artificial sequence
  SiRNA target sequence
tcatcaaaatatgcgggcactgtta

SEQ ID NO: 30662 - DNA, 25 bp, Artificial sequence
  SiRNA target sequence
catcaaaatatgcgggcactgttat

SEQ ID NO: 30663 - DNA, 25 bp, Artificial sequence
  SiRNA target sequence
atcaaaatatgcgggcactgttata

SEQ ID NO: 30664 - DNA, 25 bp, Artificial sequence
  SiRNA target sequence
tcaaaatatgcgggcactgttataa

SEQ ID NO: 30665 - DNA, 25 bp, Artificial sequence
  SiRNA target sequence
caaaatatgcgggcactgttataac

SEQ ID NO: 30666 - DNA, 25 bp, Artificial sequence
  SiRNA target sequence
aaaatatgcgggcactgttataaca

SEQ ID NO: 30667 - DNA, 25 bp, Artificial sequence
  SiRNA target sequence
aaatatgcgggcactgttataacag

SEQ ID NO: 30668 - DNA, 25 bp, Artificial sequence
  SiRNA target sequence
aatatgcgggcactgttataacaga

SEQ ID NO: 30669 - DNA, 25 bp, Artificial sequence
  SiRNA target sequence
atatgcgggcactgttataacagat

SEQ ID NO: 30670 - DNA, 25 bp, Artificial sequence
  SiRNA target sequence
tatgcgggcactgttataacagatc

SEQ ID NO: 30671 - DNA, 25 bp, Artificial sequence
  SiRNA target sequence
atgcgggcactgttataacagatct

SEQ ID NO: 30672 - DNA, 25 bp, Artificial sequence
  SiRNA target sequence
tgcgggcactgttataacagatctt

SEQ ID NO: 30673 - DNA, 25 bp, Artificial sequence
  SiRNA target sequence
gcgggcactgttataacagatctta

SEQ ID NO: 30674 - DNA, 25 bp, Artificial sequence
  SiRNA target sequence
cgggcactgttataacagatcttaa

SEQ ID NO: 30675 - DNA, 25 bp, Artificial sequence
  SiRNA target sequence
gggcactgttataacagatcttaat

SEQ ID NO: 30676 - DNA, 25 bp, Artificial sequence
  SiRNA target sequence
ggcactgttataacagatcttaata

SEQ ID NO: 30677 - DNA, 25 bp, Artificial sequence
  SiRNA target sequence
gcactgttataacagatcttaatac

SEQ ID NO: 30678 - DNA, 25 bp, Artificial sequence
  SiRNA target sequence
cactgttataacagatcttaatact

SEQ ID NO: 30679 - DNA, 25 bp, Artificial sequence
  SiRNA target sequence
actgttataacagatcttaatactt

SEQ ID NO: 30680 - DNA, 25 bp, Artificial sequence
  SiRNA target sequence
ctgttataacagatcttaatacttt

SEQ ID NO: 30681 - DNA, 25 bp, Artificial sequence
  SiRNA target sequence
tgttataacagatcttaatacttta

SEQ ID NO: 30682 - DNA, 25 bp, Artificial sequence
  SiRNA target sequence
gttataacagatcttaatactttag

SEQ ID NO: 30683 - DNA, 25 bp, Artificial sequence
  SiRNA target sequence
ttataacagatcttaatactttaga

SEQ ID NO: 30684 - DNA, 25 bp, Artificial sequence
  SiRNA target sequence
tataacagatcttaatactttagaa

SEQ ID NO: 30685 - DNA, 25 bp, Artificial sequence
  SiRNA target sequence
ataacagatcttaatactttagaat

SEQ ID NO: 30686 - DNA, 25 bp, Artificial sequence
  SiRNA target sequence
taacagatcttaatactttagaatt

SEQ ID NO: 30687 - DNA, 25 bp, Artificial sequence
  SiRNA target sequence
aacagatcttaatactttagaattt

SEQ ID NO: 30688 - DNA, 25 bp, Artificial sequence
  SiRNA target sequence
acagatcttaatactttagaattta

SEQ ID NO: 30689 - DNA, 25 bp, Artificial sequence
  SiRNA target sequence
cagatcttaatactttagaatttaa

SEQ ID NO: 30690 - DNA, 25 bp, Artificial sequence
  SiRNA target sequence
agatcttaatactttagaatttaaa

SEQ ID NO: 30691 - DNA, 25 bp, Artificial sequence
  SiRNA target sequence
gatcttaatactttagaatttaaaa

SEQ ID NO: 30692 - DNA, 25 bp, Artificial sequence
  SiRNA target sequence
atcttaatactttagaatttaaaaa

SEQ ID NO: 30693 - DNA, 25 bp, Artificial sequence
  SiRNA target sequence
tcttaatactttagaatttaaaaaa

SEQ ID NO: 30694 - DNA, 25 bp, Artificial sequence
  SiRNA target sequence
cttaatactttagaatttaaaaaat

SEQ ID NO: 30695 - DNA, 25 bp, Artificial sequence
  SiRNA target sequence
ttaatactttagaatttaaaaaatt

SEQ ID NO: 30696 - DNA, 25 bp, Artificial sequence
  SiRNA target sequence
taatactttagaatttaaaaaattc

SEQ ID NO: 30697 - DNA, 25 bp, Artificial sequence
  SiRNA target sequence
aatactttagaatttaaaaaattct

SEQ ID NO: 30698 - DNA, 25 bp, Artificial sequence
  SiRNA target sequence
atactttagaatttaaaaaattctc

SEQ ID NO: 30699 - DNA, 25 bp, Artificial sequence
  SiRNA target sequence
tactttagaatttaaaaaattctct

SEQ ID NO: 30700 - DNA, 25 bp, Artificial sequence
  SiRNA target sequence
actttagaatttaaaaaattctctg

SEQ ID NO: 30701 - DNA, 25 bp, Artificial sequence
  SiRNA target sequence
ctttagaatttaaaaaattctctgc

SEQ ID NO: 30702 - DNA, 25 bp, Artificial sequence
  SiRNA target sequence
tttagaatttaaaaaattctctgcg

SEQ ID NO: 30703 - DNA, 25 bp, Artificial sequence
  SiRNA target sequence
ttagaatttaaaaaattctctgcgg

SEQ ID NO: 30704 - DNA, 25 bp, Artificial sequence
  SiRNA target sequence
tagaatttaaaaaattctctgcggc

SEQ ID NO: 30705 - DNA, 25 bp, Artificial sequence
  SiRNA target sequence
agaatttaaaaaattctctgcggca

SEQ ID NO: 30706 - DNA, 25 bp, Artificial sequence
  SiRNA target sequence
gaatttaaaaaattctctgcggcat

SEQ ID NO: 30707 - DNA, 25 bp, Artificial sequence
  SiRNA target sequence
aatttaaaaaattctctgcggcatt

SEQ ID NO: 30708 - DNA, 25 bp, Artificial sequence
  SiRNA target sequence
atttaaaaaattctctgcggcattt

SEQ ID NO: 30709 - DNA, 25 bp, Artificial sequence
  SiRNA target sequence
tttaaaaaattctctgcggcatttt

SEQ ID NO: 30710 - DNA, 25 bp, Artificial sequence
  SiRNA target sequence
ttaaaaaattctctgcggcattttt

SEQ ID NO: 30711 - DNA, 25 bp, Artificial sequence
  SiRNA target sequence
taaaaaattctctgcggcatttttc

SEQ ID NO: 30712 - DNA, 25 bp, Artificial sequence
  SiRNA target sequence
aaaaaattctctgcggcatttttca

SEQ ID NO: 30713 - DNA, 25 bp, Artificial sequence
  SiRNA target sequence
aaaaattctctgcggcatttttcat

SEQ ID NO: 30714 - DNA, 25 bp, Artificial sequence
  SiRNA target sequence
aaaattctctgcggcatttttcatt

SEQ ID NO: 30715 - DNA, 25 bp, Artificial sequence
  SiRNA target sequence
aaattctctgcggcatttttcattt

SEQ ID NO: 30716 - DNA, 25 bp, Artificial sequence
  SiRNA target sequence
aattctctgcggcatttttcatttt

SEQ ID NO: 30717 - DNA, 25 bp, Artificial sequence
  SiRNA target sequence
attctctgcggcatttttcattttt

SEQ ID NO: 30718 - DNA, 25 bp, Artificial sequence
  SiRNA target sequence
ttctctgcggcatttttcatttttg

SEQ ID NO: 30719 - DNA, 25 bp, Artificial sequence
  SiRNA target sequence
tctctgcggcatttttcatttttga

SEQ ID NO: 30720 - DNA, 25 bp, Artificial sequence
  SiRNA target sequence
ctctgcggcatttttcatttttgac

SEQ ID NO: 30721 - DNA, 25 bp, Artificial sequence
  SiRNA target sequence
tctgcggcatttttcatttttgaca

SEQ ID NO: 30722 - DNA, 25 bp, Artificial sequence
  SiRNA target sequence
ctgcggcatttttcatttttgacaa

SEQ ID NO: 30723 - DNA, 25 bp, Artificial sequence
  SiRNA target sequence
tgcggcatttttcatttttgacaaa

SEQ ID NO: 30724 - DNA, 25 bp, Artificial sequence
  SiRNA target sequence
gcggcatttttcatttttgacaaaa

SEQ ID NO: 30725 - DNA, 25 bp, Artificial sequence
  SiRNA target sequence
cggcatttttcatttttgacaaaat

SEQ ID NO: 30726 - DNA, 25 bp, Artificial sequence
  SiRNA target sequence
ggcatttttcatttttgacaaaata

SEQ ID NO: 30727 - DNA, 25 bp, Artificial sequence
  SiRNA target sequence
gcatttttcatttttgacaaaataa

SEQ ID NO: 30728 - DNA, 25 bp, Artificial sequence
  SiRNA target sequence
catttttcatttttgacaaaataaa

SEQ ID NO: 30729 - DNA, 25 bp, Artificial sequence
  SiRNA target sequence
atttttcatttttgacaaaataaat

SEQ ID NO: 30730 - DNA, 25 bp, Artificial sequence
  SiRNA target sequence
tttttcatttttgacaaaataaatg

SEQ ID NO: 30731 - DNA, 25 bp, Artificial sequence
  SiRNA target sequence
ttttcatttttgacaaaataaatgc

SEQ ID NO: 30732 - DNA, 25 bp, Artificial sequence
  SiRNA target sequence
tttcatttttgacaaaataaatgca

SEQ ID NO: 30733 - DNA, 25 bp, Artificial sequence
  SiRNA target sequence
ttcatttttgacaaaataaatgcac

SEQ ID NO: 30734 - DNA, 25 bp, Artificial sequence
  SiRNA target sequence
tcatttttgacaaaataaatgcacc

SEQ ID NO: 30735 - DNA, 25 bp, Artificial sequence
  SiRNA target sequence
catttttgacaaaataaatgcacca

SEQ ID NO: 30736 - DNA, 25 bp, Artificial sequence
  SiRNA target sequence
atttttgacaaaataaatgcaccaa

SEQ ID NO: 30737 - DNA, 25 bp, Artificial sequence
  SiRNA target sequence
tttttgacaaaataaatgcaccaat

SEQ ID NO: 30738 - DNA, 25 bp, Artificial sequence
  SiRNA target sequence
ttttgacaaaataaatgcaccaatt

SEQ ID NO: 30739 - DNA, 25 bp, Artificial sequence
  SiRNA target sequence
tttgacaaaataaatgcaccaattt

SEQ ID NO: 30740 - DNA, 25 bp, Artificial sequence
  SiRNA target sequence
ttgacaaaataaatgcaccaatttg

SEQ ID NO: 30741 - DNA, 25 bp, Artificial sequence
  SiRNA target sequence
tgacaaaataaatgcaccaatttgt

SEQ ID NO: 30742 - DNA, 25 bp, Artificial sequence
  SiRNA target sequence
gacaaaataaatgcaccaatttgtg

SEQ ID NO: 30743 - DNA, 25 bp, Artificial sequence
  SiRNA target sequence
acaaaataaatgcaccaatttgtgc

SEQ ID NO: 30744 - DNA, 25 bp, Artificial sequence
  SiRNA target sequence
caaaataaatgcaccaatttgtgca

SEQ ID NO: 30745 - DNA, 25 bp, Artificial sequence
  SiRNA target sequence
aaaataaatgcaccaatttgtgcag

SEQ ID NO: 30746 - DNA, 25 bp, Artificial sequence
  SiRNA target sequence
aaataaatgcaccaatttgtgcagg

SEQ ID NO: 30747 - DNA, 25 bp, Artificial sequence
  SiRNA target sequence
aataaatgcaccaatttgtgcagga

SEQ ID NO: 30748 - DNA, 25 bp, Artificial sequence
  SiRNA target sequence
ataaatgcaccaatttgtgcaggag

SEQ ID NO: 30749 - DNA, 25 bp, Artificial sequence
  SiRNA target sequence
taaatgcaccaatttgtgcaggaga

SEQ ID NO: 30750 - DNA, 25 bp, Artificial sequence
  SiRNA target sequence
aaatgcaccaatttgtgcaggagaa

SEQ ID NO: 30751 - DNA, 25 bp, Artificial sequence
  SiRNA target sequence
aatgcaccaatttgtgcaggagaat

SEQ ID NO: 30752 - DNA, 25 bp, Artificial sequence
  SiRNA target sequence
atgcaccaatttgtgcaggagaata

SEQ ID NO: 30753 - DNA, 25 bp, Artificial sequence
  SiRNA target sequence
tgcaccaatttgtgcaggagaatat

SEQ ID NO: 30754 - DNA, 25 bp, Artificial sequence
  SiRNA target sequence
gcaccaatttgtgcaggagaatatt

SEQ ID NO: 30755 - DNA, 25 bp, Artificial sequence
  SiRNA target sequence
caccaatttgtgcaggagaatattt

SEQ ID NO: 30756 - DNA, 25 bp, Artificial sequence
  SiRNA target sequence
accaatttgtgcaggagaatatttc

SEQ ID NO: 30757 - DNA, 25 bp, Artificial sequence
  SiRNA target sequence
ccaatttgtgcaggagaatatttct

SEQ ID NO: 30758 - DNA, 25 bp, Artificial sequence
  SiRNA target sequence
caatttgtgcaggagaatatttctt

SEQ ID NO: 30759 - DNA, 25 bp, Artificial sequence
  SiRNA target sequence
aatttgtgcaggagaatatttctta

SEQ ID NO: 30760 - DNA, 25 bp, Artificial sequence
  SiRNA target sequence
atttgtgcaggagaatatttcttat

SEQ ID NO: 30761 - DNA, 25 bp, Artificial sequence
  SiRNA target sequence
tttgtgcaggagaatatttcttatt

SEQ ID NO: 30762 - DNA, 25 bp, Artificial sequence
  SiRNA target sequence
ttgtgcaggagaatatttcttattg

SEQ ID NO: 30763 - DNA, 25 bp, Artificial sequence
  SiRNA target sequence
tgtgcaggagaatatttcttattgt

SEQ ID NO: 30764 - DNA, 25 bp, Artificial sequence
  SiRNA target sequence
gtgcaggagaatatttcttattgtc

SEQ ID NO: 30765 - DNA, 25 bp, Artificial sequence
  SiRNA target sequence
tgcaggagaatatttcttattgtca

SEQ ID NO: 30766 - DNA, 25 bp, Artificial sequence
  SiRNA target sequence
gcaggagaatatttcttattgtcaa

SEQ ID NO: 30767 - DNA, 25 bp, Artificial sequence
  SiRNA target sequence
caggagaatatttcttattgtcaat

SEQ ID NO: 30768 - DNA, 25 bp, Artificial sequence
  SiRNA target sequence
aggagaatatttcttattgtcaatt

SEQ ID NO: 30769 - DNA, 25 bp, Artificial sequence
  SiRNA target sequence
ggagaatatttcttattgtcaattt

SEQ ID NO: 30770 - DNA, 25 bp, Artificial sequence
  SiRNA target sequence
gagaatatttcttattgtcaatttt

SEQ ID NO: 30771 - DNA, 25 bp, Artificial sequence
  SiRNA target sequence
agaatatttcttattgtcaattttt

SEQ ID NO: 30772 - DNA, 25 bp, Artificial sequence
  SiRNA target sequence
gaatatttcttattgtcaattttta

SEQ ID NO: 30773 - DNA, 25 bp, Artificial sequence
  SiRNA target sequence
aatatttcttattgtcaatttttat

SEQ ID NO: 30774 - DNA, 25 bp, Artificial sequence
  SiRNA target sequence
atatttcttattgtcaatttttatc

SEQ ID NO: 30775 - DNA, 25 bp, Artificial sequence
  SiRNA target sequence
tatttcttattgtcaatttttatcc

SEQ ID NO: 30776 - DNA, 25 bp, Artificial sequence
  SiRNA target sequence
atttcttattgtcaatttttatcca

SEQ ID NO: 30777 - DNA, 25 bp, Artificial sequence
  SiRNA target sequence
tttcttattgtcaatttttatccaa

SEQ ID NO: 30778 - DNA, 25 bp, Artificial sequence
  SiRNA target sequence
ttcttattgtcaatttttatccaaa

SEQ ID NO: 30779 - DNA, 25 bp, Artificial sequence
  SiRNA target sequence
tcttattgtcaatttttatccaaat

SEQ ID NO: 30780 - DNA, 25 bp, Artificial sequence
  SiRNA target sequence
cttattgtcaatttttatccaaata

SEQ ID NO: 30781 - DNA, 25 bp, Artificial sequence
  SiRNA target sequence
ttattgtcaatttttatccaaatat

SEQ ID NO: 30782 - DNA, 25 bp, Artificial sequence
  SiRNA target sequence
tattgtcaatttttatccaaatatc

SEQ ID NO: 30783 - DNA, 25 bp, Artificial sequence
  SiRNA target sequence
attgtcaatttttatccaaatatcg

SEQ ID NO: 30784 - DNA, 25 bp, Artificial sequence
  SiRNA target sequence
ttgtcaatttttatccaaatatcgc

SEQ ID NO: 30785 - DNA, 25 bp, Artificial sequence
  SiRNA target sequence
tgtcaatttttatccaaatatcgcc

SEQ ID NO: 30786 - DNA, 25 bp, Artificial sequence
  SiRNA target sequence
gtcaatttttatccaaatatcgccg

SEQ ID NO: 30787 - DNA, 25 bp, Artificial sequence
  SiRNA target sequence
tcaatttttatccaaatatcgccgt

SEQ ID NO: 30788 - DNA, 25 bp, Artificial sequence
  SiRNA target sequence
caatttttatccaaatatcgccgtt

SEQ ID NO: 30789 - DNA, 25 bp, Artificial sequence
  SiRNA target sequence
aatttttatccaaatatcgccgtta

SEQ ID NO: 30790 - DNA, 25 bp, Artificial sequence
  SiRNA target sequence
atttttatccaaatatcgccgttac

SEQ ID NO: 30791 - DNA, 25 bp, Artificial sequence
  SiRNA target sequence
tttttatccaaatatcgccgttaca

SEQ ID NO: 30792 - DNA, 25 bp, Artificial sequence
  SiRNA target sequence
ttttatccaaatatcgccgttacaa

SEQ ID NO: 30793 - DNA, 25 bp, Artificial sequence
  SiRNA target sequence
tttatccaaatatcgccgttacaat

SEQ ID NO: 30794 - DNA, 25 bp, Artificial sequence
  SiRNA target sequence
ttatccaaatatcgccgttacaatg

SEQ ID NO: 30795 - DNA, 25 bp, Artificial sequence
  SiRNA target sequence
tatccaaatatcgccgttacaatgc

SEQ ID NO: 30796 - DNA, 25 bp, Artificial sequence
  SiRNA target sequence
atccaaatatcgccgttacaatgct

SEQ ID NO: 30797 - DNA, 25 bp, Artificial sequence
  SiRNA target sequence
tccaaatatcgccgttacaatgctt

SEQ ID NO: 30798 - DNA, 25 bp, Artificial sequence
  SiRNA target sequence
ccaaatatcgccgttacaatgctta

SEQ ID NO: 30799 - DNA, 25 bp, Artificial sequence
  SiRNA target sequence
caaatatcgccgttacaatgcttag

SEQ ID NO: 30800 - DNA, 25 bp, Artificial sequence
  SiRNA target sequence
aaatatcgccgttacaatgcttagt

SEQ ID NO: 30801 - DNA, 25 bp, Artificial sequence
  SiRNA target sequence
aatatcgccgttacaatgcttagta

SEQ ID NO: 30802 - DNA, 25 bp, Artificial sequence
  SiRNA target sequence
atatcgccgttacaatgcttagtag

SEQ ID NO: 30803 - DNA, 25 bp, Artificial sequence
  SiRNA target sequence
tatcgccgttacaatgcttagtagt

SEQ ID NO: 30804 - DNA, 25 bp, Artificial sequence
  SiRNA target sequence
atcgccgttacaatgcttagtagtg

SEQ ID NO: 30805 - DNA, 25 bp, Artificial sequence
  SiRNA target sequence
tcgccgttacaatgcttagtagtgt

SEQ ID NO: 30806 - DNA, 25 bp, Artificial sequence
  SiRNA target sequence
cgccgttacaatgcttagtagtgtc

SEQ ID NO: 30807 - DNA, 25 bp, Artificial sequence
  SiRNA target sequence
gccgttacaatgcttagtagtgtca

SEQ ID NO: 30808 - DNA, 25 bp, Artificial sequence
  SiRNA target sequence
ccgttacaatgcttagtagtgtcat

SEQ ID NO: 30809 - DNA, 25 bp, Artificial sequence
  SiRNA target sequence
cgttacaatgcttagtagtgtcata

SEQ ID NO: 30810 - DNA, 25 bp, Artificial sequence
  SiRNA target sequence
gttacaatgcttagtagtgtcatat

SEQ ID NO: 30811 - DNA, 25 bp, Artificial sequence
  SiRNA target sequence
ttacaatgcttagtagtgtcatatg

SEQ ID NO: 30812 - DNA, 25 bp, Artificial sequence
  SiRNA target sequence
tacaatgcttagtagtgtcatatgg

SEQ ID NO: 30813 - DNA, 25 bp, Artificial sequence
  SiRNA target sequence
acaatgcttagtagtgtcatatggt

SEQ ID NO: 30814 - DNA, 25 bp, Artificial sequence
  SiRNA target sequence
caatgcttagtagtgtcatatggta

SEQ ID NO: 30815 - DNA, 25 bp, Artificial sequence
  SiRNA target sequence
aatgcttagtagtgtcatatggtaa

SEQ ID NO: 30816 - DNA, 25 bp, Artificial sequence
  SiRNA target sequence
atgcttagtagtgtcatatggtaag

SEQ ID NO: 30817 - DNA, 25 bp, Artificial sequence
  SiRNA target sequence
tgcttagtagtgtcatatggtaagc

SEQ ID NO: 30818 - DNA, 25 bp, Artificial sequence
  SiRNA target sequence
gcttagtagtgtcatatggtaagct

SEQ ID NO: 30819 - DNA, 25 bp, Artificial sequence
  SiRNA target sequence
cttagtagtgtcatatggtaagctt

SEQ ID NO: 30820 - DNA, 25 bp, Artificial sequence
  SiRNA target sequence
ttagtagtgtcatatggtaagcttt

SEQ ID NO: 30821 - DNA, 25 bp, Artificial sequence
  SiRNA target sequence
tagtagtgtcatatggtaagctttt

SEQ ID NO: 30822 - DNA, 25 bp, Artificial sequence
  SiRNA target sequence
agtagtgtcatatggtaagcttttt

SEQ ID NO: 30823 - DNA, 25 bp, Artificial sequence
  SiRNA target sequence
gtagtgtcatatggtaagcttttta

SEQ ID NO: 30824 - DNA, 25 bp, Artificial sequence
  SiRNA target sequence
tagtgtcatatggtaagctttttaa

SEQ ID NO: 30825 - DNA, 25 bp, Artificial sequence
  SiRNA target sequence
agtgtcatatggtaagctttttaaa

SEQ ID NO: 30826 - DNA, 25 bp, Artificial sequence
  SiRNA target sequence
gtgtcatatggtaagctttttaaat

SEQ ID NO: 30827 - DNA, 25 bp, Artificial sequence
  SiRNA target sequence
tgtcatatggtaagctttttaaata

SEQ ID NO: 30828 - DNA, 25 bp, Artificial sequence
  SiRNA target sequence
gtcatatggtaagctttttaaataa

SEQ ID NO: 30829 - DNA, 25 bp, Artificial sequence
  SiRNA target sequence
tcatatggtaagctttttaaataat

SEQ ID NO: 30830 - DNA, 25 bp, Artificial sequence
  SiRNA target sequence
catatggtaagctttttaaataatc

SEQ ID NO: 30831 - DNA, 25 bp, Artificial sequence
  SiRNA target sequence
atatggtaagctttttaaataatct

SEQ ID NO: 30832 - DNA, 25 bp, Artificial sequence
  SiRNA target sequence
tatggtaagctttttaaataatctt

SEQ ID NO: 30833 - DNA, 25 bp, Artificial sequence
  SiRNA target sequence
atggtaagctttttaaataatcttt

SEQ ID NO: 30834 - DNA, 25 bp, Artificial sequence
  SiRNA target sequence
tggtaagctttttaaataatctttt

SEQ ID NO: 30835 - DNA, 25 bp, Artificial sequence
  SiRNA target sequence
ggtaagctttttaaataatctttta

SEQ ID NO: 30836 - DNA, 25 bp, Artificial sequence
  SiRNA target sequence
gtaagctttttaaataatcttttaa

SEQ ID NO: 30837 - DNA, 25 bp, Artificial sequence
  SiRNA target sequence
taagctttttaaataatcttttaat

SEQ ID NO: 30838 - DNA, 25 bp, Artificial sequence
  SiRNA target sequence
aagctttttaaataatcttttaatt

SEQ ID NO: 30839 - DNA, 25 bp, Artificial sequence
  SiRNA target sequence
agctttttaaataatcttttaattc

SEQ ID NO: 30840 - DNA, 25 bp, Artificial sequence
  SiRNA target sequence
gctttttaaataatcttttaattct

SEQ ID NO: 30841 - DNA, 25 bp, Artificial sequence
  SiRNA target sequence
ctttttaaataatcttttaattcta

SEQ ID NO: 30842 - DNA, 25 bp, Artificial sequence
  SiRNA target sequence
tttttaaataatcttttaattctac

SEQ ID NO: 30843 - DNA, 25 bp, Artificial sequence
  SiRNA target sequence
ttttaaataatcttttaattctaca

SEQ ID NO: 30844 - DNA, 25 bp, Artificial sequence
  SiRNA target sequence
tttaaataatcttttaattctacat

SEQ ID NO: 30845 - DNA, 25 bp, Artificial sequence
  SiRNA target sequence
ttaaataatcttttaattctacatc

SEQ ID NO: 30846 - DNA, 25 bp, Artificial sequence
  SiRNA target sequence
taaataatcttttaattctacatca

SEQ ID NO: 30847 - DNA, 25 bp, Artificial sequence
  SiRNA target sequence
aaataatcttttaattctacatcat

SEQ ID NO: 30848 - DNA, 25 bp, Artificial sequence
  SiRNA target sequence
aataatcttttaattctacatcatc

SEQ ID NO: 30849 - DNA, 25 bp, Artificial sequence
  SiRNA target sequence
ataatcttttaattctacatcatca

SEQ ID NO: 30850 - DNA, 25 bp, Artificial sequence
  SiRNA target sequence
taatcttttaattctacatcatcaa

SEQ ID NO: 30851 - DNA, 25 bp, Artificial sequence
  SiRNA target sequence
aatcttttaattctacatcatcaaa

SEQ ID NO: 30852 - DNA, 25 bp, Artificial sequence
  SiRNA target sequence
atcttttaattctacatcatcaaat

SEQ ID NO: 30853 - DNA, 25 bp, Artificial sequence
  SiRNA target sequence
tcttttaattctacatcatcaaatt

SEQ ID NO: 30854 - DNA, 25 bp, Artificial sequence
  SiRNA target sequence
cttttaattctacatcatcaaattt

SEQ ID NO: 30855 - DNA, 25 bp, Artificial sequence
  SiRNA target sequence
ttttaattctacatcatcaaatttt

SEQ ID NO: 30856 - DNA, 25 bp, Artificial sequence
  SiRNA target sequence
tttaattctacatcatcaaattttc

SEQ ID NO: 30857 - DNA, 25 bp, Artificial sequence
  SiRNA target sequence
ttaattctacatcatcaaattttcg

SEQ ID NO: 30858 - DNA, 25 bp, Artificial sequence
  SiRNA target sequence
taattctacatcatcaaattttcgt

SEQ ID NO: 30859 - DNA, 25 bp, Artificial sequence
  SiRNA target sequence
aattctacatcatcaaattttcgtc

SEQ ID NO: 30860 - DNA, 25 bp, Artificial sequence
  SiRNA target sequence
attctacatcatcaaattttcgtcc

SEQ ID NO: 30861 - DNA, 25 bp, Artificial sequence
  SiRNA target sequence
ttctacatcatcaaattttcgtccc

SEQ ID NO: 30862 - DNA, 25 bp, Artificial sequence
  SiRNA target sequence
tctacatcatcaaattttcgtccca

SEQ ID NO: 30863 - DNA, 25 bp, Artificial sequence
  SiRNA target sequence
ctacatcatcaaattttcgtcccag

SEQ ID NO: 30864 - DNA, 25 bp, Artificial sequence
  SiRNA target sequence
tacatcatcaaattttcgtcccagc

SEQ ID NO: 30865 - DNA, 25 bp, Artificial sequence
  SiRNA target sequence
acatcatcaaattttcgtcccagca

SEQ ID NO: 30866 - DNA, 25 bp, Artificial sequence
  SiRNA target sequence
catcatcaaattttcgtcccagcaa

SEQ ID NO: 30867 - DNA, 25 bp, Artificial sequence
  SiRNA target sequence
atcatcaaattttcgtcccagcaat

SEQ ID NO: 30868 - DNA, 25 bp, Artificial sequence
  SiRNA target sequence
tcatcaaattttcgtcccagcaatc

SEQ ID NO: 30869 - DNA, 25 bp, Artificial sequence
  SiRNA target sequence
catcaaattttcgtcccagcaatct

SEQ ID NO: 30870 - DNA, 25 bp, Artificial sequence
  SiRNA target sequence
atcaaattttcgtcccagcaatctc

SEQ ID NO: 30871 - DNA, 25 bp, Artificial sequence
  SiRNA target sequence
tcaaattttcgtcccagcaatctct

SEQ ID NO: 30872 - DNA, 25 bp, Artificial sequence
  SiRNA target sequence
caaattttcgtcccagcaatctctt

SEQ ID NO: 30873 - DNA, 25 bp, Artificial sequence
  SiRNA target sequence
aaattttcgtcccagcaatctctta

SEQ ID NO: 30874 - DNA, 25 bp, Artificial sequence
  SiRNA target sequence
aattttcgtcccagcaatctcttag

SEQ ID NO: 30875 - DNA, 25 bp, Artificial sequence
  SiRNA target sequence
attttcgtcccagcaatctcttaga

SEQ ID NO: 30876 - DNA, 25 bp, Artificial sequence
  SiRNA target sequence
ttttcgtcccagcaatctcttagac

SEQ ID NO: 30877 - DNA, 25 bp, Artificial sequence
  SiRNA target sequence
tttcgtcccagcaatctcttagacg

SEQ ID NO: 30878 - DNA, 25 bp, Artificial sequence
  SiRNA target sequence
ttcgtcccagcaatctcttagacgc

SEQ ID NO: 30879 - DNA, 25 bp, Artificial sequence
  SiRNA target sequence
tcgtcccagcaatctcttagacgca

SEQ ID NO: 30880 - DNA, 25 bp, Artificial sequence
  SiRNA target sequence
cgtcccagcaatctcttagacgcaa

SEQ ID NO: 30881 - DNA, 25 bp, Artificial sequence
  SiRNA target sequence
gtcccagcaatctcttagacgcaaa

SEQ ID NO: 30882 - DNA, 25 bp, Artificial sequence
  SiRNA target sequence
tcccagcaatctcttagacgcaaaa

SEQ ID NO: 30883 - DNA, 25 bp, Artificial sequence
  SiRNA target sequence
cccagcaatctcttagacgcaaaaa

SEQ ID NO: 30884 - DNA, 25 bp, Artificial sequence
  SiRNA target sequence
ccagcaatctcttagacgcaaaaat

SEQ ID NO: 30885 - DNA, 25 bp, Artificial sequence
  SiRNA target sequence
cagcaatctcttagacgcaaaaatc

SEQ ID NO: 30886 - DNA, 25 bp, Artificial sequence
  SiRNA target sequence
agcaatctcttagacgcaaaaatcg

SEQ ID NO: 30887 - DNA, 25 bp, Artificial sequence
  SiRNA target sequence
gcaatctcttagacgcaaaaatcgt

SEQ ID NO: 30888 - DNA, 25 bp, Artificial sequence
  SiRNA target sequence
caatctcttagacgcaaaaatcgta

SEQ ID NO: 30889 - DNA, 25 bp, Artificial sequence
  SiRNA target sequence
aatctcttagacgcaaaaatcgtat

SEQ ID NO: 30890 - DNA, 25 bp, Artificial sequence
  SiRNA target sequence
atctcttagacgcaaaaatcgtatt

SEQ ID NO: 30891 - DNA, 25 bp, Artificial sequence
  SiRNA target sequence
tctcttagacgcaaaaatcgtattc

SEQ ID NO: 30892 - DNA, 25 bp, Artificial sequence
  SiRNA target sequence
ctcttagacgcaaaaatcgtattct

SEQ ID NO: 30893 - DNA, 25 bp, Artificial sequence
  SiRNA target sequence
tcttagacgcaaaaatcgtattctt

SEQ ID NO: 30894 - DNA, 25 bp, Artificial sequence
  SiRNA target sequence
cttagacgcaaaaatcgtattcttg

SEQ ID NO: 30895 - DNA, 25 bp, Artificial sequence
  SiRNA target sequence
ttagacgcaaaaatcgtattcttgg

SEQ ID NO: 30896 - DNA, 25 bp, Artificial sequence
  SiRNA target sequence
tagacgcaaaaatcgtattcttggg

SEQ ID NO: 30897 - DNA, 25 bp, Artificial sequence
  SiRNA target sequence
agacgcaaaaatcgtattcttggga

SEQ ID NO: 30898 - DNA, 25 bp, Artificial sequence
  SiRNA target sequence
gacgcaaaaatcgtattcttgggat

SEQ ID NO: 30899 - DNA, 25 bp, Artificial sequence
  SiRNA target sequence
acgcaaaaatcgtattcttgggatg

SEQ ID NO: 30900 - DNA, 25 bp, Artificial sequence
  SiRNA target sequence
cgcaaaaatcgtattcttgggatgt

SEQ ID NO: 30901 - DNA, 25 bp, Artificial sequence
  SiRNA target sequence
gcaaaaatcgtattcttgggatgta

SEQ ID NO: 30902 - DNA, 25 bp, Artificial sequence
  SiRNA target sequence
caaaaatcgtattcttgggatgtaa

SEQ ID NO: 30903 - DNA, 25 bp, Artificial sequence
  SiRNA target sequence
aaaaatcgtattcttgggatgtaat

SEQ ID NO: 30904 - DNA, 25 bp, Artificial sequence
  SiRNA target sequence
aaaatcgtattcttgggatgtaata

SEQ ID NO: 30905 - DNA, 25 bp, Artificial sequence
  SiRNA target sequence
aaatcgtattcttgggatgtaataa

SEQ ID NO: 30906 - DNA, 25 bp, Artificial sequence
  SiRNA target sequence
aatcgtattcttgggatgtaataac

SEQ ID NO: 30907 - DNA, 25 bp, Artificial sequence
  SiRNA target sequence
atcgtattcttgggatgtaataaca

SEQ ID NO: 30908 - DNA, 25 bp, Artificial sequence
  SiRNA target sequence
tcgtattcttgggatgtaataacaa

SEQ ID NO: 30909 - DNA, 25 bp, Artificial sequence
  SiRNA target sequence
cgtattcttgggatgtaataacaag

SEQ ID NO: 30910 - DNA, 25 bp, Artificial sequence
  SiRNA target sequence
gtattcttgggatgtaataacaagt

SEQ ID NO: 30911 - DNA, 25 bp, Artificial sequence
  SiRNA target sequence
tattcttgggatgtaataacaagtt

SEQ ID NO: 30912 - DNA, 25 bp, Artificial sequence
  SiRNA target sequence
attcttgggatgtaataacaagtta

SEQ ID NO: 30913 - DNA, 25 bp, Artificial sequence
  SiRNA target sequence
ttcttgggatgtaataacaagttag

SEQ ID NO: 30914 - DNA, 25 bp, Artificial sequence
  SiRNA target sequence
tcttgggatgtaataacaagttaga

SEQ ID NO: 30915 - DNA, 25 bp, Artificial sequence
  SiRNA target sequence
cttgggatgtaataacaagttagac

SEQ ID NO: 30916 - DNA, 25 bp, Artificial sequence
  SiRNA target sequence
ttgggatgtaataacaagttagact

SEQ ID NO: 30917 - DNA, 25 bp, Artificial sequence
  SiRNA target sequence
tgggatgtaataacaagttagactt

SEQ ID NO: 30918 - DNA, 25 bp, Artificial sequence
  SiRNA target sequence
gggatgtaataacaagttagactta

SEQ ID NO: 30919 - DNA, 25 bp, Artificial sequence
  SiRNA target sequence
ggatgtaataacaagttagacttag

SEQ ID NO: 30920 - DNA, 25 bp, Artificial sequence
  SiRNA target sequence
gatgtaataacaagttagacttagc

SEQ ID NO: 30921 - DNA, 25 bp, Artificial sequence
  SiRNA target sequence
atgtaataacaagttagacttagct

SEQ ID NO: 30922 - DNA, 25 bp, Artificial sequence
  SiRNA target sequence
tgtaataacaagttagacttagctt

SEQ ID NO: 30923 - DNA, 25 bp, Artificial sequence
  SiRNA target sequence
gtaataacaagttagacttagcttg

SEQ ID NO: 30924 - DNA, 25 bp, Artificial sequence
  SiRNA target sequence
taataacaagttagacttagcttgc

SEQ ID NO: 30925 - DNA, 25 bp, Artificial sequence
  SiRNA target sequence
aataacaagttagacttagcttgct

SEQ ID NO: 30926 - DNA, 25 bp, Artificial sequence
  SiRNA target sequence
ataacaagttagacttagcttgctc

SEQ ID NO: 30927 - DNA, 25 bp, Artificial sequence
  SiRNA target sequence
taacaagttagacttagcttgctca

SEQ ID NO: 30928 - DNA, 25 bp, Artificial sequence
  SiRNA target sequence
aacaagttagacttagcttgctcac

SEQ ID NO: 30929 - DNA, 25 bp, Artificial sequence
  SiRNA target sequence
acaagttagacttagcttgctcacc

SEQ ID NO: 30930 - DNA, 25 bp, Artificial sequence
  SiRNA target sequence
caagttagacttagcttgctcacct

SEQ ID NO: 30931 - DNA, 25 bp, Artificial sequence
  SiRNA target sequence
aagttagacttagcttgctcacctg

SEQ ID NO: 30932 - DNA, 25 bp, Artificial sequence
  SiRNA target sequence
agttagacttagcttgctcacctgt

SEQ ID NO: 30933 - DNA, 25 bp, Artificial sequence
  SiRNA target sequence
gttagacttagcttgctcacctgtt

SEQ ID NO: 30934 - DNA, 25 bp, Artificial sequence
  SiRNA target sequence
ttagacttagcttgctcacctgtta

SEQ ID NO: 30935 - DNA, 25 bp, Artificial sequence
  SiRNA target sequence
tagacttagcttgctcacctgttaa

SEQ ID NO: 30936 - DNA, 25 bp, Artificial sequence
  SiRNA target sequence
agacttagcttgctcacctgttaaa

SEQ ID NO: 30937 - DNA, 25 bp, Artificial sequence
  SiRNA target sequence
gacttagcttgctcacctgttaaaa

SEQ ID NO: 30938 - DNA, 25 bp, Artificial sequence
  SiRNA target sequence
acttagcttgctcacctgttaaaat

SEQ ID NO: 30939 - DNA, 25 bp, Artificial sequence
  SiRNA target sequence
cttagcttgctcacctgttaaaatt

SEQ ID NO: 30940 - DNA, 25 bp, Artificial sequence
  SiRNA target sequence
ttagcttgctcacctgttaaaattt

SEQ ID NO: 30941 - DNA, 25 bp, Artificial sequence
  SiRNA target sequence
tagcttgctcacctgttaaaatttt

SEQ ID NO: 30942 - DNA, 25 bp, Artificial sequence
  SiRNA target sequence
agcttgctcacctgttaaaatttta

SEQ ID NO: 30943 - DNA, 25 bp, Artificial sequence
  SiRNA target sequence
gcttgctcacctgttaaaattttat

SEQ ID NO: 30944 - DNA, 25 bp, Artificial sequence
  SiRNA target sequence
cttgctcacctgttaaaattttatc

SEQ ID NO: 30945 - DNA, 25 bp, Artificial sequence
  SiRNA target sequence
ttgctcacctgttaaaattttatct

SEQ ID NO: 30946 - DNA, 25 bp, Artificial sequence
  SiRNA target sequence
tgctcacctgttaaaattttatctt

SEQ ID NO: 30947 - DNA, 25 bp, Artificial sequence
  SiRNA target sequence
gctcacctgttaaaattttatcttt

SEQ ID NO: 30948 - DNA, 25 bp, Artificial sequence
  SiRNA target sequence
ctcacctgttaaaattttatcttta

SEQ ID NO: 30949 - DNA, 25 bp, Artificial sequence
  SiRNA target sequence
tcacctgttaaaattttatctttaa

SEQ ID NO: 30950 - DNA, 25 bp, Artificial sequence
  SiRNA target sequence
cacctgttaaaattttatctttaaa

SEQ ID NO: 30951 - DNA, 25 bp, Artificial sequence
  SiRNA target sequence
acctgttaaaattttatctttaaaa

SEQ ID NO: 30952 - DNA, 25 bp, Artificial sequence
  SiRNA target sequence
cctgttaaaattttatctttaaaaa

SEQ ID NO: 30953 - DNA, 25 bp, Artificial sequence
  SiRNA target sequence
ctgttaaaattttatctttaaaaat

SEQ ID NO: 30954 - DNA, 25 bp, Artificial sequence
  SiRNA target sequence
tgttaaaattttatctttaaaaatt

SEQ ID NO: 30955 - DNA, 25 bp, Artificial sequence
  SiRNA target sequence
gttaaaattttatctttaaaaattg

SEQ ID NO: 30956 - DNA, 25 bp, Artificial sequence
  SiRNA target sequence
ttaaaattttatctttaaaaattga

SEQ ID NO: 30957 - DNA, 25 bp, Artificial sequence
  SiRNA target sequence
taaaattttatctttaaaaattgat

SEQ ID NO: 30958 - DNA, 25 bp, Artificial sequence
  SiRNA target sequence
aaaattttatctttaaaaattgata

SEQ ID NO: 30959 - DNA, 25 bp, Artificial sequence
  SiRNA target sequence
aaattttatctttaaaaattgatac

SEQ ID NO: 30960 - DNA, 25 bp, Artificial sequence
  SiRNA target sequence
aattttatctttaaaaattgatacc

SEQ ID NO: 30961 - DNA, 25 bp, Artificial sequence
  SiRNA target sequence
attttatctttaaaaattgatacca

SEQ ID NO: 30962 - DNA, 25 bp, Artificial sequence
  SiRNA target sequence
ttttatctttaaaaattgataccac

SEQ ID NO: 30963 - DNA, 25 bp, Artificial sequence
  SiRNA target sequence
tttatctttaaaaattgataccacc

SEQ ID NO: 30964 - DNA, 25 bp, Artificial sequence
  SiRNA target sequence
ttatctttaaaaattgataccaccg

SEQ ID NO: 30965 - DNA, 25 bp, Artificial sequence
  SiRNA target sequence
tatctttaaaaattgataccaccga

SEQ ID NO: 30966 - DNA, 25 bp, Artificial sequence
  SiRNA target sequence
atctttaaaaattgataccaccgat

SEQ ID NO: 30967 - DNA, 25 bp, Artificial sequence
  SiRNA target sequence
tctttaaaaattgataccaccgatg

SEQ ID NO: 30968 - DNA, 25 bp, Artificial sequence
  SiRNA target sequence
ctttaaaaattgataccaccgatgg

SEQ ID NO: 30969 - DNA, 25 bp, Artificial sequence
  SiRNA target sequence
tttaaaaattgataccaccgatggt

SEQ ID NO: 30970 - DNA, 25 bp, Artificial sequence
  SiRNA target sequence
ttaaaaattgataccaccgatggtg

SEQ ID NO: 30971 - DNA, 25 bp, Artificial sequence
  SiRNA target sequence
taaaaattgataccaccgatggtgt

SEQ ID NO: 30972 - DNA, 25 bp, Artificial sequence
  SiRNA target sequence
aaaaattgataccaccgatggtgta

SEQ ID NO: 30973 - DNA, 25 bp, Artificial sequence
  SiRNA target sequence
aaaattgataccaccgatggtgtag

SEQ ID NO: 30974 - DNA, 25 bp, Artificial sequence
  SiRNA target sequence
aaattgataccaccgatggtgtagt

SEQ ID NO: 30975 - DNA, 25 bp, Artificial sequence
  SiRNA target sequence
aattgataccaccgatggtgtagtt

SEQ ID NO: 30976 - DNA, 25 bp, Artificial sequence
  SiRNA target sequence
attgataccaccgatggtgtagttc

SEQ ID NO: 30977 - DNA, 25 bp, Artificial sequence
  SiRNA target sequence
ttgataccaccgatggtgtagttct

SEQ ID NO: 30978 - DNA, 25 bp, Artificial sequence
  SiRNA target sequence
tgataccaccgatggtgtagttcta

SEQ ID NO: 30979 - DNA, 25 bp, Artificial sequence
  SiRNA target sequence
gataccaccgatggtgtagttctac

SEQ ID NO: 30980 - DNA, 25 bp, Artificial sequence
  SiRNA target sequence
ataccaccgatggtgtagttctacc

SEQ ID NO: 30981 - DNA, 25 bp, Artificial sequence
  SiRNA target sequence
taccaccgatggtgtagttctacca

SEQ ID NO: 30982 - DNA, 25 bp, Artificial sequence
  SiRNA target sequence
accaccgatggtgtagttctaccac

SEQ ID NO: 30983 - DNA, 25 bp, Artificial sequence
  SiRNA target sequence
ccaccgatggtgtagttctaccacc

SEQ ID NO: 30984 - DNA, 25 bp, Artificial sequence
  SiRNA target sequence
caccgatggtgtagttctaccacct

SEQ ID NO: 30985 - DNA, 25 bp, Artificial sequence
  SiRNA target sequence
accgatggtgtagttctaccacctt

SEQ ID NO: 30986 - DNA, 25 bp, Artificial sequence
  SiRNA target sequence
ccgatggtgtagttctaccaccttc

SEQ ID NO: 30987 - DNA, 25 bp, Artificial sequence
  SiRNA target sequence
cgatggtgtagttctaccaccttct

SEQ ID NO: 30988 - DNA, 25 bp, Artificial sequence
  SiRNA target sequence
gatggtgtagttctaccaccttctt

SEQ ID NO: 30989 - DNA, 25 bp, Artificial sequence
  SiRNA target sequence
atggtgtagttctaccaccttcttc

SEQ ID NO: 30990 - DNA, 25 bp, Artificial sequence
  SiRNA target sequence
tggtgtagttctaccaccttcttcg

SEQ ID NO: 30991 - DNA, 25 bp, Artificial sequence
  SiRNA target sequence
ggtgtagttctaccaccttcttcgt

SEQ ID NO: 30992 - DNA, 25 bp, Artificial sequence
  SiRNA target sequence
gtgtagttctaccaccttcttcgtt

SEQ ID NO: 30993 - DNA, 25 bp, Artificial sequence
  SiRNA target sequence
tgtagttctaccaccttcttcgttt

SEQ ID NO: 30994 - DNA, 25 bp, Artificial sequence
  SiRNA target sequence
gtagttctaccaccttcttcgtttt

SEQ ID NO: 30995 - DNA, 25 bp, Artificial sequence
  SiRNA target sequence
tagttctaccaccttcttcgttttc

SEQ ID NO: 30996 - DNA, 25 bp, Artificial sequence
  SiRNA target sequence
agttctaccaccttcttcgttttca

SEQ ID NO: 30997 - DNA, 25 bp, Artificial sequence
  SiRNA target sequence
gttctaccaccttcttcgttttcaa

SEQ ID NO: 30998 - DNA, 25 bp, Artificial sequence
  SiRNA target sequence
ttctaccaccttcttcgttttcaat

SEQ ID NO: 30999 - DNA, 25 bp, Artificial sequence
  SiRNA target sequence
tctaccaccttcttcgttttcaata

SEQ ID NO: 31000 - DNA, 25 bp, Artificial sequence
  SiRNA target sequence
ctaccaccttcttcgttttcaataa

SEQ ID NO: 31001 - DNA, 25 bp, Artificial sequence
  SiRNA target sequence
taccaccttcttcgttttcaataat

SEQ ID NO: 31002 - DNA, 25 bp, Artificial sequence
  SiRNA target sequence
accaccttcttcgttttcaataatt

SEQ ID NO: 31003 - DNA, 25 bp, Artificial sequence
  SiRNA target sequence
ccaccttcttcgttttcaataattt

SEQ ID NO: 31004 - DNA, 25 bp, Artificial sequence
  SiRNA target sequence
caccttcttcgttttcaataatttg

SEQ ID NO: 31005 - DNA, 25 bp, Artificial sequence
  SiRNA target sequence
accttcttcgttttcaataatttgt

SEQ ID NO: 31006 - DNA, 25 bp, Artificial sequence
  SiRNA target sequence
ccttcttcgttttcaataatttgtg

SEQ ID NO: 31007 - DNA, 25 bp, Artificial sequence
  SiRNA target sequence
cttcttcgttttcaataatttgtgg

SEQ ID NO: 31008 - DNA, 25 bp, Artificial sequence
  SiRNA target sequence
ttcttcgttttcaataatttgtggg

SEQ ID NO: 31009 - DNA, 25 bp, Artificial sequence
  SiRNA target sequence
tcttcgttttcaataatttgtggga

SEQ ID NO: 31010 - DNA, 25 bp, Artificial sequence
  SiRNA target sequence
cttcgttttcaataatttgtgggat

SEQ ID NO: 31011 - DNA, 25 bp, Artificial sequence
  SiRNA target sequence
ttcgttttcaataatttgtgggata

SEQ ID NO: 31012 - DNA, 25 bp, Artificial sequence
  SiRNA target sequence
tcgttttcaataatttgtgggatat

SEQ ID NO: 31013 - DNA, 25 bp, Artificial sequence
  SiRNA target sequence
cgttttcaataatttgtgggatatt

SEQ ID NO: 31014 - DNA, 25 bp, Artificial sequence
  SiRNA target sequence
gttttcaataatttgtgggatattg

SEQ ID NO: 31015 - DNA, 25 bp, Artificial sequence
  SiRNA target sequence
ttttcaataatttgtgggatattgt

SEQ ID NO: 31016 - DNA, 25 bp, Artificial sequence
  SiRNA target sequence
tttcaataatttgtgggatattgtt

SEQ ID NO: 31017 - DNA, 25 bp, Artificial sequence
  SiRNA target sequence
ttcaataatttgtgggatattgtta

SEQ ID NO: 31018 - DNA, 25 bp, Artificial sequence
  SiRNA target sequence
tcaataatttgtgggatattgttat

SEQ ID NO: 31019 - DNA, 25 bp, Artificial sequence
  SiRNA target sequence
caataatttgtgggatattgttatg

SEQ ID NO: 31020 - DNA, 25 bp, Artificial sequence
  SiRNA target sequence
aataatttgtgggatattgttatgt

SEQ ID NO: 31021 - DNA, 25 bp, Artificial sequence
  SiRNA target sequence
ataatttgtgggatattgttatgta

SEQ ID NO: 31022 - DNA, 25 bp, Artificial sequence
  SiRNA target sequence
taatttgtgggatattgttatgtat

SEQ ID NO: 31023 - DNA, 25 bp, Artificial sequence
  SiRNA target sequence
aatttgtgggatattgttatgtata

SEQ ID NO: 31024 - DNA, 25 bp, Artificial sequence
  SiRNA target sequence
atttgtgggatattgttatgtataa

SEQ ID NO: 31025 - DNA, 25 bp, Artificial sequence
  SiRNA target sequence
tttgtgggatattgttatgtataag

SEQ ID NO: 31026 - DNA, 25 bp, Artificial sequence
  SiRNA target sequence
ttgtgggatattgttatgtataaga

SEQ ID NO: 31027 - DNA, 25 bp, Artificial sequence
  SiRNA target sequence
tgtgggatattgttatgtataagag

SEQ ID NO: 31028 - DNA, 25 bp, Artificial sequence
  SiRNA target sequence
gtgggatattgttatgtataagaga

SEQ ID NO: 31029 - DNA, 25 bp, Artificial sequence
  SiRNA target sequence
tgggatattgttatgtataagagac

SEQ ID NO: 31030 - DNA, 25 bp, Artificial sequence
  SiRNA target sequence
gggatattgttatgtataagagaca

SEQ ID NO: 31031 - DNA, 25 bp, Artificial sequence
  SiRNA target sequence
ggatattgttatgtataagagacac

SEQ ID NO: 31032 - DNA, 25 bp, Artificial sequence
  SiRNA target sequence
gatattgttatgtataagagacaca

SEQ ID NO: 31033 - DNA, 25 bp, Artificial sequence
  SiRNA target sequence
atattgttatgtataagagacacac

SEQ ID NO: 31034 - DNA, 25 bp, Artificial sequence
  SiRNA target sequence
tattgttatgtataagagacacaca

SEQ ID NO: 31035 - DNA, 25 bp, Artificial sequence
  SiRNA target sequence
attgttatgtataagagacacacaa

SEQ ID NO: 31036 - DNA, 25 bp, Artificial sequence
  SiRNA target sequence
ttgttatgtataagagacacacaag

SEQ ID NO: 31037 - DNA, 25 bp, Artificial sequence
  SiRNA target sequence
tgttatgtataagagacacacaaga

SEQ ID NO: 31038 - DNA, 25 bp, Artificial sequence
  SiRNA target sequence
gttatgtataagagacacacaagaa

SEQ ID NO: 31039 - DNA, 25 bp, Artificial sequence
  SiRNA target sequence
ttatgtataagagacacacaagaat

SEQ ID NO: 31040 - DNA, 25 bp, Artificial sequence
  SiRNA target sequence
tatgtataagagacacacaagaatt

SEQ ID NO: 31041 - DNA, 25 bp, Artificial sequence
  SiRNA target sequence
atgtataagagacacacaagaattg

SEQ ID NO: 31042 - DNA, 25 bp, Artificial sequence
  SiRNA target sequence
tgtataagagacacacaagaattgg

SEQ ID NO: 31043 - DNA, 25 bp, Artificial sequence
  SiRNA target sequence
gtataagagacacacaagaattggt

SEQ ID NO: 31044 - DNA, 25 bp, Artificial sequence
  SiRNA target sequence
tataagagacacacaagaattggtt

SEQ ID NO: 31045 - DNA, 25 bp, Artificial sequence
  SiRNA target sequence
ataagagacacacaagaattggttg

SEQ ID NO: 31046 - DNA, 25 bp, Artificial sequence
  SiRNA target sequence
taagagacacacaagaattggttgt

SEQ ID NO: 31047 - DNA, 25 bp, Artificial sequence
  SiRNA target sequence
aagagacacacaagaattggttgtt

SEQ ID NO: 31048 - DNA, 25 bp, Artificial sequence
  SiRNA target sequence
agagacacacaagaattggttgttc

SEQ ID NO: 31049 - DNA, 25 bp, Artificial sequence
  SiRNA target sequence
gagacacacaagaattggttgttcc

SEQ ID NO: 31050 - DNA, 25 bp, Artificial sequence
  SiRNA target sequence
agacacacaagaattggttgttcct

SEQ ID NO: 31051 - DNA, 25 bp, Artificial sequence
  SiRNA target sequence
gacacacaagaattggttgttccta

SEQ ID NO: 31052 - DNA, 25 bp, Artificial sequence
  SiRNA target sequence
acacacaagaattggttgttcctag

SEQ ID NO: 31053 - DNA, 25 bp, Artificial sequence
  SiRNA target sequence
cacacaagaattggttgttcctaga

SEQ ID NO: 31054 - DNA, 25 bp, Artificial sequence
  SiRNA target sequence
acacaagaattggttgttcctagat

SEQ ID NO: 31055 - DNA, 25 bp, Artificial sequence
  SiRNA target sequence
cacaagaattggttgttcctagatc

SEQ ID NO: 31056 - DNA, 25 bp, Artificial sequence
  SiRNA target sequence
acaagaattggttgttcctagatca

SEQ ID NO: 31057 - DNA, 25 bp, Artificial sequence
  SiRNA target sequence
caagaattggttgttcctagatcaa

SEQ ID NO: 31058 - DNA, 25 bp, Artificial sequence
  SiRNA target sequence
aagaattggttgttcctagatcaat

SEQ ID NO: 31059 - DNA, 25 bp, Artificial sequence
  SiRNA target sequence
agaattggttgttcctagatcaatt

SEQ ID NO: 31060 - DNA, 25 bp, Artificial sequence
  SiRNA target sequence
gaattggttgttcctagatcaattc

SEQ ID NO: 31061 - DNA, 25 bp, Artificial sequence
  SiRNA target sequence
aattggttgttcctagatcaattcc

SEQ ID NO: 31062 - DNA, 25 bp, Artificial sequence
  SiRNA target sequence
attggttgttcctagatcaattcct

SEQ ID NO: 31063 - DNA, 25 bp, Artificial sequence
  SiRNA target sequence
ttggttgttcctagatcaattccta

SEQ ID NO: 31064 - DNA, 25 bp, Artificial sequence
  SiRNA target sequence
tggttgttcctagatcaattcctat

SEQ ID NO: 31065 - DNA, 25 bp, Artificial sequence
  SiRNA target sequence
ggttgttcctagatcaattcctatt

SEQ ID NO: 31066 - DNA, 25 bp, Artificial sequence
  SiRNA target sequence
gttgttcctagatcaattcctatta

SEQ ID NO: 31067 - DNA, 25 bp, Artificial sequence
  SiRNA target sequence
ttgttcctagatcaattcctattat

SEQ ID NO: 31068 - DNA, 25 bp, Artificial sequence
  SiRNA target sequence
tgttcctagatcaattcctattatt

SEQ ID NO: 31069 - DNA, 25 bp, Artificial sequence
  SiRNA target sequence
gttcctagatcaattcctattattt

SEQ ID NO: 31070 - DNA, 25 bp, Artificial sequence
  SiRNA target sequence
ttcctagatcaattcctattatttt

SEQ ID NO: 31071 - DNA, 25 bp, Artificial sequence
  SiRNA target sequence
tcctagatcaattcctattatttta

SEQ ID NO: 31072 - DNA, 25 bp, Artificial sequence
  SiRNA target sequence
cctagatcaattcctattattttag

SEQ ID NO: 31073 - DNA, 25 bp, Artificial sequence
  SiRNA target sequence
ctagatcaattcctattattttaga

SEQ ID NO: 31074 - DNA, 25 bp, Artificial sequence
  SiRNA target sequence
tagatcaattcctattattttagag

SEQ ID NO: 31075 - DNA, 25 bp, Artificial sequence
  SiRNA target sequence
agatcaattcctattattttagagc

SEQ ID NO: 31076 - DNA, 25 bp, Artificial sequence
  SiRNA target sequence
gatcaattcctattattttagagct

SEQ ID NO: 31077 - DNA, 25 bp, Artificial sequence
  SiRNA target sequence
atcaattcctattattttagagcta

SEQ ID NO: 31078 - DNA, 25 bp, Artificial sequence
  SiRNA target sequence
tcaattcctattattttagagctaa

SEQ ID NO: 31079 - DNA, 25 bp, Artificial sequence
  SiRNA target sequence
caattcctattattttagagctaat

SEQ ID NO: 31080 - DNA, 25 bp, Artificial sequence
  SiRNA target sequence
aattcctattattttagagctaatt

SEQ ID NO: 31081 - DNA, 25 bp, Artificial sequence
  SiRNA target sequence
attcctattattttagagctaattt

SEQ ID NO: 31082 - DNA, 25 bp, Artificial sequence
  SiRNA target sequence
ttcctattattttagagctaatttc

SEQ ID NO: 31083 - DNA, 25 bp, Artificial sequence
  SiRNA target sequence
tcctattattttagagctaatttct

SEQ ID NO: 31084 - DNA, 25 bp, Artificial sequence
  SiRNA target sequence
cctattattttagagctaatttctt

SEQ ID NO: 31085 - DNA, 25 bp, Artificial sequence
  SiRNA target sequence
ctattattttagagctaatttcttc

SEQ ID NO: 31086 - DNA, 25 bp, Artificial sequence
  SiRNA target sequence
tattattttagagctaatttcttct

SEQ ID NO: 31087 - DNA, 25 bp, Artificial sequence
  SiRNA target sequence
attattttagagctaatttcttctt

SEQ ID NO: 31088 - DNA, 25 bp, Artificial sequence
  SiRNA target sequence
ttattttagagctaatttcttcttt

SEQ ID NO: 31089 - DNA, 25 bp, Artificial sequence
  SiRNA target sequence
tattttagagctaatttcttcttta

SEQ ID NO: 31090 - DNA, 25 bp, Artificial sequence
  SiRNA target sequence
attttagagctaatttcttctttag

SEQ ID NO: 31091 - DNA, 25 bp, Artificial sequence
  SiRNA target sequence
ttttagagctaatttcttctttaga

SEQ ID NO: 31092 - DNA, 25 bp, Artificial sequence
  SiRNA target sequence
tttagagctaatttcttctttagac

SEQ ID NO: 31093 - DNA, 25 bp, Artificial sequence
  SiRNA target sequence
ttagagctaatttcttctttagaca

SEQ ID NO: 31094 - DNA, 25 bp, Artificial sequence
  SiRNA target sequence
tagagctaatttcttctttagacat

SEQ ID NO: 31095 - DNA, 26 bp, Artificial sequence
  SiRNA target sequence
ttaagaatttttcaatattttttttg

SEQ ID NO: 31096 - DNA, 26 bp, Artificial sequence
  SiRNA target sequence
taagaatttttcaatattttttttgc

SEQ ID NO: 31097 - DNA, 26 bp, Artificial sequence
  SiRNA target sequence
aagaatttttcaatattttttttgct

SEQ ID NO: 31098 - DNA, 26 bp, Artificial sequence
  SiRNA target sequence
agaatttttcaatattttttttgctt

SEQ ID NO: 31099 - DNA, 26 bp, Artificial sequence
  SiRNA target sequence
gaatttttcaatattttttttgcttg

SEQ ID NO: 31100 - DNA, 26 bp, Artificial sequence
  SiRNA target sequence
aatttttcaatattttttttgcttgt

SEQ ID NO: 31101 - DNA, 26 bp, Artificial sequence
  SiRNA target sequence
atttttcaatattttttttgcttgtt

SEQ ID NO: 31102 - DNA, 26 bp, Artificial sequence
  SiRNA target sequence
tttttcaatattttttttgcttgttc

SEQ ID NO: 31103 - DNA, 26 bp, Artificial sequence
  SiRNA target sequence
ttttcaatattttttttgcttgttct

SEQ ID NO: 31104 - DNA, 26 bp, Artificial sequence
  SiRNA target sequence
tttcaatattttttttgcttgttcta

SEQ ID NO: 31105 - DNA, 26 bp, Artificial sequence
  SiRNA target sequence
ttcaatattttttttgcttgttctaa

SEQ ID NO: 31106 - DNA, 26 bp, Artificial sequence
  SiRNA target sequence
tcaatattttttttgcttgttctaag

SEQ ID NO: 31107 - DNA, 26 bp, Artificial sequence
  SiRNA target sequence
caatattttttttgcttgttctaagt

SEQ ID NO: 31108 - DNA, 26 bp, Artificial sequence
  SiRNA target sequence
aatattttttttgcttgttctaagtc

SEQ ID NO: 31109 - DNA, 26 bp, Artificial sequence
  SiRNA target sequence
atattttttttgcttgttctaagtca

SEQ ID NO: 31110 - DNA, 26 bp, Artificial sequence
  SiRNA target sequence
tattttttttgcttgttctaagtcat

SEQ ID NO: 31111 - DNA, 26 bp, Artificial sequence
  SiRNA target sequence
attttttttgcttgttctaagtcata

SEQ ID NO: 31112 - DNA, 26 bp, Artificial sequence
  SiRNA target sequence
ttttttttgcttgttctaagtcataa

SEQ ID NO: 31113 - DNA, 26 bp, Artificial sequence
  SiRNA target sequence
tttttttgcttgttctaagtcataaa

SEQ ID NO: 31114 - DNA, 26 bp, Artificial sequence
  SiRNA target sequence
ttttttgcttgttctaagtcataaat

SEQ ID NO: 31115 - DNA, 26 bp, Artificial sequence
  SiRNA target sequence
tttttgcttgttctaagtcataaatt

SEQ ID NO: 31116 - DNA, 26 bp, Artificial sequence
  SiRNA target sequence
ttttgcttgttctaagtcataaattt

SEQ ID NO: 31117 - DNA, 26 bp, Artificial sequence
  SiRNA target sequence
tttgcttgttctaagtcataaatttt

SEQ ID NO: 31118 - DNA, 26 bp, Artificial sequence
  SiRNA target sequence
ttgcttgttctaagtcataaattttt

SEQ ID NO: 31119 - DNA, 26 bp, Artificial sequence
  SiRNA target sequence
tgcttgttctaagtcataaatttttt

SEQ ID NO: 31120 - DNA, 26 bp, Artificial sequence
  SiRNA target sequence
gcttgttctaagtcataaattttttt

SEQ ID NO: 31121 - DNA, 26 bp, Artificial sequence
  SiRNA target sequence
cttgttctaagtcataaattttttta

SEQ ID NO: 31122 - DNA, 26 bp, Artificial sequence
  SiRNA target sequence
ttgttctaagtcataaatttttttag

SEQ ID NO: 31123 - DNA, 26 bp, Artificial sequence
  SiRNA target sequence
tgttctaagtcataaatttttttagt

SEQ ID NO: 31124 - DNA, 26 bp, Artificial sequence
  SiRNA target sequence
gttctaagtcataaatttttttagtc

SEQ ID NO: 31125 - DNA, 26 bp, Artificial sequence
  SiRNA target sequence
ttctaagtcataaatttttttagtca

SEQ ID NO: 31126 - DNA, 26 bp, Artificial sequence
  SiRNA target sequence
tctaagtcataaatttttttagtcaa

SEQ ID NO: 31127 - DNA, 26 bp, Artificial sequence
  SiRNA target sequence
ctaagtcataaatttttttagtcaaa

SEQ ID NO: 31128 - DNA, 26 bp, Artificial sequence
  SiRNA target sequence
taagtcataaatttttttagtcaaat

SEQ ID NO: 31129 - DNA, 26 bp, Artificial sequence
  SiRNA target sequence
aagtcataaatttttttagtcaaata

SEQ ID NO: 31130 - DNA, 26 bp, Artificial sequence
  SiRNA target sequence
agtcataaatttttttagtcaaatat

SEQ ID NO: 31131 - DNA, 26 bp, Artificial sequence
  SiRNA target sequence
gtcataaatttttttagtcaaatatg

SEQ ID NO: 31132 - DNA, 26 bp, Artificial sequence
  SiRNA target sequence
tcataaatttttttagtcaaatatga

SEQ ID NO: 31133 - DNA, 26 bp, Artificial sequence
  SiRNA target sequence
cataaatttttttagtcaaatatgac

SEQ ID NO: 31134 - DNA, 26 bp, Artificial sequence
  SiRNA target sequence
ataaatttttttagtcaaatatgact

SEQ ID NO: 31135 - DNA, 26 bp, Artificial sequence
  SiRNA target sequence
taaatttttttagtcaaatatgactt

SEQ ID NO: 31136 - DNA, 26 bp, Artificial sequence
  SiRNA target sequence
aaatttttttagtcaaatatgacttt

SEQ ID NO: 31137 - DNA, 26 bp, Artificial sequence
  SiRNA target sequence
aatttttttagtcaaatatgacttta

SEQ ID NO: 31138 - DNA, 26 bp, Artificial sequence
  SiRNA target sequence
atttttttagtcaaatatgactttaa

SEQ ID NO: 31139 - DNA, 26 bp, Artificial sequence
  SiRNA target sequence
tttttttagtcaaatatgactttaaa

SEQ ID NO: 31140 - DNA, 26 bp, Artificial sequence
  SiRNA target sequence
ttttttagtcaaatatgactttaaaa

SEQ ID NO: 31141 - DNA, 26 bp, Artificial sequence
  SiRNA target sequence
tttttagtcaaatatgactttaaaat

SEQ ID NO: 31142 - DNA, 26 bp, Artificial sequence
  SiRNA target sequence
ttttagtcaaatatgactttaaaatc

SEQ ID NO: 31143 - DNA, 26 bp, Artificial sequence
  SiRNA target sequence
tttagtcaaatatgactttaaaatct

SEQ ID NO: 31144 - DNA, 26 bp, Artificial sequence
  SiRNA target sequence
ttagtcaaatatgactttaaaatctc

SEQ ID NO: 31145 - DNA, 26 bp, Artificial sequence
  SiRNA target sequence
tagtcaaatatgactttaaaatctct

SEQ ID NO: 31146 - DNA, 26 bp, Artificial sequence
  SiRNA target sequence
agtcaaatatgactttaaaatctctt

SEQ ID NO: 31147 - DNA, 26 bp, Artificial sequence
  SiRNA target sequence
gtcaaatatgactttaaaatctcttt

SEQ ID NO: 31148 - DNA, 26 bp, Artificial sequence
  SiRNA target sequence
tcaaatatgactttaaaatctctttt

SEQ ID NO: 31149 - DNA, 26 bp, Artificial sequence
  SiRNA target sequence
caaatatgactttaaaatctcttttg

SEQ ID NO: 31150 - DNA, 26 bp, Artificial sequence
  SiRNA target sequence
aaatatgactttaaaatctcttttgt

SEQ ID NO: 31151 - DNA, 26 bp, Artificial sequence
  SiRNA target sequence
aatatgactttaaaatctcttttgtt

SEQ ID NO: 31152 - DNA, 26 bp, Artificial sequence
  SiRNA target sequence
atatgactttaaaatctcttttgttt

SEQ ID NO: 31153 - DNA, 26 bp, Artificial sequence
  SiRNA target sequence
tatgactttaaaatctcttttgtttc

SEQ ID NO: 31154 - DNA, 26 bp, Artificial sequence
  SiRNA target sequence
atgactttaaaatctcttttgtttca

SEQ ID NO: 31155 - DNA, 26 bp, Artificial sequence
  SiRNA target sequence
tgactttaaaatctcttttgtttcat

SEQ ID NO: 31156 - DNA, 26 bp, Artificial sequence
  SiRNA target sequence
gactttaaaatctcttttgtttcatc

SEQ ID NO: 31157 - DNA, 26 bp, Artificial sequence
  SiRNA target sequence
actttaaaatctcttttgtttcatct

SEQ ID NO: 31158 - DNA, 26 bp, Artificial sequence
  SiRNA target sequence
ctttaaaatctcttttgtttcatctg

SEQ ID NO: 31159 - DNA, 26 bp, Artificial sequence
  SiRNA target sequence
tttaaaatctcttttgtttcatctgt

SEQ ID NO: 31160 - DNA, 26 bp, Artificial sequence
  SiRNA target sequence
ttaaaatctcttttgtttcatctgtt

SEQ ID NO: 31161 - DNA, 26 bp, Artificial sequence
  SiRNA target sequence
taaaatctcttttgtttcatctgtta

SEQ ID NO: 31162 - DNA, 26 bp, Artificial sequence
  SiRNA target sequence
aaaatctcttttgtttcatctgttac

SEQ ID NO: 31163 - DNA, 26 bp, Artificial sequence
  SiRNA target sequence
aaatctcttttgtttcatctgttact

SEQ ID NO: 31164 - DNA, 26 bp, Artificial sequence
  SiRNA target sequence
aatctcttttgtttcatctgttactt

SEQ ID NO: 31165 - DNA, 26 bp, Artificial sequence
  SiRNA target sequence
atctcttttgtttcatctgttacttg

SEQ ID NO: 31166 - DNA, 26 bp, Artificial sequence
  SiRNA target sequence
tctcttttgtttcatctgttacttgt

SEQ ID NO: 31167 - DNA, 26 bp, Artificial sequence
  SiRNA target sequence
ctcttttgtttcatctgttacttgtt

SEQ ID NO: 31168 - DNA, 26 bp, Artificial sequence
  SiRNA target sequence
tcttttgtttcatctgttacttgttt

SEQ ID NO: 31169 - DNA, 26 bp, Artificial sequence
  SiRNA target sequence
cttttgtttcatctgttacttgtttg

SEQ ID NO: 31170 - DNA, 26 bp, Artificial sequence
  SiRNA target sequence
ttttgtttcatctgttacttgtttgt

SEQ ID NO: 31171 - DNA, 26 bp, Artificial sequence
  SiRNA target sequence
tttgtttcatctgttacttgtttgta

SEQ ID NO: 31172 - DNA, 26 bp, Artificial sequence
  SiRNA target sequence
ttgtttcatctgttacttgtttgtac

SEQ ID NO: 31173 - DNA, 26 bp, Artificial sequence
  SiRNA target sequence
tgtttcatctgttacttgtttgtact

SEQ ID NO: 31174 - DNA, 26 bp, Artificial sequence
  SiRNA target sequence
gtttcatctgttacttgtttgtactt

SEQ ID NO: 31175 - DNA, 26 bp, Artificial sequence
  SiRNA target sequence
tttcatctgttacttgtttgtacttt

SEQ ID NO: 31176 - DNA, 26 bp, Artificial sequence
  SiRNA target sequence
ttcatctgttacttgtttgtacttta

SEQ ID NO: 31177 - DNA, 26 bp, Artificial sequence
  SiRNA target sequence
tcatctgttacttgtttgtactttaa

SEQ ID NO: 31178 - DNA, 26 bp, Artificial sequence
  SiRNA target sequence
catctgttacttgtttgtactttaaa

SEQ ID NO: 31179 - DNA, 26 bp, Artificial sequence
  SiRNA target sequence
atctgttacttgtttgtactttaaaa

SEQ ID NO: 31180 - DNA, 26 bp, Artificial sequence
  SiRNA target sequence
tctgttacttgtttgtactttaaaaa

SEQ ID NO: 31181 - DNA, 26 bp, Artificial sequence
  SiRNA target sequence
ctgttacttgtttgtactttaaaaat

SEQ ID NO: 31182 - DNA, 26 bp, Artificial sequence
  SiRNA target sequence
tgttacttgtttgtactttaaaaatt

SEQ ID NO: 31183 - DNA, 26 bp, Artificial sequence
  SiRNA target sequence
gttacttgtttgtactttaaaaattg

SEQ ID NO: 31184 - DNA, 26 bp, Artificial sequence
  SiRNA target sequence
ttacttgtttgtactttaaaaattgt

SEQ ID NO: 31185 - DNA, 26 bp, Artificial sequence
  SiRNA target sequence
tacttgtttgtactttaaaaattgtt

SEQ ID NO: 31186 - DNA, 26 bp, Artificial sequence
  SiRNA target sequence
acttgtttgtactttaaaaattgttg

SEQ ID NO: 31187 - DNA, 26 bp, Artificial sequence
  SiRNA target sequence
cttgtttgtactttaaaaattgttga

SEQ ID NO: 31188 - DNA, 26 bp, Artificial sequence
  SiRNA target sequence
ttgtttgtactttaaaaattgttgaa

SEQ ID NO: 31189 - DNA, 26 bp, Artificial sequence
  SiRNA target sequence
tgtttgtactttaaaaattgttgaat

SEQ ID NO: 31190 - DNA, 26 bp, Artificial sequence
  SiRNA target sequence
gtttgtactttaaaaattgttgaatt

SEQ ID NO: 31191 - DNA, 26 bp, Artificial sequence
  SiRNA target sequence
tttgtactttaaaaattgttgaattt

SEQ ID NO: 31192 - DNA, 26 bp, Artificial sequence
  SiRNA target sequence
ttgtactttaaaaattgttgaatttc

SEQ ID NO: 31193 - DNA, 26 bp, Artificial sequence
  SiRNA target sequence
tgtactttaaaaattgttgaatttca

SEQ ID NO: 31194 - DNA, 26 bp, Artificial sequence
  SiRNA target sequence
gtactttaaaaattgttgaatttcaa

SEQ ID NO: 31195 - DNA, 26 bp, Artificial sequence
  SiRNA target sequence
tactttaaaaattgttgaatttcaat

SEQ ID NO: 31196 - DNA, 26 bp, Artificial sequence
  SiRNA target sequence
actttaaaaattgttgaatttcaatt

SEQ ID NO: 31197 - DNA, 26 bp, Artificial sequence
  SiRNA target sequence
ctttaaaaattgttgaatttcaattt

SEQ ID NO: 31198 - DNA, 26 bp, Artificial sequence
  SiRNA target sequence
tttaaaaattgttgaatttcaatttt

SEQ ID NO: 31199 - DNA, 26 bp, Artificial sequence
  SiRNA target sequence
ttaaaaattgttgaatttcaatttta

SEQ ID NO: 31200 - DNA, 26 bp, Artificial sequence
  SiRNA target sequence
taaaaattgttgaatttcaattttaa

SEQ ID NO: 31201 - DNA, 26 bp, Artificial sequence
  SiRNA target sequence
aaaaattgttgaatttcaattttaaa

SEQ ID NO: 31202 - DNA, 26 bp, Artificial sequence
  SiRNA target sequence
aaaattgttgaatttcaattttaaat

SEQ ID NO: 31203 - DNA, 26 bp, Artificial sequence
  SiRNA target sequence
aaattgttgaatttcaattttaaatt

SEQ ID NO: 31204 - DNA, 26 bp, Artificial sequence
  SiRNA target sequence
aattgttgaatttcaattttaaattc

SEQ ID NO: 31205 - DNA, 26 bp, Artificial sequence
  SiRNA target sequence
attgttgaatttcaattttaaattcg

SEQ ID NO: 31206 - DNA, 26 bp, Artificial sequence
  SiRNA target sequence
ttgttgaatttcaattttaaattcgg

SEQ ID NO: 31207 - DNA, 26 bp, Artificial sequence
  SiRNA target sequence
tgttgaatttcaattttaaattcggc

SEQ ID NO: 31208 - DNA, 26 bp, Artificial sequence
  SiRNA target sequence
gttgaatttcaattttaaattcggca

SEQ ID NO: 31209 - DNA, 26 bp, Artificial sequence
  SiRNA target sequence
ttgaatttcaattttaaattcggcac

SEQ ID NO: 31210 - DNA, 26 bp, Artificial sequence
  SiRNA target sequence
tgaatttcaattttaaattcggcaca

SEQ ID NO: 31211 - DNA, 26 bp, Artificial sequence
  SiRNA target sequence
gaatttcaattttaaattcggcacaa

SEQ ID NO: 31212 - DNA, 26 bp, Artificial sequence
  SiRNA target sequence
aatttcaattttaaattcggcacaat

SEQ ID NO: 31213 - DNA, 26 bp, Artificial sequence
  SiRNA target sequence
atttcaattttaaattcggcacaatt

SEQ ID NO: 31214 - DNA, 26 bp, Artificial sequence
  SiRNA target sequence
tttcaattttaaattcggcacaattt

SEQ ID NO: 31215 - DNA, 26 bp, Artificial sequence
  SiRNA target sequence
ttcaattttaaattcggcacaatttt

SEQ ID NO: 31216 - DNA, 26 bp, Artificial sequence
  SiRNA target sequence
tcaattttaaattcggcacaattttt

SEQ ID NO: 31217 - DNA, 26 bp, Artificial sequence
  SiRNA target sequence
caattttaaattcggcacaatttttt

SEQ ID NO: 31218 - DNA, 26 bp, Artificial sequence
  SiRNA target sequence
aattttaaattcggcacaattttttt

SEQ ID NO: 31219 - DNA, 26 bp, Artificial sequence
  SiRNA target sequence
attttaaattcggcacaatttttttc

SEQ ID NO: 31220 - DNA, 26 bp, Artificial sequence
  SiRNA target sequence
ttttaaattcggcacaatttttttca

SEQ ID NO: 31221 - DNA, 26 bp, Artificial sequence
  SiRNA target sequence
tttaaattcggcacaatttttttcaa

SEQ ID NO: 31222 - DNA, 26 bp, Artificial sequence
  SiRNA target sequence
ttaaattcggcacaatttttttcaat

SEQ ID NO: 31223 - DNA, 26 bp, Artificial sequence
  SiRNA target sequence
taaattcggcacaatttttttcaatt

SEQ ID NO: 31224 - DNA, 26 bp, Artificial sequence
  SiRNA target sequence
aaattcggcacaatttttttcaattt

SEQ ID NO: 31225 - DNA, 26 bp, Artificial sequence
  SiRNA target sequence
aattcggcacaatttttttcaatttc

SEQ ID NO: 31226 - DNA, 26 bp, Artificial sequence
  SiRNA target sequence
attcggcacaatttttttcaatttca

SEQ ID NO: 31227 - DNA, 26 bp, Artificial sequence
  SiRNA target sequence
ttcggcacaatttttttcaatttcat

SEQ ID NO: 31228 - DNA, 26 bp, Artificial sequence
  SiRNA target sequence
tcggcacaatttttttcaatttcatc

SEQ ID NO: 31229 - DNA, 26 bp, Artificial sequence
  SiRNA target sequence
cggcacaatttttttcaatttcatct

SEQ ID NO: 31230 - DNA, 26 bp, Artificial sequence
  SiRNA target sequence
ggcacaatttttttcaatttcatctt

SEQ ID NO: 31231 - DNA, 26 bp, Artificial sequence
  SiRNA target sequence
gcacaatttttttcaatttcatcttt

SEQ ID NO: 31232 - DNA, 26 bp, Artificial sequence
  SiRNA target sequence
cacaatttttttcaatttcatctttt

SEQ ID NO: 31233 - DNA, 26 bp, Artificial sequence
  SiRNA target sequence
acaatttttttcaatttcatcttttt

SEQ ID NO: 31234 - DNA, 26 bp, Artificial sequence
  SiRNA target sequence
caatttttttcaatttcatctttttt

SEQ ID NO: 31235 - DNA, 26 bp, Artificial sequence
  SiRNA target sequence
aatttttttcaatttcatcttttttc

SEQ ID NO: 31236 - DNA, 26 bp, Artificial sequence
  SiRNA target sequence
atttttttcaatttcatcttttttcg

SEQ ID NO: 31237 - DNA, 26 bp, Artificial sequence
  SiRNA target sequence
tttttttcaatttcatcttttttcga

SEQ ID NO: 31238 - DNA, 26 bp, Artificial sequence
  SiRNA target sequence
ttttttcaatttcatcttttttcgaa

SEQ ID NO: 31239 - DNA, 26 bp, Artificial sequence
  SiRNA target sequence
tttttcaatttcatcttttttcgaat

SEQ ID NO: 31240 - DNA, 26 bp, Artificial sequence
  SiRNA target sequence
ttttcaatttcatcttttttcgaatt

SEQ ID NO: 31241 - DNA, 26 bp, Artificial sequence
  SiRNA target sequence
tttcaatttcatcttttttcgaattt

SEQ ID NO: 31242 - DNA, 26 bp, Artificial sequence
  SiRNA target sequence
ttcaatttcatcttttttcgaatttt

SEQ ID NO: 31243 - DNA, 26 bp, Artificial sequence
  SiRNA target sequence
tcaatttcatcttttttcgaattttc

SEQ ID NO: 31244 - DNA, 26 bp, Artificial sequence
  SiRNA target sequence
caatttcatcttttttcgaattttct

SEQ ID NO: 31245 - DNA, 26 bp, Artificial sequence
  SiRNA target sequence
aatttcatcttttttcgaattttctt

SEQ ID NO: 31246 - DNA, 26 bp, Artificial sequence
  SiRNA target sequence
atttcatcttttttcgaattttcttc

SEQ ID NO: 31247 - DNA, 26 bp, Artificial sequence
  SiRNA target sequence
tttcatcttttttcgaattttcttcg

SEQ ID NO: 31248 - DNA, 26 bp, Artificial sequence
  SiRNA target sequence
ttcatcttttttcgaattttcttcgg

SEQ ID NO: 31249 - DNA, 26 bp, Artificial sequence
  SiRNA target sequence
tcatcttttttcgaattttcttcggc

SEQ ID NO: 31250 - DNA, 26 bp, Artificial sequence
  SiRNA target sequence
catcttttttcgaattttcttcggct

SEQ ID NO: 31251 - DNA, 26 bp, Artificial sequence
  SiRNA target sequence
atcttttttcgaattttcttcggctt

SEQ ID NO: 31252 - DNA, 26 bp, Artificial sequence
  SiRNA target sequence
tcttttttcgaattttcttcggcttc

SEQ ID NO: 31253 - DNA, 26 bp, Artificial sequence
  SiRNA target sequence
cttttttcgaattttcttcggcttct

SEQ ID NO: 31254 - DNA, 26 bp, Artificial sequence
  SiRNA target sequence
ttttttcgaattttcttcggcttctc

SEQ ID NO: 31255 - DNA, 26 bp, Artificial sequence
  SiRNA target sequence
tttttcgaattttcttcggcttctcg

SEQ ID NO: 31256 - DNA, 26 bp, Artificial sequence
  SiRNA target sequence
ttttcgaattttcttcggcttctcgt

SEQ ID NO: 31257 - DNA, 26 bp, Artificial sequence
  SiRNA target sequence
tttcgaattttcttcggcttctcgta

SEQ ID NO: 31258 - DNA, 26 bp, Artificial sequence
  SiRNA target sequence
ttcgaattttcttcggcttctcgtat

SEQ ID NO: 31259 - DNA, 26 bp, Artificial sequence
  SiRNA target sequence
tcgaattttcttcggcttctcgtatc

SEQ ID NO: 31260 - DNA, 26 bp, Artificial sequence
  SiRNA target sequence
cgaattttcttcggcttctcgtatca

SEQ ID NO: 31261 - DNA, 26 bp, Artificial sequence
  SiRNA target sequence
gaattttcttcggcttctcgtatcat

SEQ ID NO: 31262 - DNA, 26 bp, Artificial sequence
  SiRNA target sequence
aattttcttcggcttctcgtatcatt

SEQ ID NO: 31263 - DNA, 26 bp, Artificial sequence
  SiRNA target sequence
attttcttcggcttctcgtatcattt

SEQ ID NO: 31264 - DNA, 26 bp, Artificial sequence
  SiRNA target sequence
ttttcttcggcttctcgtatcatttg

SEQ ID NO: 31265 - DNA, 26 bp, Artificial sequence
  SiRNA target sequence
tttcttcggcttctcgtatcatttgc

SEQ ID NO: 31266 - DNA, 26 bp, Artificial sequence
  SiRNA target sequence
ttcttcggcttctcgtatcatttgcg

SEQ ID NO: 31267 - DNA, 26 bp, Artificial sequence
  SiRNA target sequence
tcttcggcttctcgtatcatttgcga

SEQ ID NO: 31268 - DNA, 26 bp, Artificial sequence
  SiRNA target sequence
cttcggcttctcgtatcatttgcgaa

SEQ ID NO: 31269 - DNA, 26 bp, Artificial sequence
  SiRNA target sequence
ttcggcttctcgtatcatttgcgaaa

SEQ ID NO: 31270 - DNA, 26 bp, Artificial sequence
  SiRNA target sequence
tcggcttctcgtatcatttgcgaaat

SEQ ID NO: 31271 - DNA, 26 bp, Artificial sequence
  SiRNA target sequence
cggcttctcgtatcatttgcgaaatt

SEQ ID NO: 31272 - DNA, 26 bp, Artificial sequence
  SiRNA target sequence
ggcttctcgtatcatttgcgaaattt

SEQ ID NO: 31273 - DNA, 26 bp, Artificial sequence
  SiRNA target sequence
gcttctcgtatcatttgcgaaatttc

SEQ ID NO: 31274 - DNA, 26 bp, Artificial sequence
  SiRNA target sequence
cttctcgtatcatttgcgaaatttca

SEQ ID NO: 31275 - DNA, 26 bp, Artificial sequence
  SiRNA target sequence
ttctcgtatcatttgcgaaatttcac

SEQ ID NO: 31276 - DNA, 26 bp, Artificial sequence
  SiRNA target sequence
tctcgtatcatttgcgaaatttcacc

SEQ ID NO: 31277 - DNA, 26 bp, Artificial sequence
  SiRNA target sequence
ctcgtatcatttgcgaaatttcacct

SEQ ID NO: 31278 - DNA, 26 bp, Artificial sequence
  SiRNA target sequence
tcgtatcatttgcgaaatttcacctt

SEQ ID NO: 31279 - DNA, 26 bp, Artificial sequence
  SiRNA target sequence
cgtatcatttgcgaaatttcaccttc

SEQ ID NO: 31280 - DNA, 26 bp, Artificial sequence
  SiRNA target sequence
gtatcatttgcgaaatttcaccttca

SEQ ID NO: 31281 - DNA, 26 bp, Artificial sequence
  SiRNA target sequence
tatcatttgcgaaatttcaccttcat

SEQ ID NO: 31282 - DNA, 26 bp, Artificial sequence
  SiRNA target sequence
atcatttgcgaaatttcaccttcatt

SEQ ID NO: 31283 - DNA, 26 bp, Artificial sequence
  SiRNA target sequence
tcatttgcgaaatttcaccttcattt

SEQ ID NO: 31284 - DNA, 26 bp, Artificial sequence
  SiRNA target sequence
catttgcgaaatttcaccttcattta

SEQ ID NO: 31285 - DNA, 26 bp, Artificial sequence
  SiRNA target sequence
atttgcgaaatttcaccttcatttaa

SEQ ID NO: 31286 - DNA, 26 bp, Artificial sequence
  SiRNA target sequence
tttgcgaaatttcaccttcatttaat

SEQ ID NO: 31287 - DNA, 26 bp, Artificial sequence
  SiRNA target sequence
ttgcgaaatttcaccttcatttaatc

SEQ ID NO: 31288 - DNA, 26 bp, Artificial sequence
  SiRNA target sequence
tgcgaaatttcaccttcatttaatcc

SEQ ID NO: 31289 - DNA, 26 bp, Artificial sequence
  SiRNA target sequence
gcgaaatttcaccttcatttaatcca

SEQ ID NO: 31290 - DNA, 26 bp, Artificial sequence
  SiRNA target sequence
cgaaatttcaccttcatttaatccac

SEQ ID NO: 31291 - DNA, 26 bp, Artificial sequence
  SiRNA target sequence
gaaatttcaccttcatttaatccact

SEQ ID NO: 31292 - DNA, 26 bp, Artificial sequence
  SiRNA target sequence
aaatttcaccttcatttaatccactt

SEQ ID NO: 31293 - DNA, 26 bp, Artificial sequence
  SiRNA target sequence
aatttcaccttcatttaatccacttg

SEQ ID NO: 31294 - DNA, 26 bp, Artificial sequence
  SiRNA target sequence
atttcaccttcatttaatccacttga

SEQ ID NO: 31295 - DNA, 26 bp, Artificial sequence
  SiRNA target sequence
tttcaccttcatttaatccacttgaa

SEQ ID NO: 31296 - DNA, 26 bp, Artificial sequence
  SiRNA target sequence
ttcaccttcatttaatccacttgaag

SEQ ID NO: 31297 - DNA, 26 bp, Artificial sequence
  SiRNA target sequence
tcaccttcatttaatccacttgaagg

SEQ ID NO: 31298 - DNA, 26 bp, Artificial sequence
  SiRNA target sequence
caccttcatttaatccacttgaaggc

SEQ ID NO: 31299 - DNA, 26 bp, Artificial sequence
  SiRNA target sequence
accttcatttaatccacttgaaggca

SEQ ID NO: 31300 - DNA, 26 bp, Artificial sequence
  SiRNA target sequence
ccttcatttaatccacttgaaggcac

SEQ ID NO: 31301 - DNA, 26 bp, Artificial sequence
  SiRNA target sequence
cttcatttaatccacttgaaggcaca

SEQ ID NO: 31302 - DNA, 26 bp, Artificial sequence
  SiRNA target sequence
ttcatttaatccacttgaaggcacaa

SEQ ID NO: 31303 - DNA, 26 bp, Artificial sequence
  SiRNA target sequence
tcatttaatccacttgaaggcacaat

SEQ ID NO: 31304 - DNA, 26 bp, Artificial sequence
  SiRNA target sequence
catttaatccacttgaaggcacaatt

SEQ ID NO: 31305 - DNA, 26 bp, Artificial sequence
  SiRNA target sequence
atttaatccacttgaaggcacaattt

SEQ ID NO: 31306 - DNA, 26 bp, Artificial sequence
  SiRNA target sequence
tttaatccacttgaaggcacaatttc

SEQ ID NO: 31307 - DNA, 26 bp, Artificial sequence
  SiRNA target sequence
ttaatccacttgaaggcacaatttcg

SEQ ID NO: 31308 - DNA, 26 bp, Artificial sequence
  SiRNA target sequence
taatccacttgaaggcacaatttcga

SEQ ID NO: 31309 - DNA, 26 bp, Artificial sequence
  SiRNA target sequence
aatccacttgaaggcacaatttcgat

SEQ ID NO: 31310 - DNA, 26 bp, Artificial sequence
  SiRNA target sequence
atccacttgaaggcacaatttcgatt

SEQ ID NO: 31311 - DNA, 26 bp, Artificial sequence
  SiRNA target sequence
tccacttgaaggcacaatttcgattt

SEQ ID NO: 31312 - DNA, 26 bp, Artificial sequence
  SiRNA target sequence
ccacttgaaggcacaatttcgatttc

SEQ ID NO: 31313 - DNA, 26 bp, Artificial sequence
  SiRNA target sequence
cacttgaaggcacaatttcgatttct

SEQ ID NO: 31314 - DNA, 26 bp, Artificial sequence
  SiRNA target sequence
acttgaaggcacaatttcgatttctt

SEQ ID NO: 31315 - DNA, 26 bp, Artificial sequence
  SiRNA target sequence
cttgaaggcacaatttcgatttcttg

SEQ ID NO: 31316 - DNA, 26 bp, Artificial sequence
  SiRNA target sequence
ttgaaggcacaatttcgatttcttgc

SEQ ID NO: 31317 - DNA, 26 bp, Artificial sequence
  SiRNA target sequence
tgaaggcacaatttcgatttcttgct

SEQ ID NO: 31318 - DNA, 26 bp, Artificial sequence
  SiRNA target sequence
gaaggcacaatttcgatttcttgctt

SEQ ID NO: 31319 - DNA, 26 bp, Artificial sequence
  SiRNA target sequence
aaggcacaatttcgatttcttgcttt

SEQ ID NO: 31320 - DNA, 26 bp, Artificial sequence
  SiRNA target sequence
aggcacaatttcgatttcttgctttt

SEQ ID NO: 31321 - DNA, 26 bp, Artificial sequence
  SiRNA target sequence
ggcacaatttcgatttcttgcttttt

SEQ ID NO: 31322 - DNA, 26 bp, Artificial sequence
  SiRNA target sequence
gcacaatttcgatttcttgctttttt

SEQ ID NO: 31323 - DNA, 26 bp, Artificial sequence
  SiRNA target sequence
cacaatttcgatttcttgcttttttt

SEQ ID NO: 31324 - DNA, 26 bp, Artificial sequence
  SiRNA target sequence
acaatttcgatttcttgctttttttt

SEQ ID NO: 31325 - DNA, 26 bp, Artificial sequence
  SiRNA target sequence
caatttcgatttcttgcttttttttc

SEQ ID NO: 31326 - DNA, 26 bp, Artificial sequence
  SiRNA target sequence
aatttcgatttcttgcttttttttcg

SEQ ID NO: 31327 - DNA, 26 bp, Artificial sequence
  SiRNA target sequence
atttcgatttcttgcttttttttcgt

SEQ ID NO: 31328 - DNA, 26 bp, Artificial sequence
  SiRNA target sequence
tttcgatttcttgcttttttttcgtt

SEQ ID NO: 31329 - DNA, 26 bp, Artificial sequence
  SiRNA target sequence
ttcgatttcttgcttttttttcgtta

SEQ ID NO: 31330 - DNA, 26 bp, Artificial sequence
  SiRNA target sequence
tcgatttcttgcttttttttcgttat

SEQ ID NO: 31331 - DNA, 26 bp, Artificial sequence
  SiRNA target sequence
cgatttcttgcttttttttcgttatc

SEQ ID NO: 31332 - DNA, 26 bp, Artificial sequence
  SiRNA target sequence
gatttcttgcttttttttcgttatcc

SEQ ID NO: 31333 - DNA, 26 bp, Artificial sequence
  SiRNA target sequence
atttcttgcttttttttcgttatccc

SEQ ID NO: 31334 - DNA, 26 bp, Artificial sequence
  SiRNA target sequence
tttcttgcttttttttcgttatcccg

SEQ ID NO: 31335 - DNA, 26 bp, Artificial sequence
  SiRNA target sequence
ttcttgcttttttttcgttatcccgt

SEQ ID NO: 31336 - DNA, 26 bp, Artificial sequence
  SiRNA target sequence
tcttgcttttttttcgttatcccgtc

SEQ ID NO: 31337 - DNA, 26 bp, Artificial sequence
  SiRNA target sequence
cttgcttttttttcgttatcccgtct

SEQ ID NO: 31338 - DNA, 26 bp, Artificial sequence
  SiRNA target sequence
ttgcttttttttcgttatcccgtctt

SEQ ID NO: 31339 - DNA, 26 bp, Artificial sequence
  SiRNA target sequence
tgcttttttttcgttatcccgtcttg

SEQ ID NO: 31340 - DNA, 26 bp, Artificial sequence
  SiRNA target sequence
gcttttttttcgttatcccgtcttgc

SEQ ID NO: 31341 - DNA, 26 bp, Artificial sequence
  SiRNA target sequence
cttttttttcgttatcccgtcttgcg

SEQ ID NO: 31342 - DNA, 26 bp, Artificial sequence
  SiRNA target sequence
ttttttttcgttatcccgtcttgcgc

SEQ ID NO: 31343 - DNA, 26 bp, Artificial sequence
  SiRNA target sequence
tttttttcgttatcccgtcttgcgca

SEQ ID NO: 31344 - DNA, 26 bp, Artificial sequence
  SiRNA target sequence
ttttttcgttatcccgtcttgcgcag

SEQ ID NO: 31345 - DNA, 26 bp, Artificial sequence
  SiRNA target sequence
tttttcgttatcccgtcttgcgcaga

SEQ ID NO: 31346 - DNA, 26 bp, Artificial sequence
  SiRNA target sequence
ttttcgttatcccgtcttgcgcagat

SEQ ID NO: 31347 - DNA, 26 bp, Artificial sequence
  SiRNA target sequence
tttcgttatcccgtcttgcgcagata

SEQ ID NO: 31348 - DNA, 26 bp, Artificial sequence
  SiRNA target sequence
ttcgttatcccgtcttgcgcagatac

SEQ ID NO: 31349 - DNA, 26 bp, Artificial sequence
  SiRNA target sequence
tcgttatcccgtcttgcgcagatact

SEQ ID NO: 31350 - DNA, 26 bp, Artificial sequence
  SiRNA target sequence
cgttatcccgtcttgcgcagatactt

SEQ ID NO: 31351 - DNA, 26 bp, Artificial sequence
  SiRNA target sequence
gttatcccgtcttgcgcagatacttt

SEQ ID NO: 31352 - DNA, 26 bp, Artificial sequence
  SiRNA target sequence
ttatcccgtcttgcgcagatactttg

SEQ ID NO: 31353 - DNA, 26 bp, Artificial sequence
  SiRNA target sequence
tatcccgtcttgcgcagatactttgt

SEQ ID NO: 31354 - DNA, 26 bp, Artificial sequence
  SiRNA target sequence
atcccgtcttgcgcagatactttgta

SEQ ID NO: 31355 - DNA, 26 bp, Artificial sequence
  SiRNA target sequence
tcccgtcttgcgcagatactttgtat

SEQ ID NO: 31356 - DNA, 26 bp, Artificial sequence
  SiRNA target sequence
cccgtcttgcgcagatactttgtata

SEQ ID NO: 31357 - DNA, 26 bp, Artificial sequence
  SiRNA target sequence
ccgtcttgcgcagatactttgtatat

SEQ ID NO: 31358 - DNA, 26 bp, Artificial sequence
  SiRNA target sequence
cgtcttgcgcagatactttgtatatt

SEQ ID NO: 31359 - DNA, 26 bp, Artificial sequence
  SiRNA target sequence
gtcttgcgcagatactttgtatattc

SEQ ID NO: 31360 - DNA, 26 bp, Artificial sequence
  SiRNA target sequence
tcttgcgcagatactttgtatattcc

SEQ ID NO: 31361 - DNA, 26 bp, Artificial sequence
  SiRNA target sequence
cttgcgcagatactttgtatattccg

SEQ ID NO: 31362 - DNA, 26 bp, Artificial sequence
  SiRNA target sequence
ttgcgcagatactttgtatattccgt

SEQ ID NO: 31363 - DNA, 26 bp, Artificial sequence
  SiRNA target sequence
tgcgcagatactttgtatattccgtt

SEQ ID NO: 31364 - DNA, 26 bp, Artificial sequence
  SiRNA target sequence
gcgcagatactttgtatattccgtta

SEQ ID NO: 31365 - DNA, 26 bp, Artificial sequence
  SiRNA target sequence
cgcagatactttgtatattccgttag

SEQ ID NO: 31366 - DNA, 26 bp, Artificial sequence
  SiRNA target sequence
gcagatactttgtatattccgttagc

SEQ ID NO: 31367 - DNA, 26 bp, Artificial sequence
  SiRNA target sequence
cagatactttgtatattccgttagca

SEQ ID NO: 31368 - DNA, 26 bp, Artificial sequence
  SiRNA target sequence
agatactttgtatattccgttagcat

SEQ ID NO: 31369 - DNA, 26 bp, Artificial sequence
  SiRNA target sequence
gatactttgtatattccgttagcatc

SEQ ID NO: 31370 - DNA, 26 bp, Artificial sequence
  SiRNA target sequence
atactttgtatattccgttagcatcg

SEQ ID NO: 31371 - DNA, 26 bp, Artificial sequence
  SiRNA target sequence
tactttgtatattccgttagcatcgg

SEQ ID NO: 31372 - DNA, 26 bp, Artificial sequence
  SiRNA target sequence
actttgtatattccgttagcatcggc

SEQ ID NO: 31373 - DNA, 26 bp, Artificial sequence
  SiRNA target sequence
ctttgtatattccgttagcatcggct

SEQ ID NO: 31374 - DNA, 26 bp, Artificial sequence
  SiRNA target sequence
tttgtatattccgttagcatcggctt

SEQ ID NO: 31375 - DNA, 26 bp, Artificial sequence
  SiRNA target sequence
ttgtatattccgttagcatcggcttc

SEQ ID NO: 31376 - DNA, 26 bp, Artificial sequence
  SiRNA target sequence
tgtatattccgttagcatcggcttca

SEQ ID NO: 31377 - DNA, 26 bp, Artificial sequence
  SiRNA target sequence
gtatattccgttagcatcggcttcaa

SEQ ID NO: 31378 - DNA, 26 bp, Artificial sequence
  SiRNA target sequence
tatattccgttagcatcggcttcaaa

SEQ ID NO: 31379 - DNA, 26 bp, Artificial sequence
  SiRNA target sequence
atattccgttagcatcggcttcaaat

SEQ ID NO: 31380 - DNA, 26 bp, Artificial sequence
  SiRNA target sequence
tattccgttagcatcggcttcaaatg

SEQ ID NO: 31381 - DNA, 26 bp, Artificial sequence
  SiRNA target sequence
attccgttagcatcggcttcaaatgt

SEQ ID NO: 31382 - DNA, 26 bp, Artificial sequence
  SiRNA target sequence
ttccgttagcatcggcttcaaatgta

SEQ ID NO: 31383 - DNA, 26 bp, Artificial sequence
  SiRNA target sequence
tccgttagcatcggcttcaaatgtaa

SEQ ID NO: 31384 - DNA, 26 bp, Artificial sequence
  SiRNA target sequence
ccgttagcatcggcttcaaatgtaac

SEQ ID NO: 31385 - DNA, 26 bp, Artificial sequence
  SiRNA target sequence
cgttagcatcggcttcaaatgtaaca

SEQ ID NO: 31386 - DNA, 26 bp, Artificial sequence
  SiRNA target sequence
gttagcatcggcttcaaatgtaacat

SEQ ID NO: 31387 - DNA, 26 bp, Artificial sequence
  SiRNA target sequence
ttagcatcggcttcaaatgtaacatc

SEQ ID NO: 31388 - DNA, 26 bp, Artificial sequence
  SiRNA target sequence
tagcatcggcttcaaatgtaacatct

SEQ ID NO: 31389 - DNA, 26 bp, Artificial sequence
  SiRNA target sequence
agcatcggcttcaaatgtaacatcta

SEQ ID NO: 31390 - DNA, 26 bp, Artificial sequence
  SiRNA target sequence
gcatcggcttcaaatgtaacatctat

SEQ ID NO: 31391 - DNA, 26 bp, Artificial sequence
  SiRNA target sequence
catcggcttcaaatgtaacatctatc

SEQ ID NO: 31392 - DNA, 26 bp, Artificial sequence
  SiRNA target sequence
atcggcttcaaatgtaacatctatct

SEQ ID NO: 31393 - DNA, 26 bp, Artificial sequence
  SiRNA target sequence
tcggcttcaaatgtaacatctatctt

SEQ ID NO: 31394 - DNA, 26 bp, Artificial sequence
  SiRNA target sequence
cggcttcaaatgtaacatctatcttt

SEQ ID NO: 31395 - DNA, 26 bp, Artificial sequence
  SiRNA target sequence
ggcttcaaatgtaacatctatctttg

SEQ ID NO: 31396 - DNA, 26 bp, Artificial sequence
  SiRNA target sequence
gcttcaaatgtaacatctatctttgg

SEQ ID NO: 31397 - DNA, 26 bp, Artificial sequence
  SiRNA target sequence
cttcaaatgtaacatctatctttgga

SEQ ID NO: 31398 - DNA, 26 bp, Artificial sequence
  SiRNA target sequence
ttcaaatgtaacatctatctttggaa

SEQ ID NO: 31399 - DNA, 26 bp, Artificial sequence
  SiRNA target sequence
tcaaatgtaacatctatctttggaat

SEQ ID NO: 31400 - DNA, 26 bp, Artificial sequence
  SiRNA target sequence
caaatgtaacatctatctttggaata

SEQ ID NO: 31401 - DNA, 26 bp, Artificial sequence
  SiRNA target sequence
aaatgtaacatctatctttggaatac

SEQ ID NO: 31402 - DNA, 26 bp, Artificial sequence
  SiRNA target sequence
aatgtaacatctatctttggaatacc

SEQ ID NO: 31403 - DNA, 26 bp, Artificial sequence
  SiRNA target sequence
atgtaacatctatctttggaatacct

SEQ ID NO: 31404 - DNA, 26 bp, Artificial sequence
  SiRNA target sequence
tgtaacatctatctttggaatacctg

SEQ ID NO: 31405 - DNA, 26 bp, Artificial sequence
  SiRNA target sequence
gtaacatctatctttggaatacctgc

SEQ ID NO: 31406 - DNA, 26 bp, Artificial sequence
  SiRNA target sequence
taacatctatctttggaatacctgca

SEQ ID NO: 31407 - DNA, 26 bp, Artificial sequence
  SiRNA target sequence
aacatctatctttggaatacctgcag

SEQ ID NO: 31408 - DNA, 26 bp, Artificial sequence
  SiRNA target sequence
acatctatctttggaatacctgcagg

SEQ ID NO: 31409 - DNA, 26 bp, Artificial sequence
  SiRNA target sequence
catctatctttggaatacctgcaggt

SEQ ID NO: 31410 - DNA, 26 bp, Artificial sequence
  SiRNA target sequence
atctatctttggaatacctgcaggtg

SEQ ID NO: 31411 - DNA, 26 bp, Artificial sequence
  SiRNA target sequence
tctatctttggaatacctgcaggtgc

SEQ ID NO: 31412 - DNA, 26 bp, Artificial sequence
  SiRNA target sequence
ctatctttggaatacctgcaggtgct

SEQ ID NO: 31413 - DNA, 26 bp, Artificial sequence
  SiRNA target sequence
tatctttggaatacctgcaggtgctt

SEQ ID NO: 31414 - DNA, 26 bp, Artificial sequence
  SiRNA target sequence
atctttggaatacctgcaggtgcttt

SEQ ID NO: 31415 - DNA, 26 bp, Artificial sequence
  SiRNA target sequence
tctttggaatacctgcaggtgcttta

SEQ ID NO: 31416 - DNA, 26 bp, Artificial sequence
  SiRNA target sequence
ctttggaatacctgcaggtgctttag

SEQ ID NO: 31417 - DNA, 26 bp, Artificial sequence
  SiRNA target sequence
tttggaatacctgcaggtgctttagg

SEQ ID NO: 31418 - DNA, 26 bp, Artificial sequence
  SiRNA target sequence
ttggaatacctgcaggtgctttagga

SEQ ID NO: 31419 - DNA, 26 bp, Artificial sequence
  SiRNA target sequence
tggaatacctgcaggtgctttaggaa

SEQ ID NO: 31420 - DNA, 26 bp, Artificial sequence
  SiRNA target sequence
ggaatacctgcaggtgctttaggaat

SEQ ID NO: 31421 - DNA, 26 bp, Artificial sequence
  SiRNA target sequence
gaatacctgcaggtgctttaggaatg

SEQ ID NO: 31422 - DNA, 26 bp, Artificial sequence
  SiRNA target sequence
aatacctgcaggtgctttaggaatgt

SEQ ID NO: 31423 - DNA, 26 bp, Artificial sequence
  SiRNA target sequence
atacctgcaggtgctttaggaatgtt

SEQ ID NO: 31424 - DNA, 26 bp, Artificial sequence
  SiRNA target sequence
tacctgcaggtgctttaggaatgttt

SEQ ID NO: 31425 - DNA, 26 bp, Artificial sequence
  SiRNA target sequence
acctgcaggtgctttaggaatgtttt

SEQ ID NO: 31426 - DNA, 26 bp, Artificial sequence
  SiRNA target sequence
cctgcaggtgctttaggaatgttttt

SEQ ID NO: 31427 - DNA, 26 bp, Artificial sequence
  SiRNA target sequence
ctgcaggtgctttaggaatgtttttg

SEQ ID NO: 31428 - DNA, 26 bp, Artificial sequence
  SiRNA target sequence
tgcaggtgctttaggaatgtttttga

SEQ ID NO: 31429 - DNA, 26 bp, Artificial sequence
  SiRNA target sequence
gcaggtgctttaggaatgtttttgag

SEQ ID NO: 31430 - DNA, 26 bp, Artificial sequence
  SiRNA target sequence
caggtgctttaggaatgtttttgagc

SEQ ID NO: 31431 - DNA, 26 bp, Artificial sequence
  SiRNA target sequence
aggtgctttaggaatgtttttgagct

SEQ ID NO: 31432 - DNA, 26 bp, Artificial sequence
  SiRNA target sequence
ggtgctttaggaatgtttttgagctt

SEQ ID NO: 31433 - DNA, 26 bp, Artificial sequence
  SiRNA target sequence
gtgctttaggaatgtttttgagcttt

SEQ ID NO: 31434 - DNA, 26 bp, Artificial sequence
  SiRNA target sequence
tgctttaggaatgtttttgagcttta

SEQ ID NO: 31435 - DNA, 26 bp, Artificial sequence
  SiRNA target sequence
gctttaggaatgtttttgagctttat

SEQ ID NO: 31436 - DNA, 26 bp, Artificial sequence
  SiRNA target sequence
ctttaggaatgtttttgagctttata

SEQ ID NO: 31437 - DNA, 26 bp, Artificial sequence
  SiRNA target sequence
tttaggaatgtttttgagctttatag

SEQ ID NO: 31438 - DNA, 26 bp, Artificial sequence
  SiRNA target sequence
ttaggaatgtttttgagctttatagc

SEQ ID NO: 31439 - DNA, 26 bp, Artificial sequence
  SiRNA target sequence
taggaatgtttttgagctttatagct

SEQ ID NO: 31440 - DNA, 26 bp, Artificial sequence
  SiRNA target sequence
aggaatgtttttgagctttatagctc

SEQ ID NO: 31441 - DNA, 26 bp, Artificial sequence
  SiRNA target sequence
ggaatgtttttgagctttatagctcc

SEQ ID NO: 31442 - DNA, 26 bp, Artificial sequence
  SiRNA target sequence
gaatgtttttgagctttatagctcct

SEQ ID NO: 31443 - DNA, 26 bp, Artificial sequence
  SiRNA target sequence
aatgtttttgagctttatagctccta

SEQ ID NO: 31444 - DNA, 26 bp, Artificial sequence
  SiRNA target sequence
atgtttttgagctttatagctcctaa

SEQ ID NO: 31445 - DNA, 26 bp, Artificial sequence
  SiRNA target sequence
tgtttttgagctttatagctcctaaa

SEQ ID NO: 31446 - DNA, 26 bp, Artificial sequence
  SiRNA target sequence
gtttttgagctttatagctcctaaat

SEQ ID NO: 31447 - DNA, 26 bp, Artificial sequence
  SiRNA target sequence
tttttgagctttatagctcctaaata

SEQ ID NO: 31448 - DNA, 26 bp, Artificial sequence
  SiRNA target sequence
ttttgagctttatagctcctaaatat

SEQ ID NO: 31449 - DNA, 26 bp, Artificial sequence
  SiRNA target sequence
tttgagctttatagctcctaaatatt

SEQ ID NO: 31450 - DNA, 26 bp, Artificial sequence
  SiRNA target sequence
ttgagctttatagctcctaaatattt

SEQ ID NO: 31451 - DNA, 26 bp, Artificial sequence
  SiRNA target sequence
tgagctttatagctcctaaatattta

SEQ ID NO: 31452 - DNA, 26 bp, Artificial sequence
  SiRNA target sequence
gagctttatagctcctaaatatttat

SEQ ID NO: 31453 - DNA, 26 bp, Artificial sequence
  SiRNA target sequence
agctttatagctcctaaatatttatt

SEQ ID NO: 31454 - DNA, 26 bp, Artificial sequence
  SiRNA target sequence
gctttatagctcctaaatatttattg

SEQ ID NO: 31455 - DNA, 26 bp, Artificial sequence
  SiRNA target sequence
ctttatagctcctaaatatttattgt

SEQ ID NO: 31456 - DNA, 26 bp, Artificial sequence
  SiRNA target sequence
tttatagctcctaaatatttattgtc

SEQ ID NO: 31457 - DNA, 26 bp, Artificial sequence
  SiRNA target sequence
ttatagctcctaaatatttattgtct

SEQ ID NO: 31458 - DNA, 26 bp, Artificial sequence
  SiRNA target sequence
tatagctcctaaatatttattgtctt

SEQ ID NO: 31459 - DNA, 26 bp, Artificial sequence
  SiRNA target sequence
atagctcctaaatatttattgtcttt

SEQ ID NO: 31460 - DNA, 26 bp, Artificial sequence
  SiRNA target sequence
tagctcctaaatatttattgtctttt

SEQ ID NO: 31461 - DNA, 26 bp, Artificial sequence
  SiRNA target sequence
agctcctaaatatttattgtctttta

SEQ ID NO: 31462 - DNA, 26 bp, Artificial sequence
  SiRNA target sequence
gctcctaaatatttattgtcttttac

SEQ ID NO: 31463 - DNA, 26 bp, Artificial sequence
  SiRNA target sequence
ctcctaaatatttattgtcttttacc

SEQ ID NO: 31464 - DNA, 26 bp, Artificial sequence
  SiRNA target sequence
tcctaaatatttattgtcttttacca

SEQ ID NO: 31465 - DNA, 26 bp, Artificial sequence
  SiRNA target sequence
cctaaatatttattgtcttttaccat

SEQ ID NO: 31466 - DNA, 26 bp, Artificial sequence
  SiRNA target sequence
ctaaatatttattgtcttttaccatc

SEQ ID NO: 31467 - DNA, 26 bp, Artificial sequence
  SiRNA target sequence
taaatatttattgtcttttaccatct

SEQ ID NO: 31468 - DNA, 26 bp, Artificial sequence
  SiRNA target sequence
aaatatttattgtcttttaccatctt

SEQ ID NO: 31469 - DNA, 26 bp, Artificial sequence
  SiRNA target sequence
aatatttattgtcttttaccatcttt

SEQ ID NO: 31470 - DNA, 26 bp, Artificial sequence
  SiRNA target sequence
atatttattgtcttttaccatctttc

SEQ ID NO: 31471 - DNA, 26 bp, Artificial sequence
  SiRNA target sequence
tatttattgtcttttaccatctttct

SEQ ID NO: 31472 - DNA, 26 bp, Artificial sequence
  SiRNA target sequence
atttattgtcttttaccatctttctt

SEQ ID NO: 31473 - DNA, 26 bp, Artificial sequence
  SiRNA target sequence
tttattgtcttttaccatctttcttt

SEQ ID NO: 31474 - DNA, 26 bp, Artificial sequence
  SiRNA target sequence
ttattgtcttttaccatctttctttc

SEQ ID NO: 31475 - DNA, 26 bp, Artificial sequence
  SiRNA target sequence
tattgtcttttaccatctttctttct

(The sequence listing continues in the following parts.)

What is claimed is:

1. A method for reducing the susceptibility of a bee to a disease caused by a *Nosema ceranae* infection, comprising: feeding the bee an effective amount of a bee-ingestible composition comprising:
   a) an isolated nucleic acid agent comprising a double stranded RNA comprising a sequence capable of binding through complementary base pairing to an mRNA encoding *Nosema ceranae* ATP/ADP transporter protein homologue Nc014, a double stranded RNA comprising a sequence capable of binding through complementary base pairing to an mRNA encoding *Nosema ceranae* ATP/ADP transporter protein homologue Nc017, and a double stranded RNA comprising a sequence capable of binding through complementary base pairing to an mRNA encoding *Nosema ceranae* TOM70; and
   b) bee feed, thereby reducing the susceptibility of said bee to said disease caused by a *Nosema ceranae* infection.

2. The method of claim 1, wherein the isolated nucleic acid agent further comprises one or more of a double stranded RNA comprising a sequence capable or binding through complementary base pairing to an mRNA encoding *Nosema ceranae* ATP/ADP transporter protein homologue Nc006 and a double stranded RNA comprising a sequence capable of binding through complementary base pairing to an mRNA encoding *Nosema ceranae* ATP/ADP transporter protein homologue Nc123.

3. The method of claim 1, wherein the isolated nucleic acid agent comprises one or more double stranded RNAs comprising a sequence that is complementary to a sequence selected from the group consisting of SEQ ID NOs. 55-59.

4. The method of claim 1, wherein the isolated nucleic acid agent comprises a double stranded RNA comprising a sequence that is complementary to a sequence as set forth in SEQ ID NO. 55, a double stranded RNAs comprising a sequence that is complementary to a sequence as set forth in SEQ ID NO. 58, and a double stranded RNA comprising a sequence that is complementary to a sequence as set forth in SEQ ID NO. 59.

5. The method of claim 4, wherein the isolated nucleic acid agent further comprises a double stranded RNA comprising a sequence that is complementary to a sequence as set forth in SEQ ID NO. 56 and a double stranded RNA comprising a sequence that is complementary to a sequence as set forth in SEQ ID NO. 57.

6. The method of claim 1, wherein the double stranded RNAs are greater than 15 base pairs in length.

7. The method of claim 1, wherein the double stranded RNAs are greater than 30 base pairs in length.

8. The method of claim 1, wherein the bee-ingestible composition is in solid form.

9. The method of claim 1, wherein the bee-ingestible composition is in liquid form.

10. The method of claim 1, wherein the bee-ingestible composition comprises protein.

11. The method of claim 10, wherein the protein is in the form of pollen and/or soy patties.

12. The method of claim 1, wherein the bee-ingestible composition comprises a sucrose solution or a corn syrup solution.

* * * * *